United States Patent 9,328,346 (POLYCOMB-ASSOCIATED NON-CODING RNAS) - sequence listing, part 106

SEQ ID NO: 21314 - RNA, 218984 nt, Homo sapiens
uucaauauggucgccaaacagauucauccauucugccacuagaauucaaaacaguuggggaacugcuguggcuuccaucagcgucaacaccaucauucugguuaggcaaauuuggauuuaauagcgugcugccauucgaggugguggugcauggcggaagcauucuggaaggagaccggucuccccccggcaccaugggaaacugauaggauccugacgaagugccauaguagagauauggagugcugcuggucuggaaggguccacucuggcuuugggaagagccgggguagggugguggcagguaggugugguagugagugguggcggacauaccgagggacaugccugaggugacuggcgggguguaaguaaagguggcuggauagugcauucguggguuggagaagcggcucucagugagggaugaaaugcuugggaacugccuggggucugaaaaagggcccaguucugaagcaccuaaaaauuauaacagaagauggagggaaaaaucuguaaauaucaauuaaaauaaugauagaauuguuacaagaaaaaaaaagagaaaacuuuagcuuucccauaaaggaacagcaagccacagacagaccuucaaaugcaccagucacuuuacagucuuuuucccccacuuugcagucuuaacagcauugauccuuaaguucuucacccccagagaaucccagagggcuuuaaaaacccacaugugugccaggucaauguguaaaccaacccaacacucugaucacauagguucacucaccagacuuuaaaaccaaauccucauggauuuuuuuucucuuuuugcuucucguugcacuuuagauauuugaagugaaauuuuuacuaagucagacaaguuuauuuuccucaacucaauauaaagaaauuccaaaauaaugucuuacuguuauuuacucuugguaggcucuuucaucaaugaaggaacaucaaaaagauauccuaucauguuccuaucauuuccuuuaaggccuuuaaagaauuuaaaaucuugucagaggucucaucuuagcaacagugaaaucaaaccagaaacucauaacuucucuggggguggauagggagggucauaagcuacuagaucagucgguuuugaaaaugggaguuaggaggcacaagggggcuugguaccuuaggaaucauugauuucaagucuugaugggagacuugugaccugauuuagaccaggugcuaacaguagcuuuugcgagaggcucgcugccuaggggagauuaagaggagggcacuccccacccgucucccaggccccagcaccacauccuacagaaccagcuucaggucaacuugaagcaguaaccugaaggcaaagaugguuuuccccuaaaacaugaaguccuuucacuucuaaagcuaacaguaggccuccuuaauagauguuucuggugccuaaguuaugaaaccaccguuauaaaccauuucauguggaaauuuguuuucugaaaugcuagaaucuuguaguugugaccuuuaaagauuggguuuauuauuauuuuucuagaauugacagaauugugacaagcccuuuucuaauaccagugcucuuguuaagauauuguucccuucuaaaauauuuugauuauucagaucucauauauuuguuucuccuacagcuuuuagcuauaaaggaaagcacuaaacaauucuugaggacuuuaaugaauggguacuucuucaccucauuuuuauucagaccuuguucuuggauauuacgauguuuauuaagggaauaauccgaacacuuuucuuuaaaggugcugauugaagguuauuaauuuuuguuaaaaugcacacugcuuauaaucuucacaaaaugcaaggguuaagugccaugaugugcauuuguaauaaaaagugacucuuuaaaagcaacauauaguuaacaaaacucacaaaucggacaguaacaaccagacagcccagcccagcccagcccugcccagcccagcaauuguuaaaagucucaccugccuggcucuucuuacugagaguggaaggccagaggcagaagucagagguggcagugucaucaucuguaaaaugagggggaugagcucuaaguucccuuccagcucuaauguucuaugacuaugaauuccaagagagaaggagaagcaacagccuuaggggagggguagacagagagguucccaucccucauuaguauuucccagagucugcaggcccauaagcagaggguaaaagcuagugagcagcuucuaaggccagaagcaaacacuuucaagaugaagaaccaaaacugacagcccaggcagucacucucugcuuuuuauaaauucuuccauccucaacuagccucuaccuauuccucccaaaaacgaaauucugacaagcuuaaauuuaaaaauguggaaacagcgauuaugacagaaucagaaaugggagcagaugcuccauaacauuucccccgcccagugcuugugcccugccucguacaauacagaggccaaauggaggccacagacguuccucaggcagccucugcauugcagggcauccaggugaccuugagcuggcagaacuaacagcgaugggcagggcacuucuguaugcauuaaguucaauauuuagaucauauaagaagaaccagaauaaugugaacagcguguaucagaaagaagucgcacuuaaaacgccaacgugugcccccugcagaaguauggaguucacacagauagacauguuaauguaaaaacugcuucuuagguguaucuguacuuaaaauacacugcaguaauaauuacaauuccguaugguuucacuuauuuugaugcagaagccucauuaaaacucuuuauguggggcccuggcaguaaacuccaauaugguuuugaauuuaccccuccccacuccuuccucucaauuuuaccugauacauuuugcugauguuuuuauugcccaucacaugccaggaucacuguaccuuuuugguuuauagaugcuagcuaacacaaaaugacauuuguuuuucaauuaaugagcucugguuaugguuuauagaaaacaaugcaacaaauuuccgcuagguuuacaguauuuuaaccaaucacuucuaggcauuugagucuuaaugucuugagaauggacucuuucuugauaaagagcgcuaauguugacuugaaagggauuauaggaugauuuuucaacuuacaaacaauagaauuuucuggaauuugcuuagucacuuuauguuaccaagaaauguuccugaaacauuuugcaacauguucucuaggaagaaauaguaacaauuugcucuaguaccauacgagaucccuuauaaaauaaucaugauaagguggugggagaaauccuaaacuuaaaagaaagacuauaaacuccuuccuaaucuucaaauuuuuaaauaauaauaguuacagaagcaaauaauauccuuaaauuuucuuucauugaauaagguugugucugugcuuccaaugucuguuuuguacaugaacucagguuuucuuuuagaaccccugcuugggcuauuuugacauuguauccuaaacuagucauccuugugucaccaaccacauuguagccacaaacuuaccaacauagaacuaacuggauguuacaucaacuaaaguaagcaaaauauaaguuugacuuauuaagaguccauauuaugaaggccuagaguucuaaaagcagugcaaccccaaucugauuuucuaaauauaaaaccaaagcucagccacucccccagugauaugccugguacgcucagagcucccaagagccaguuuaaaacucaugacuacaacuuacuggauagauaaagccaaaggugguuuggggaccuuuuuaaaauagcaaggaacaacuugcacaaguccauucuuuuugcuguuauccauguuaucuccuccauauacaaaguacauucggcuauuaggcuuugcugaacaguggagaaguugagagugcuauagccaacacuagaucacuuggugcgaagaguuucaaaaugguaugugccuacaucuuccugggggacugccaggaguuacuagaagcccaagauaaucaucgugcauuuuccugauggguugguuuuacucaacuuggggaaaauaauacacuauacaauaaacaugaauaugauguggaggagagugcaacauuuaugugaauuuuuagauaaauaaaaaaugacuucaacaaaauuuugcucuuguaaagcuuuaggcuaugauccgagaucccccaagguacucaaauacuccuuuaugcugguugaggaacucugauggaaaagucuaaacucuuaauuugcugcuuagguaaugcaaaucuaaccccuguuugacaaauaggaaagcugguaucuagagaaaagaagccauuuacucaauaucacaaaaucacagccacagcuagacagaccucuuugacuucuaacaaaggauaugcuaucuuaguuacccuuaaggaauuugguuaacaugaucacaggucuaucuacauacacauacacaccugcuaucuuagaaguugauuugccuaaaugaaaaauacucaaaauaucucaaaauacuuaaauugacucuucuacugccuaaguguugccccagugagaguuccuaucuuugggauauuauuaauaacucuuuuaggccuuguugaucuaaucugcuaaauaaugggcaauuaguuugguugcucagggcaacaugugaaugagaccaaggucaaggguaugauccccuuaggaccugcuggcuuccuacagaugcauuucauuccaaaacugcugucuacaccccuagccaaagccaaacagcuugcaaacaaauguagcugucauaaaaagagcugcaagaacuuugcucauuaaaauaguaacagcagcggcagcagcaauuuuucacaaccuaauauacacaggaaagaauauauuaauaacauuuccauggagcacaaauaaaaauaaaaucacuaauaaaaauuaaaacaucuugccccuccucccaaggucuaugagggaaaaggaaauagccucucuuuacccaacuagguuucuugggucuucaaguggaaagugugugaaaccaagauaagagggaaucaaacagaaugucugaucuucaauuuucagggccgggaauccucccuguggcaucuuucacacacuguuuucgaaugcugcuuauccugagucacguuuggcucccacugagagugagcuguggaggguagagaagugucugauacuucuuugccuccccuucagaacuucauaacagucacaccuguuugacauuugaaggccuuuacuuuaacauacauuuucucauugacuaggcccccaauaaauaugguugguugacggaaaauggguaaggagaucucuagaacaaaaaagaaauuggaauuugaccaaaauaacagaccggguacuugccauuggggcugucagcugggaaaccccaugccccauguccucuuggccucugugcaguacauucacacaucccagcagagcaggcaggucagggcagaaaaaaggaaggggggccuugaauccagacugaacauaugcuggcauauucagaguccucugcccacuuuaugugaggggauaaagguacagaaugaaaagccauuguacuucucagcaaugagguguuaacuucaaagcuucauuggggccuuuuaaaugguaggaguuauugcuucaacaaaucucaaauaaauccgaaggacguuuuauuaaccccucucagaguucuuucuauuggaacauguaauacacaagaccuauguggagcugcucuccccugguaaccaagaaucuucucccccuuuuaaacguuuuggcugcccccuucccaacagcucuauuauuuaauuuccuauuuuacuuccguuccaauagcauuuauuuucuauaucacucuuuuggacccuuacucacucccuuauugaauuauuagcuguuucuuagucuguuuucuccaacuauaaagucagcuuuggaugguaaagaauauguuuuccucucauaucccucuuggaaccuaguacauuguaagaggcuaaaaugaaaaaaaaaaugucagugcaugguuggauggauaaaugaauacguaaaugagucuaaggauugggaacucuguacaauaacucuguacaguuuuaacacaaaaggaaaagauaugaaaagcauugagcaaugcugacaucaaaccuaaaauguaauucaaauacauuccauaccuauaaaaccuuauacaacucucuuuaaagagcauucaaagcuauucccaagcauuauugcaucacuugaccucacauugcagacaggagcccccaaaacagcaguugacacuaguaaacggaugccucugcuuugcuuccacuguuauuuccucuucacucccagcaccuguccugccucccagccaguaucuggguguagauccacacuagggagcccuggggagacuagaugaaggggaaagagggccaggccagaaacccauggccugcuguuagguaagcacacucguccuuccuuaugauccuggguuaaucgcugccacuaagaucauaaucuuuauuuggagugaauaguuuaaaggaacagagagugaaacuagcaucuuguuugaauuuuuuuagacuaguauacagaagcagaagucagagucaucaagaaucauagaugaguucuauagaugaguuuuauagacacggaaaccugcaggcaugguagaucugagcggcaacacgagacuccaacaugguucucuguccuagcuccagcauucuauucuaccucugcacccugacagagcaugcagggugcagaggaaaacauagagggucugccuugagcuuccugagaucugcauucuaugaaaacacacaugaaaagggaaauucuuccacuuacugccuuuuuaagucacacaggcagcagggccuuaaaacaagaguguauuaccccuuacucaagcauaggccagccaccuuucaaaaagcauaucugagcaauucuguaaugaaggggugaaaaggaaggaggcuaugggcauauucagaguccucugcccuauuucaaagucauaucccacugcuccuaagcauggccccucuuccugguggagugauuauauacucaggacacucacgggagcuuugcccaugcucuccccagcacccaugguuuucucucuucucucugccagaccaaaguaagcgagcucuggcucaaagcucaccacuacacaaggauuuccugggcacacaaauucuuaccauaauauuucauuuaccaaacuaaccuuggacauuuauguagauaaaucuuacugcugcacacauuccuaaguauuaucauugguuuuagauaagaauuuucauuuuccaacuaaagaggaagcaaaugaagaggaagaaccacauauucuucuuccagauccuaccuuauaguauggugcugagaagacagaugcuucaaaaaauuuugcaaagcagaugaauuacuaccaaagucucaaggaggcaaacacgacagagguagaaaugcuauggauaaacauuauucaaaagucaaauguagacuauaugcaaaauauuacuuugcauuuuccacacugagguucuaagggaccaauuuucuaaauuucccugaauuucuccccucacacuaaaaaaugaccaacuauccaucacuaacuuaguuuuacuuuucauuucauuagauaauaauuaggaaaauauaccauauauagaagacaugcaauggaucaugcugauggagaagaaaccagcaaaaugagauuguaaaaucauuuuaagauaaugaaaugaccagcaaacuccauucuuuugcaaaagagagggaaagucccucgacuauccagucuaaauauuuguuuucuguguuguaaugaauuguacuuuuccacugcaugcucacaaauucugaaagaacuagcugauccuaaggcuaagaaaguauguuaugcugaaggaaaaagagagagagagagagaaaaaaaaaccuggcaauuuucagaaaauucagccauuccuuaaacccacccaaauuuugaggauauuguuggaagaauauauuuccuuuuauaaagggaaagggggcaggcaguagaugugugagugaguguguaugcauacagggagggagaguaagggaaggaacgagccaaagauggagggggagagaaaagggaggaaaaaugagagagaucuuccugcuaggccuugauuaagaacuuuuuaaauccuaggaaggauggauagucuuugaaaccagauccacugcaggaaggaggccagcacccaggacaccgugucuuucagaaggggccacccacggugccguggcagucauaugacugcccugucacauccugaagccauuuccagcccaugcacacgucugugcucccauuuagagaggaugggauauauugggaacacauauggaaacacuuucagagaaucaguuuccaugaaauucauaaugagccaaguggcuucagaugugguugcguuccuccgauuagccagccaaaaaaaaaaaggaaaaaaggaggaaaaaagggacaaauccacccuuucagaccuuauuucaguuucagaaaaauuaaaaaccacuaaugacuuauggcuaccaaaacauggagccaaauuaggagagaaggaacuaggaaaaugagggagagagguuuaaaagugauagccuuucccuccuaaaaauaacagcuuagauauugguaaucuuaucuuaaaucagagagagccuuuccugcgaugguaucugccuggaguggcauaauuaauuuucugacauccuggcagaagguuguacacaugugcaaaugagggggugggagguggcggggagauggcgagcgaggcagaggcuacaagaccaacucuuauuugauaacauauguggucaauuaagauuauuuuaaaaauugcaaacuaaaugauaaauuguuccuaaguaaaucuuucaaaaaagccagaauucagacaggacagacugguauuuuccuguggccugcgcuagugguaacuuggucuauauuaaaagcagaaauuuaugaacugguugagauguuauauauuagacaccaaagccuaacugauaggaaggcaugaaauacaagaaguggacaaauggagaaggguuuuuaaagggggacauuuaacugauauuaguaaguuaaaacguuauuuauauauuaaaacaaaaacauacauauucuaaaauaaaauucacauacauucucagauaaaacaagagacuugaaaauauucucuuuggggaccugggguuguuuuggguuaugccagcagaucagggagagcagggauagugaaggagcccuugaguuuccucugcccuuugaggcgcucccguggaaaaaucugcgcagcguuucuuucaggcuugguagcaagccugaagcccuggugcaggaauguucugacuugaagcugcuugaugaugggcugggaacuagaacugccuauugcuuaacagacuagucagucgcuuuucccuaaccauaugaauccuauaagugauggaauagccacagcaucccaugguguuagcaaaaauugacuaagaggaaagaguggcuaaccaaacagcugggaugccacagcucagaucugcagaaguacucgaucaaagcacucccacugccauuuugucauuaaauccucuguaagguagcaaugccacugacuauacuauaugaauggcaaacucaagcucaaaaaaagugauuucgucgaaguuacagaucaguacaugguagcccaagaccuggccccagacuugugggggcuuugcugucacugucuccccuaaggugcagggauucggggucauuuucaugugaaucuagcagccuggccauggcuaccuggagggcaaugaugaaaaguguucugaccaauuaucacugacagcccugggauggagguggaaugggaggcagacgcaugcacucauuagccaugcuugacccagccccagaauucugauauugucuuuaccacugguguucugaaugauaugaagcaaaccauguuuuauauuccuuagguaaacucauugcaugagacucuuguaagcaggaauugguaacaguacacagcaaauagcaaacauuuccauccuaaaagggcauuccuccuuacccgcacuauuugaacuaguagagccagagaagaaggaaaccgaaaagauugggucuccaagcuagaaaauacauaaauugagaaucaaaaucuugaaauucgugauuaaccccacacacccagcugcagguccagccaaacucuucuguaaaaaaaccauaacugagaagagagaugcugguugagguaggaaaagacuaugaaaugaauaaucaccacaaagcccaauguuuucagauagaguuugaagaguucugguuggacucugcuucuuaaaguaggacucaagcugcuccuuuaaaucuaaaaccaacccaaucuaagacuacaccuguaacugagacuagcacugguccaggagagaugccggggaaaaggaagaguccgcugcaggcagcggcuguuuucaaggccgaaucacacaaaaccugacaagcugggggcacuauuuuuuucaaauacaauuucccaaaauagaucucaaaaggcuugguccccaggugugguccaacagcccugaggccauccugggccuuaaagcacguggcucgaauugccugaugccccuagaccuaggacuugaaccagauuaccaagugcuguucagucucuauaauucagcuccaaaagauacagcuaccccaggccuaacgcaauccauguuaaucuaggaucaaagccacaggcuucagccucaaacuguauccugugaggaccuaugcuuauuuuugcccuuucucccucuacagucagaugcagccacuuaccugugccccacuggaggccugggcugaccaugcccugggagggguuccugccccaggaggaaauacauaaggggcuuccggguugugacagaagcuggcuuuauauucaagguucacuuucuguguugcaucuucugcuugggugguuuaucuggcuuccucaaucuuuaucuuguuugacuuucugguuccucgggauuuccuuguucauguuugccuaccuguucugugacuucacgucaggcuuuuucgcucagguguguguguguuucuagacucuguguuaagggcacacaaacauuugcaagagcaacaaucuugucccaacuuaccuuuccagucuugucucucauuuuacuuccaugaacucuauaauccagucauaccagacccuuuuccaucuucugugcuacccuaccuuuucccaccuuccugccuggguuuacauuggccccuccgcccuuaguaucccacuagcccccuacccuaucucagcuccuuaaaauucuaagcagccuuuaaaaucgaccucacagucccccucugcugugaagcuucuucauauauuccugcuuuagcccacaguaaccuccccuuccucucugcaggcaauuaguucuucauuuguaucuuucuuuuucuuucuuuuuuuuuuuuugagacagagucucacucuguugcccaggcuagagugcaguggcgcaaucucggcucacugcaagcucugccucccggguucacgccauucuucugccucagccuccccaguagcugggacuacaggcacccgccaccacgcccagcuaauucuuuguauuuuuaguagagaugggguuucaccguguuagccaggauggucucgaucuccugaccucgugaucugcccgccucggccucccaaagugcugggauuacaggcaugagccacugcccccggcccauuuguaucuuucuuauaagugugcuggggaagcaacaaucgcgcaaucaccucuauagccuuuuuuuuuaauuuaacuuuuaaguucaaggguacaugugcagguuuguuacauagauaaacuugugacucggagguuuguuauacagauuauuucaucguccagguauuaagccuagcacccauuaguuauuuauccugauccucucccuccucccagccuccaccguccaauaggccccagugugcaccguuccccucuauguguccauguguucucaucauucaggcucccacguauaagaacaugcagcgguauuugguuuucuguucaugcauuaguuugcuaaggauaauggucuccagcuccauccaucuuacugcaaaggacaugaucuuucuuuuuuauggcuguguucaacuagacuuuaaacugcuuaaaaaugggaaugcuguccuauuuaucuuuaaacacaccauggccccucucacaguuacauacaaaaaguauuuacaugugugucuaagggaaaaaugauggcaauagcagauuugaccuaaauccuugucuuucacugaaauuugugugugucaucugccuucugucuguacaucuucaacuaacugccuuuccuacuuacucuaccuguguuuaccugagaggguucagguuaguugcggagccacagcucugcccugacuaccaguuaguucuguggugcgucucuugcucuccucaguucccuggcuugcccucuuuauccuaugaacaaaaacuguuucugauuuuuuucagucccagcaaaccaucaggucccacaucaaccuaccucucaaaaaucaucaugaaauaauaagguaacaucucagauuuugcuuuuuaaguuuucacugcuuuuacauacauuugguuuuaccuucacaaagagccugagagguagucaggauaggcacccauugauaaggaagcuucaucagagaaagaaggcaccaucucgaggacacagcucauuagugcagagcugaagugaacgcguuggguuuccaauuuguguccuuuuuucccccaauagaggugccucauuagcaucuacuacuuuccauccaaacagaagucucaacgggaggucugggcgugguggcucaggucuguaaucccagcacuuugggaggcccaggcaggcagaucacuugaggccaggaguuugagaccagccugaccaauauggugaaaccccaucucuacuaaaaauacaaaaauuagccaggcgugauggcgggcaccuguagucccagcuacucgggaggcugaggcaugagaaucacuugaacccaggaggcggagguugcagugagccgagaucgagccacugcacuccagccuggaugacagagcgagacucugucuccaaaaaaaaaaaaaaaaaaaaaaagucucaacaggggaaaggacgguauuucuuuaaaaacagggcacagggcacauuucaauugauauuuuuaaagugaugacugguaugccuucucgcacuggauguuuauauccagugacaucaggaaccaaacuacuaccuuuuauuuaacugaaaaacugacuuugcaaagaauuucuuucucuuuguuguuaggauuuagccuaaaaccauguacaagagucuuccugcuauccugagacaaugcuccuuauguaacuuccgaauccaaauguaguguuguaguaacucguuccucugacagucucagcguuuuuccacucaagcccugcacacagaauuaacucaaaacuucugcaagaaaaacgucccuuuuagaguuugauuuggcaucaguuucaaagagcuguuuguauauuuuagaauauguagaauuuuccuuugauugaaaacucucuuuuuaacaauggacaagagaugauuucucuucugagugauuuaaacaaaaacaaacacaucuuaguuacauagagccuuguucucaaaguggucuuucugaaagaaaucaaacccuacagauuguuaagcauuuggcaaaagccuucaaacagccaaagccaaauagcgaaauuuuccuuguugcaggagauaaacaaauacuagagcaaauuuuuuaaaaaauagaaccuccuuucacuuucuacucuguucgauaacauuccccucucaacacacacacacacacacacacaccccuucagagggguuucaucuucaauguuuauuccuggugcuauaguaauaaacucgccacaaauggacauuuucaacaucuguuuguggcuguucccagacgucuuguauuucucugggacaugaagcccucugucucccaaguguaaacagacacaccuaauuauguauuaaggugucugagaggagcuacuuguuuugaugaccgugaaaaaaaaaaaaaaaaaaaagagcccggucugcuuagcuagcugugggacgugggacaaacacacaguaguccaguaguagcuccucaaacaguggaaguucucugccugccaaggacaaaauccaaguccuauuuuucucagccugagaaucauguccacugaguccacuccagauguggaccaaaacagucagugacuggucaggagagacagugcugccacagaugcagggccacaucuauuuaaucuuuucauaaggacuuaauuuucgggugaaaagaggaaaggugcagaggaggaagaggucauuggugguucauuuuuuuucuucuucuucaggucacaauggccauggauagcaauuuuaauacaaugucaguagccuaugagaagaguagcaggauaaaauaauucuagaguguuggacuagcaacuggagauguggguucuggccacagugcugucccugccucacagggugaucacgguggagucccuuucccucccugacccacacauuccuugucaguaaaaagaggggcggggaugaaaucaucucuguggguuucccugcucuaaaauucugauccugcuacauauuggacaagucugagaauuccaaaaauaccuucaaaaauucuacuagaaauacuguuccugcaaagaaugguccccauucauuaaaaagcaguacuaguuuucaaaaugagguaauaaagcuauacauucaaugugcaaaaaaaaaaaaaaaaaaaaaaaaaucuagguuuucuauguacaaaaugucaauucaaaaauuuaggaucuuuucuaaaaacuaaaaaaauguaauuguuaacaacaguucccaacacaggccaaaagaaaaugggaacacuacuaacuuuuuaagaaagucuuucauccuuaaauuuagcaguaaaggagguuaaaacuaacacuucaggcucccauauucgaugggagauaccacgugagcuauuucucuuucuuuucuguucuagauuauuuaagcaaauuguuugaucugaauuauccaaaguuaaauaaaugauuuuuuguaucaaccuuuccagcucuugcaagguagaauauaucgugcaaaauuuaaguagcuuuaaauuuccucgccccacauauaaaaccauauauuuugaguuuuguuuuuuuuuuagacagaaucucacccuguugccagacuggagugcaguggcgccaucucggcucaccacagccucugucuccuggguucaagcgauucuccggccucagccucccaaguagcugggacuacaggugcgcaccaccacgccuggcuaauuuuuguauuuuuaguagagaugcgguuucaccauguuggccaggauggucucgaucucuugaccuugugaucugcccaccucggccucccaaagugcugggauuacaggugugagccaccgugccuggccuauuuugagguuuuaagauuucauuaauguguacauuuuuaauuucuagaauaaaauuuauguuuacaaaauugggagguagauuuuuccacuauuauuucuuguuagggauuugguccauuuuacuuuauuuuggguucucugaucugcaucaaaccaugaauuuuggcuacuuaguaaggauuaaugguguuauccagguuugggcuggaaagaucagugauaacaaauauuccucuuaggaugauagccaacaggccuuuguagcaaaguccgauucugauauggagacuccuacagcaacgcagaguagggaaaagcauauuauguggagcuaaaagaccuggaauugaguuuucacucucuaucccuuucacuugaugacccugaacaaaucucuaaaugucucugagcccucauuuccugcuggcaaacuacugaguauaguaguauugauacuucaaugcguuguaaugauuaaaugaaauaaugucuaugaaagugcuuucuauagauguaaagcacuaucuaaguauuauuaauauuaagucuugcuaugcauuuauuuuuacucucaccuuuggaguuaguugcuaaaauucuucccaucuuccccugcacuuaauuugucugagguucuaacaugauguucuuuaucugugagcuuuaaguacuuuccgccaucagaaaagagcuguuacagaggacccaauaguccugcuccuuuuuaauucccucacucucuggaguuccugaagcagagcagaagaguucaaggugcccuccuaagaugccuccuccuuccugggggaguccucaguuugucuguacauauucuguugcacaugcccgaguuuccacuucucuuggaugaccagcagcauccucuggagacagcagcuugauaagcugccagaguccacugucaucuaacugcacuggaccauggaccucuucauaugcaauaggauacugugggggaaugcaauaagccuaacucacagauuguacuuguaccaaucucuuuguucuucccguuucccucaguguuaaccugcuuguuacacuuguuggaacuuacuugccacauuuuuagauaacugaagggauuuaccuccaaaucgccuucuauauaaccuaaagugguacugcuuauuugauuuuaaugaacuuuuacaaagauuguuuucaaacuucuaacuagacauucuauaauuugcaguuugagauuuaaccuuuuuauuaaaauggugguaggaagaccccugggagggguucacuuuggagaaauaguuuuucucucuuagguaccagggaaugugguaaagugcaggaggaaggcaacuuagccaucugcagaagcuguggcuuugcaaguccaaagcugacaccucaaauacuagcuugcaaagucugcaaaugggcugaaagauaaccacaucuccaguucccuaguuuuaaucuaucuccuaguuaccuaucuccuaacccaccugugcggugauuuucacuauuauaccacgguguuguuggagugaaaaagaucaguaccaaugccuuaagacuggagggggagggcauuaguauaagcaaguccagccacucaucugaagaggaggggaauucauuacacacauguguauugucaggauucagaccucuuggcucauggggagaaagcacgccucuuuucaauaaacuacccuaccaauuuuauuccuuuuuaaagugacuguuuuuuuccaggggcuguuaucuguuaucugcugcuucugacucuagugagaaaauucacauuacauuuuuucaccuccauucucuuuuacuauacccuucuaaaugaaagggaaugcaauaagccuaacucacagauuguacuuguaccaaucucuuuguucuucccguuucccucaaugggcugucaaaccuaguuuuuaaccagggagaaagguuaaaaacuagguuugacagccaaagaaacagccaacccaucauccgaagcuccaaucuaugaaguuuuuggagcucugagaauuauucuggauuccccaugcugacacccuuugaacuguaucuucuauggaguccuugagcuuccaaaacucaaaauaaauccaucaaauacauuuugaguagguuuggucacugggaaaugugcucuccagguccugauuuuacuacucuccuuuccuuuaaaacaaacuaacaaauggcuguaauaguuuucaguacacacaccucugaacuucaggauuccagaaagaacagaaagcuguguccauggagaaauggaacuucauuacauuuuaaacaggaaauauaagaaaaaguguucauaucugcauaagaucuugaagcuaacuuccagagccccaaauuuagaguuucaugaggaggaaucuccuuuuagggcaugguugaaggaucugagaauggagugauagcuuacuacaacugugaugccaacaggguuaccuguuuaaagcuuucuccuauaagcuuggcuugugguuaugagauucugcuuagaacauguuccucaucccuuaucaauucaaguuccuugcuauuuaagauaagccccaauuucucaguccucugaagaagcuguuuggguacugacuccacagggaggacaagugcugguuucucaccuggacugacuuuucuugacugcuggauauuagcucgccagccugaaggaacugauagccccuugccuaaguguuucuucacuucagagcuguugccacgcacugcccagugugaucaucuaaugauugccugcaaagccagccuggucacaccugcaugcaugaugcuuuccauugaagugcaucuuuuuuuuuuuugagacagagucucccucugucacccaggcuggagugcaguggcacaagcuaggcucacugcaaccucugccuccuggauucacacaauucuccugccucagccuccccaguagcugggauuacaauugcgugccaccacacccgacuaauuuuuguauuuuuaguagagacgguguuucacuguguuggccaggcuaaucuugaacuccugaccucaaaugauccaccugccuaggucucccaaagugcugggauuacaggcuugagccaccgcgccugaccuaaagugcauuuuagaagcaguagaaggaacugguguguaugaaagauacagaagauacauuuugagaaugagaagaauguugauaugguuuggcuguguccccauccaaauuucaucuugcauuauagcuuucauaauccccaugugccaugggagggaccuggugggagguaacugaaucaugggggugggucucuuccauacuguucucgugauagugaauaagucucaugagaucugaugguuuuaaaaagaggaguuccccugcccccuguacacauucucuugccugccaccauguaagaugugccuuucuccucuuucgcguuuugccaugauugaggcuuccccaaccauguggaacugugaguccauuaaacccaucuuucuuuauaaauuacucaguucuuggguaugucuuuauuagcagcaugagaacagacuaauacaaacauauaauguucuuucaguccccaaaauucaucucaucauuguacaucauuguacuaaaaucuggguuugcauggugccaaggaaggaaagcuauuggaaaucagaagauuaacaaaaugugauuacaaaaaccuaaaaauuuucagucaaacaaaacauuucagaucucaaaauggauuucuggccugaaauuuccagguuaauaguucuguauuuguuuaauaaaucaaguaacuccugaauuaccacuucacuuaggguguauaauagugucuaaacauuaauuaaacuuguaaaagaugcaauauuauuccuuuuaaaguaaacuaacaauugggagaaaacauuacuaaagcauuuugaugauaccagcaaaauucucucucuacuccagugucucuauccccaccauuuccagggaagcccaagccacuguccucucacuagggugacugccaagccuccuaaccuccucccuaccccuguuacaauucuccacccaaccgccagagugagcuuugaaaaauauaaaucaguguauaucaagacccugcuuaaaaucugccaaauggcuuaacacugcacauaacagcaaaucuaaaccucugaucuugaccuguaguggcccugcauaacuuggacccagccuaucucucuaacuucaugucaucuacacacuccagccacugagcauucuucucaaacaccccacagucuucccaccucugggcccuugcacucgauuuucccacugccuagaaugcccucccuuccuccugaucuugacagggcuaacucuuuuuuguuaauuagaucucagcuucaauauugacuccucaucacaucacucuauuuuacuucuuucauaguacauaucccuagauaauauuuuauuauuuucaauugcccacccuuugguaguaauagcuaacauuuauugagcaucaggcauuauucuaagggcuuuacauauauuaacuauccuuuaguccccauaacaaccuauuaaagcagguauuauuauuauuagauuauauggucauuuaacugaugcggaaauugagguacaaacaagcuaaguuaccuccccacaggcacaaagcuagugaguaaagaagccugaauuuagaccuggcucuaaagacuguuuaauuauuaugccauaugccaauagaaaaaguuccaagagccuuucugucuugaucaucagaguaucuccagugggcagaacggugcucaauaaaugaguaacuuuaauguuggcaauaacuuguguuaaauauuuuuaucaugcagucauaaaacacuaugacaguaauguuucauuaagagaaaucucguuaugauucaaaucauauuuucuuuaaauagaucuaauuucuuuaauauagaaagccugguccugugaucacauuuauucuguuauuaacagaauucgucuguuuuaauaacucuuagcuuauaagguucucauuucuccaguaagauaaauuaucacuuacaaauguaccauucucauguaaagaggguuaacaaauaaauuacauaaaaccaugcaaggguaugagagaugucaauaaaauuccuuaauuuuacauuaaaucugggauuucaaaaauugucuauggauucugacacacaugcacauauauaaggcuucaccuuaaagacagguucagcuguggucagguaucaagaucuaaauguacaguuuuuugguauuaaauaaccugaucuuagguugcuucucaucagaaucucuuaacugaaauacaaaacaaaaccuuuccugacaucuaucauaguugcuccuguuaauuuaguucuucgauuaaaugcuauauuagccuuuaguguuauuauugauggugguauuuaguuuucuuuuuuuuuuuuggagacagagucucugucacccaggcuggggugcaguggcacaaucucagcuuacugcagccucagccucccuggcucaagcaauccucccaccucagucucccaaguagcugggacuacaggcacgcaccacccccagcuaauuuuuguauuuucuguagagacgggguuucgccauguugcugaggcuggucuccaacugcugggcucaagcaaacugcccgccucagccucccaaagugcuaggauuacaaaugugagccaccgcacccagccggaauuuaguuuucugaugugaugauuacuaaaucucuccuguaagaaaaccugcccuuucaggccuuaauuuagaaucacagacaucaaaaacuuuaugauauaccuuggggaaaaacuagcccaauuaacucaguucacgcuuaaagaaacuaagaccuacagaaguuagugaccugcucaagaacucagaggcacaucugaaauucaaaagagaggcuccucaauucccagccaacuccuauuuccaauacacugucaacgaugcuaugaauguuuaauuaccacucuacaugcuugagucauggaagaaauguuuuccugauaaaccaaaucaauucagcacaauuuuauugagcaacugcuguuuuaucaguguugaacucaauucuucuuugggaggcaagacccaauucaaaaguuucaaccaccuacuggauuaaagagguuaugugagguuuuauuaacccuucaaagaguaucuguggcaccugccaauuucuaagguuagagaacaacuuuaacuuucuuuguuaacugcucugagggccaaacucuuuccuuuuuggaaucuuuuaggucaguucucuacuauaucuuuugagacugagucucacucugucacccaggcuggagugcaauuacgcaaucuuggcucacugcaaccuccaccucccggguucaagcaauucuccugccucagccucccaaguagcugggacuacaggcgugcgccaccacacccagcuaauuguuguauuuauaguagauacgagguuucaccauuuuggccagaauggucucaaucucuugaccuugugauccacccaccucggccucucaaagugcuggaauuacaagcaugagccaccgcgcccagccucuaccauaucuuuaagccacacugagaauguacuguuuuccuaagguguaguuugggagcuuacaaguuuguuuucuuuaaugaugaguaccauaacgcuauuaucagacuuuuuccucuuuuccaaaccuguuuuuauuuccuuuguaguuuuuauuuagaaaagguucuucuuaauuauguacggauuuauugugaccacaucaauggguuuauuuauugauuuuucaugaaucacugcucuccuuggcacaggucaggguguguuuguaaccaucauuauauguguuauuuuuauuccaucaacuauagcauuguuacuaauuaccacagagagcuggaacggugaccguuuuggguacagcgcgagauggcgauaagcuuuagauacaaaagcacagggcuccuccuagucucccaugcuucgcugcauaguuauggguugaucacuuaaggucacagucucucuggaaaauacauggcauguuucuacuuaaaaaaaaauccucugagauauuuaggaacaauguugccugugcagcauuuuauuuuuauuuacauuacuuucauggauuugaaauucauuaauuuauugagucauauaaaaaaauuuaggcaguauagucaaaugggguccuagauuugccucagaccaaguuacuuaaauucugacccaguuccagaaaauacgccuuccuguuugcauuucaggaaaacaaaaaagaagucugaaaaugacugaacuauuugaaacaaaguguuguccacaaaugacuuugaacaauucaaauuaaaguucugucauuugcauuuuaucauauaagauauuuuaauuagaaaaaagcuuuuuacuuguuuaguuaucucuuuuuuuuuguuuucguuuuugguuuuuuuuugagaugcagucucgcucuguugcuaggcuagagugcaguggcaugaucucagcucacugcaaccuccgccucccggguucaagugauucuccugcaucaacuuccugaguagcugggauuacagacaugugccaccacgccuggcuaauuuuguauuuuuaguagagaugggguuuuaccauguuggccaggauggucucuaucuccugaccucgugauccauccaccucugccucccaaaguccugggauuacaggcgugagccaccgcaccagccuaguuaucuauuuucuaagauuuccccuuauaacuauuucugcauguuaacaaaccuaagagcuaauuuaaaauaaucaugcaggccgggcgcaguggcucaugccuguaaucccagcacuuugggaggccgaggcggguagaucaccugaggucaggaguuugagaccagccuggccaacauggugaaaccccgucucuacuaauaauuuuuguauuaguuagccaggcaucguggcaggugccuauaaucccagcuaccuagaaaggcugaguuaggggaaucgcuugaaccugggagggggagguugcagugagcugagaucaugccacuacacuccagccugggcaauaagagaaaacucugucucaaaaaauuaauaaaauaauaauaauaaucaugcaguuccucuguccccuuucuaucaacagugaucaguuaauguuuccugagaaaucaaugcuuaaugaaguaaucaaauaauauuaagacauagggaugucagugauccuauuuuuccugaaaaaaguaugaacuuggcuaauauuuauuaauaucacaaauaauagaccugucaagacuauuuauauguauauucauuaucaauauaaugaguagguggauucaugcauauggggauguauaugcugaagcagagcaacaacguuguuugauuuugucagaguugcuggcauauuccguaacauauugcauagugagaccauacaugcauuuacgaaauaugaaauaaagguaaacagaaauugucuuagucuccuauagaaucuuacuucuagaucuauuagccaauuucuaauaauagucacagcauaagaacccugaagcaugcagcacugauuccuggguagacuuuucuacugaaugcuaguacuucccacgacauuaugcaugcugagcaucggaguaggaguuagagauagaaagggauuagaaggccaggcccugggccaaugggagucuucaaucuagcaggagcucuggagagauagcaaaggauuagaagacuaggccccugacuuaggggagcuuucagucuagcugggaaaagacaagauccuccauauccuugucacaucuuaagaaacaugaagccacacacaucaaacauacguaauuuuuaaaaguugaaaacguaauuguugaagcaauucggagugaaaguauaaucugagcugaaugggauuguuguuuuuuuuuaauuuccuaaugcagauggcuuuaaguugguuacggaugugaauuauuauaauagagcaaaggaacaaaagagaucuccuuuccuaaaauccugagcauucuuugcauguuuuuggcaucuacaugggcuaguacuauaauguaaccaucacauuugcuuuauguuguauccuaaaugagacugaaagcuucuugaaggcagagacuauaucuucuauuucuuuuuuuacuucucaccugcauaagcacauuuuaaguacaugccaaauauuuguugagcugacuugaaaugacugaaaugaaugaaagaaaagcauuccaaacaggaaggaaugccagggacuacuaauguauuagaugacauuauuaaaaucuaaaauguucuagacaggcagaaauuauuaccugaauuaaauaagguaaaaccuaacagggauaacuguaaaguaucauauuuggaucuacaaaaaaacagcucuaaaaguaaauaauuggagaaaugcagauugacagaaguggcaaauaagagaaaacaguguaauauggucaccaaaagaacaaaggccacuaaagccugcacuaccagagccugagaagagaggaauaguuugguucuggguacgaggcguuaagauggacacuaaugaacugugucagagaccacugaccagaccaguaggaugaccugcaaccauacuauacagaaagcgucaaaaaaaacaggcagagguggggcauacaggaaaaauucagccugaaaaagauaagacuaugagaaaugauagcugucaaaacccuaucuuuugcuuuguuguagaggaauagcugugcuucaguuuacagauuaguuaacauaauuucuaucauuuucucagaaaagagcuuugacacuuuauuacaugauggcuauaauuaaugucagacucuaaaguggaaaucaaaaauucuauuugaucauuugguuucaagcuggaccuaaaauauguuuuggcauuguuacuaacuguuagcagcaaguucuggaaacagauacagucuugauauguguucuaaauaugaaacauauugcaaaaagacuuggagauaaaaauauauacugcuuaugcacacucuuacugugcuauuuccuguccuuaucagcaaugaaaguuucucuuguuuugcccuuucuuuguuguuccaggugaacaaaaucuuuuuucuuccuuuuuuucuccuacauaucuaucuuccucuuuuuuuuaaaaucuucuuucccacuaauacuuguuucauuaaacauucuuaagcaccuaccaugugccaaaaacugugcuagguuauaaggauucaagaauaugcaaaacauagccacuguccuuaagaagcuuauaaaaggagaauggcaugcaauuaaauuuuuaugcuaaaggacaauaugggcugggcaugaggccucacaccuguaaucccagcacuuugggaggccgaggcggguggaucaacugaggucaggaguucgcagccuggccaacauagagaaauccgucucuacuaacacuacaaaaauuagcugggugugguggcucaugccugcaaucccagcuacucgggaggguaaggcaagagaaucuuuugaaccugggaggcagaggcuguagugagccgagaucacaccacugcacuccagccugggcaacagagugagacucugucucaaaaaaaaaagaaagauauguacacauuagagguguguccaaaguacagaaaugacauacaaauggguguagaugagacagcgauucacuuugaagaaagugguguuugggaaaggcaugcccaagagggaacaacagggcccugccccccagugcaaagaaaugggcugacauggaagugggaaauagcacagcacacuuaaggaaugccaggcauuuuuaagagaaaaggccccccuuuaccuaggagagucaaauauuuugggagacaacuaagcagucacauaacuguauuguuauuuuaacuugguauguuccguauuugaauugguaugcaugaccaccaaacaguagauguucaggaauuuaucuaugggcaagauuaggaaaaaaauauuuaauuuaaaaaugcacccaagauacagaaaaccauuuggugacaauugcuaugauagaaaacaugcuucuccaggaagaaaugugugaaaugcuuucuaauaggaacgaccacugacaaagucagcaacaaaaggaaaauggaagauaagauaguauccucagguucagguagagcaccuuugaugauuuuaaaaauauaauagcauccggucgggugcaguggcucacaccuguaaucccagcacuuugggaggccaaggcagguggaucaccugaggucaggaguucgagaccacucuggccaacaugguggaaccccaucacuacuaaaaauacaaaaaaauagccagaugugguggugggugccuguaaucccagucuguaaucgggagggugaggcaagagaauugcuugaaucugggaggcagagguugccaugagccgagaucaugccauugcacuccagcaggggcaacaagagcgaacuccaucucaaauauauacacacacacacacacacacacacacacacacacacacacacacacauauauauauauauauaauagcauccuuccaauggaaugcaauucgggguagaaugaaaugcauuaauaagccaugaaaagacauggaggaacuuaaaugcauauuaccaagugaaagaagccagucugcaaaagcuacuuacuuauuguaugauuccaacuauauaacacuggaaaaggcaaaacuauagagacaguuaaaaaaaaagaaucugugguugccaggggcucaggaaaagagaagggaaagagagaugaacaggugguguacaggggauuuuuaggguaaugaaacuacuccuuaugauucuguaaugguggacacauggcauuaugauaaaacccauagaacugcacaacacaaagagugagcccuguguaaacuauggacguuauuucauaacaauguaucaauauugguucaucaauuacaucaaacaucacacaaaugcaagauguaaauaacaggagaaagugggagaugguaggaggagaauauaagaaacuauacauucugcuccauuuuucuguaaacuuaaaaucucucaaaagaauaaaguauuaauuuuaagacauauacauaaaaguaauaaugucgcaugcauuucuacucuuuagaagauaauuaugcgaccuccuuuuuccacuagcauuuaucugguaaggcaaacuuuacuaaaaguccuaagaacaucaaaucccuaaacagauagcaccuuacuccuugcagagccucugagauauaugauucagcgauuucuaguaauucauuaacauaggaccacugaggcacaauaaauuaacuguaucugagaaugauacaaagacucuuuagugacaaugaaaugaaaacucagguguccuaaguuaaacugcgcccccucuucucagaccccagugcacugcagaagccacuguaucuaucguuagaaaauuaauacuuugggugaaaugagguucauacacucaaguuuucuuugauggaaaggagauuucagcaaauccucaauaaaauauauaaccauguguuugccaucccugcaaaagcaugauuccuuucauuacuaaaucuuuucccuaugugugggugguuguacaugugucagaaauaaauccccacaaaaacaacugagaaaaaccauguaaaaaaucagagucaaaccauguacacagguuucauucugagcuuuaguaucucaguguagcuacaaauaacaguaauuaaucauacaaccaagcuuaguaaacuuugugagcuggaccaacuauuaucuccaacugaucuaguaggaaugaaaaccacuucuuugggccucagcaggaguaaaucaaaaauuagaguaaacggagguccagguaagauuagaacaccaucugcuaugucaaaagauaggcuauuuuuagggaaagcaagaugaauuucaacuuauggaaugcaaaaguaauccauccaaucaguggcgauauaaugaagaauacggaacauucaauuuuugacacagggcuugccuuuguuuaggguccauaaaauuuaauaacuuccccacucuguggcuuuaaacggagaacuucuucaaaauaagaguuacuccuauuaaacuuaauuauuugccuguggcugcuguggcagaguaugucuaccaaacagguggcucuuaagaaaggaaugguucuguaguaaaaaguagaugcucuaguguuuuauuaugguugcuuuaacuuucugguuuauuaguauuaauugcugaaguuuuccuuuuaaccuuucuuaaggcauuccucccuccugugaguuaagagcugcucugcuaaaauaaauguucacauauaauuggcacauuacgaagcugcugguuucaagaacuugacucgguggacuugauagagacuggguuauaagggacauuuuagaaugaacaaccucaaacucuacuggguuugaauccuccugacagaccuugaguacucaaauggggugggguuuuuccacuggcaauuucuagauuuuguaguagugauaaaauaauuuuuaauaauuguauuauuaaacuaaugcuuauucuccugaccuuggaauauuauaguuuagccaccgaaagucauaaaacuggagacaucuucaauaguccugugcaguugaguaagugaaaaguguuaauauuuacauauuuugaaauaagagauucaagacuacuuuccuaagcagaagaaaaaaauaaccuuacagaaagauuaacucuguccuauguuaacaacaacaacaaacaaaaaccccauaaaugcagagaagaaucuuccauacaaucuauaguggcaagcagggagagguggcucaugucuguaaucccagcacuuugggaggccaaggcaagaggaucacuugagaccaggaguucgagaccagcccaggcaacauagugagauccugucccuaugaaaaauauuggccuggcaagguggugcaggccuuuagucccagcuacucaggaggcugagaugggggaauuguuuaagcucaggaauucaaggcugcagugagcuaugaucacgccucugcaucccauccugagcaauagagcaagacccugucucuuaaaaaaaaaaaucuauagugaccucuuucagaguaacugaggcagccaacaucuaugaauaagaugcaucuuaccugugcaucuuuaacuaacauauccuaagucucuaagaaaccuccagaaagcaucagaaagguauaaaucccuucuacuucauuaugccaaagagugguacagacuuagguuaaucuaagcuacuucacucaaaugagugggauaguggaggaguuauuugcagugaaaaaaaaaaccuguguaagcucucuaggagacucauacucugacccaaacaaucagccucaauaaagaguugugcuucuuuccauaguaggauaauuguauaaaauacauuuugaaagucagcaauuauuuauuuacauaguauuuuguaaugacuuccagaaauguaauuauaaucuuugugucaagccucacaagugcuuugaagaucaaaacugccaugggugauacgauugcaauuauaaagacaugcagugguucgggucauauaaggcuugccuugucacaccuuacccuugacuagaaucaaugagaaauaacuuuggccaccucuguguacugaauaaucuuuuagaaacauguaggaugaagugagauaauguauaaaaucaccuggggauaggagugcuacuuaaauacagauuauuauaugaugaggccauauguaucaauguaaguaugguaggaaaggaggugucuucugcacuguaacaucacuagacugguuucugagacuagugcugacuuuuauaauucaacugaauaugauucaaacucauuaccauaacauacaccuguuagucaauuacauggcaauaacuucucauucaauuacaaacuuauaugugcucuuguuguuccauuacaauauuuaaggcuacccaauguuaaggaaauauuuccugaaucauuguauuguaccucugaacuugaagacgucuaguauuauaucuuucucugcaguaaaguaaggauuguagguaacauaccuuuaucauuuuaucuuauuuuguuuauaccuuccuuccaaaaauggucugaggaaaacuacaagacuaucuaauauaauaucacugugauuauugucauuuauuaacuucuagaauuguugccaugcuugaaaauuacucagaagaaaggauacuaauaaagaaaggugaaauauuggauucucugaaggucuuuagguagauuaaaucauggucuuucuuuggaauggucuuuuaggagaaaauggaauuucuuuuggaacaguucuuucugguggaucuuucugguuguuucuauuccuaugaucccuuggaacacagcauuagcaugccuaguuaauuuaaguguaacucagcacuuucuauugucugacauaauugaaucguuauuuucucuuaaugcuuuauugacuuuuuugugaaugguucccaauugcuuuuugcucuguaaauauucauuuuaaaucuacgaauaauaauaauaaugggaaacauuugaggaguucuaugugcuagguacugcauuaagugcuuuaugaaugccauguggguauuaacuuauuuagauaaucuaagggcuuuguuuuaaauaugcccugcggugaucuauuuucugaaggaaaaguccccuuuaaaaguuuagauuuuuaucuaaucuaauuugacucacuuaacaagacuugccuguaaauuacauauggauauagaauuuuuacaaaacaauuuuagcuucauaauaucagcuacaaucuauuuggcacauaucaugugccaggccaguucuaaacacuuuauaugaaguaucucacuuaauccucacaccaacccugaagaugaauauuguaugccuauuuuacaaauaauaaaacuaaguuucagagaaguaagaaguugccugauauauguaugagcugggauaaaaaccuggguccgaacauccaauccuacugugaagugaagaauuuuauucuuucucacccaaaaucauaugagaauauuuuguguaucccuuuagauauggagaugaaaauugaucaaugcacacaaaaacauaaacuguucuggaaagcauuucaaaaagagaccacaggacugccuguaaacagggauagagguuaguauuuuuagcuguccgcguuauguggaaacagcauuauuuggcacagagcauuaugaagacuaaaggcacaggaauggacucaauccaaaggacuuuauuuacuaaagcacacaaacaaaaaaaaaaaaaacccaaauuaaaaaaccccucaugcuuaagucucacauguaggagccucuaggucauggacuuagacauuggguuuagauguugagaggaaucauaagauauaaauugucuaacuugguaccugggaaccuaugagacaggcucccccaagaaggcucccaggacuaguccccagggaauuagaaauggugcacacuccgaugacaugguccuugaguccaccaggcagugcuugggugugcaggcacagccccgcagcccagggcaaggucaggugagucacggcuccuccaguucccugacaguccaugucuaguuguuucuuccuguuucccuaccuacaugcugacaagagggauuuucuguucucuuuacuguuuauacagaaccucccacccuggcaccauguuacuuuaccagugacaacuccagaaauguuaaggguuggaggaaaaaacuggacuaaacucaguauaaaccaguuuaaaccagaggcucacuccuaccuguggccuaagauagauacauggcuggaaaauuaaccaguuucugcuccugccucccuaccugugaaaugggaaagguacuguuuuguggaaauguuuuaaguaacccucaguaaaguaacuugaaauaaucuggcuguuuuccguuacacauguacaugauaaacaaugacgacuacucauuuaugcagcauuuuuccaauguuauuuucaauggcuuuccuggugaacucacaggaauauaccucaguaggaaacugcuguaguuaagugucucuaaugcuaccaucacucccugagguuuuuuucuuguagguacugcuagagaaaaaaacagcaaaaucugcuucagccacaguggguugggcagauggaagccccaggggaccccaaacagaagcaaguuugcauaagucuauucugucaaaguguccuuucggcccuauguaaaacaaaacagccucucaguaugaaaugcagaaggaauaaccagaacuaacucaacaccaucaacauuaugcuuuuaaucccgcaucagccuucguuauccccacugugccuuacucauccuuucccguaccuuuaauuaauguuugccugaaggcgacggugaucccaggcaagggaaaugauaacuaaaauucuauacucuauacaauuccccaauacauacuaugugauucguaaaaaugauaacaggagucauaaugaaaagugguaacaugguuuuccaaaaaaccuugcaauucucccuccaccccucuucuuucccuacucacccccaugggaguccaucugcugcagaaaaugugaggcacuaggaccagagagcccuuuccugcuauuugcuugagaaacaaagccuucccuccucccaaguugaaagaaauaaaggagucugaacuaaucaaaacccgcaagccugcugguggagcuucagcuugucagugaugcaacucagcggagugaguaacggcuucgagcuuugcagaaaaugagagagggagagaaacagagacagaaacacaaagagaaagaaagaaaggcauuaaccuggccaggagucaaacaggugcaggggcccgaacgcugagaagaguaucuggcaaacgugggauccaauggggugugugccucuguggacguacgucauugaguggggacaauguuugcaguucauaugucaggguggaccaagagguuucuuuucuuauucaugggacucauauagucagcuaagggccuuuaacuuuucucuacuugucaguuuggaguuuuugugaacacuuucuggcucucugugaugaauucuccaggauagaggggcagccaggucaucugucacacacacucuccccaugggccacacauuucuguggugccuuuggaacagaggaauugugagcacugggcugccgggcugcaagugacagcagcaugcauuauguuucacagaaagucugccuccuucuugaguuagccacucagaggccacgcauugucuuuuaagauucuuccaggccucacagcacuucaaaugacuaguuucugacaaagauccuaaguuugcaggugcucucucuuggaacugacuagcuuggacuccugggacuuauaagccuuuaggaauggagggcugugccaucaaucuuguuuauaggcagauguuacgaaaagaaaggaacacaagcagaggaaauccuggcauaauacccucaggaaaaggcccuaguuaugagacagugcccaccaaaugggauacaauucagcaggacacuaacugggcggcauuaaauaccauguuaaaaguaugccaucucuagcggauuuucagucucuugacuuaaaauguuccaguguuugauaaccccauaauucagaagauuuaauuugccaguugucauucccuugcccacaugccucuaauagagagucacugugagcauggaugagacaggcucagcccaucccacuccccccgaccccugugcagggauggauuuuuaguuaaagcacggucuuuaccugaaaugcgccuaggcacaucggugauggcaggaagcccagugccccguguggaagacagcggggugguagaguggauggacggggacgucaucuggcucagguaggagggguaagacuggucauaggaccacggcggggaagacugugccugccuggggucugggaaaaagaaaaagaaaaaucuuuaguauagcaaccauugcagccuuagaaacaugcaacccaaaacucagaaaggaaaaagcagaaaaacagggagagaaaaaaaaauggcuuauauauauauaauauauaaggaauggcuauuuaucucuuauaaccccauccuuucaggccuuaaauagcacaaagcguucuagacuuugagucucaaugaaagcaacaaaauggaugaugcauaaagacuauuugucucucucuuccaaauauuucaauuucgaaagucuaauagucauuuagaaaacaaucugcuuugguuaucuuuacaaaguggaauuauauuuauuuucuguaucucuaaaauuccuccagugaacauggauaacuuuuucuaaguuagaauauuuucugaacaauuaacuugguuaaagacuauguagacugugccuuucgcugcugcauauccagcuacuuacuaucuuucagacaugcuuuuugguuuuaaagugcaugauuccaugauuucaucucagggcacuuucuuuucaggcaggucaauggaauggcccuuucuagcauggggugaagggaauaagggcaggaaugagaauggaggggcagcacguaagaugaacaggaaggagggaagccaguuacguuacucucaugcuaaagcuaaaacagaaaauaacccggaagaaaaagacaaaaauuuaauuucaaagucaacuaccauuaagaacugaaaaguuucaucaccagccaguuucaauguuaagcaccauaguuucugacaguaagaaaaugccccaaaacaggagaacggggaaauguuuuuaauccuacuggaaucuguuuagaagaagucacaugucuggaauuuggccuaguguuaccuacagucauuguaauaauaaaacuaaugggcagucagcuguuuagguuuaauugcugaacauuaacaauauuuuuugauguaucucuaggaguuucuuggagguacaaacucaaggccacauagauuuauuaaaagaccuucugcuuauauacagaaaaaaagguaaaugugcuguauguuuccaaagcaaaaaaaguauguauuucaaacucuuuugcucuuacuugagggcuaaucaaacaaaaucauaaccaaauuucucuuaacacguuuuuaugcuaauuuuuaaauuauguuaauuuuuaaaauucuaauagaccaggcuguucacaagauagcuugguaucuuagaauaugcacggacuuuggaauguucagaauuagguccaaguucugagacuucuucuuucuguguaaccuuggcuuaauuacucagucacucugagccucaguuuccucaucuguaaaaggugaggaaggaggggcagcaauaauaccugaaucauaaggauaugaaaauuacaggagaaaacgauuaagagaaaacuagcacaaaauagacuuaauaggcauuaauuauuuuauauacauauauauauuaaaaaaaaaacucugggugacauaggguaaguuccauguuucaaacauaucugaacuggaguuaauacacuuggaauagguuucaaauuaucccuacacaucaccuauuauucuuugaaaauaaaaacuauuaauauacuugaacaguuaauucagguuuaucucuaaaaguaaaaaugaguauaauaagaugcggauuuuuagaucauuccuccguuaaaaccucucaguuuuucuauacagucacagcaguuuaguucagcuauuucuuguuuauuuguucaauucagaaacaauuuauuuaaagauuguuuaaauaggacauacuuccuugagucaaaauaauuaaacacaccuggauauuuaucggauguuuacugacauugacauauacagaaaaaugucauccaauucaauuuuaaagaacauuuaccugaguuugcaauuugaauaaaaaagcaguacuauaagugguuaacaaacuuuuccuucagaaaucuaaaggauaauugaucauuaaaguaacgggcuucugugccuuaaaauucucaaggccgagauuguagagauuggcaacauuucaaaucugagugacugguccuuguuauauaucugauauugacauacuuccuugccuuacaccauuaauguaauucaguauucagagaaacgguaaaugaucuucagauggaaaaagauucauuccuuacagcacaggaaagcagucucgcaagggcaaguccuucucucaagcaacauuuucaaaagacaaagagguugagaaccacauagcuaaauaaguuggguacacaggacucaaauuuggauuugaguucucaucuaacuuccccagaugacuuccugagcaagcaguuuaaccuauaccauuccucuccugcaacaagucauccgucuagggcccccugccuaaaaacaagaacaaauacaaagaaauguaaaaaaugacgaaaaggaauuaggguacucaaccuggauguaagauacaguucuccuugugcagaaaggcggcucaguacagugggaaacaagugggcuuucuagugagaggaucugaguuggcgugccagcuccgcuauugauaagcuguaugaccucaucuggguuagcuaacucugaaucucaguuuccucaucuggaaaaugaggcagcauaauacagaaaagugaauauaguaaaguggucacacauccuggcugugcagacaaaccuaggcuucaguuaaaccucccugcugugcugagcauaucacuuaaacuuuuaggccuugguggcucaucuauaaaaugggaauaaugauacuuauuaggguuuuugugaggauuacaugaacuaggccaugucuaauaugguaccuggcacucuuagcacauauuaaguauauaauaaauacaagagcuaucuauauaaugaauacaauaauaaauacucucauuuuuggaaaaugagauaaugcaaguaaaagcauuuugauaacuauaaaguacuacagaaaaacuauuuugacucucuuuaggagcucacauggugaaggcccugccugagccuugugaccugggcuguguuucucaauguuacugagcuuuaauuuccucaucugcaaaauggagaugauaauacuaucucaaagaguugaauccucagacugaagauuaaauaauauaugguaaauggaaaaucaucauuauuaaaaauaaauauuaaaauaugacucuaugcuaucuaggguagcuggguuugucucauguuguuauucuuaaagacuuccaagaucagauucagcauaacuaaguauaaugccuugcacauaguacucaauaaacaacuauugaaugaaccuuucaggguggcuugagugaauaauaaaauauuaaaauuaagucauaauuaguaauucucuaauuucucuuuaagcuaccaaagagguuuauaucgugagguuuuagguuuuacauccugacugccagaauauauacuagaaaagucuguuaaaggauaguuuugcuuuuaguggaggccuuuccaaauauccaagauuaggaaaaguaaguucucaagaucccuaaacaagucagaagaucuaucuuugucuuuuugucucucagaggauaggcuagagucaagccagucucuuucaaggucacuguccuaagagucuaugagaaugacuuaaagaaagaguuacuaaagaaaaauaaaauaggccgggagcaguggcucacaccuguaaucccaccacuuuggaaggccaaggcaggcagaucaccugaggcugggagcucaagaccagccugaccaacauggagaaagccugucucuacuaaaaacacaaaauuagcugggcgugguggcacaugccuguaaucccagcuacucaggaggcugaggcaggagaaucucuugaacccaagaggcggagguugcggugagccgagaucacgccauugcacuccagcccgggcaacaagagcaaaacugcaucucaaaaaaaaaaaaaaaaaaaaaaaaaggaaauauaagaacugccauaugggguuaugggguucacuagaucuagcauaaaaaacaauuuuaaagaggauagcaaccuuuuaaacaaaagccauggucuccaaacacccccaugccuucucuaauaccuugugaaugagugauuaccaauccaagcuccaccauuuccagacugugugauuggacaaauuacguaucuaagauuaaaguuuccucaucuauaaaaugggaguaaauaagaauaucuccuucauaaaguugucugaugauuaaaugagauaauauaauauagaguuuagcauauggaaagaaccugauaaauguuucccacaguuaaagacucuaucuuacugaaccuucauuuuauauuuguuucuagcccuugaccucuuuuucuggcagaguacaauuuuuaggagagcuuccuguaccguguaguucacaauuuggagcauauauguccguguuagucacguugauauccuuuuacaauggcuuaaccuuaaucauguucuuucuuaaguuuugguuucuucccagagaaauccuaauuuuuuaaguguauuuucaaauacuguacacuuuaaccuuuucaaucuuuuaguggggaaaaaaauggcuguaaaaugucuucacuuccuaaaugcgcaaucaccaagaaaauauaauccugucauaaauacaugauuacaacauauuugcuuuuuauggacaauuauuagugcuuauaguagaggaaagucaccuuaaccugaucucauaaacaauuucugaacucaacuuccugaagaaaccugagacuucugagauuuacucucaaauuggaugagucagaacaggugauagauguuuuucaggcaucaucagucaauccuaaaguuacuaauaggaaagauacaaggccuagcucugagacaaaccuacuaauuaacgacaaacaagaaacugucuuuaucucagccucaggucccacagagcaaggauaauccauccgucacccugccucacccagaguuauauuggauggugugucuuuucaaaucuacagaaacauggagggaagaaccauguccuaacacuccagcauaaacacaaauauccuugacuuuuaaucauggccuuaaggugacacccuggcugacugcaguuauaggucagccagagugucaccucaaagccaugaacuaccuacaaguuuucgggggcuaaaucaaugcuaugucacagaaaguuuccaaaaaaaaaaaaaggaaagaaaacuguugccaggcacgguggcucaggccuggaaucucaguacuuuggaaggccaaguuggguggaucacuugagcccaggaguuggagaccagccuggguaacaggcuuuuguagagacggugaaaccccaccucuacaaaaaaauacaaaaauuauccgggugcagugaaacaugccuguggucccagcuacucuagaggcugaggagggaggaucauuugagccugggaggcacugagucacgccacuguacuccagccugggcgacagagcgagacuuugucucaacaacaacaacaacaaaacuguuguugaacuuuaaauauuuuuauguuuuuuuaaaaacuauaauucauucuuuuuauauggcaaucuucagaaacaguaucaauauuauuuuaauuacuauauuagagaaauucaacaaauugacauguuuuuauauggauaugauauaugaacaacccucugguguuggguuuuuaugcacucacucuugagugcuugggaaaucugaggcacuacguaucacuaaagaugacuccacucuuauuucuccaccaacuucucuccugccaccuaaaauagggggucuuagagggaagugguaaucaaaucugaccuguaacauaaacuugagagagaaaaucaggucuuuccuaucugaugggucugcuguacucacagacaggaugugauugaucaaaaugacuacaugcgagagaagagaacaaagcagaggaccagggcugcuccugcgggcccugaggaugaacccaggaagaaagggguccccagggccgagaaagcacacuaagaaccaccaccaggaauaaagggaaggcuauuuauuggaccccucagaucugcaacaacacauuuucagaagcaaucaugguuuccuccgugagaguagaccaaaucuagcuauuaagaguucagguuaauuucucuuuuucugucuaagguagaagccacugaaagccguaaaaaggaaccagucaucugucauaaggaaucccuucagcauguguuucaaccgaggcaaagucugucacaagcauggaauuguguuuuuaaaaacgcucuaaagauggaaaggaaccauggagcaccaaugucagaaucgauuuuauaaguucuccuucuagggugguguuccuucagcuuagacuucuuggagagugguugcaucugcuuuccauccuauaaaccacaaaacauaaaagcacagaaggcaaaaccguacccagggggugcucaaaaaugcuaguugggagaggggugguuccucugucucaaguugccuuucaucaggcaaaaauggagacaacccuuuauguaaaccuguggagaugaggaaagcaaacagucuuuuuugagcaggaccacagcuucugaaguacaaucacugguauggggaacaaaaaggggguggcuaugcacuuccuacagugauauagaagagucaugagcucuaggagucuccauacuuucaaaugacuaaaaagccaaauuucgcaucugcauaauugaacccuaaacacuuggaguuauauugagaagggaggaaggcagaaaagaaaaaaaaaaaaaaaaggcaucccaggaaaaugaacugacuccgggaaaacauauccaauucucuucugaaugaguaaguuugagugggggcagcagagcaggcagagagcuuucugaaagcccaaagguaugcuggaaacaaggcagcugcuauuagcaaggcuccuuuuguaaacacuuugguuaaacaugugugggugugaaggaggaucugcuuuccuaggaauugcucacaacaaggcacaccagggacagggugcugaacuugaugcagacgggaggaaacaagucaaugggagcaaagccugaacccgcauacaaaaggcuauuuccuguuccugcggccagcaggcuucuguguaacaggacaccauggcagccagugauucugccaaagcugucugcagggaguaccugccguauuggggcaacaagguauaaucaaagauccccacaaucccaccccuuauucuccacccauuuucccccuaaacaguacucaaaucaggcuguguaaaccucaaauauuucuugagaaaacuggggugucaaaaaugauauacagagucuacuggcuuagaacuaugccucuuaauugcuaccagggucaaucauccuaacacagaggagcagauuugccauuuccuaucuuaaacuauuucugucauauuacugucauucauaauacagacauacucacacuuauacauauacacauucauacauacagagauucccauuucaaaacaaucuacacuaaauaugaaauguuaaauucuaugucuuuucuaauaacccugucagcaagacuggaauuuuagaaugagcuuucuucacucauuucugguucucuugacuaacaggaaacuguuuacaaacaaauggccuccuccaagcauaggaagagcccuagacuggaggcucuggcacuaacugugcaggcuuggacgaauaauuuauggccucugagucucacuguuuucaccuguaacaugggaauggguggguuaucucuaagauguuuuccagauacaaaaugcuaugaugcuaaccacucagaagagugagcucccaacccucaguccuuucuggagacuguaacugcaucagaaaugacugaagccaugcagagcugacuugggguggcuaugaaagguagcugacaaugcagcgccucccaucacagagcaucuggcucaugucugcugagaagccccaagagcaaggugcggaccccccuuguccccaccaagggccuucuccaacugaucugguggcuaccagaaucauccagcaggagacagacccgagugacagagucuaaaaaugaaaucugagaaaaaaaagcagcaaacugguuaaaacuggaggcuauguaggguacaccaggcaugaccauagguuauauuacaacacaaacaaugggagaagagagaauuaguaaacuuagaagacaauaagcagagaagagaaugaaaaacgauauguauggccuaagauaucauauccuguaauaaaauguuaaaagaaaaaccagaaggaaguugcauuguuaagacaaggugaugagaagcacucuuauguaucaccaacuuuugcuagauagggaucauaacugucuuacagaaaaggacaggcauuucuuguuuuaaaaaaaucuaauagaagaagaaagaggcuauaccacaugucauaccuguccuggccucucagccuuggcauauccugaaucucaacggcaaagcuagaagagggagagaaaugagauacaaaagggugggacaagaacuugaaaugccacugagaugugaugcuggcaagggagaguggcccuuaguucgaaucauaguauugaacugggugugguaaauucagguucaaaucaggcugaugucaacauccaggaaaucagauaugggcagucgggguauuacagaagguccccaggcauggugauaccugaugucacauggaugauuauauccaucguucuaguaauugucucucauucauucauucaaaaaaauauguaucagguaucuacucugguauuguguaggcacuuggaauauuaauguugaauaaaaauagaccuaaucccuggugcuauggaguuuuaugaccuaaucccuggucccauggaguuuuacaguuggguaggagagacaggcauuaaucaaauaaucauauaacuaugguaaaugcugaaaaagagauguucaugguaccauaaaaugggaacuccaaccacauugagcaucagggaaagcuucucuaagguaguaaagaucaagccaagaccugaaugacaagcauaagucuagaagaugaguaagggagguuaagagggcuuuaggcccguguccaguuccugggaagaaggcaauaucauuuuuuuauguacuugauagaaggccuguguuuagaacauugugaaaaaguuucaaaauauugugagaugagaauggagagcaggcagggaggagccaggcugugcugacccugcugggccaugcuagacauuuuaaucuuuauccuaaaugcaauaggucaccuuagaagauguuuagguauagagugacauaaucagacaugcauuuuuaaaaucucccucuggcagcauccuaaaagaaacagggcagaaguccagucuaggaccaggcgugcaggaaaggguguggagagaaaacaacagcuggaauggacacagggguggaguccaggggcugcacucaggcuucgggcucuuagcugccuccacacaucagcugaucacgggggcgaggcuccugagauggccucaggcuggaucaggaugaguucuggauggguaaggugagccuugaguaauaggccugccuugggccuacagcugggagugauuugggccggcuccaccucacaccuucuaauucagcgguagaaccugggcaucuguauguuuaacaagcuccccaggugaugugauuaugugccaaaguucaagaacaauaggcauaauuuuuauuaaugaaaguuagaaaggaaaauuaccgaacccuauuuugauuuaaucuucccuaucaaaaaggaugaucuuacauagaaagagcagaacaaacgugcauaagaggaaauuaaggcccaagagaagugaggagauaagggagagcagugugcugcuuuagaugaauucaagucucugcuccaagauaaaugacaucccacaacauggcaaaaauguagguaacuaguacucaaggggcugcuucuugauggagcagggucuaaaaaguuuuuccuuagauuaaguaaaauaugccucccuauaacuccaaucacuacuaaucuuaguuuugcucucugggauuacuacuccacaugacagcuguuaaauuacuugaagauaaugccuuuaaaguuuacgacacaaaauacacuagguuuuacauucccuuauuccauuuaucuuauucugaaaacagcauugcuauugguaaaaucuaaguugcugaaacuaaguuguuuuggagccacuguugguguugacuugcuugcagcccacuaaaaacacuuucaauagccagugugcaaagaacuucucacacuucaucccacagugacuaucagaaagcagaaugggcucacuaaaaaacugucuccuagaauuacuaaagcaauagauuagaaggcagcucaucugucuauugcauaucuggaccucagcaagauauaugccuuaucucuaagugauuuauagcuaguuaaaaagccugccagaaaguggucauuaauauauagauuguggucaguuuagacagaguuauaugguggcauaauccagggcacaauagucuuauuucuguccagcaucuucaccaaagucuugaaggauuagaagggaccuuuccaagcuucaagaugagacaaaguugugaggaauaacccaacacaacagaagaagaaucagaacuacaaaauaacccuacaggauggaaagaggaggugaaagcaacaugaugaaaugaaauaagagcaaaaguacagugcugcauuuugucaacuacaagacaggaugggggagccugcuccaagagcagaguuuuucauggacugacagccacagugugaugggauaacaaaaaguuaacacaaacuugggauauauuaacagaauauuaguagaccccuacugaccuggucaggcauagcuagcggauuguguucucaagaggcagcaucaggcuagagcacuggagaagacaggacaaggugugggaccucuaucggucacaugaggaauagcugaagaauggcuaagagcgcccaucuaccuucaaccucuccagaugacacuccuuccccuucccaccugaacgaacacacggauuuccccguuaaauuucccucuuaacccuuccacucagcugcugcucauuuucccaguccagaugggucaaguccucuuuggaaguucuuccaucuaccaaccugcaggacauucccccacaugggaaacuggcucaacaucuuccuuguuccccuguguuguacugaauccuaccuaguccuagcagacagacgguccacgacagccuagcccacuccuagucacaaacuguaaccacugugggagagaaucacauaaucaugccaauuggcucuucccaugaccucuaccuucagcuggguccucaaagaugcucauccaaagucauuuuccauucccaccauucacccuggcaacagcgccaaacauuuuucauucuaaaucuuucccccuacaccuucacccacuccccaccuaaaacuaucugucagguuucaccuuccuaagacacagauuuccaauuucagcucugaggauuucagaaaucuccuagcaccucaguuuucauauucucuauauggaucacaaucugauucuuccguuaaaucuugucuuuuaaagucuauuaaaaccaauuguuuuaagccauuaaaaagcaagucuuuauuacaauaaacaaagcccuaaagagaaucugaugccucuaacugggaguagugccauacaguuauauuccuggaauacuuucgcauacauuaaaaugaaaacacuuuuuagacugaucauaucuauaauauauuauuguugcuauuaauacugcacagucaauguacaccaacucucugugugaagcccugagauauguggaagcauaucacauaaauaauggauaugugaagcauauccauuauuuagugugaaaauauaccaccagggcaucuuugcacaaagcgcaggccuaacuugccccucugcuggguuaccccauaaguuaauauuuccuucaacauuaaucuccuauucugauccuuuugcccauaguccaucacaaaagguaaaacagggcaaaaaaggacccuaagcaacuaauaaaggggacagguaugcauacacguggguguacauauauacguacauauacauauguauauaaaacuaaaacuaaauauaaaacuaaaagagaaagaugauguguuggaaaagaauaggagaacaaaaucaagacuuccucugcauggagaguuaaagacaggcuagaaauggaacuguuuugggggaagaaggauaaaaugaggcauuauauaggagaugaacccuucuuaucacaacuaaguguuaacuaugcaucuuauauucccagauaggagaaaauuacaaagacaauuuuuugaaacaaaaaaauaauuuuucugggaacaucacccucucuacuuuucugaaagcguacuaaagucagaccaucuucaguuaauaagggaaugccaacagacagaaauccaaacagagcaccuuuaagaagcucaucuguggauacugcuaacaggcuaagcaacaacauaacggguugaccaccagcccuucacagaguccuaggaagcuucauucuuuaaagccagcacaggcugcaccuaaagucuacucuuccucauaauguggccaccagagcagaaucaguaugaaauaguguuuacacacaggauuugagcccuuucuaaaaauaaggauugugacuagcaaccuccuguacagauucccugcucacacaugugcaaggcagcagcaaauuugcccagcugccccaccugaaacaucucaaaggaagaagacagggcaaaacuucccaggaacuucagaaauuacaacacugcaccaccaaaguaaaaaagaaccacuuccaacaaucugucuuucaaugcagugacuucaguuccuugacacaaguugccuacaagugagcaggaccacagugacugugaagucugagaauucacuugacucccacucuccuccauacccacacugaugguacccuacugucauucuuccugcucaccaacaguaucugagccucuuauggguccauccacccucacacucacagccaacaucaccccaggcccacuucaucucccaacuuguuucacauuaaagaaucauguggucacucagcacuugaacagaacaguaacuuaagacacaugcaacucagcugugcuuucugauuucugaaaggauuacacuaguaaauguuucgggacaagcacuagaauccuaggacagccaaacauauacacagccuaauuccagcuggccuaauuggcugagguccccuuaauuuuuaaaggaguucuguuugcugagggaauacagaaucagacugaaguuagguggaaaccacuucagucacaguaacugcugauaagauuauuauuagacaggaugucuggcaagcaguuuuuaccuuaaauacaugccuuauauaacuggaauuuaaucauuuaaaugauuauauugaauuuuaaaguauaauucagauauuccuaaugcuaacucccguucaugaaaauauucucucuaaguauccuaaauaauguauaauggacagaagaaaaagaaauuaguccugcaggacacaugucacuuagauuguuggcaacaagcccaaccuaucuugauagggaugaaggugagugcuugcuaagaaucaggaacucacagucaacugcaauagcugaaguagccuucagcaagucauuucuccaagaaucaauuucuuccaucugugaaauauguaccuuuagaauuguuuuaggccuuugguuuguaaaugguaaagaacugaauaaaugaaagugagguacagaaaugggaggaagcugagccaugauaaaaguaccuuucagcuucccaagaguacuuggugguaaguacacagggccauggagcuauggagagcugccuuuacuuccuguauuuaccacuuacuaguaguaagugggaccuugggugaguuauuccaccugucuaccaucaguuuccauaagaaugccuccuaucucauagagcuauugugaggaacguaugaguuaaacuaauuagaacaaugccugacacaugacaagcauuuaauaaaugguaacuaauaguaauucaaucaaacagacacuagaaaaauauuaaggcuaggauaauagugggucccgccuccugaagaggucagugaccccauuuauucacugaucaccgaaccaaaagucacguaguaagcagguaccguguaagacaaugggggacacaaagaugaagaaaacauggcccuagacuuugaaaaguccaaagucugauggaggagacagacaugugaacaguaaucaucagcacauggaacaagauauaaucaaggguuguacaagguggcacgggagccugauucgacucugcuuggauagguuggaagaggcuugacagagguggcagcauuugaucugaguuuugaagaaacaauaaaaauguguuuggaaaaacaagacaaggaagagugucuaggcagagaaaaaagcaugaaauacaauaacauauuaauuuaaaauaaaaaaauaagugaaacuucaaaugaauugcuuguacauuacaaaaggagaaaaagucacaauaaauaacaugauggacuaucuagcagccuaugcagaaguguccagaaucuacuccugagugaagggcaaauaggggucugaaccaaggaaaaaaauauccugugcacuuccuuccagcauuuacaugcagggaaaaucaacuuucauugacugcuuagaaaaacaaccaagacucaaaagaaccaagagcugcuuuuaaaagagaaaggaaaucaugaaagggaacgcugcaaccuaggaagaaucaugagaagggaagccccuugggugucugcaaaggcaguuuuacaagcuacuguaggagugagaaugucgagucucuucuuucuuaguaucuucuuuucuccacccaacugcuucucugagcuccccagccccacuccaccuuauccucccugagucuuccccacaucagugaauggcaccaccauccuccaauugcccaggucaaaacucugaaguccuguuuucccuucaccaucagcgagaguugugaacucucuauuaaaaaaaagagaguauucagaauccuucaguguccuuccaccuccacugcuaccaccauuuacucucucgagcuacuguagcagcuuccugaacauaauucugcuucuuuguuuagccccuuaugguccccucaaacagcauccaaacagguuuuauuaugcauguaaaugacauaaugucauucccuugcuucacaucccccacuacacugguagcccacuacaaucagaacuaaacccaagccacuauuguggcccccaagacuccccauaaucuaggcuuugcaugaguuuccuacugccugaaaugucauuccucacagaucuucaaagcuuuucaaaggaccuuuucucaacuuuccaaucaaaauuagcuccuucccucuccgaguuguuaccuagcaauuauccuauuucauuuucucauagcauucauuauuaucagacauuaucuuauauguaugcuuauuuaccuauuuauugacugugucugacacuaaaauauaagcuccuugugagcagaagcugugucucucucacucacuugcaucaaugccuagcagauaauacgcacucauuaaguauuuuuugaaugagugaaaaacagaauagcaguacaucccccacccuaaaagcgagaugaaugucccaauccaccaaacccaagggccugaaucagcauuauuuuuuagguguagcggacccaucuagaggauaaugaguuuaaagauaucuuaagcgauaucucccaacaucauauccuuacucuauugcuaucgccgcuuucugaaucaaaagaagugaacauuugugacagacuagguguuuccuggcaccuagagacaagcagcagaugucugaaugauaagaggucuagaggaagcaacuuccccaggaagcuguggggaggcccugggccuucagcugaacaucagccauuaaagacuuccacaaaauaucaccaucagacaagcacugcaaagauaccagggagggaauacagaaucagacugaaguuauguggaaaccacuuuaauuagguucuagcuaccacauggcuagaaguuuugguccuaggaacugcaagagacacuggaaaaggcuaacuaugaaacacuaaaugcuuaugacuuccucaauuuaugauugcuaauuucacuucacucuucugggaguuuaaagacgucuucugccuuuuauguuggcaagugggagaacuagaggggacuauauaaccaugaucauuaucuacaguuuugggguaaaagcuugagauaucaagaguagcaagccaauugcagagaggaaacugggcccuuccuguuacaaacgucuuguccaaaggauuacaugaacuaaaaugcagauauggcauauugcaaagaaguuacaaaauccauuacaggcaagaauuuaaauuuagucaugcaauuacauugacccuaaacuugaauaaaaccgaacaguuuaacuaaguaaauguuuuauugaaaugugauuuaagcugcugcccaucacuagggaacaaugacauccugggacaggaaauuagaaagaagaguuaaugcuacuaagacagauaugauauccucucaacccuuauugcaccgauugcuucucaccugaacuuucaauaauucauauuuaaugagacacugccacugggcuagucacaaaagaaaauaaaucccuguaauaaaucccucaaagaauguacaauguagcaggguagaaaagaugaauacacaguauccuuaaaagaaggcaaucuuaacuaaagcuuagaggguggaugaacugccuuuggaugaagguuccagaacuuuuuccugaagaagauaacacaguggccuuggaggauggguggaaucuugucagcagacagagacuacuguagaugggcuggcugaguaaagggguacagagagaagcacguguacucaggaaugguauuacaguuggggcacaggaugugguaugccagggcuggggaggauaacuaucucuucaacuacaacuaagaacagcgcuuuucuucucucuccauauuaccuaacacccaguuugcuacaugugauaggccccaaaucauacuuauugaauaaacaaagaagucaauccagagauuaaaaaauugaaccuauucaauucauuuucgcauugcugcugcuccagauguuccugggcuuuccuuuaaaaauugggucacaguagaacacugcaucuccuugguuauggacagauacaggcauucucucacucacaauaugggaacauuuaaagaaagcucacauggccaagagugguuggggugacaaguauguauguggacaucuggaaauuuggaaaguuugagaaaaguuguuggguccaauaccuaguggauguugaaaaaaaaagaacacuagucuauaaaucaauucuauuacuacuauaaucccaaaaugaagagcacuaauacucauaaaaauuccaagaagcuaucaguaccuagaaauuaacuuguuuuauauuuucauuuucagaaauauauccagugaauguguucccugcccugccaguaacuugcugugcaacugcagacaagaagcuuaacuuccugagcccccuaacagggaagagggugaagagaagcugacaacuggaggagggccaggccuguggagguggccacacucucgaucugcucagaugcauuuguggcacaggugagccccacaccuccucugagccucacucucugcacguguaucugcuaggcggggaugcuacuaaaacacagauccucuucacaauuuuuccagccauugguuucacaauaucuaagguaccuuuagguucuaaaauguccucuggaucuacuuuaugaucucaucuuuagauuuaaggacaaagccuugagagaagcaucuucuuaagugaaucuggcaacacgcagucuccaaaggccauuucuaaagcauuagucauuaacagcauaaauagcaaacaaauaaugaucagaauacagaaaucaaacauuuaaaaagccagugguugccaaaucauggaacauauauuuauauauauuuuauuagucaucauaaauccauuacaaaucauauauaaacacauauauauguguguauauauauacauuugcuucuacaaacacacacacacacacacacacacacagucuaaggauuacuauaaagacaaaaggaaagcuauuuuaugccuuaaugaauaaucuaaagucuacuacuuuuuuuuuuacauauauuuaggggguauaaguauggauuucuuauaugcauauagugcauagaggugaagucugggcuuuuagugcacccauaacccaaacagcaaucauuguacucaagggucauuuuucaacccucaccaccgcccccccacucucccaucuuuuguagucucuaaguccacuacuuuaaaugcagcagcacccauagcuacaagcuucaaauucacaaguuagugugaauuuuacucuuguauuuuuaucaaggacauaugucuagugaacacauugaccuuucaaccccacauaugaaugauuaaaguuuuauauagucuaaaacauggccauucuucaaagagcaauaauguucuuccuuaaugcagauaucugguuaucuuuaguguuuagauguuugauuuuuauaauucuauauuauuuuuuaaaauauacacucaugcaaacucauacauuccgacuaaaauauauacacucacagaaacugaaaccuacucuaaguaacuauccaagaauacauuuacauaauaugggcaggagagaagaagagauaggucauucugcuuauaaacaauuauguuuugagaccauuaagaacauucgagccuaacuacuauaaacaaaaaucuaaccauaaaaaagauccauguugagggcuuauuacacauuuuguuuugacuuacuuucccucuauucuaguccaccucuaccaaugauagcaauuagaugacauguaaacuuccuuucagcucucaauacuuuuaucugcaaauuaaagauuuauaauaauuaauacacucucuugucaucaugaccuaaaagcauucaaacgagucuuuaaauaaaucuguuuuugcacaagugggacaaaaagaaaagaguugggggucuuaaugcaccaaaugugaaugauuagucuguaauguaaugccgauguuaauuucucagaagaaagguaaaguaaguagcugacuagaauuuauaaagagaaaugucuaauggagaaccagagcuaaauguaaaucagaagugaauucugugugcccgaugagccacacauugaccuugccuuauaacuaccaaucaaggcuuccuguucgcccugggcaauuuucaagcagacuuaaugaaauaguuauacauguaagaaauguaagcccaaaucugagaggguaacacuaauuuucuaauaguaagggugugauguuauccccugcaccaccuggauacaauauagaaacguauaauaaacauucucccaaagugcauuauuaccguuccaccaggguguagacugagauugcugcagaguagagcauuaguagaaauaucccccaaaauguuauccccaaguuauugaauguuauuuuuuuuaauaaaaaagaagaaaucagugucuucaagucuugauucuuuaauaauaagccgcuucacagcuccaggaguuuugaagugaacacaucuccucugguagccccucacccccagccugccagcgucuaugcaagugaaaccuaugagucugucuuaccuguaaucugacucuguccuuguggauuaaaaggacuuggugcagaguucagggagggccguggguucugaggcgggacaccuacucucauacugggaugaggaaugcgcccuaaaucacugaggcggucagagaacaaacuagguuuagagucaucaagcuucugucugugcccuggaaauagcaaaucauaaaauaaaagcauauuaauuagcugaacaauugaccaugcuaaauagauaugugaacauacaaacugggaguuuaagccaaggaauuaucaauauuaauauuuauaaugacuugucuacauaaugccuuccauuucaaauugcuuuauaagcgguaucugguggccagcauuccuagcucuguuuuauaaauggagagcugaggucucagaggacaacuugaagucaagcaucaauagagaggcaggauacuagacaccuucucuggcccucucaguaaaaaaaaaaaaaaaaaaaaaaacaaacaggagagauguguauuggggguguuugcuuguuucaugauggaggaaauccccucugaaaguucagagaguccgugcauguuagccacaaugucacaaagcuggagcagagacacggacaaacacauuugucaaagggaaauuuccacgaugaccauagugacuuuucuuuaacguuacaacuacucuuuacuaagacucuuuucuggaaaauuaaaacucaaaccuaaaccccuuuaagaaauaaaaaaacagaaauguaagcagggaaacucaaauucucaagaggaaucuggauauuuugugauaugccaaagcuggaauguguauaauaaacucuguuaaaucagagagaaugcuuuuuuauuuuaaauccacuacugugguuuuggaaaagaagcugaaauacacucuuuaaguaaacaugugacugugacaauccauuauuuggcggagggggggagccuuucuaucucucuucuaguuuauucaagucuaaaagcuaaagaaauucuggguauuagagaaaugcacaaauuaaaacaaaccaagauacuaagacuucuuaaaaaucaucaaaucauucuuaacaaaagacauacuagugucuuggugcaaguauaacagaaaagcaucugaaucuggguguaccacaguagaguaaaucuauaggguggugcuauuggggacaaaugcaaugcuaauagagaaacagaaauggacuggggauuccuuccuccagauucugugccagugaggcccuagggugcugcccuaacauuuuaguaugacuauuaaguaacugaagcugauucgaggaagaaccaccaagaugaugaugggauuaagaguuugccccuugaagagaaacuaagggaauuagaauauuauccauaaaagaaagaaaccuugaagaagguuuaugaaaagccuucaagccugggaguuuuucacuacucuauggguagcgcaaacgccuuagcuuccacuuaauacagaacaagaggaauguaucaggauaggguuaaauugaacauuagaauuucccaacuauaagcugucuucguaagacaaauuccuuauuuuauuugccccaaaauguauuuuccugucuccuuuuucauugccuucccagcccaaagaaaacagauaggaagccaaggcuugguaauaugaguguagcugucuccacggccaaacguguuccaacuaggcccauuaacugaaaugcacccaccacccuauuuccugccagugcaaguuuuugggcaucugcuauaacagaaggacuagaccuaggagaaaaaugaacaggaaaaauuagagaaauucauuguuaaugguuguuuuccccaccauuacuguuuuguauccagauuacaaauagauuuuagaucccuagaggacuuuuagagaugacccaaaacaacuccuagacccuggcaaguaagguguucaccuaugaagugacugaggccugcagagguagaacaacuagcuuaugguccucggcugccgacuagcugagccuucacgaggauauagcccucguccaaguugacugagcuuuccauucaucacguggcaccaucagugcugguauucuagcuuucucuucccuuccucuuccagcugcuauggaggacugaaaauauccagaucauauagagugaaacaccuaagaacuaagcccagugaggugccaaggcuggcuuucaacauaagcagaaguagcaacaaggauucaauuacaaaguuaauaauucacccauuacccuaaacaaauggcuguagccuaacucaccaaacuuccaucaauacaucuugcugggucuaacuaguuucacaauuagggaauuauauaguacuugucacagauccauggagucuguuccucacacucacacacagacacacacaugcacacacauaguauuggugugguguugauacagcuguaaacauuaacaagaaagcuuacggaauugucccuggaaguuauuuuucuuaauaggccauauuuuuggaauggcagguucccugagggcugaggggagggcuacaugaucuugcaugguuccuuuauacacuaggacuuuacgugggccaugggucacaagaaaauuuaauaagcuuugccucugcuuucuauagccuuuucauuagguuuuccuagaggcuguaugagaugugagcucagacuguacaugugugaguacauuuuuacuuucucuuagcccagcguuuucaggaguaauaagaguuugcaggcaaaaauaaaggacuuaggcuaggacugguaagugugaaaaauuuuaaagcaggugaaauuuuaaaacccuucaugaucuuuuggaaauuaucuucaaagaacacuuccaaguaucuacaggcacccuagaauaauucaggaaacauuuaucugcagaugcacacauacaaaaacauacgcauuuuucuuuguagauaucugccccuucacagacaccacugcaaccacaacaaaaugcacucuucauaauguaugaaguacauugaagaacaaaguacauugaagagcaaaagccaaacaaguucuucacauuucaacuaugacaaauaccuguuaccacuaaaccacaucaggguaacacucgaaugaugggcugaaagaagguguacuuaaauccccagcacccaagcaauuccuucagaaauuaagaacauggaagaccaaggacacacugacuaagucaaggauaggguacucugucauagugcagugaggacuaaaccucauccaacgggccaacgaguagauguuccaaacaggaggaggguaugaagaauggaaaauuccuguauuauacuugagacucuauguaaaaaugcucaguccuggaucccuucucuagcugaacuucucccugaauccuuccaucauugcugaauaagaaaauucccuagggagcuuugaaacauggauguccaggccccauaucagaucaauuaaaucagaauuucugauagugggaccuggggaaaaggucucuuuuauucaagauuucaccacaugauccaaucugcagccaggauugagaaccacugcccaaggugaucucagucucaugcacuaaauacuaccuauuuauagcaaugacucccccuuuucugguugagcccugaccucugucuugaguuccagguuuguguguucuacugccuacuugacaucuacccugggaugucccaaaggcaucuuaaaugcaguauauucaaaacagaauuuuuuauucuccccuccaaaaaaauccuauuucucucuaauagucccccaucucaguaaaugacacuagccacucaguuuccuaagccaaaagccuagacauuuuccuugauuucuccuuaucucucacucuccacauucaauccauuaccgaguccugccauuucuuucugaaugcuauaucucaaaucgauucaguucucuccauuucuacugauauaaccuuggccuaagacucuagcauuucucucugggcagcugaaaaucugucuccuuuucaguuucccaucucaagagcuuuccauauuccugaagugcucuccccugauuccuuguagggcccacucuuucuuaccccuuagaccucagaaugaacaccaccuccuaugagaggccuugucugccucccauaaccaaaauagguucccacccucuugaacacacccucucuuuauuuucuuuauggcagucaccacaaucuauaauuaucuuguguauuuauuuuugucucuccuguaagacuguaagucucaugagaaugagcccucugucuuguuuacagcuauaaucucacaaccuaguucagugccugcuacagagugggugcucaguaaauauuuaugcaauaagugaaugaaugaauauucuccucuuuuagauaaauuccuugagugaaagaaaauuuucugguccaggacaucauauuauauauaucauauucuuuccccaaaaaaguucuucuuguuugacaaucuagugaaucuagugggcaaaaccuuucucuagagauaagcccuuacuggugcuuccuacaaaauuuuacugaaggacauucauuuaaguaaaaauuugcuuucuuucuggaaaacccuauucacuuucacuguaauucuuaagcauuguugaaagucacugggaaucagagagaugaaagggcaauagaaaucauuuagacucuaaaguuuagaguaacaugcuucuuuuauggaugaggacccugagucccugagaggggacaugccuuaccuaaagucauauaguuaguggcaggaccagacucaguuuuccugauugcuggccuggggcuguuuucucucccauugccaaccagcuuauuucagcucauaauaguucagcagcagucauucaggggaaaucaugaucaaaaaucaauuuaaaauuaaaaacaaaaaagugguuuccagaaaagauuucuuucaaaaaguugaguguguuuagcugaauaugacuuuuguugcaauaaauucaggggcacaagaagaaagcauaaucaaaaggucacagcauucacacauccuuagagcaaagacaaaugagaaacaguuaagucccuaagccauagucuagcgaaucaccccauugugcccuacccacaaugaaaguuaguaauacuaccauuauaacuucugcuuucaaaaaucacacaucugaaacuggcacacgaagacucugaaaauguggucugugaacuaugaaaguaaacuugacucugugugaugugacccauuuugcccauuuuuaugaaaguugauugagaaacauuuaacaacuucggagagcuacguggcuccccagccagaaacuuacauucucuguauuauauccacaaccugaugcacugcaccagucagcgcacccugaagaaugucaaaaugcacuuacaaaaaacaaggcacuuuucaugaagagugugccaugugaugcccagucuacccuaauauggcacagcagaaucauuuugcugaucacuagggcaugauguuuggcagcucaucuuuuuggaguaguauuuuaacuugauuuuaaaaauucccuagguauuuaccuguauccuaaguaucaugaaaacauaauuuuuaaauaaaauaaaguuuaaaagaagaucuguaauagagcaucaauaaggaagcaguaccauguccauauuugggucaguuagugcagcuaauguguacugguuaucuacuacaugcaagccucacuagguauugugaggaggagaggauagaaaaauauauaagauaauauccuugcccucaaggaguucacagucuaguggggaagaaagcaauuaaauauaacugaagagaggcuguggugagggcaaucacuaaaaugccaugauugcggaucaauugagaaaaucugaauaugaacuguuuuuaaauauuaaggaagugguacuuucugugauuauguagaaaaauguccuucuuauucagaagggcuaacauauaguuagggguuaaauaucauggcaaccaguauuugcuuuacaauauuugggcaaaauaguaggugaggaaauaugccaaaaaauaaauaaaaggugauggguagauaguauuguauucaauauaaucuuuauuuuuauguuugaaauuuuucauaauaaaaaauuuaaaaaguauugaaguauuauaggaagugcaggggagcaauugauuuugacuaaggggaaagaggaaaccucacugacaaaaucaugaugccuguccuugaagguugacuaggauuuugauaagcagagaagaaacaaggaaaguuagcuggaagaaaaaugaugaaaaccugauaauaaauaucuugugagauaagaugaugcuaaauauguguauauauauauauauauauacacacacacacacacacacacacauacauauccaugcacacauauauauacgcuuaucuauauaugugugugauaucaaucuaaacagacgcacaccauucuucaaaccacuuuauaacucuagucuuacuacuauacauuaauucuucuaagcuaugcaguaccuaugggaaucugcccuuuaaagacagcucucagccaggcacaguggcucacaccuguaaucccaacacuuugggaggccgaggcgagcagaucaccugaggucgggaguucgagaccagccugaccaacauugagaaaccccguuucuacuaaaaauaugaaauuagccaggcgugauggcacaugccuguaaucccagcuacucgggaggcugaggcaggagaaucgcuugaacacaggaggcagagguugcggugagcugagaucaagccacugcaacaagugagaaacugggcaacaagugcaaaacuccgucucaaaaaagaaaaaaaaaaaaaaagaaagaaagaaaagaaaggaaaaagacagcucucuuaaugaauaaaaccauacuuuggcaguccaugagccucauccaccaugcauucagacuucacuggaagagagggguaacuggggagacaugagcuaauuuugcugucaccaaguaugugauugaauaaagucugguccaauacucuagggcucaagccacaggauguaacaguuucagaauguugugacaaugaucccuggaguaaaaaggaagagaggagaggacuugcaucagaauuacuauuucucagagaaaauugguuauauguccacagagcugcuauuccacagcaguuuuggaaaaaaauaaugagauccuucacuucuaaucuauccuaaaagugcuacaugaaggaguguguuuguagggaagcguuagggaacagguugacuaauuuuaaagucacgauugcauuccacauguaauuguugcauuucuacuucuaaggaugagccuuacuguaucuuagggaguucagucgaugguuuccagcaaaagcaauagcacaaggaagauuacccagacucaaguacauucuuaggaaagccacgcaaaguucucauccacauacuuuauuauaacuauugaggcucuaaauuuaaaaacuuugauuuucugcauuccuacauacauguaaaaaugaagauacuacggagaaaagugaaagucugcuccucuguuuacguucagaugacuacauuucacuggugguuugugaaugucuaggaaucaaagaccuauacucuuguaauguuuaauuaagcccuuugccccucccuuccuccucaaaccaucccaaccagcuucucuucugauuuccuuauuuucaucaucaucauuuucuagucucucagacucaaaauccagcuuaggcauaucuuugucaccuccuuuccuagacccccaucauccacuccagcccauuucuacaguuucuucaggaaugggccuccacuagaacccuccuaaccucuggccuguggcuaauacaacagaguagcagccuggcauauuuggaagggcaccaaaauggaacccuguuggucuuagcuuccucgucuaccaaaaaaugaagaguuaguuuccauaauuucugaaauucuuucugcccccaaauccuaacauucaugucacuuaccugcucaaaaccuuucaauugucuuccauugucuauugaauuaaauagagcccccugagcccagcaaauaaggaccuggaaaauauggucgcaauaugcguugucacucucauuuccaauggcuacaacuguacugcucccagcuugugcucuacucacacuggucuaucgacaguccaaauacacccugugccuuugcucaagcuguccccuccacuuggaacacccucuccgcaucaacuccguuuggcaaaaucccuuccaagcucaacuuggucaucacauuguucugguguuuccugucucgagagccuugaugaucccucugauuuauaucccagcaagcugacagcagcgacaacuauguuuugucuacuacaugugguuaugcuuaugugcaguaggcauccaguaagcauucacuuacuaugaauugacauaaaauauuuauacaaaauuucaaacccuaauauuuuagauuuuccuagacuugacugagagccccuuaaggaugggugucacauuuuaugucuagcacaaacuuggagccuagguacagagaagucacacaacaaaugauugcugaauuaaaaaauaagaacauggauaaauuuaaaauuaucuguacuuuuguccaguaaagacaaagaagacagaaaaaaaaaaagcugguuauugggaaacauuucccacaguaaaauugaugagucuauaaucuuugcugggaaaggcugcugcgucaucuuuuucccuaagagugcacugucugauucaggucagaaacuauuucuggacuagaauaaugaaaugggcuaagaaacugucuucauguuuaaggccucuagcccuuugagccgcuggaaauuaauagccaugcaauaugauacaggauagcucgugaguagagacagcccuagaacaauguuaguguguggcuucagacacaggaccacagaucauaaacaaaucugcuuccagaagauucuucucugauggcauuucaaaaaugagcuaacagagcuucucucuaagggcccuucuuaauacauaaaccaauuucuaaaggaaaaaaaucauaaucacuaccacauaucuucaagaguccccuuucagcucuuaaacagagucaggcacguaagauucggcguuuaucaagagagaagagaggaagaacaauuucacccaagacaggucuaaagccuuuccagucucuugggugaaacauaauuaugggaagaaaaauauaaucuacucaagagacauaauuacaugguuaaaccauagacuccauagaaauauucuagggacuccauuucauagaaaaaauguuaaaagcugaguuugauuucuuuuaauacuaaaaggcacccauuuagaccagugacauaaaguucacuaucucaaucucauauguagucauauuuaaauacaauuagaugugugugagagagaagugaaggccugcuccuuucaaaauuuaggcuucuaaggauugaagaauucgagaucuuugaauaaauucauaaauaaauaaaagaauuguacaauguuaauuugaaugucuauaaaugcaaguuccuuuauaacuuuuagguuuuaggcuguggcgaaucacaacaaucaaagcauacagugucugggagaaaggacaguuaucaggcuacgccaauaucagucaaacuucaggaaauaaauuauaauaaacacgugcuuacaguauaaucccuuuucuucagauaauggacuaaaaaaacuugagacgucugaagaaaaagaaacuucauaggagguaggaagcaaaaaaggauuaaaaaauuuuuuaaaaagauuggaugaaagcaucauggaaauauacaagaugagaaguaauacuuuuugcaggcaggaaaaaaagagcuaaccgggaauccggcuaacuucgccguagcuccucucccauguccuaauacaccucuaaccuacuaugcuucuuuauuacaacucuacugguauuuucucauuucagaccuacuacucaaauuugucugccuguuguuuccaagggaugcuuccaucccuccuuacuccaauucaaaguaaaauuauaugaauuaggauuuuucagaguuguaagagaauauagauuucaucagacuggguucuucauuuuagagaaauaauuaaugcccagaaaaauacugagacuagcuuuaaagucauggaacuaggcagugacacugggaggcaguccccuaaacugccugagccuccuuuuuccuauaccaggcugccacugagggaaagaagaaaacguggagcaaagagaccagaaggagacauuaagaaaaagugcagaagcuuacuucaaagauguuauuacauuaugcccagucucucugacuccguuuuaucacuuguucuccuacuaauuacaacugaacauucacaccauccuggaccaugugaaucuuuaucucucccuugacuuuaugggaaaugaacaaaaaaacucuuucucuaugucuacacuuuacuuccaaaacuuaguaaaacuugaguguuuuaguuccaaaaacauuuucuuugccuucuuuuucuguaacauguucacacauaccacaguucuuuguguuucgagcacuuauagagaccccacugagagaugcaaagauuuuuuuagcgguaacauuuuuagcaauggaaauagcaguuuucguaguugaacaaaaagcaucacuguuuauuugccaauccagcuaaacauggauggcauuauucuucaaagagugcagugacaacuagccuacaaacagacugucacgcaauuccuggauccuggcucaauuuccuuagcaugcgauccuuucuauuucucuuucauuauuaagguuuugugcauauuuuaugugagacagagagugagacagagacagagacagagaaacagagagacagaguguuuuaagcaaaaagaaacacuacacagauguaauuaaaaaggcaaagggcuccucucuugacauucacugcugcagcagcagaacaucauucucaauuuucucauuucuguaacaggaagaaaauguuaaaaaguaauaaccaaagaaaaagucagccaacucccacagccuggucuugcugugcugaauggcagagaagaucacagaggaagaaaaaagaaaaagacagaaaaaaggaggcggagaauuucuugcuuaaacuggaccuaguccagcuggcaagaagaggugguuuucuuaacgccugcaaaaccugauuacuuuuuuuaaaggaaugaagaagaaggagauguaaacacagccauuaaaacagauuuaagguacuuaguuuuaaucuagucuaagaccuuuucaauuguaugcugcucugcaauucucugcuugcuagacauuaauacagugcauaggcacaugucagugucuucuaaccagugaacgcuuucagcugagcucugugguuacccucucaggucaggcauggaaggaacagcagcuuaagcaauaauggaugcaugucuguuacgugcuaugucugucagaagucuguuuuacgacauuaaaggacuauuguguuuauaucuacacaacaggucuuaaacagauuguuuaaacaugauuaaacaagagacgucuuugaaauaaccccccuaauaaaauucagauggguaaagaacugaaaaaugcagucaacaauauuuugaaaaaucauuucucucuaagcugcaagaguaacaugauauaaacuccaaaauaaaacuguuuuuacaaguuaaacucaaaggauuaccucauauaucagcaccgcuuuccaauggaauagcguuuauccaccuauccauccacucuuucuuaaugcuguugcacaaguugcuagucuugauagacagauaauugcuuuauucagccagguguaaugaaggggagucuauuguguuaaucccaguauucuuaucuucugugaacucugaauaaggaacugaaaacucuaccucuucauuucagaacuacuggaguuuacucacauucaaaucuguuaaaguguucuuacaugccacucugucacuaaaggugccaaguauuuugaguaggaucaaguuaucguuauauaaaaaggaaucaaauguaguguuaaauggaguuagaagauagcaaguuuuacucuucuuuucaaggcacaacagauuuuuuuaaaguguauuauucucaagccaaaggaagcagguugguguggguuaauauuaaaaaacauccuucgagcgauuacauuuaaaaccuuuuuuuguuuuucaaaagcaaguguaguguuaaguuuuguggauaucugccugcuggcuucaugcugaauuauuuaaucaauaaugacaguuuggcaaaauguuuuucuuugguccauaugaaauauauucccuuuuccacauauacguacauauaugugguuauaaauuuauauuaucucuauuauaugcauaccuauguguacagagaggaauaauccagccagaggaacagcguuacuacuaacauuaguuccaugucucuauccagguaauuagggauaccguccucucaaggccccacaugcuuuauacucugccccaugacaucacaaacacuucugaucacaagcauaccuuucuuugcaauagaaacguaccuuucuuugcaauaggaaguucucauccuucagccuaauuagaugccuucauuuuaguucaaaaugauacauaccgaagaaccuaugaagcucacuggaaaagaaguaaugcaaucuggaagaaugggauaaucccugaaagaauauuaucauuuaauucuuucucuucuggguccuaucucuuucauggaccuuucauugagaauguucucaggaauggcauucuuucugcucagaggaugggcucuucucaagauuuaacuugccuaaugucucaacaaauccuacuaacaacccuugcaauucaacacagaaagucuguccuauugcgugcaccuuaaucucagcuacucuggaggcugaggcaggagaacagcuugaacccaggagguggagguugcagugagccgagauggugccacugcacuccagccugggcgacagagagacuccaucuuaaaauaaaaagaaaagaaaagaaaagaaaaaaaaagucuguccuauggaauugaugacugcccaaaaugcaguaugaaagagaacaugugacugaaaggagacauggguucugcuacuaauagcaagugugaacuucucagguacagaauuuucucaucuguaaaauaacaggugaccuaauuugcaauccuaagaaucaauaaagcuauggauuccucaccugucacuaugaguuccacaaauacacacacacacacacacacacacauuuacacacaauuagugaacuuaauggaauaguuaaaagaccaaggcagugucugauuaaaaaggagaaucucauuucuaauucugggccugacuauacaaggagcaggaaaacuugggagucuauuccuagcucugcuacuaaguuaguugugaggcuguaggcaaauaucuaucaucucuaugauucaauuuccuccuaugacucaacuuccucaucugucagaaaaaaacaaaguaucuacaacacagggaugucgucaggacaaaauguaauaagaggugaaaauguccuacacagguaaaaccacuaugcaaauguaaucuucacuuaucaauuaaaauauccuaagcauuauuauguuucaugaacuaugcuaaacuagggugcucacgguauacuggaggcaucauaaaaacaaauaauuacagcagugugauaaauaauauaauuaaaguaugaaaaggaaaccaaagaggagccaaagauuaaauacuugacuuucaagagcagucaggaagggcucccagaggagacagcguuugaguagacuuaaagaaugaguagaauuuagucaagcaaaugcagaagaagauaacauuccaaccagaaggaacagcaggugcaaagacaccgagaugagaaaguauagagugaagcaauuuggcaucgcuggagcucagccacagguguguggguggaaggcaguugggcagagcagaugcugaagggccuugucagugugccaccaagucugaacuucauccugcaaauaacagggagacacugaaguauuuuaagcaagggugugccaugcauugguuuacaguuuaggaagauugcuuuacuuacaggggaagauagauuuagaagggagugcaguuagagacauaaaaccaguuaggaaauuguuuuuacguuauaagucagaagauaaacacugagagaguauacuaagcuaaaucagcacuaaaagauuugagggagugaaugugagacauagaauagagguacagacaacaguacaguggaauaauuagaugucagaaguaaggcagagaaggugagucucagguuucugguuuggucaccugggugaacuguagggcacucaaaacugguaaaacuggaggagguucauguuugggcagagaaguuugguugaaguagagguggggaaucccuaacgcuguguuggccaugaguuugaaguacccaugggacauauucaggugcagacacccaggaagcaaccuagaaauaccagucugaaguucagaagagacugaagaugcauuuucaguggucaugggaacacgaaguuaauagugucaaugaggacacucagggaauggguacagaacgaguggagaaaagugucuaaaagggaacccugagaagcaaacacuccuaggguggcuaggcaaggaagaggaacacaaaaagugaucuaggaaagagaaagaugaggagccaguggcggagacaacccaugcaguggccacugaaacgguucugaaucugcucuucugcugcuucagggacccaggggagcuuagcaagagaaccuuugucuguguccaggcaagggacacaaaguuaggucacaaugguaaaaaggauaacucuccuucauucauuccauacccauuccucaugcagccucaucaaucccaauggcuucaaguuccuaugacuauggaaaaugcauuuccaguuucuaccaagcuucagauucauauuucuaaaugcuuccuguacauccuugcauaagaauaccucuaaugauauucauuauuuaaagggaaagauagauuuagaagggaaaaaugucuaaauacuauuagagguauucuuauacaaagauguauuauuuucuaauauuucaaaauggagcccuagacuggucuauaauuuuauauaccaggucgcaguauaaacuuuuauuucuuaacacuaauuugaaaagaaaugcaugcacagugucuucugaguucaaucuuagucauguuauuuuaaacaaaugggagaauuuuuuacccagucuaaaagcccucccaacugcaugacaaucagcccuuucugggccaagucacaagucagacaauggcucuguaugugucacuugcacaggccagagaguaggcaaaauuuguucucguccaaauauuauauagggaaagccaacaucagagucagcaucaaagaugagggaaaucaaaagaaaacaugaagcaacaacaaaaaucuccaaaauuaaccauccuccccagccuaucuucugagcaagguccuuccuccccaaaggcuccuugaaucucauggggcaguauagcugaccacuuauccuaccauuugccacuccaguaagcuuaggagaaauauggaaacaaaauaaaacagacucacucccucuuuuccaucccauuucugcauucucauuucuguugucuaucagaaaguaacaaacccugagcaacguauaguggaauggaagaacagaauccaucuguuauggauggagaaauggcagggauccaaugcaacuaguacaaaugauaucauuuauagagcugcaaacuuaacuaauaaacacauauaaaagggcuugagaaagaaagucugagccaccaaguuggccugaagauuuuuggaccucuuacuuuucccuauaaaaaacagaacaccagagguugcuaaaaucuagaacaauuuagaaugucccuugaaaaaacaugauuaucaucguuuuguaaugggcuuauuuucuaguauuucaagaucaggcccuagggcuauaauuuuauguaccaguucaccguauaaauuguuauuccuuaacacuaaucugaaaacaaacuucaauauguauuuaaaagacuaauucagauaccugaucuacuuuguucaacugaaucauaucaguugaauaucuagaaugugcaaaacguuaucauauuguagugguacagcucuaguaggggagaucaauaaauacagaacuaaaaaaugacagaauuguuaaaauacuagagaaaguggcauuuaaaauuagcucugaauguugaauaggcccuagauuaauagagcagaucaccacugagguggaaggaaccaccuaagcuaaagcacuaaggcaugugauauuauaucuccaugccauaccuuccaucaguauaccugcacauggagccagggauaagacagugaaagacauauaguguuagucuccuaaaagucaucaucuaucuaccuagaauuuuauaaccaagaauuucugccaauaagucuaauuucuaaucuucaagauucagcucaaacgccuugacuucaauaaaaccuccccuccacccucaaauagaaguaaaaauguuucugaacuuccaugucacuccaguugccacuuucuuaugcccuuucucauguucuaucacuuucugucacauaaucauaguuauuaauacccaugucuuaucuccuaaaacagauuaagcuucuuuuuuuuuuuuuuuuuuaagauggagucuuacucugucgcccaggcuggagugcaguggugcaaucuuggcucauugcagccuccaccucccagguucaagcgacucuccugccucagccuccucaguagcugggauuacaggcacgugccaccacacccggagauuaagcuucuuucuagcccaugugaugggccagagaugggucagaacucagucaucaucucugaauucccacagcccuuucuuaaagugccuaugguagguacccaguaaguguuuguugaauaaauaaauuauugaauucagagugugauucagugaccaaagguucuaugugcuagcaaccauucuacuuaauaaaagcagcucucacuacaaaaacaaauaaggcaauagaaaaagccaucucaaccauucacagucauagauuauuuugccuucuuccucuaggauaagaaaugaaaagcuggacucaacaucuauuaaguacuccccgagagucugaugcucaaagggacauuucaacuccccagcauuaccaacagccagacuaaacucuacagacucugauaagaucccaggcuuauuaacagaugugaacaaacaucgaugguuuguuuauauuucuucuacagcaaagacuaaccaggaagacugcccacuccucucaaaaaaaaagauaaaauccacaaugauuucucacaaugcacacauuguauugucuacugaaauacacacacacacacacacacacacacacacacauauauaaaacauaaaaauaugguggccauuguuuaauaucuuuuccuaacuuaguuuauucccaaauauucccuagccauuauacaaacuaaacuuuuauucacuuuaccuuuuacucuacuauaccuaucucuagggcacaauagcacugugacaaauuaguucagagaaaguuuuauagccccugaugcugggcaaagggaaaaaaaaaaaaagaaaacagaaaagccaacuaaaucugcacuaaggguuuggacagacagaaugcaauuaaccugaccuuaagauguguuuucaggguugacaaaucauauuucacuggauuaagggcaauuuuucuuuucuuuuaaagacaaaaucauuuggcgcagauaauaauucagacauuuacaccugaaguggcggugcugcggcagcugagccugcuucuuuccaggaccuggugaccaugguggcauuugugaaaacggaaagaaaacaucuaacuuucacaacuaugaccgaggaagaaaacuugacauucauucccacauaugugacuccuuucaagaacuccugacucaaaauuucagagggaaguggcccuguaauaacaucucuucugagaauagugccauaugguuuuaacagagguuuauuuccugaacccaaagagggcugcugauucucaauccaacgaaaauaauuaugcagacaauuucacucuauuacuuucagugaaacccauucugugugguccacacaugccugcugacaccuucaaagagacauuaagccauuuuuauguaccauacccuuaauggguggaauguaagguaaauuuccuugaagauuagcaccugucgucaagcauaaggcaacaccgccgccaccgcucccccaccuuugaguaccacauguuaauucucagagugggucaaagaaaaggagagagauguguccaucuuccaaguuaaguaacaacuuauuaucaguuagauauuaaggcaaacauacacacaaacacacauacacgcgcacauacacacgaacuggaaauacuacaucucccaaagucaacagcacugcugggaaauuacuucagacacaauuggcaggugggaggaaugggggaggguggagcugggggguguggggaaccacucccuuguguaaauucuagcaacauucaacugcuaaccuuaaaauaaucaagagaauaggaaaauaaaaucccuucagcgcaaaggcugaacaacacaaaugcuguauaaauaaagauuuaaaccaaggaauacaacuauuaaauaguucuuucaaagaagaccacccuuuaagccuaagaauauucccuuaagaacaaaauaugcuaacucacaccagguugccccugaaucucaauuuuauuacacuagcuggguaugaaaugaacugguucucccuuucagacgacuaaagauuauugagcuugaaaaugaacuggugaaaacaggcuuuuauuuugccaacauacuuggcccauugcagaaagauacccuuuuccucccauaagaucuuugcuuucuaauacccacccaccucucuuugaaucaauacagaaacaagcaaaaaaaauuacaguuucucuagauguccacggguguuucacuaaaucgaaccaaaaucacgaauacucuuuaaaagagagagacagagacaaagacuauaaggaaagcaguguccaggccacagggucagagcaggaaccagauacaagccagcacaguauuaaccacaaggcaggcccaaaggcugcuccgggacuguuuucuuuagacugccuaaaaguccugccaagaaacagacggaugcugcugaaagaauaucuuccacagcugggcaucuggguucagugacagacagccccgcuccuguguguguggccugcagaacauaucgaaagccuaggagggaauauuuggcagaaugggagaaaaccuaaggauguucuuucugggggagaggggaauguaauuccaacaucauauacaucugacugaaacuuugccuuuguuccugacacccagacuuaaauuuuguuucucacuuuugcuauccguuucugaugucugcuuacuuauuggguagagaaagcccucugcucacuuuccuuuccaguaauaccuuuacaucuaguuuuugcaccaggcagcacuaaggcuauuuuguuuuuaacaauccaggggacuauuuagauaaaaaauaaacuaaaaaucuugaaauuucuuaaaaacagaaacaauuaaaaaauggccuagucgugcaugagaauuacuaucaaacaagcuucaguuaauuuucuuaaauuaaaaaaaagaagaaccaagaacccacuuaccuucauucaucagauuuauuuucuuaaagcauaagcaguaucaaaguuuaacuuuaauaguauacugguuaaaacaguaaaacaaaaacagggcucuaucaaagaaaaaagaccagccucuacuauaugcccuucaaaggaaaaacucagcgcuuaauagagaaaaggaagguaaaucugagaaauuaaccauuaauagacaauaccuaacuuccgauuuugauggaauaauaggacacugucuucaugauuauccuauuuaaauagcuuugaaaauguuggccgggcagcgguggcucacgccuguaaucccagcacuuugggaggccgaggaggacgaggucaggagaucaagaccauccuggcuaacaaggugaaaccccaucucuauuaaaaauacaaaaaauuagcugggcgugguggugggcgccuguagucccagcugcuggggaggcugaggcaggagaauggcaugaaccugggaggcggagcuugcagugagccgagaucgcgccaccacacuccagccugggcgacacagcgagacuccaucucaaaaaaaaaaaaaaagaaagaaagaaaaugucuggggcgagggauguagguaccacuugaguucuacaugcacaggaaaaaauaugcacaaaacacccugcuuuucaggaacuuagaaagaggaugauucccugacuuauauccauaaauaucucccaaacgcuagcacuuuguuaggaagucauacacacuccuuacaaccaggaacuuauuuguucuggaccuacuuuuuaauguaacaaaucuggugacaucaaugaguggaaaucacuuuaucaaauuuaaaaguugaggcaccuuugcuaaaaagaaugggaaaaaaugcaguaguaauuuuccacccccauucccaacccccaaguguccacgucccaagauggcuccuggguuggcuuucuaucaucuuggcucuaacuagcaaaacugaaaagcuauaccguuauuauucccacaaugccauuauuauguaagcuuuugucaaaucucaaauuuggggccuugaauccacaaagucuaagccaauuucucugggacagagugguagaggaaauggguuaaaaugaaucaguuuaauuucuauggaaacuuuuuugcccucacaaaagccacaggacucgccagagucuugagcuaacaaguauaagagcuacaagaguuugaggcaugucuucagagaaauauauuacaaggggaaacaggccuguuagugagacauuuuaaugcccaaucauggugcuacaaaaaggcacaguuucugagucccaagggaaaaccucauagagaccaggagaaguauuuccgguaccaaagaaaggacaaucugaucaaaagacaaucuuggacucacauggaggccagguugcuuuuucugaguaucaggguccacagugaucucaucccccaaaucugugguacucuugucuguaucacucaugugacauuuaucauacacuucuuuguaaucuccucuggcagaugcuuaacuucccaguucuacguaaaauccuugaaggcagaguacaucuuuauacuccauugugucucucaaacuacaagaagagcugguuuuuaauugacugauucaacccaagucuggcauuuuucuaucaagcugggcucugggcgaggcucaaaugcaucugaggcaagagauggaaagaaaguaaugaaaauuaaucaugucauuuggccauaucauuuucuuggaucacuuuacauggucucuacauucaaagacaaauacuuccuacuucagaaaaaauuauaaacaaagagcuguuaaguuucuucuuguaaauaguaacgaacuuuuguugauuagcaccuaugguucgacuaauuauuuaauaaaugaaaacacaaccaugaaaacuacacauugccagaguacugcaguuggauuggcagaaaaaauaucuacuuuuccaguggcgauagugugugcaguagcuuaaauguguuuuucauugucaaaggggucugauuucuuucauauggauauuguuaggaggcugaggguucgugacggaguuaagaugacagaaaaugaagccauggcaggaaagacugcacaaaugcuugaugcuccucuaguuagagaugaaagguggguggagugagcacugggcuuuccuagcucaugucauuggagagggauacucaaaaaaguugaaagcuuucaguucuuggaaaucucgcuuacucuuuagacucuauguguuagaaggagaucuugagggaauuacccauagugguuuugagguuuuugaauaaagggagaaaacagggaaauuguacaggcaucccaauugacuucacaaguugauuugaucuguacauuucagaauugaaugaaaaagaagcacuuucuccguauuuucucuacaguguuugaaugcugguucuugcuauguguagagaaugaucuuaucuuuaauaauaauuccaguggacacauauucauaaguauguguacagaccaaaccauaggccuauaggcuaugugcuuuucugauauuauuuuguacuauuagaaguuuaugacaugaggauaaaauguaaauguuauaaaaacaaaaguaaguuuuaaauguuaaaauaaaaaccaaccuuuucuuuuuucuuuacaaauauucuuuuaaaauuaaccauucauuuacccgauaaacauucacugggcaccuacuaugugcaagacacuuugcuauuaauagaaacacuggggaauauaaccucuuauaacauguaaauaacauaaagggucuauauccccaaggaccuuacaagcugguagguaauagcuguacacaaauaacuaacaugaagcaguauguuuuaagaauucuaagugccacaucuggaugcugcaaaauuuuagacugaaggaaaauuuaaugggguguaugccauucaagcuaaagagauaaaauuucaaaaggcagaaaugaaagaaauauauucaaaucaaaaggugccacaugaaaagagaugugcaauugggaaaaggcaaggcauguucaccaacagugagagcaguuuggcuaaagcagugguucucagcucagguaguacaaacuccuugggaguuugggaaauauguggaggcaguuuugauuguuacaugauugggggugugcagcuguaaucuggugggcauaggcuaaugaugccaguuguccugcaaugggacaguccuacagaaugaaaaguuuuuccacauuccucaugacuuuugggacauacaccagacauucaaguaggugaaaaaaaaucugguuauaauuaccugagccuagaaccuaguucuacuuaaauauaaagggauuuuuuucccuaaaguuuuaacacauuggguuuucuaggaauaaaaccaucuagaaaccaaagacaaagcauauuuuguuucauuaggagcuucaacaagaguugcucuacauuucagaaaaucuucgcuaacaguaacaucauucuuaguguuugaguuacuaauaugcaccugcaucaaucuugauuuguagcugucauauucaaggugguuuuacacauguucaagaagcuggcuaguucauuguguuuucuagcauguucucuaaguauuuagauauuaaaauauaugaauauaauuuuguuuuaaauuagguuccuuuauuuuucuuuuauacuaugguaauggcaucagagugaucuuucagaaauuguguggauauauuuagaaaaucuacagauuucauugaggauaguaaagagagauuauugaguauucguuacaaaaaggagguguuggcccuaauacauuugagaaguacggggcuaaaauguguguaagaaagugacugcaguuguaaugauaagacugggcuaaguuauucugggcauagggaaacagccugagaagccuguacuugguugaguagcauguggggcaccacagagaguuucacaacaugaaggccucagguugacaugaucaaagcugagaucgaggaaaacugaguuacagcacugcaugaaaagaacuuuaaggagaaagaggcugguagcuagaagaauaauugguaaucacuacaauucccuauauuaagguaaggaaagguuaguuuuuacagagauauauuauuuaaagaucaaaaggauuuuguggcauuaguuuuaggcauaagggagaugggacauugaagacggcuagaaugaaagauaaagauuugggaguuguucauuaagucaaggugacugcucacaugauagugucuuugaugagcaagcaaggaaacaggaagaaaggaaagccaagucagaacuuuuggcaauguccauuuguccacuuguaggagguagaugaguggcugggggcgguggggguggcgguucuaaaagauaaagcaggccuggugcaguguuucaugccuauaaucccaacacuuugggaggccgaagcagguggaucacuugaggucaggaguucgagaccagccuggccaacauagugaaaccccaccucuacuaaaaauacacaaauuagccaggugugguggugugcgucuguagucccaguuacuugggaggcugagguaggugaaucgcuugaacccgggaggcagagguugcagucagcugagaucacgccacugcacuccagccugagcgacagagggagacuucgucucaaaaaauaaaaguaaauaaauaaauaaauaaaagauaaagcaaaagagaaagaggaccagucauacaggcaggagaaaauuagaauaugauauggaagagaccaaggauggaggcagaaggggucaccaacaggauuauaccugcaaagaggccaaggaucaugaggacugaaagucggccagaguaaggcauggaccauggcuaagcaaccuucaagacaacagucaagccgugggagcagaagccagacugcaggaggcucagcgugaguaggcaaugaggaaaugaaggcgacaagucuaagugacucuuuccagaaguuuggugguuaggagcaagaaaaauaaaauaucaucucaaaagaguaagaaaggaaagggauguuuuagcacaaucugaccaaauaaauauuaaagcauugcaggaauuguuugucaguuucuuaucugucgaauaaaugaacugaaucaaagcagccuuuguuacaacucuaagguucuaugaugagcuacucaggcauacaaauuacacugguuaagaaaugaagcauuccuaacaaaaaucuguuuaauggaaauaggauuuaucucuccaggagacagaaagaggggaaaagauaaauuacguacuccuacuggaauccuacuaaaaacuacacagcauuagaauacuggaaggucucucaccaaggccaccugugaagagaugucaaugccauccuggccacccuucuuggagaccugaaagaucaucacacaaccagacugggagcuguauuguagccuggcaagggcucaggcuuggauguugaugcuggauuccaguccugacucugcaggucacuggguuugaggacuugggcacacuaccuaacuucuccccauuuuuuucuucacauuuaaauugaaaucacacuaguaccucagaggguuaucguaaauacuuuauaauauuaguuauuauuuuuaguuuucuuuuuuuuuuuaagacggaguuucacucuuguugcccaggcuggagugcaauggcgggaucucggcucacugcaaccucagccucccugguucaagcgauucuccugccucagccuccugaguagcuaggauuacaggcgcccaccacacucggcuaauuuuuuuguauuuuuaguagagauaggauuucaccauguuggccagguuggucucgaacuccccgccucaagugauccgcccgccucggcuucccaaagugcugggauuacaggcaugagccacugcacucggccuauuuuuaguuuucuuaacaucucaagauuagagcuacugcugcaauuuagcaggcauggaacuaaggcauagaaaaaagaaguagggcgggguacagucgcucacgccuauaaucccagaaauuugagaggccaagguggguguauugcuugcguccagcaguucgaaaccagccugggcaacauggugaaacccugucuccacuaaagauacaaaaaaaaaaaaaaauuagccaggcguggugguaugugccuguagucccagcuacucaagaggcugaggugggagaaucaccugagccuagaggcuucagugagccaaaauuguacuucugaacuccagccugggcaauugaaaugagaucuugucuaaaaaaaaaaaaccaaaaagaaaaaaauaaaaauaaaaacagaaaaauuaaguaguuuucaucaaguuccuacagauacagaccagaaggcaaauuucuaaaacaucauaugaccauaugaccauaucaacuagacaaggccacuuuuuaauuaacugaaaaguuuauacuuguucagauuaauuaaauauuaauauuuauuauauaagguaugcauaguacuaaaauuagaguccuuugagaauaggacucuugaccaauaauauuuauuauccaggcagaacacccucaaaauaucauauaauuaaccaugaaggauuaauauuucagaaggaugaaauaagaguugucauauuuccauuucacugcccuuagaugaucuugcugagcaaugucucugaaagauccucugggauuauaacaggaacuuggaguuuucagaguaucuauggaaugccuacaagaaauggauggauuggccaaggcuuauaaauacaucaaaaagcagguaaccuuauuucagaagcauacugcucucccugagccaccgagugauuuauaaggaaccauggcagagacaaaagaaagagucacauauaaauucuaaaguauuuccccagcuuauaaacauuuuuucuuauaaggcucaaaagauggcaaaucuuguauauacucaagaaucagcaccacucccagaguuuccuuguguuugaaagcagugaacuggccauaugauagauaaauguuccagacacuuaagcagcugccacaaucccacugugcaucaagagauauugugauucacacccaccagaggguuuguccagacaacuuuaaaaagcuuaaauccuaccaaggcacaguuaaauaccuaugguuaugaaaaugacagcuucugaugugacugauaggaaaauauucauuaggguaaaaugagaaaagugaaugaacaggcuaccuagcugcucaaucauauacagauucugaaagaggaaauuccuuuguuuucuguaagaaagugaguuuuggauaaugcucggacauugaccuaagcugguuuuuccagcucuguagagaguaaagcaacagauagaaaaaucugguuugaagcagcucaugcaacccaagggccgcuguagauagaguuuuagaaugcugacacuuaucaaaaagaaguaaaggacuuguauuucacuuuacauuauucucaugucaucauucuagcccaucaucacuaaaaagaaaaaaaaaaguuuauauuuaggguauaaaugucuuggguuuagcaaucaauuaacaguucacuuauucauuugaaaacuuuacuguuaacuacuaccugacagauacugggcugggaccuugcacauaagggugaaaagacacagucccugauacacagagaaccaauaaaugaucacuuaggagccaaacugucucugauguuguaaacauuuuuuuuuuuuuuuagacggagucucgcucugucgcccaggcuggaaugcaggggcgugaucucggcucacugcaagcuccaccucccggguucacgccauucuccugccucagccuccugaguagcugggacuacaggcaccugccaccacgccuggcuaauuuuuuguauuuuuaguagggacgggguuucacuguguuaaccaggauggucucgaucuccugaccucgugauucaccugccucagccucccaaugugcugggauuacaggcgugagccaccgugcccggcugauguugugaacauuuuucuaauuucaaacacaguccacaaugaguccaacucauugucaaauuagucuuaucucacaaauuaaugaagauagaaacauuuccauuaauauguguauuuccaagacaaaguaaagaucuggaugcaaaucccucacuguacugucucaaagcugacccagaauaaugaauaaacugagauacccuauucuuuccagggaaaaguaaacugaaagaaaaagggaacaaaaauaaaaggagggagaauucauuuuuuuaaaaaaagcauuuaaacaaauuugaguaucgcuguauagauuucuuugcuuuacauuaucauacuuacacugagaaaauccaucaguuuuaguucuacuggcaagacaaaaggaaaaaaaccagcauacaccaaaugaaauaaagacuaaaguuggaaagaauuuuucuccccagcuagaaagaaaauaucuccuuguuuuggaauaauaaggucaccuaaaaugccuuaauggcagucuauuuagcauaugguccaccuuauaacauuacuuuaauauuugaugucuuagucaauucauucuguuuuuaauaugccugaggaugauauaaaugccuccuuguacagacuuuuccucuuguuucuguauggaaagauuuuauuucuguuggagaguaaugguaugcauuuuauuuccauuggaaaguaucagcauguauuuuauuuccugugcuuacaagaccaaaaagaaaagugacccaggaacuaaaccauuugguaaagacuccuucuuuuuaaaagucauugaucaauauuugguagaaagagaaacugccugcgaugugcuccuuucaggucagauacccaaguggcugcuggucuguaaaggugccugugccacuguaugcauccuucacauagggccagauggggacaacuucagccucagguucugcccagccagcagaacucugggguuagacaagcaacuuguuccuuuacucacaugagcacagagggacaauacuacacuacgacucacugugguaauugaugaugccuuccagacauccaugucaaaauuaacuugcaauugaugcucacuugcuuaaguuucauucaaguucaaauuauuugcucugaaagggaacuguuuacuuuuguacacacuuugauuucaaccuccaaaaccauugcuagaaauuaaucuuaaccacugaacaugugcuuuaaaacccaaacccaaguccgucauuuuaacaacaucaauuacaaauauacuguuuuaaaaacucuauugugaauaguggcauauugucaccacacaaaucauuaaaaccagaguccuagcccugacgaauuauucaaaacuacaguucagaaauuaguaagcacauuauuucaugcuuaagguuuguuuucagccaguuugagagcucauuuauucauguaucuguuuauucucaccuaaaucuccagguacaauguucuguggucuucuuauacaucccucccacagauacacauaagaccuauaagacuaucgaugucaaugagaagcaauagcagaacugucauaccccaucagcuuaauguugaguaaacgguggaguaccaaugccgcccccuucuuauuucccuggaaaggauccaagcagcacuuucacugaauuagaaguagaaacauggguugcuuaacauauggauauaaauaacugcagugcaccucauugauucuaaauccuuucauguauuuaaggcaauuuccuuaaagcagacugucaggaauggaaccucuuuuuucucucuuuauuuuuaaucaggguuucucuguacauuuugcuuuauuuaucugaaugucuuuuuuauuauuuguuuguaugagggucacacgaauggcuggggggcuuauauuugacagaauucuuuagcagcuggacaagccaaaucuggucauguguucuagccacagcugcccugggaacauuuuuaaagcuaguaauuuauauugucaaaucacauuuaaaaaaaaguugcagcaaccaauuaauaucgauaauucauuuaauaaaaaucauuaauucacuuagcaaauuauguaguaggcaccgaagaaauacaaaaucuaauggaccuaaucccucaaaaaacaaaaaaaaaaaauaguaagccucauucuaucacuauuuggcuuccucccacacauuuccugcccuuaagcauguuuguaguccaugcuuagaacagagcuuagaagagugcccagacuagugccaagaacagcaaugguacauaguaggugcuuaauauucuugucgauugacuucagacucauuucaugaguguuuccccaucuuaagacauuccuuccuuuugcacuuuccuucuccaugauguugauacugacuuuaaauggcauauauauuuccugggucucaucacacugggguugugcgaguacuuuuccagcuggcuucuuugccucuauacaucccuucccuucuacgucuuccguauauuugguuccucuuguuuuccccaccaaaucaaaauaucucuguugcuucacaacacuggagcacuucuguggacagagguagaauggauccagucccuguaauucccugucagguggcaauccaaagcccucccuucaacuaucuuguuggggaguucaugaggccacccuacugccugcuccauuaacugagacuuuucugaauagcuuuuacagcccugcaucauuagccugauucuaccuauucaaugugauuuuccucuucuccccaacauucauccucuguuccaaaccagcuguucuuacuucuucacauucccuggucuuucccuucccugugccuguaacacaugccuucaguccaccuaauccaucauaaccauuuucuucaggaccuaauuuccuccaagugaucuugucuuucuuucaaaauuucuauuacacgcuaaggauaguaugacuuuuacauuuauguugcauuuuacaaaugacaaaauuuuacuauacacuauccucuaaaauaaccauuauagguagguguuauuauauuucuauuuuucugcugaagaugccaaggcucugagagacaaagugguuugucaagggucacucacucuuuuuuuuuuaagaguuggggucuugcuauacugcccaggcuggagugcaguggcuauuaacaagugcaaucauagcacaugacagccucgaacuccuggccucaagugauccuccugccucagccucccaaguagaugggacuacaggugcaugccaccaaacccagcucaagggucacucguucuuaacaguucagcacaagagcuccauuaugccauauccccuuccgguuacugccccauuucccugcucccuuuaaacauccugaaaguguguucacuuucuaaauucauuguacucaccuccuagccuccauuucucuuaauuuucaacaaaugaucuuuugaaucuauccuugcacugacaucuuuuuugccaagaucaucaaugccuuccacaccgccaaacucaaugacaguccuuggucagcaaaauuugacacaguuggugacauucuucuugaacagaguccuuugcugccugaauaccacauucuuugggacucuuccuaucucacugguuguaccuacucagggucccacauuggcuccucuuccuaaucccuauuuccaauguugagaauuacccccagggaucuguccuuggcccucuucucuaucuaaaauuauuuauuccaguccuaugacuuuaaauaccacaccagauuugaccuagagccugaaggccaacucauggucuagcuccuacuugaucugugccuuccacgcaccauucucugcccccaacuaucucuguggccucaugucauaccacuuucccauucacucacucugcugcagccacacuggccugcuugcuaucccauaaccaugccaaagagcugggccucaaugccuuugcucuugacauucugcuaccuagauauugauagauggcucgcucccuauuuaauucaagccuccgcucaaauguugccccaucagcaaggccugacugaccuacaugaaaaaucauccaccucccucccucuguccccuuacccugguucuuuuuucuuuaaaguacuuaucacuaucugcauauuugcauauuauauauauucauuuguuugcuuauugucucccucuuucaauagaacacaaguuccaagagggaaacaauuuuguacauuuuguuaaaggcuauauuccuaacacauagaagaaugucugucauauggcagggcucaauaaacacuuguugaaagaaugaacaugugauagccgaauugaauacacagugccaucuaauuguuuauuaauuauagcacuaucuccaggaccauauuuuaauucuuccaaaguaaaacuuugugccuuauauuccaaacuuguguguagcuggcauacuuguaggcacacagcaggugcucaguaaauacuguggcugccugguugaugugagcaacguagagaaaagcaggaucagaauuucaaguauauucagcaauucaaguauauucaguuauuuuuagguaauucuaugauuuuuacaaagaaaauuaacuguuauaucucugcucugugggaauacgguuuuugauacugaaaauggaagaucaugauguaugugaccauaagaauguguacaaauaacuauaaacaugucaagcucugggguucuuuauggcaagaacccaagcuaaaguaaauucaacugaaagaagaguaaggguugagacuaaagagagaauaugggaugucaagaaauccagacagaaauaagggcugcuuaaugucacauacacacagggaaaaggaaauuaaucaggagaggggaaggaagaaggcaaguggcucaaagcuucagguuacugucagguuuuagaaacagagaauacagcuacgcauuucuguuggcaaguuuuuuccaagaggacagauuguggaccuugagguuuugcauccauaacauuugcccucugaaaccagagacauuaacaaaagagcaccucaggaauuugaaggagucaagagguucuguauguuuccagaucauacuuagagccacuuuuucccuccugccacagauuauuacauaugaguuuuauguagaaugaauauaugaaccuugaaagguccauucagcuaacuggaagauuccauucgcaguuuauuuuucauauauuuuuacugaaaugucuuauaccagagaggaaaaauaaucaaaauuuuauuguugauuuaauuuauuuacuuggcaaaaaggauuagaaacugaaggagaucauaauguauuugccaguuaacacauuggugacacggaauaaauguauaguuuaucaaaauugucacagcugauuccuuaguaacccaauauuucuaucugauuucucaauguuacaaaagugaaacacagacucuagguaguuucaucaagaauguaagaugcuuaacaaauacucuucauugccuaaaaguuggcacuguuuuuguuuuuaauuuccuaccccaagccgggcacgguggcucaugccuguaaucccagcacuuugggaggcugagguggguggaucaccugaggucgggaguuugagaccagccugaccaacauggggaaaccccgucccuacuaaaaauacaaaaauuagccaggcaugguggcaggcaccuguaaucccagcuacucaggaggcugaggcaggagaaucucuugaacccaggaggcggaggcugcagugagcugagaucgcgccauugcacuccagccuccaggcuaggcaacaagagugaaacucugucaaaaaaaaaaaaaaaauccuaucccagaauuuaucauugcauuugauuagaucccauauagacugucagagagccuucauugccuguuaaaccuucauaugccugugagcuuccuugucauauuaaccagacaaaugcauuuuagagccaccucugcacacuuuucacaaagcuuuuaaccacaauggcugacugggccucuauguuuuuccacucagucccaggcucucaucagccaagcugccauugcccuggcuuauuucuucuacuuuguucuaugggccagccuccccaaccuagucuccuacuuuucucuacuucacuuagccuccuugaugucaaaagucacacuagaaaggcugcuuuaguuuuuacaagcguugaauaaaaaauaauaauaauucaaauugcauuuucagguagacuuuuaguagcuuaaggcaaagcaugugccaagaagaaugcuucuucuuuuccagauauacuuaugaacugaaaauguuauacuuuucaggauuuuuagagucuucaaaucuacauccucucaucuuucauguuucuagaauuccaaaaauaggaaaaagcauugucugacaugggaucuuccuuccaccuucccuucuccagucacccuaucuccuauggagaugguccaggaggaaaaaagaacuaccuuaccugcugauucagccaucccugcccugacuugcagccuucuucuguugggaaagguuaagcauuaccuuucccuuccauccuuaguaaugaacaagcugcuacacuaaaaaggcaauguuuucuuuuuuucuacauaucucuuuuucuccauuaauucugcuuuucuuugauccuccaccagagcaauucagaacaaaaacuacaacuauguaacccccaaaauugauuugaauuuuuuuuucuucacauguaucugauuccuacuuacuuuugcccccuccucccaaaaaaaugcauauaaaaauuggcuagcuucuaguuagaguaaucugaaauuauuuuggaugugguaaaauagugacaucuuacacauuuuucuucaaauucacagcaggaaccuuuuuucaacuugaauuugauuugaaucauacuaaccaauuucaaauaugaaauguucaacacagaugugugauccugggcaaguucucuaauuucuccagccuucuuuaucacuugaaaaagggcaucuucucugucugcuuuacagaguuguugugaagucaucaauguuauuacaaacuuuguaugcuaugcaaauacagaauauauuauuuucugaaaacccagcccauagggcaggucugagcauccuuugcuaagguauacauaagccacuccaaaagaugacauaaagagauggagccuugaggaagucugaagaggaaacccaagagacccucaaagcaugcuuagagugcccaacauagcauauucuuauucgauuagcauaccaaacaucuugugagcaccuauaaaacagaacagagauaaaaggaaaaaagagacaagaagaaaagcaaggagaagaauguacacuucauaugaguugucuucugaggcaggcaaccauaucagaaaauaaugcagugggcuguaauguuuuuaaaggaauagauuuuauaccaauuuuuguaaaucaauuuucaaaauguucauuuuuaaucgaacaggauuuaccauuuugcgauuaagacucaggguauaggucagucaauuccuuugaauaauuaaaaaauaaaaucaguuuagaaaaugcaaaaauguauaaaauaaaaaguauaugugaauauauauucauacauacaaauacauuuaggaaaaaguaguaaaaggaauuaugucaaaauauuaacugagauuaucuuugguguugaguuucaaaugacuuuuuaccuuuuuuucaaugcuuucugaauuuucugaaauguuuacaacagaucuuccuguauacuaauuaaauuaaguaaauguuauuucaaauguaaaaagaaauaauuggcagcacugagcaucauauauaugcuuuuguuacuaguccuaacaaugucguauuuucaccaaaacagaauuuuuuccacauaaucuaaauuaucaaaaacuaaaaguaugauuaccucucuacaauggcagggcauuuaucuacaaugcuauuaaagacuaacaggauaaacaaauccuguaagguacaugagaauauucauuucuugugaccaauaauaauugcaguuucucuaagaagaaaagauggcuuaguaaagauaagcaaagcccaaugaacuuaaaggcguauugcugauugucacgggagucucucuuuaccuugcuccuucaccuuccacccuaguccaucacacuucacacugugcuaaagauaaauaaaaggacuacaaauuaagcccuuuauggaccuuuacgggugcuaaucucggguuuauacucaauucugcuggaggcccuuucaaguuagacucucaaaguuauuucagcagcacuuagcauucucaaaagcccuggacagagcagccauggugcaaauguuugcucaauuaacguagaaauaaacaauauggauacguuauuaaagcugauuuucuuuccuaaaauuaccuucuuuuaauuaccaagcucaccaagaacaaaagcaucuaaauaucaacauuagaauuuuacuggaauauaauuauuugucaauuaaaaaugaaauaaaacuuaaaaaagaagaauuucccugaauuucuacaguuacuuuguaaguuguauagaggucuugggauuuaagaugcuauuguacaaauaauauuuucuaacgcaguuguuuuaaauaauuucuaaaccacgagcuuuccaacagccuggccacauuuauguggaggagaacggugagacuauguuuucuuuucuuuuuuuucuucccaaagucucacugucgcccaggcuggagugcaauggcacgaucucggcucacugcagccuccaccucccagguucaagcgauucuccugccucaaccuccuaaguaguugggacuacagucgccugccaccaugcccagcaaauuuuuauauuuuuaguagagacgggguuucacuauguuggcaaggcuggucucgaacuccugaccucaagugauccaccugccucagccucccaaaguacugggauuacaggcaugagccagcaugcccggccugagacuguguuuuccugaagugaaaacuaucaaaauccauucuaagaacugaccaaauagcaccaggaauagaaguaggaauagaacucagcuaugguucagcuggaggaccucauugcuguaacaaaaguacauacacacacacauacauagauaaauaccuacauacauacauaaucuucugauagacuuuuuggagcaauuugucccaauuuagaaaggaaugaaaggagacauuuauaaauuagccggaaaugccaccuauuccuucaaacacaaggauuucucccuuccccauaaaaguuuuuguuuacagcuaagagaugacucauccuguugaguucuuagcagagaggcauuuagcaaaagugguaauaaccaaaggcaucuaucuagaucaucagauuuccuuccucuggucaguuugugccacaaaucucaugcuacgaaagcuacauuucauccuucagugucagauuuuuuccaauucaguugcaaauuuuuauuuauuuauauuucaguuuuccuaacaagagaauaaagaaauggugccuccauaccacagaagggcuucuccaccuauaucugacaguggguugacccucagcaagaaugagugguuggggcugguaugucuugcaaaguccuuuuccauuaacuuacuuccauucaaaugcuaccacugggcuacgaggugacaaauuaacuacaaucaguuucucuauucaccauccucagcauagcuccaacacaaucuagaaugaaagcaaaggaagaggcaucucuccuucucuucauucaggcuauuuggcucuaccaaggaacugcugcaccaggucucacaaaauauagaaccaauauauaauauacagaaaggggacaaaaauauguucuguaaaaaauaaaaugaauguucauccugcguuuuggaccaucagugcuuuccuaauuauacaauccaaaaacucuuggaucccuggccccagcaaauuuccuugcuauaucagaucugugccaacaauguagacuuucauaaauacccaaagagagucaauguggggaaucuccugagacaugaucaaagcacaggaccuucacugacacacucuccaaaccauccacuuuuguucccuuugaaucucaagaccuucauaaaagccuccauccuucuugauugugcuuuaggcauuaucauggccauguguccagccuucuagaaagcccugaccacugaaagcucucacucugucucuaucacaguaccucuuaaggaaagggagacugguuuauaagucuuaaguaaaguccucaggggagaacagauaaucaaacacuuuuuguggguauaccaguggguguucuguugcuucagauaaccuaguauauccucaguuucacagcuuauuccucaggaaaacagagccagccucaguuacugcagaaaauauggaacuggcccuccacuguccccacauagguaaugaagagaccuuuccuauagcaacguguuugagaagagcguucuuuuuuauaaagauaaacaacaggaggaaaccaaaccucucuccagcugauuuuccuucccacuaucaauccuguggccucacagcaaaaaaggagggccacuaauccccuuuagguuggcuuuucccaugaagagacagcuguagcuuuuacaaaucuuuagaagagguuugaaaauaaaucaucuuggggggaggggugggggagacccaaauguaaaaaucauaagaaggacaucagaagugccaaggaccacuaagaaaaugucauggacaaugaagaaaggagggcaguggaagaaagcaaguugugacuucugacccaucuucaacugugggugguucuccaccagugauggugcuuuggaaggguaaaguguaguggcuaagggucuaaauguucuuaaugagccauggagcccaaguuauuuugggaggaaagaaaaauaggcuuucugaguauuuuuccuuuccccuagccuggcaccacacccacucagccuucuuccuuguugugucaccuguuucgaagucuguuucuuuggucucuugauuauuuuuuucccuuagagaaaauuguaugcacuuaguucaaaacaagaacucaucuaaaacacugugcucgugugcaugugugugucuguguguguguguacaugcuuuguuucucaucguuucaucaaugagcuaucagugagugcuuaaagcaaaccaugugcagguguacuaauuaauuauuacaaaaguugcucagacagguauuuaauaagcaaaagaaugaauuaaaaaauaaacuuaaaaauacaaacucugaugcuuggcuucuccaagaaaaguuaacccugaaaacagggcucuuucuuuccugcagcuccagcuccaaagcugaaaggaaugguguguucagccagccuuucucagacuugcucugcucaacuucacuucucugccagucuuuaaaugcaugaagguuucuguuuucagaaauaaauccugccuauuuccucucuguuuccuucccugugacaauaaauuccuugagguugauuuuuggauugcaucacucaagcuccagguuauacgaacuuuggugucaccuggaaauguuuuuaauuucuccccauagggaggaacagacaaaaaugaaucaauuucauaaagcccccuaccuuuucuaucuggaauauacaaaucaaaugaacguggguuuuucuaacaauaaaacauuaucccccucaguccaaaauuaauaaugcaccuauucugauuaucaguaacaauuuuuugaucauauggcagaucuguuucucuuuuuggucauauuuuucucaauuaaagauucuaauggccacagagucaagacaaauuacccucauuauuuauguccacaaaccucugcgagucugagcuucagaauuauaauggaaaacagaaaucaugccuuugauuuugaaagcagaaagguggcacuuuguugcacuuuauaaacacacagagaaucacuaaaauggaagguauuugaaaagcccuccauucaagcccucauccuucagcaaccuguacuauuuaacaauucuuauagucaagaaguucuucuuuaaaucuaaccuaauucauuugaaaccuauucuuucucugaccuugccagaaacaaaacagcuggucaccauacauagcuuaauaacucucauaauuuugagucuguuauuaagucauuuuucagucuccucuucuugaagcuaaacgaucccaagucuuucaacuuauccucauagguucaauuuuacaagccuuuaaucaucaucaaugcucuucgcuaaacauucugaaguuuuccauguugcucuuauguuuugaaacccagaucaccuucgggauugcuucucauuguccacauaagccaaggcuuuacugcaugauacauaguccuaagagaaucuacuuauauagguagccuacagcuuuguuuggguuauuuuuaguacaagcccacuccuauugcucuucaucuaagaaaacauguuauucgggacccagaauucuuacggagccccagcuacagacaagccauucccccuccaccuccucccacucgauuuuucucaccagagcucuucaaggucuuucucaaccugcuuucccuaccaauuugggucuugugguccucugcuauaaaauaaguaucuagcuaaucugauuugauucacuuauuuaaaccaaguuguucaccaaaaauggcuuagaauguguuauccuuuguagauaacaucuaugaacauccuguccucgaagccuuaacucgaagaagaaucucaggcaccuggugagaaugauaagagagugguuuggggccaggagggaugaacaugaagaguccuuuugugcuccucuaauuacaccacaccagccuuggguacaauuauaaacagccacuuuugggugugugaguccagucuacuuuuuuugcaaccucuucccaaccauguaggcauugcuaaugcccucucaccuugcaaaauuagauauuagauucugauacugacuguguucaagguuugcacacaauguaccuuuugccuugaugucucuucccccaacucuuccucaaacuggcuucuucucacccuuuaggucugugcuccgaugucaucuccccagacaggccuuccuuggaccacucuucaauagguuccauccuguucccucccacuccauuacucuuuacuaugacaucaguucccuuuacagcacuuaucacaauuugcaauuagaugugauuauagagaaauguuuguuuacuuguuucuugccuuuuuucucuacagaauguaggcuccucaaagggaggaucacgccugccuggcaccuggcuaacaguaagcacucaaaaguaauuuuuugaaugaauaaauguucccaugccggaaauauuuacauuuuaaaacacaucucuaauugucaccaaaaaaaaggcucugucagcuauuuuaaagggagaugguauuuucaguggugggacaggguugggggaggaacggaucuuucucagauccaucuagucccacaucauucaggcagcacaggcccuucacaucacagaggcagccauuaacuggaaacaauugucgguucuauugucaugcuccuuuuccuuacagcaauuauccucauuuccaguuauucgcucuccuuugagcuucaauguggucaugccauucuguagcauuccaucauuuuccugauguuauuuccccaacuucuguuaucuuucauaacaguaccagcauuaucuaucacagaauaucugggagauacacaucacgauguuaguagugguaaucuugggagaugcaauuaugagugaucucugucuucuucuuuguuauuauuaguuuuuauuuucuagugugcaauuuuuucacuugugcaauuuuuuaaaguuaauuuuuuuuaaguacuaaauucauuucacugguauucaaaguaagauucuauugagguuaaguuauacaauguauuauuuucaucucacaaaauucaguguuuucagcuguuaaaaugaauucaauacucauucaacaaacaugccuauguccaugaacugcaugcccacucugugccaggccuuauaacuuugacuucuguacuauucagcgaugcuacugcagcauuaagcaugcuucuuauguaacacugcuucaucacaucaaccaagaauccccugggcccaacacuuacacagacuugacaaacggcaacaggauaaacaggaaaauaucuggaauccuugccugucucuauaaaucaucugcugacuugcagaguaacauaggacaaaugaguucucagguguccaugccucaguuuaccuauguguaaaaugcauaacgccucccucagagagauguacagagaaucacugagguaaugucuaagcauuuggaacuccuuggcagaaaggcgcuacauaauuacuaauugguauuuaagcugcccuucaugugugccaaguacuuuaugaucauuccuuaggaguuacucccagcuacuuugugaaguugccuucaugucuauuuccauuugaaagaugaagaaauagaaguagagaaaaguuuagugguuugcuuaaggucacaaagauggcaaugaggucucaaaagaagaauuccugaguccuccaauccccuuagccauaagggaauccaccucuuaaacacaaacuacccuuacagauuaauucccuguuaagcuacucugaaauagccuucaugguagaaaacacauugucacuuguuuuuguaggcuggaguaaacagugagggggugaaacagaaaccaaagcucuagaauuaguaacccagacuucacacucacccuucuuuuuacacaucuauauuucuccucacuucuuguagaacaaccugcauuugguaccuucaucaucuccuugaagggcccaucuuugccuacuaauaauuuccugggccaauccuaaggaggcauaaggcccagauuaaucauccugaguaucccccgcaaccaaaauacaugcuagcguuuuuacccagauuguaucucauaaaauuuaacuccaaggagguaaaugagaagaugagaaugcauguuguggagggugcauaugcauucugagaguucacggcaaggcagaaagcaccagcuugcuucagugucaucugaugucuuccccaccugccaacuacugcacaaccccaggaagacacacaccgagccagcacuggagucaccccauccaccuugcccagagcuagucucaccccagaucguggucuccuggcccuuuuaaaccauguuccucuaguccacacauuauuuucuucccucuucuuaauucguugauucguuuacccuacaaaagacagcucuugugguucugaguccuguacucucaccaaaaugacagaaacguguggacaccaauaucuaaggauuccugcuccgguugcucagggagcaacagccacaugaccucugcagagcaaguguaaugguggaguucuuuaacauaaauuuggauaaaaaguuccaaagcaacucagugccugcccauggcaaaaguguaaaauaagggauuuaauuuccuccccguuugcuuucuccucugcaggaacauucccucugaccuccuccccacucacugacccuagaccucuccagaguucuccagagugacaggagcuuagaaacauuucccuuccaccaucuuucaugaauauuaucuguccuguguuccauuuccuuaaauacuacuccagcuaaccugauaauaaugaccugaaaguuucaauacaaaggaaugacuggaaguguggaucucaggcacucaaagcagacaggcuuucagcagaacgccucucacaucaccgcauguuggcagcagcuaacacacacaacugcuaacauuuucaggaauaaaaacucucugagaguuucacacuaacaguuucucauugaaggaauuacugaaggaucuacaucaagaaaaaagcaaacucaacuuaaaaggaagaacuaaggugaaagaaggaaugauaagcaaaugaaucaauaaacauaauggauaaauacaaguauaaacauuuuuuaaacaccgauaaugacuaauccaggaaauauaaaacaaggaucuacuaaaauaucagauaacgacauuagaagagagggggugagacugcaguuuaaagaaugcuaaaguucuuguauggacagagaucaugauuaauuuuaauaagacaaauauacauauuaaaaugguaaagauaauacuaaaauaaaagaaacacauucaaugauaacuugcaaaccaauagaguaggaaagcuagcauguaucuagaacaacagaaaaggaauacucugaaaggaaaacauuugcaaaagagagagauauggaaauacagaacccuaaaacucucaccuuucaauaacaaaaucuugcacucuuaagaguauaucagaacuggaaagcaucaggaaugcucauugcuacaguugaccugcagcaaaacugugaugccugaaguuggcaaccacuggccucaaggccggcaaagguccugccugcugcacacugccacucacuguuuacuuucuaguacccaggauuucacugaccacuccuccccuaucuuccaaaaccuacuucccaaaaaaugauucuaugucacuuguuuuuaucuuaauaagaauuuaagucugaguuaccuuuuccaggggugcuuggguuuaagccuuaaaccuaaauuuuaaugaagaguuuuggucuuccaacaaauagauuuucaccaccagugugcaguagcagagaaauuaugagaacuggagcccuuccuuugcuacuuacaaacacagucuuuuauuuuaacuguuacauaugaucuugaauuaauauuuuagaccuaaaugguuuuuaugccuuuucuuaauuuccaaaauuacuugaacaaacaagagcaauuaauuauuuuuuauaccugcuuaaauaaaaacuuuagagauuuuaugugaaggccaaagauguucuuuaguugacaucauaaauguauccuauaaaaaugcuagguauggacagguaugaaugggaaaagcaauacaacaaaucuuuuuuuucccugcuauuuuuaaguauguccuauucacuggucuagucuuccuugaagaaauugccauggcacaaacaaaauagaggugaacagaauauuucagugaucuaucaggaauuaucuuucuugagaacgaaaggucauuauuauuuaaaaaaaaaaaaaagagagacaaaaaaagggggggaggggaaccucuuucucucaagucccugucaagucccuaacacuauuuucagaaugaaugaucucugacuuacacuaagauacaaacuacugacacauuuggaucaagcauguauguguuuuuagaacacauaucacuugaaaacuugccaugcuauauuuaguuagaaguaaauauaucaacuggaacauaugcauguggaaacugugcucuugcugugaaagcuacagcaccuuguuaacacaaguccaauacaaugaaaacgcauauucagagcugggaagccagggaagagugcaaaggagggacacgagcauguuuuaacggcugugauaauuugccaugaaaggauguuaaugccauagcuccuugcugcagcaugccaugugcugcugaauuaaauuacugccaugcagucugcgagcgaaggaauguguaaacaggccauauauccuugcaucaguuccacagaauguugcacaacacaaaaugccucucgaugugucauuuccuucuuggcuaucuucccagcuccugacagccagucaacaaaaaaaaaggacugaaagauauuuaaaacuggucuucucaagagcacauuccaccaaccaccagacauaaccuccaccagcgcuucugacccauccccccgccccccucauccuucuugaagaaagggaaacagagaacagugggguuuucuuacuguuauuauucucuuaaguuaaagauuuucaacgauguuuuauauacugguagccaagugauuaauaucuaugacaaucaaauugcugcuuguauuugccaacuuguaaauaucaaaacauggcauuuacccauaaauucuauuccuugggcacuucggagacagugaagaacccaggggaagucugaaagucaggaaguuaagggcuucucuacuaaugcuuugugcuaaggacuaaaacccaggccugcagcaucuggggcauggcacaaaggcuaucaagguuuuuucaaaucauccucacagacugcaagaaugugaaugcaagaacuguguccagaagaaucaaauaaucuuaaaaaauacaucugcugucccucuauccaacauauuuuacauguacccucaccuuauuucacaugugaccaaucucuaaauaagcaucuuccugggccgggcgcgguggcucacaccuauaaucccaacauuuugggaagcugaggcgggugaaucaccaggucaggaguuugagaccagccuggccaacauggugaaaucccgucuccacuaaaaauacaaaaaauuagccaggugugguggcacacacuuguaaucccagcuacucaggaggcugaggcaggagaaucgcuugaacccaggagguggagguugcagugagccgagaucccgccacugcacuccagccugggagacagagcaagacuccaucugaaauaaaauaaaauaaaauaagcauccucuuuugguaaauaagcaaaagucaugggcuagccuuuggcauaaaaagucuauuccuucacccaacuaagaugaaaaguaauggaggauaaaagcgagcugccgcugacaucagcuggaaugaggaagagaaaaaugucaaccccuccauucucuccacccuucaccaggcuggaaagcagucccagaacuagguggaacagcguaagagaaaaaugagaugaugucuugccuacaccaccuguuucguuaagucuguucacucaaguuuguuaagguaaaacuucugcaauuggacaugccucaaaaauacagagaaauaaaacuucucugaacaauuacagauuuguugaugaauugggcacaacugagaauaagcaaacaggaaaagaaaauaguuuagcugcaggaccuaagccuaacaagcugagugaagcaggauacuaaggcaagccuagaaauaccaacaguacccuauacuuccagauaaccucucacuaaccuaagccccagacccuuacugaagcuacacacaaagacaagcagagaaauguugcagccauguacucugagcuugcaagaaaggagcuagaucaccggagggaaaaaggcagagcuucuccuuuuucccaccagguugagacagguggcuggcugaucaguggugaaugccagugcccuggcaggaaguacacaauucacagcuuuggucucuccuugagaguaaauaugguuuaccuaccugagacccgacacacaaaaauuuuuagaaacccacucacaugugucaggcaguagguuugccaaggugccagcaagcaagaauuucaaaguuggaugauacaaaguauaaaaccucuaaucuuggccaggcgcaguggcucacgccuguaaucccagcacuuugggaggccgaggcgggcagaucaccugaggucaggaggucgauaucagucggccaacauggcaaaaucccgucucuacuaaaaauauaaaaauuagccaggcauggugguacacaccuguaauccuagcuauuugggaggcugaggcaggguaauugcuugaaucuggaagauggagguugcagugagccuagaucaagaucaugccacuccaucucgaaaaaaaauuuuaaaaauugaaaaaaaaccucuaaucuuaaccaucugaggauucauaagauauuucugcuacagacuugucauguugcugggcaaggcucauacuucuuuuuguucaaacaucuaauguucuucucacuugaguagugaucugcuaauaccaagcaccacaagggaauacccaccacuaauucaucugauauuuaccaaaucuguucaauucagaaugacacuacgauuagacuaguaaauuuggaguauuuucuuugaauguccccuagauugaaaaagccaagaguccuuucagaagauggcaccuugaaaagaauuauuuuuccuguugugacaaugacaacugccagcuaagcacuuauguaaguugaugacauuggugucaugaaccacaucccccaacauucacaccauuggugguuuuuuucccuuaaauccaggcugcaccugugucuugcuucaaccaaucaaaucuagaggaagcaauuccaugccaguucugagccuaauccuuaagaaggcccaacauccuugggugcaguggcucacaccuauaauuccagcugcucaggaggccaaagcaggaggaucacuugaggccaggaguucaagaccagccuaggaaacauagugagaccccaucucuacaaaaaauguaaacauuagccagguauaguggcacuuacuuguagucccagcuacucaggaggcugaggugagaggauggaucacuugagcccaggaguuugagguuggaguuagcuaugaucauggcacuguacuccagccuggaugacagggcaagaccucaucucaaaaaaaaaaaaaaaaaaaaaaaaaaaagcaaggccugagaacucucacuuuuguaccuuagggagcccugagcugccgccaugugagaagucagacucagcgggaaagaccacauggagaggccacguggagaggaagaggauccaggauuauauggaaagagaugcaguggggccugcuguugcaucauuccagcugagcccaaccaugcagccaucccaccaaggcaucagacacauaaaugaagcaugugggauguuccagcaccagccacuaucugauugcagcuacaugauagaccccaagccugacaaauagaaaaaccauccagaugaaccccaaucaacccacagaaucauaagaaauaauaaacuggauguuauauucgaggguaguuuauuauuuaguaauagacaacuaaaaaauacagcaagagaauuuaaaguauccuauguaagcuuauuuacuuuuuccauccucugcacaacaaauaauaccuucucccaucaguccucuucccuaacucugaaccacuucuauagaauaugauguugcuaaccaaguuuucacauuccuguagaaauuauuuaaaucagacuggagguggaaccaaguccacagauggaacaagggauccuaauagaaaccgauguuucaaagagcuagguaucuaaaugcauuacuauugcugcugcugcuacaccacuucuccggcugacaguuguucuucagagcuagcuugccaacagaaggucaaaaugccuugccuaaacacaagacuuacaaauuugggaucuuaaguaugaugucaugucuuaaaaugauaagcuggcaaagaaaauaaauggcauuuuguaaagauguguaccauuuucauguuuacgcuacuuaagaugaagguucuaauaagucaucggcuauguuccuuuaaagggaaguuuuauaaccgagaugaaucacaacugcaaaagaucaaaguuaaaaaacaucaaugaugccauaggguacuuuuuaaucuuguaaugagugaugaucaugugcucuuaugaaguuaguccaacugccaacgccagauguguauauuaagaaaagaaguuguuugugaugugacagcacugguucagcugccagagacagaaaacauagaaggaugaaaccuuuuggauuuuugagugaaaagcaagucuuggcagauguguugauaggcaaggccucacagugggguacuagugccauagcaucugcucuuggacuuugcugcaaacaaauuaaauuuaucaucaguucugcacagcuuucccugaggagcaugaauaucugcucaggcauaauuuauaauacuuauuagugucauuuacuaaugagcaaaaauuaguaaagucaucugcagggggaaaaaaguaauauacuagagaacagaaucuauagauguuaucuguuuccuagaggcauaccauaagcaaaacucuacagccaacgucugacacuaaagaaaauugauguaauaauagcugacacuuaaugaacacuuacuacaugacagucacugugcuacccauuuuacauacauuacaauauuuaacauucuugcagcaacugaugaggaagguauuaucauucucacauaaaagaugagaaaaccaaggcaaagagaaguuagguaacuugccugccuccauacaguuaauaaaugauggaguugggauuucgauccaagcaguccgacauaaagacccaaccaguuaacccagaauuuguccuuguucaaacagcugagcuaccagaagcaggcuuuucaauauauauucagaucuuuagaggaaggagugaaauuccaacaacaggaaccgauaguacaaaauccucaacuucaagccacuauaagugauaaacagaaguauacuacuuuuaugacuaauaaccacuaauuaaggaauuauaauuugggggagaggaggcuaaacaauugcauauaaauuguuccacucccccugccccaacacugccccaggaaagccuuuuacuaaagcccuucucuguuaaggaucaauaaaauaagccacuuugaauaagcaaggguugacaaacuacaacuuggcccaccaauuauuuuuauaaguaaaauuuuaguggaauacagaucgaguauccuuaaucugaaaauccgaaaugcuccaaaaucugaaaguuuugagcaccaauaugaugccacaaguagaaaauuccacacauaaguacauaacacaaacuuuguuucuuccacgaaauuauuuacauauuguauaaaauuaucuucaaacugugugcauaagguguauaugaaacauacaugaauuucauguuuagauuugggucucaucaccaagguaucucauuauauacgcaaauauuccaaaaauuaaaaaaaaaaauugaaauccgaaacacuucuggucccaagcauuuuggauaagggauacucaaccuguauagccaugaccaugaauguauguauuugcuuaugcugcuuuugagcuacaauggcagaguugagugguugugacagagaccaccauacggcccacagagucuaaaggauuugcuaucuggcacuccguagaaaacgugugccagucuguguucuagaggaucucccauuuaacauuauaugcaccaacuaaucaaacuccuauuauacucacuguuuaagaaaauuggaaauauugugcauuucccacaccugggagugucaaaauuaaagaaccauauugagaagagggcuaugcuacaaauauucaaugcccaggauggccaagaacagggaggaaaaaaauaauccagcacagaauccagguuauaggauucagcugucgcucaaagcagacccaugcuucucuccagacacugacuucgucaagucacccuaugaugucaggaaaaugaccccgcauuuucaccgauauuuucaguuaauaagaaauguuacucaggcuuaucuagggcagguggccuaccacuugcagaucuguaucugcuuccaccgcccacccugggcaccacacaaagcuugaacucaggucccacguauaccaccuggccccucuacuccuaacucucacugcuuucagagcacuucucugccuuuacaaggcaauucucugccuuuauaaauuagucuauugacuaauuuggacaaaaaccucucugaaauaagguacugcuaugcacacuugaaacagaagugacuuuuccaaagcuacccugccuucucacuuauugucauaucguucagaacagggagcaccuauccuucccucuuuccucucccagccaucaacuuuugagcaucaacucuuguguguauguacacauauacacacacaaacauacacacacacauacacacacacacacacgcacacaaacacacgcaaaugguuuuuccaagaacugagaaaagcagcugagaucagcaggaaauaucuuuaagagauaaguauuagcggugcuacauuuuaaaaaccaacuauccugcuaugugcauuacuaaaauggacguccugccuuuucaggaauuccggggcuagucugaccaaaaguuagaagacaucuuccaucauaaggcaucauccccaacuuauggcuauccagaaaaggcaggcaaagccccaaaccaggcaaagcucuguucuauucaccugcacuccauaaccacuagcccuuaggacuagagacuuggugcuuacacacauguguacagcaaucaccuaacaggacauucccaaacugaacagacagggccagcacugacucaacauuaugaaccuggaagaaugccacacacaugaaaggagaagaaaacaaaaaccucaaagacuugcuuuugaggcaggaaaccucccuaguucaggcaagcagucagccuuugugaaaagagacagcagcaaaagggacgggacccaccauaugcucccacugcuaggaagguaugcugcuuggguagaggcaaaacuuuaugagaccuuuucucucauuuuaggggaagaaaagauaugccacucucauggucuaugcagguugauuguuauagaacaaguacuucugccagcuaugccuccaccacaaaccaaacugaccucccuaaaugcagugguuaggauuccaauguauucacucagcaaaggcagaguucuauaugauguuuccauuggcacacaauuguuaaugguuuauauaucaaauaaucuuuaaucucuaaauauauucaaauaccgcuaugcugaguuuguucaaagcaguuuuuuggugggggugggggaagcaaaccucggucauuuuagauuuagaaggaacauacauauuggcccaaguagauuaugugcgcuaccugaaacugauugccggugaaaccuucuggauguccagacagacaaauaaaccaagauggauuuaaacgugguuugacucuaucuguuaaaagaaaacuaccuauaacaauuacuagagcaugaccaaacaacaguguuguaacaaucaagcaaguuaucauuugcaaauaaauucuuuguaauuaagcagugugcucuucauaaagggaauugagugggcgaguuaaaaagcuaaaacacauucuuaggccaugggaaacacaugccagugcuuuuugacuaagcucaagauuuuuaaguuugcucuuuucuuccucagcucucaugggucuauucugccccauuauguucaguacaugagcaaaauuucuuagcaaauaguuaacagugacugaauaauuauucacucauuucccaaagcuacggaggccuuagugauuguguggcaaagguuaaaaccguaguuuuauuuucuacuaacucugaaguuugacuaacucucccucacuaaaaaaaauauaugcagauagcaaaguccacaaagacacuauggacaugaaagugacacuaacucauuuggaauaaauuccucauagggucucuggaaacucuauuacuuucuucaauaaaaaggggaguacuuacuucuggguucccgagguccaucuacuguaacuuuaauugcucugugauagguagcuacuuggggaggauuugugaagacgguuauggucaaggugaaacucuugccugcagauauaaaaggggaaaauauacagugaauauuaaaaaacaguguugaugauuacacagcagcauagauuuccaaauugcauuuaagcaucucuaaggaggcaaugaaacaaagacaagaggcaggacuccuucuucuaaauuggaaacccuccgaugaccacuuuaggacauuuccaaauuugcuuagagucaagaucaucguccucauuguagugcuacacaggaagacuccaauuccaaaaaagcuccucaguagcaacaguuguaaugaaaacaaaacccugguccacuugaggaagguucuuuuucuuucaguuuucuccaacaucaggaacacauccaagcacagacaauuuuagaagucuuuauuuaggguugggucaugaccucacgagagaacaauaguaaaucauuguugauuauguuauuuacuucacauagcuuuagcauuucauuugcuuagcugcacuacaauaagaagauaaaagaggaaaguucuuaugggaaucauuuuaacaggagccagugucuccuguccuggccguaaugugccugugguaugaugauuucaucauuacuggaacaaaguuuuucuccucccuguccaccccuccccuaacauacauccuugcuguuaaaucuugaaauaacccccugacagcgacuuacuuuuugcuaaaugaacaugacaucucucaguauaaacucaaauuuugcuuuuagcagaaggugugcuucauugaaauauuacaucugaugcuucaaauuaaugagcuaaaagcgacgaauaagaaggggaaaagagacagggaaaaguuugguagcauauuuggaugucuguuuucuccagaagaagauaccauucucuguugcacagacuuacuaacaguuguaaucaguuagauuugcaacgguuaaucaugucagauagucaaaacugcaaacuguuacaagacaggaagaggugggcgugaaacagugacucaauaaaacauucagcaaucucaggccagaguacucauucagucugcuccuguaacagaccuuuaaaaagcucauuuuguuuugcuuuguuuuuuggucagagauucuuuuucccuuacugaaaacugagaguauuaaaccaaaacacaaaucuuugacaauauguaccaaugcaaaguuuaaugcagucuuuucaaagcuuaauauggaacagguuauauacaaggcuuaauggagaacaggucuuuggcugucaagucuagugaauggguuuucuuuucaaccuagaccauguaaguuccuaaaaucuguuuaagacgcacaucauuuguuacugaguauaaauaguuuuaagucuccuuggcuauacuuuucuauagccaaggggaaaaaaacaggaaagaaaagacaggaauggggugggugcaguuugaauagggaaaggugaauaacaauuagaaacguauuaagugccacuucauacacauuaucucaauuaauccuccccgcuuagaucucucacccccauugcacaaauaaggaggcugaagccucaagagacuuaguaauuuacccaaguucauacaacuaauaaaugaaaaaaugaagaucugaaccucauuuuucagacccuaaaauuaaugcucuuuuuuuuuuaaauauucugucacuuggccacuuccuuaaguggcuugaucacuugccauuuaaaaaaauuaauaaguaauuuauuucuagaugcgucccaaucagcucuaugugcccaagaaacaguaaacauaaauggacuaaugcaauaucucaggaugaugaaagcaucuauuuuuaaagugucauugauauauuuuauccacuauauuggcuauuacacggauuuaaauaauuuauaauugguuagcaaagagaggcuuuauuauaagcguuaagacuaaccagaagaauaaaccagccaggagucuaaacuaguuacagaaaacuaaaagccuacagaauuagaaaccagaaacuugaauaggaagccacuggguccaaguuagaaccucaaaacaauggaaagaucgcaaaaaguaaaagagcugaaucucuagauugaaaguuaauuuacacuaaaacauuuuaaagugccauuuuggggucagauuaguggucuaugggcccaggauugccuuucuaacaguggcucccauggcuguguuucagagucaguuuucaucuauggcacucaucuuaauaaaucaaggauauauacagaucucaguuauccuuaaugucucuaaauaaccugguagaaagauugucggcugggcgcgguggcucacgccuguaaucccaacacuuugggagguggaggagggcagaucgccugaggucaggaguucaagacuagccuggccaaccuggugaaacccugucucuacuaaaaauauaaaaauuagcugggcguggugacgcacgccuguaaucccagcuacucaagaggcugaggcacaagaaucacuugaacucaggaggcggagguuauagugagccgagauggugccaccgcacuccagccuggguggcagagugagacuccaucucaaaaaagaaaaaaagauaaaauagauuguccauaaauuuauuuaaaccaguuuugguaacaguucuacuugagaccuuuacaacuuacuuaggauauuaaaagucaucuaugcuuccccuaaauucagggugacgccucauguaggaacaaaagccaaaaauaaaauucacccuucaaguauaaagcauuuaaauuuucagaguagaaugaguucucuauaaaaaacugcuuuuaaaaagagauggguuugggggaggaaacaaguaguuaaguauaacuaugaucugccaaaaucagacccuaaggaucaagauguaauuaacaacuacagcaaaagugaaugaggcuccuucugcuucuuauugccccuucagaagaaauauguaugcaauguugaagaaauuuucagaaauuaccaaccaauuuaguaauugguucuucauccuauaauaauaaugcaccucuuaagucaaauguuuaugugggcauucaugauuuccuuaaauuaauuuuuucucaaaaauccccuuuuuaucacuuuccauaagugauaaaauacagccuguuauuuuaaaauguaggcucucaaauagggagcuagcagucaguagauaacuaauugugucauccauggcuucaucaggaaaaagaaagcauaccaaaaaaaaauuuaaggaccaaaaucauuuuaaacacuucucuuuaaaagauuaaggauaaaaaaaaggaaaaaccaugaaaaaccuuaagccucuccuaacuuaaugcaaguuccacugaugcucuacuuuuauucuagcacuuucaaaaguuguggucauaagaugacccauaaagucaaagucaguagugacaugacuccuuuauaaucuaagauuguuuuucaguuucugagaguuuauguuucuaccaguggaaagaaaaaaaaaagugcaauauuugaggaacuugguguuuuuuuauaacacuacugaaaauagaaauauuuaaagccgggaaagaaaauacaaugguagcagcauguugauccagacuuaauagcuuaagagaaauguagaagugugaaaaucaaagaggaagcuggaagagucuguuauaaagcaggucagguacaaaggguacaaaggcagguuaaaggguuuccugccacugaaaaacugacccauuuuuuuuucagagugugaucuguuaucaguguucucuguccuuuuuuccucuucaucucagcuugauauuacuguuuccuuucauacaauguuaaugcagugauauaaaaauauauuauuagugauaaaucaauuuuucuuucucucuccacccacucccccuaccccccaucuaagucuugaagacaagucuggaccaauuucuccauccugccucuggcagcagacuguagcauuucagauccuccaccaagucccggcugcuucaaaggaaaaauccuacuuucuucaguuaagaucauaagaaauauagggggagggggucagcucuguuuggacauaauuacacuucaucaaaagaagcuuucuucaucuuccaugcgugaaaagucugcaagcaguuaagucugucuuuuuuuuuaaauauaaaaauugcuauuugggaaaccagccaaaacucagaaagccaauauaguaaaacagugcacacccuuuguuucucuuugaaguuucuuaaauaaauauguugaggguuuacaaaguacacuaucacuuugccauacuuucuacuuaaauugaucagaaaaaaguuaugcagcaucuauauaauacaaaaguaagauaaaugaaaacacuaguuugaaucuguaauguaaaauuaagcauggcacccaauccuuuaaaaacuaaaauucauuacucuaguuaaaaaaaaaaaguauuauuacauaagaagaaagaugcaauucagagcauacagguaaaucaucauguucacauuuuucuugauucuaacuagaaaaaaaggaaaacuuuaauugcauaguggaccugcauaaguaaaugagaaaaaggaagaaugaauacacacacacacauacuccaaaccuaaucagucaauagugauauaggaugugucuuuuuuucuucuuuuuaugaaaguuaacuaaaccugaugcagagauaacucccuuaguuuugauucuaccggaggcugugagccucauuuuauuucaaacaacaugucagugacaguaucucauuagcaugaaucauuuuuuuuaaguuaaaaaguacaacuucuuggcccuguuccuagaaaguaaacuaacacuacucaucggaaacagccuugcuugaauuucccuuaucaaguuuuuacaaugguaauaauuugacaucugauccaaacuaaagagcaauuauuagacaugguuuaaaaaguggugcuccucauuuccuauucaaaccuggguugcaaugauuccauaaggcuuuauuucaccucaguucuaaaguggucuauuuucuuucuucuuaucaaaauacuuaaaauggaaauauuagauucaguuaaguaaauaaauaagcauaaugcuucuaauagugaguaacuaguaaaagucuuucuguagaauaaguaaauaaaagccaaaauauuggccuccuuaaagacuuuuuuaaaaaacauuaaccucauuuaucaaacaguuacaaaaacccuaaaagggauaauuuucuauuuaaggaucucuaauuuuugaauauggauucagaugaugggaauccuuacauaguauggaacuauuaauauuagaguacuaaucauucaucugucuaggcaaccuuacauagucacucuaacauaaguaauacauuauucacuuauucaaaugaaaagccuuauguuaaaaaaaaaccaugguuuuuaauaaauucuuacuaugagaguaaauuaaaucauauagagguaaccugugauaagugaagagcauuaugccagcuguccuugcuacaacuuagaccaaaauugauauuaccaggaaauugauccaacauauccauuuuucuuuccccuuuaccacucaauuuacucaguuauuugacuccucauaauucagaaguugauccuccaacuguucuuuucucuaccuuauaugcucacacccagugaaauuaggagcuaguuuuucugaaaacauuguuugaauuuucaauaucauaaaauaaaugaaaaaggccugaguacucagaaaaacacucaacuucaucuggauguauuuaaaucaaaucuucaguaauucuauucagaaaaagaaggugcugauuuguauacagacuagucuacauuucaucaaaggagccuaaugugcuuauucuauuaucaguaucaaaagucagagaccuaccucguccacuccggcccacaaaucucagaucguugaaccuugcuacuugguuuuucauaacagcagaggcauuccggagcucagcagaauaauuuucaucguuacccgccaugacaguaaccacagucccaucugguaccucuccgagggcuaccaccuacauaaaacaggaaacacagcagcaauaauggcacaucagaaaggcuuacaaacagaauauauucucauugcaaaugaugugucuuaucaggacuuaguguucuaguccaguccaguaauggccgacaggaaugaagcaucuguguauggguugugaugccacuucaaacagaccaauguuucaggguccacccauuucaaaggcaggcaaaaacuucuuucauuuguuguuggauucuucacagaaaauauguacauuuuuauuaaauccccauguuaagcuguccguaggaauuaugccacagaaggaagagggaugccccaucugcagauugcaucauacagaucaaggcaccaccugucugcaggcuuucucucagggagagcccugagguguggucuuaucccaucacaggcuaaaaaauaucaagucuggucaacuuuaugggagaagauuuuuaagugaaacccuggggcuccucacuacauagagccuagauaucguguagucuguuuuaucuccuuacuuugggcuagcacuucagcuuuuaauaaaguauauuuacugaaaaccacacugcggugggacccagugugauauccaaagucaucaagaaacugaaggugaaaauaauugaugauaaauaagaaaaaaacaauauauacccuuagccucaguucuauuaugucuugugucccaucugccauccuggaaugacauacuugacugcuuaaucuucaacaguuaaucugaagcaaauuaacucaaucaagaaaagaucuagauuaauccaucuuuggaacaaacaaacauuuucucugcucuaagacuagagauaacacuuuaaccugagucagcuaacaugcaaaugugugccuuugauuaacacagagcccaguaaggagaugcuggugcagauccuucacugucauauaugaaacacuccuccuaauccauugccaagauccugccccuugguaacaaucccuucucucaacgaacuuccaggacucuauauucagauuauuuccaugucuuccucauucagcuuccagaugcccucaugguaacucagcaaugaccgcagcucaaguagcccacagcugucugacaauaauaccccugugugcuugccugucuggugaaccucccacuuaucuuuuucuccuucuagugcuacucccuccuuugucaagauuuccauaagacaaaccuaagcauuuaauuccauguucccaauacaauuggcauauuacaguagauuucuuaacagugugauaauacacacuauaccuauauuuuagggcugaauuucccccauccaugaacccuacugcaacacgccuucacuauguccucuccuccagccaggaaaacaaucaaacaaaaaacuugucaauauuuuugucacccuuacuuuucucuuaggcuguuucucaguuccauuccuuccauuuaguacuguguuauucaguucaaaaucaauaaagccuuccuuaaauuacaggccccacuuuccccagccucccaauguacucaagugauccucauuucaacguacauauguuaauauuaauggucuaugacuacuuuaaauauaccaggccaaagcugagggacucacuccuaggaguccagauuauaugaguuaggaaacuacacgagagaagggccuucaucucaucugucuuguucaccacuuaucaacccugcucccaaaaguguccagcacaugguaaguguuuuauuaauuuuuuuuuuuuuuugagauggagucuuagucuaucacccaggcuagagugcaguggcacgaucucggcucacugcaaccuccaccucccagguucaagugacucuccugccucagccucccgaguagcugggauuacaggugugcaccaccacaccuggcuaauuuuuguauuuuuaguagagaagggguuucaccauguuggccaggcuggucuugaaccccugaccucaggugauccgcccgccucagccucccaaagugcugggauuacaggcgugagccaccgagcccagccagguaaacauuuuugaaauaaaugaaagagcuccauaaagagccccacuucgcagagacagaagucuguggggcuacccacuaaaacucugagagggccaguuaauguugagucagcaccccuugcuaacagcaaugugcccuugcccccagcuuguuuucugacauuguuuucaucucagaggagacggaaccaugcugccucccuuucccuggagaauauaguuauucucaauaugagaagucuccuggaucaaaaguaaaaucccuugaaaauaagacuuccucucuguacacgucaucucauaucucaagcggcuacugaauacagguaaugcuguacuccugauggaggcaaugugcuuuucaauuuuucaaauucaccaugccaaaaaugugaacauuugaaaauacugcaauaauugacuacauucgccaggauucaucugaauguuugacauuuuguacacucagcauauuguauuuuaacaccugcugcguggcuuucuaugucaaaguaaauauggacccaguaagcauauuaauaaaggcaggagaaaaguuguacuguuuagaagagaaugaauauaccaaaaucaagaggcuccacuuuuuccccacuucugcuacauaucugcuaugaccucacacaaaauaacuucaucuccaggaaccacaguuuuccaauaugaauuggaaagucugcaaaauguagaagauacuauauaaguauagaguguaauuauaaugaugugcuuuuuguaagaugaggaggguaacacaguguucuguuccaaaucugcugucuguuaaacauaggcuuuuacuuauaagcauucuuaaaggguucaacugaguacguacuuccucacuucauguucugagauguucuuugauguuguugagagauacaggaugacugcugguggauuucacucaagucuggcuacauuuccgaaaaaaaaaaaaaaaaagcaaucugccccaauauaaagguuuucaagaacucugggacauuauuauuuuacugcauauuuuuaacauaaugaauuuuuuuuuaguuagaagaaauggaaaauugauucaauaugggaaaauaugaaagaaaagaucccuaagagugaaauacauacauccauuuuacugugcuuaagcaguauaauaaugaccauauucaauauuaguguguuuuacguaucacauuuuacaaaacaaauaaauaaucacaaguugugugagccuucuaugaggcugagagcaagaccugaaaaaaaaugcuaaugcaagguagugacaaucuuuccuguuaaagcugaacucuaguuuaauggcuaaauauauugguuuuuuuucugcuauucacucuaccaaaucagauugcccgauguuuuucugagggggagaaaagguugggaguugggggaaguacuguauuugacuuuauaucaaucagaaguauaauuauauguuugagagguuuuuucuuuaaguagaucucugaagcuaaaaaguuucccuuggagauucucaacuguguuuaucuaaaagaaaaccaaaagaaucaagaaauuuuuacacauuucaucuguaccaaaaccaagcaauggaaaaacauuugaagggguaaagugcagucaaaacucgcucuuuaacuaguuaggaauaagcacaaauuagaauuugcuuccauccuacccaauacaaaaguacugcucugcaaagaauaauuugugaugaucuuaacaauuacauuucuauguuuuuuuaaaauauaaaaucuacaaauucaagaaacuccaugagaaaaggagaaguaauuuucuguccugacauuucagaauagagaaagacguuccuuuauuuagcgcaccucaccauaacuagcauuuaaaucacaugauauguggcuugcacaaaauaaaguagaaggauauuuaacuguaguaaugcuauugaaauuuuguaugagacuccuuaugacuaaaucugugaaucacuaaaagaagaggaauggagaauuaacucaaacccuuaaaacaguuucucaucuuuuuauauggaaauuaaaauugccuaugacauuuccauggacagaagucuagucuuaacuaaucaauuacucuuauaggccaaaauaauucaggauauuguacuugcgguauaauugaaauauaauuauuuuucaagauaaaaucugaucaaaucuuucuuugcaauaaaaagagaagugagacuaauugcaaaaagcaaaaauguuauuccuaucacaauuacuuaaagauaacuucaaauacaguaucaaaacauuucaacaaauacuacaguuaauauuuugaauuuauccuagaacuuaggaaaagcccauugaauuuuagagaaaaaacacaauaugucauuucauaauuuuaaaaauauauaugucaaagauaaauuuugauaaaaauuauuucaauguaaagcagcaauuugugggccauguaucauggugguuuagaucaucuaacaauagauauucuggaauuuugaaaggauacaaacaauaaugccaaagaggaaaaaauaaugaaagauaucuaccauaccuauuuucaaauauuuaauagaaguuuucuaaaaaauuuuauaaguauuuauuuuccaccugaaauucuuuguuccaacuuccuuacuuagaaguuuuauauauucagucccaaaauauuuaacuuuaaauaaguuuucuugaauucaaaggcauaacacaaaaaugugucugucuucacacaacuugaaaucuauugauuuacauaauuuugcauaauaauuuauauuacgguuaauaaggauuuaacaggcuuaacaaccuauuuucccuaguuuagauacaaugagauucaaaaaauauaaacauaaaaucugaucauuaacuauguaagaaaaauacuacucacugguaucaaguauuuaccaguuguauauuuguuuucgaagagagaaaaauggcuagugaugccaaaaauuuauuuucaaacagaaauugcucugucauuuugaaaccccuccuuuugacaagcacugaaagguauuauuaaauauacagaauuaacuaugagugcuagcuuauauaucuaaaaauguguuuucuuucuuuaacacugccagaaaaacauaugauacugauaaauauauguaguccaguguucucuaacuuaaaacagcagaauagacuugaacuacuuuuaguuuuaaaauauacaucuggacuuaaaauuucugcauaguguuucagcuugaagcuauuuaaggcaacuaaguuacgaacccugaacaccaggcuucacaguggaaaugcugacagaccccuaacuaaaagggugcuacuggaugcaugguugacacgcucucuccaccguuaccugaccaucagcuaaugagcugaauuugcaaauuacuucuuugucacuagaauuaucuaggauagaaagggucugggauccucuaauaguaugcccuaacuauuuuaagguuucagugagauacaccugaaaauguuaaaaauauuuauuuccguuuccuugacaccuggggggaccgaacauuucaaaacugcagaacuuuguuaaaaauacaauguuaauaaacaacuuuauauaaaguauaccaguuguuuuugcauuuuuacauguaaaaauaaauaaauuuuauaucaucucgaaacaagaguagaugaacaacgcuaauacauucuuaaugaaauagauugacaauaucguguuuaaacacgaguuuaaacugacauuucaaaacagucuauugaauucauuucugauucucugcggugucaagcucagugugacagauacaaaauacgggcucaauaaauauuguauugauuugaauaucagacuucacaacaaauaaguuguguguguguguguguauguguguguuuaaauccauuuaccuaucugcuauugaccugacaaccacuauaaucuauuuuuuacauagcucuaaauaucauggccaaauugcugucaccacuuuuaaaagggagacuucuucauauuauuucuucauugcagauguauuugauuauauuguaagaguauagaaagucuagugcucucaggcuuuuauuccaaaaguaggguaaagagagguugucacaaucuggauguuccaaacauccauacauuuuuucucaacagaguauuuucuauacugaguagaucuuagcuaucacccacuuuuugaauuguuuaacacagguauguugauagaaagacauugacagucagguuguagguuaacucaauucauuauucaauugauaugaauuaaaauagucaauuuaauauggucuuguuaccuacggucuguuuacugcuuaagauacaaaaauguacucugugugauuaacaaguugauuaauaacaaagagcaaaauuuauuuucaaaauaauuuuuaaagggugguagugaaaaaucuuagaugacagccaaaauaucugagacuagcucaagcuaaagugcaaaaaacaaccuuuccauccaaaaugcucauguucaaaucaauucagccgcauaaaugcaagagaacaguucaagauagaccuuaaauauguuuagcagaaugguauauggaacacuuuaaaaauguaagcaucuguucuuauauuuucacauauucugauuuguggcauugugcagacaagguaucuacuuauuuguauuuuuugcuguuuucauccagguuugggguuuuugggggcuuuugguuugggggauuggagggcguugguggaaacaaauuuccauucucauauaagacuaauuuaaaaauucugggcccuuggacgauggacauuguaaaagauauauauuguauggaaauuuaaauuuauacaauucacauguauucugagcuuuuccuauuucaaggaagcaaacauuaaccuacaaaaugggugguuuauaaaaggagaaaugugacgguuaaaaaaaaaaauuucuugagccaacugcaaaaugaaacuugccccagaaugcaacauccccuuuccauaacaauucauucugauuucuguucugauauaaguccuagcgagauaaccaggucuaauugaccuggacuccucuuucuuuccaucccacccacacacggaaucugaauuggugcguggggugggggugaucaacaacugggaacugucaguggcccgugggaguuuggccccaggguccccagcggagaaacuggcaugauuccucccccaacuuuuuuuuuuaaccucccccaaggccuugcuugcccugcucuccacagaccucagaacccaggggacccaggcccaccuacucaaguucagagguuagcaagggcccaaagcaccuuucugagagucucaucuccacgucuggcuuaccaccccugcaucccuggcgucuugcgaguguggacaguccugcgaguguggacagccugggaacccguuuccccaucaacccagugugcgcugggcccugggggcuccgcgucuccccccuguagagggcuaccccgggaaaucuggaucggguuauggagagccaucgggcuacugugagaggcuccagauccuaaaaccucaaccugcggagcaccugccugcgacucccgcggcugccacccgcccucaaacuaacgggccgggcaggcacaagagucugcggggcgcgcagaggccgcucucaagccuucgagcucacuccgugcucaggccaccagcaggagccucucaccaccuuucagaagcaggagggaucuuuuuuagauuuaaguccuuuaaaaauaauaauaaagcaaaaauacaaaauuucaccuccguuuucaaguugggcgaacuaaaguuguuccacagguuucccucaucccucccuggcggggcgaggcgcagagcucggucccggcuggaagaagcggcccgagcucccgccccguccccuggcccgcgccucccagcacucgaggguucagcgcccaggcccccugaacgcccccgcuucggggcuugcggacgccccagcggccccgccuuccucccgguaacgggaucuggcgcgggucagcgaacagagcaaacgcccccgcccugacacccccuccucuggagacccuagguuuguccaggacccucccgggcacugguagcgcagcccgcgcgccucagucagcaccccacgcccagccccgggcacuaaugcccggcaccggcaccccacgaaucccggcacgggagcccgggagggaccaggaccgcugaacucugcgggucggggaaggggacgccgagaccugaggagaggcguuuggcugugagggaagcgggugagagcgcgcggagccccaaagagaggcugcgcgggcagcccgcaaugcggccaggccgggaugucccggaaggacgcgggagccccaggggacaaugccggggauccucgcccccgggaaaggggcgggguggagcaaguccgcucgcagugcaagaguggguacuuuggggauccugggggaaagggagacggcgcgaaggagugagugagaaucaaggccaggcaggaggcaugaggagugcugaacgggucagggggacuagggcugaagucgggguggcagcgggcacaggugggagagggagggauuugcgcggagggacugagccccgagcccgccagggcauccggagggaggcccggccggggguuucugggguuagagccgccaaggcaggaggucuuggaggacguccggggcccagccccgugggcaggaagacaccggcgggcagguuccgccgcucccggccgggggcggggggcgguguagccucuuaccuugaaggccacgggcagggucuuguugcagcgccagugcgagggcagcaccgagcacaggaaguuggggcugucggugcggacgaguucggccggguggucggcgaugaucuccaccauggugcgguugucguggggcggccgcaaccggggcacugcagcugccgccgccgcagccgccgccgccgccgcagccgccgccgccgccuccugcugcugcugcugcuguugcugcugcugcugcugcuguugcugcugcugcuguugcugcugcuguugcgcagccaccaccgggcucacgucgcucauuuugccgggcugcaggcugcuggagggggggcugaagcgccggcuggugcucggaucuacgggaauacgcaucacaacagccacaaguuagcgaaguggccgggggagggggaggaggguggaaaugaggggcaaggaggaaauugggggggugaaggcgagacggggggaaagaggauggaggugauggggcugaggaggugagaaaucaaguuugaugaggccgacugccgggcggagucugaugggccaacagagucuggcgaugcggcgcagucgggcuggcggguagggagacccgggaggcgcagaucuuugccggagucuuuggaacacccgggguggcagcugcgaacgggcgcggggguguguuuggccuggggaggcgggggacuugaguuugcagcuuggaauggggucccuuggggcaccgcguccugggugcgcuggcgcccccucccaguuggaguccgguggugaagcgguguggguucagcaguccagccccggggccggcauugccgcgcgcugcccgccaccgccgcgccgcgccgcgcgcugcuacccagcugcaggcggccgcgccuccgcccucccgcgccgccgccuccgcggcggccgccgcuccccccgcgcgggcugcacgcucagauuccucccgcggcggcugccagcccggcuccccggcuaggcuccuuccuuucccuucuuuucuucucgcccucucacagccaccucuuugcauccacucccuccugcaauuugcaaagcuccccugucucucgcgcuucaaggugccaagagguaagucgugggcagcggaucucggggcaacgaaucucgagccugcgaaucgcagccgcugccgccgccagccggccgcgagaaggagccccccgcgcgccgugugcaguuuccgaagccuagaggcggccccagacuaggggcaaucucgccaggucgcguccucuugcucuccccaccccuaggacaaggaacccccucuuuguaggaagagauugaagccgagacaccagagagcccccggcugaucugacugucgcuauuuuucguuguaacuucaggagaggaggaaagaaaauucuugagccucugugcugacuucucagcacucuucacccucccaccucuacccccaccucugucugagcgacucccaagggaaaaagauuuugcaggguuuggguguuuuuuguuuuaagugacacaaaaaaaaugaggaggggggguggagggagaucuagucaaaauaguuuuuaggaacucaagugcauagcuggacauuucuuuuuucuuauauauucaaucuugucauuccuagagaacaagaaugagguguuuguuuguuuguuuuuguuuuaaggacugaaaaacugucagcuuugugauuaaaauaaguugcaaaacccuugcuggggaaaagcaccagccguuuuccaugaauuuaaauauuuuauuaagucuauucuacaucuaagacuaaguuucgugucugucuuccccagcgcucacggggaaaaauuaaaaauacgaacuaaaaaauucaaaaugcuuccguggcuguuuauuuauguauuuauuuccuaguguggguuuaaaaagcgacuuuggaucccccaaaaaguuguggucgagaggaugaaggagcgcggaaaaaaagcggcacuuuuuaccuaaaaugugguuuuuggaggcugggauuucuaaugauuagguuuuugugguuuauauagacacgacucuggcuaagucgaucauuacgcugaugagagucagagcacgugggugucuacgaccagccucaaacucugagccuucaaaacaaauaaaacaaugugcugcgcccgcagaagccgggaaauccgcuugaggcuauuacaccccaagaagggggcacagggccguuuuacccucggcguuguguacuacuacguuucuugcuuauuaccaaacucuuuaaagccuuccaaagcuugaaaacguguuugcgaaaaaaaucaucaguugccaaaguuucaaagauuccuaguggaguagcugacacaguaacaagugauuuuauaaaauaaaugaagaauuagaaugccucccccucgaagcaucaaggaagaaagaugguugggucaucucucacgcccucccaucuuauuuaaagcaauucacauacccauuacuggguguuuuuauugcucagugcaaacgccucccucacccucguagcgaccugccacgacccucccugucugguuuuagagcuuugcucccacucgcugagcccacgcccgggucugcgcccuagaaggggccuggaagggcucugagagcaugaggggcacggaagaugggggccuggugccagucgcggacucuggagcccuuucgaguacaagaugagcuuggggggcugugguugcgugacucgggaucgccccgcugaagagaugcgcgggggacugagggucugccagaccgcgggagcagaggugggggugcgggguagccaggugugcgcucucgagggguaaggauggaguucaggggauacuacucuguccuuccuaauuggggcuuuauuuuuaccugcccuuccuccaugcacugcuccacgccucccucgucggucuuucccuuucccacguuucucuccacguuccugccucuuccccaaaucccuccacagacacuagccccaagccgcgccccucccgccccacagccgccgccugccacugccacccucggugacuccgagaagcgauucugcgccaccggcuaugacaccugguccccaaccuacucuucgcgcccggccuacuggccucccagcccgggcgccgccagggugcgagaacccauuuagccagaccggaccaacuggaagcgcagccaggagcugagcuggcuccugcgcgugcgauuuuuaauuaucuuuucggucacaggggagagcucuaaccccgggcaccgccgcguccccugcgugcacaggucucucgagucccacaggcggccgauccgggaagggaagccaggcuuucgccucaaaaaagagagagagagacugcauccauugcuguccuaccuuacacguccacucaugugcacucggacacacacucuugcaaguccacacgcagacacacauaaauacauacacacucauagagucauggcuuuuuuuuccugccuuuuuuuuuucuuuuuagggggcuaguuuuacuuugggcauguugugccacugucuaacagagaucccuggcucguuuuuuguuuuuaaaucugugggggcugcaaaggggggaagcaguuaugggaauugauuauuucuaugguaaaagugacaccaaaauuccauaacuaccauggugggugauaugccaccuucucugggauuguccuccucccaggaaguccauagaacagagaauuccuggaacuuugaagacaauaagaaacaauuaauauuucaaauauggaccaccagaggggcuuuccaaauaaaaaauucuagaauugaauuuaagaaguuaccuuggggacuuuuccuccuuuuuucuccaucgcuguuuuguccuuuguuuuauuugguggauagcaaacuaugcaguccucagugguuggggauuuuaagggcaauuuaaucaauagugagauuauuuauuuuaauuaaucauaucuaguaacucagcuuuauggccuuucucaguauccuuccuccauuucacauuucaguggaacuaauauaagcagcucuuggaaguuacuagucuuggaucucuuaaaauauccuacaguuauuuauaauguggaaaugaaauuuuccacugaauacccuaacaacguuucagguaucuggcacaguggguuuucagucuccuuucaaaaacauccuuuugcugaacauucacacuuucgacuggaacugacugagccuggagcugaugaugucuuggcucugagcauuaugcuuaaagaaagaaaacauuuuuacagaccccuaaaccaaaccucuccuguuaaucguaggcacauaggaaaaccaugagguuuuacauauguguauuuugugcuauaguuugcuugaugucaucuuuggguuuagauuuucuacgucaaaauguuugaaacaaaucacccacccuauuucucuucagaaauauucaucuuuucaguuguaugugauggcacuaaaaaguauacacuuuuuuucugaaaauguggcaacucuggaagauacaaacauaaucccacccaccacucccuaccauguccuuuaacauuuaacauaacuguuuaguaacaacaccugacaauucugacuuucuagacaaagaaaaugagaugugaagcagucagguuauuuauccagucaaagaacugacugggaacagaacccauaggccuuuuauccugguuuccuuuucuaacccccauacauuauuuuauauauacuuaugaugaaaaguagaauaagucccuguaaaaucuuaaaauauuuuucaauggaccagcuauuaaagugggaaaaccaauggaaaauuaugggcacauugaugaucccuaaagcuuugaaugucucauaugggaaaacuuuauaaacagaacgaucuuuggagaauuuucguuuggacucugauugacagaagguuacucagcccuugaagaagcagcauugccacuagaccaggagucgucauacuauggcccaugggacaaauuuggccuaaugccuguuuuuguacaauucucaaagauguuuuuugcauuuuuaaauaguugaaaaauuaaaagaauaauauucauaguacaugaaaaugauaugcaaugcaaauuucagugucuacaaauaaagcuuuauuggaauauaccuauggucagucauuuguguauuaucuauagcugccuucaccuaaagcagaagaauuggguaguugugacacuguacgagucacaaggccuaaaauaucuacugacuuuuuacagaaaaguuugccaacccuugcccuaaagugaaagggaugcaagaccauggaggagugagauagcagaaaagaguagauauuuuauaaagauacuggaaugggugugcaugugguucagauuaguucucuaaaagugaacaacguaacauuuaacuuauucuuuucugcauaaauuguuaauuagauuaauauuuuucacuuaauaauuuuggaggugccaaaacagaaagaaaagaaugaggagcgaguacauuuucacaggcuccuuaagaacaauuuucuuacacaucuccauaugucagcauuuuccauuguccuuaaaauauagugggaacacauuaacugcauagaugaagaagagugaagaaacucucauguagucugaacauaaaaaauagguaagguuuuaguagguuuauuccaacuguguugcacaugauuacacaagaaacucaaugagcuuaccaauaauuuucuaguauacaauauauucguaagaccuauauacaguuuucagacaguuagcuuaguaacuuaagugaucccaaagcuuuuugacauauuuuuuccauuuuaacuuuuuauaccguuaaauacugucugauuuguuuuaagcucaguaaauuuuucccauugucaauggaccuauaauaauuugcauggcuguaacaagagaugaaauguuuguaguggaggacuuagcaucauaaaccuuuccuuguuguuuuaguuagcauucccaagggccauauucaggcacuuacaagagaguacaguguugucauaaaaaggcugacacuugccauaugaccuuucagaaccacauucauggagcaucuguguaauuacucuucaggcaugguacugacuaaagagguauauauuuuguuugacuaaaauaccaacuuacuaaacgacacccuaguuaccuuaagaaaccaauguaauuucuaaaaagagccuaauucauuacccaggagucagagaaaacuaauuuucucaaaucagccuucugguauuuugguguuggcaauuguccuauggcaguagcagugaucuuugagcagcaguggaauguuauauauaaaaguuuacagaggucugugaugaaacuucuaagaacacccuaaaauuaaagauuuccuguaguaauucagccauucuuuacccagcugcucacauauugccuuuaagucaccaaggaaggugcuauccuauucuaaucucacugcccaagguuccaaaguuucacuuuaggcauuagggcagugacuucaauuauuuguccccucccuacacccugccaucaaagugaaaaauguaaaucauaauacucucaguucaucuaguaaaguacuaaaaauaucaacauuugcacagugugagaaauuugaauuacaaacuagcaaaguaagaaaaaauagaacagaaaaaaauagaauaguaagaguucaacuugguucuauuagcugcaauccuaggggaugccaguuauuauaagucaccauucuaaguuuuuugcuauucuggauuucauacucagaaaccguucucucaguguuuuuccccaugcuuuucuaaacuagacuuuucucagagaaaacaauuucuucuucccaucuagucauaaucaauuucuaaaagcaaugacucaucuuuucugacauuagaugauucuccugaauuaucuucguuauuggcaggaucuuuuccugacucauauuccuauuagugacaauauuucuuccagaucauuuuucuucccuaggugugccaguuaucaguuuauugucuugcagcuccaaauucaccuuuuuuuaccugcucugugaaaaugaauccggauccauuaaauauuucucuuuaucaguuggcaaucauguuuugucgguggggacguuagaaagacauugcaggaggaaaggguuuugcuuccugguuaacuugugcucacacagcaguuucugcagugcaggacauauagauuucccagcuccuggcuccugaagugcauacauacccacaucuucuccaaagcccagcugcugcaauaaagcuagcuuuuccagugccaggcuccugaagcaccgguagccagaaguuucccccagcacccuccccuccugggcuguuuguagcaguguggcucuggugaggcaacuccgugugaacagccuuccccagcacccuagagagcagaucugcagcaagcucuacuagcacaacuucucugccacccagggagccaaggcugugcagggucuggauucagccuugguugagaagaggggaggacucuuacuuuguugcuguauuucagcccugaggguaguggaugcuguuauuccuguauucuuuagaguuauuuuuaguucuuccuagccaauuccuuguuucuccaauccucuguuauagucaauaauucuucacauuaaacuuuucuuauucaaauuacuauaugguuucucuguccucauuggacuuagacugauaugcuaagguuuccauuuucugauccccaagacaugccuauucauagugguuuccauuuuggaucacuccacugggguaauuauaagaugaggauuuccaacaccauaucacaucuauuaaaugauuuaucucuuccuaauuauaagccuauaauuagaggacauauauuuuaaagagaagaagauguagacagagaguauagauauggcuauuuuaaagcacaggcuaaaauuggucaguguuucuucccacagucguccugacaucuuccaugaaaucccaugaucuuauguccauacugaaacuaaaauacacauaaacaaaauccugggcaaaaauuccagagcugccuuaucacuagaucugauaaaaaaaaaaaaaaaaaaaaaaaaaaaaaagccaggaucugggaagguggagagauaccuuacagaaucagaaaagcaaaaugcuacuaccaccaaggaaagaaagggagcagggcuagacgauugcugccuuauugcaguugaagucagagacuggguagugcugugacucuaugauaaaauaaaauugggaaaacgcuguauuaaacaagauaaacagacuucauauugucaauuuuaucccagauuuuaauaugcuacaugcauuuugaaucuccacuagacggacuuacaaguuuguaaauacagcauuuacaaacuuauuuaauuauugcuucuaaaggaauuuaaaggucuuugaaguauuuuuagaaaauacugagcuaaaucaaagugggaaaaaaauguguuggaacauuaaagggaccguucugucuagaagggaauauuguaauauaguggagaagugaaguuggcuuggcuacaagcagccaagccaaagagggccuugguaccaugauucccacuuuugugcacauuuacaagagggagaauauucauguugcuucuagaagccacaaucuuggucuuuuccucgcuauuacagcccauuaccuuccuucaucuaaaaaggagaguugaaugaaaguuucucugggcaugacucuucacuccucuugaguccucauuaagaugaagcagaagaguuaugcaggugugggaguggauccccucauuauuuaauacuuugauauuuuguuuaucauguauuuauugguauucaauuucauuuuucagaauauuccauuaaaaucauaucuugaauacuaggguuuguuuggaacucccuuaaguuuugccccuaaggcuagcuagggccuccaucauuucaucucauccuggcccagcccuaggucuguggguauugagaacuuaccgagugauuucaggcuuccuugcuucauuacgagcaucuuuauuuuuuuaauauguuauuaaauauaaguacaaauugcaaucacugcauauucuuccacaaaagaauguaucuuuuaggccaagcucugguggcucaugccuguaaucccaguacuuugggaggccaaggcuggcggaucacaaggucagaaguucaagaccagccugaccaacaugaugaaaacccaucucuacuaaaaauacaaaaauuagccaggugugguagcguguaccuguaaucccagcuacucaggaggcugaggcaggagaaucacuugaacccaggaggcaaauguugcagugagccaagaucacuccacugcacuccagccugggcaacaggcugucucaaaaaaaaaaaaaaaaaaaaaaaaaaagaauguaucuuuuaacuuucuguaucuacuugaaguauugauagcagauauaacagaauuuugaccuucacuauguaagggugauuguguguguguguccugugcuuaccugguuaucacucuuuaacaacaaaaauauggauuaucugcuuauuacuauguaauuuuaaagaaguagacauuccuguuuuguuguuuccgucuguuuuagaauugucuuugauuuuauuuaaauacauugcaaacacauuacacuuggggcuuauuuucuuucauucccauaaguguaucuuugauguuaaauuaauuagauucuccuuuaguaaauaaaauagauuccauuaucaaaucuuuacaagaguuuaaaagaggcaguucccgccaggccuaguggcucacgccuguaaucccagcacuuugggaggccaaggugggcugaucacuugaggccaggaguuugaaaccagccuggccaacauggugaaaccccgccucuaccuaaaauaaaauacaaaaaucagccgagugugguggcacacaccuguagucccagcuacucagggaggcugaggcaggagaaucacuugaaucuuggaggcggagguugcaguaagccgagauugugccacugcacuacagccuggaugacagagcgagacuccgucucagaaauaaguaaauaaauaacaauaaaaggggcaguucccaccagugccacuaugaagguaaacuuuuaccagaguaaaaaaaaaaaaguaggaaaaaaacuguuuuuuuaaaaaaagguuauuuggccaguauucuuuccuuugucaaugcaguuauuuuucucugaauucacaucuuugcccagagaauauauuuauuucuguuuccuaagugaaaccucuuucuacaguuuuugaugacuagguuugagucuuaaccaugauauacugauucucuggcuuuuugaaguagggauuuuucacaugccucaaaaucaaaacccuuaguuuacuucucauacguacaaaagaaucuuagcaagucuucuuuuuuuugggggguuuuguuuuuuauuuuuuauuuuuugagacagggucucucucugucacccaggcuggaguguaccggugugaucauagcucacuguagccucaaacugucagucucagguaauccuccuaccucagccucccgaguagcuggaacuacaggcaugagcuaccaugcccggcuaauuuuuuuuuuuuuuuuuuuguauuuuuuauagauacugggcauguagcccaggcuagucucaaauuccuggccucaagcgauuuucuggccuuggccucucaaagugcugggauuucaggugugagccauugugcccagccucagcaaguuuuaauucggauuuuuaccucaacauuuagaccagauuuauauguacauagauaaucaacaagucuaaaaugcuauugagugacauuauucuuauuauuuucaaguaagauauccuacaguaaagcacacugaaugagauguuccagaucuuaagcuuaaugcuuacuauucuccaggauuacuggaaauguggguugcaucuaguaguuucauugaauauaguuuuuuuauuuauucuguuuuuaacuugcuucacugguguuuacccuuacugaaggaaauuauuauagugugcccauaacuacaaacaugaaaacugguugaaguguuauaacuuauuauaauauauaguccuucauaauuaaauuauggcuucucugaugcugaugguauugguucauacaaaaauaaauaucuuuuuuucaaaggcuucucugauaaaauuuacacugcaacaaauaaaaaauaagagaauuaccagaaguaugaugcauaagaagcauaacucaucuuacauuagccuugaaaauugaaagcuuuuccauuuucaacuuuguuuugcuagcauuuacaaacucaaccauaaaaauucccucuaggcagagauauggcaaaaauauuccaguucaaagucaaacuuucuauagaauguuucuuauugucaguguuaaaauuacaaaauugaaaaaaaaauuguuggcaaguugcuuugcacuugucacugaauaaaaggggggagacucacaucuaaacacguuaaaguccaaacaauccgucagucauuuuuauuagacauauaugaaaagaaaaauaaauuaguuugaauucauuuacuucacccuuaaaauuguucuauuaugugaaaaaccuuugcggucuugaaaauuuuaauaugaguuacucaauuuucugaacuucucaauuguagagugugcaauuuggagccauugaaagaaaaaaacuuucagaagguuuauauuggaguggagacuuggucucuucccuuugaacucccuuccaggaacagagcaacaggaccacauguaaacuacacuucuucucugcacauccuaaaagauuggguagacugaaaagugggaagugcacugggaagccuuuuuaacuaacucacuauaaacccuuaaccaagggcucuagacuaacauguccagugguuucauagaaauuuccaucuaaacauuccauaaacccuucaaggucagcauguccaauaugccaaacuaauuguuucaggugaaaagaaagacaaggggcaacauguagguucccaaggcucggugcacaguccuuauuuuuuuuccgucuugguuaacaguacaacuguacacagaacugugugcuccuuaaccguaggaacuauguccuauccacagaaaaucuggaaccacacgauugaagaagucuggaaacaccaucccuaccauauuccauguauauaccacgugaauaguguccccuggagccauguuaacauguuaucccuagauagcccccacagucagcauaaguucuggcauguagcaugugaucaauauauauuaguugaugaaugaaugaaugaauauauccccuuagguagaaacuuagguaucaugauagacuaaucuuuucccauuauuuucuacuucuaguuuaucaccugauucuauuaaugcuacuucuugaauauuauucauaucuauuuucuuuccauauccauugucacugcuuuagguucaggcuuuuaucaucuugaacuucaacuacaauggacuccuaacgugucucccugccuccauucaugcccaucucaaucccagucuauccuccacauugccaucggcauucccuuuuuagaauacaauuucguucauuuuguugcauugccuaaaacucuuuaagugguuccauaucaucuaucauacaaaaccccuucauguccuggccuucccaaguuaucacuacagaacuaugaguauagaguuuaaaaaguaaaacccaaauuugaaaacaaauauaucuugugaaaaaccucaaccuacacauuuccugauaucucuugccccaaacucagacucauuuuucucuuuccuucaucagugcuacagaaauuugcauuuaccuccauuauugcacucaucaccugaauaaucuguugacauauaugcauuccauauagaguguaaguuccuugagaacagggauuagucuuagucaucuuuuauccucagcauuuagcauaaugccaagagugaaauaagugucaaucaaugcuuguuaaaaugaaucacugaauaaauaaaccuauuaaauuaucuuuagaccugaauuuucuauccuuuuaaaauaggaaauuuucauauuauuaaguguuauuauucuuucugaaauuaucaaauauugauuaggcuguggcucaaugggaacuuucuuacaucuuguugggaauauaaauuggggaaaaaaccucgaaauaauaguuuggcauuaagguugaaacugcauaugcuguaugacuuagcaauuccguaccuaaguaucuacccuagauauacauagaaaauuauaauacguuguaugucauacuggaauaaagaaaugagaagcuuguguuuggaggcaaaagaguacagcuccagccaccuuagcccauguggguauccuaagggcucaggagaucaauaucuugcacuuguccugaauggaagguuuuauagugaguuaguuaaaaaggcuucccaguguacuucccaucuuucagucuacccacucuuuuaggaugugcagagaagauauauaguuuacaugugauccuguugcucuguuccuggaagggaguucaaaaggaagagacaagucuccauuccaauauuggugguguucuuccaaccaggugcaaugaauauuugcuguuuuauuuaagaauauucaguaugcuaugaaaaaugagaaaaauaaggaaaaugaaugaaacuaaauauaaaagcuaguggcuugugagauauguuagacauaaaagaaguugagcauaugugugcuuaauuucaguugggaggaauaguaggaccaagagcaccaaauauucauacaguaaacauauaucaggcacucaauauucauaaggucuuaaacugacuucucauuuacaaaacccauucuagcccauguguccuuuacccaguaagcuccauagcuguucaucaguguaauuggcaagcuacagcuguggccaggucuaaacuaaagccaguguguucacuugaggcaccauccuucugccaaguccuguugcucaaaccuugacucugucuuguaaccacaccaucaggggaagguugauacacaggaggaagagacaagauguaugaacucaaauacugcaguccuuccauucugcuugacccuagccuagguguagguuaaccuacaccauuccucuccccuugcuuauccuucuguuuucaauuaauucacuaaauuacaugacacaggcaucuuauuuuagucugaaagacauuugauucagugacuuuuaggauagcuugcuuuaguguucuuaggggcugcauugcaucaagguaguuuuccacaagauguacagguacuccugcaagaccugaaaauuuuccacagacacagguuuaagagaaucaauucccaaauccucaaagucauauauacuccuuccuaaaagugauaugccuaggaacuugcccauaguucccauuuucucccuucauauuucccuuuuccuacuuugcaaaaguaggccaccuucccuuacuguuaugcauugccuuugggcauaaaaaaaucuccuggccuccaugccacuacacuccagccugggcgacagagcgagacucugucucaaaaaaaaauaaaaaauaaaaauaaaaaucuccuggccuccacacagagccuccauuaaucaaggcaccaaaagcaccacuucuuucaaauccuuaagagauguauuuccaaaaaaacaguuaacuuucauguuuaauaauuguuuauaaaaaguauaauguaguuauguucuuucaucaauucuauaccaugguaauaauaauauuauaauaacucaaaccagaagaauuauuuuaacaguuauaaacucauggacuuaggaugcuuaacuacuuacuugcaauuucaauuuauguacuuauuuuucugcugaaaaaauagugaagcaugacuaauugagacucuaaagcaaaaaaaaaauacaccauuaaaauauuauuuugggcuggacacaguggcucaugccuauaaucccaguauuuugggaggccauggcaggagaaucgcuugaggccaggaguucaagaccagccugggcaacauagcgagaccucugucucuacaaaaagucaaaaaaaaaaauuagcugggcuugguuggcauguuccuguagucccagcuaguggggaggcugagauaggagaauuucuugaggccaggacuuaagagguugcagcgagcuaugaccacacuacugcacuccagccugguggacagagggggacccuaucucaaaaacaacaauaaaaaugauuuuguggaagaagaauaagagugggauaaaaauaaacaauguaaaauuucugacugaggaggaucuuguucauguauuuuuuuaauggaugaaggugucucacaucacugugguauuuccccugcauuacauauaucugaggcugcuaguaguggcucaucucugcaucccagcaguuugggagaccgaggcagguggaucaccugagcucaggaguucgagaccagccuggugguacaugccuguggugccagcuacuugggaagcugaggugggaggaucgcuugagcccgggaggcggagguugcagugagcagagauugcacuacugcacuccagagugagaccccaucucaaaaaauauuaauaguaaauaaaacuugagggaauuauaacccccaaauucaagauuguguuuaccucugaauugguucagagaucagaucaggguuuuacagguaaggauaauguuuuauuuuauaaguggggugguagcuacacaaguauucauuguauugcuauuuuuuauacccaacaauauuauauuuugauacuacucaguauuuaauaaagcaauuuuuaaaagcucuaugguucugaauaucaaagucuaugacauuaaagcacauauauuuccuaguacuggguugggcuggagauugguuuggaaaauucaugucauuauuuuuaguauuuucggggauugggaacaaauacauccuuucccacaaaauaauauaaaaauuggucaaauucuuaucuggcccuggaaagccuauuuaacaugcaauaaaacuaaauguaaugcuaaccccagcacuuuggggggccaaggcgggcggaucacuugaggccaggaauuugagaccaaccuggccaacauggcaaaaccccaucucuaccaaaaaauacaaaaauuagccaggcgugccuguagucccagcuacuugggaggcugaggcacaagaaucgcuugaaccugggaggcagagguugcagugagccaagauuguaccauugcaccccagccugggugacagagugagagacucuuccaaaaacaacuauaaaaagaauauuaaauauaaugcuaagagucuuauucuuccauugauucuacaaaaaaugggcccaaccuuuaccugagaagucaggauaccagaacacaccacuuacuacuuuaguuccagccuccccaugauaauuucuacuguagucguccagacagagggauuccuaugcuaugguuaaguucccuuaucauagggguaggugaagaggagucuguugagacaacagaggguguuuacuggggagucguggaaaauaaugcugcauagauuaugaucauaucauagacuuccucaaaauguuuacagagcagucgagaauuugugaaauagguagagagauuguuuaauaaaaauuaagcuaacaguuguugaauauauauuauguaccaacgaauuuucuaagugguuuacauauauaaacucuuauucuccugacaacaacuguaugaaauagguaauauaauaucccuauuuucagaugaagaaagugagaggcacagggugguaucucaucaaaugucacacaaguaguaaaucguaaugcuagaugugaacccauucuaccgaucuauagcacuugccaauuucuauggucuaaauauucccaucauaguugauuuuuuuuuuugagacggauuuucacuucuguuggccaggcuggagugcaguggcacagucucagcucacugcaaccucugccuccuggguucaagugauucuccugccuuagccucccaaguagcugagauuacaggcgcccaccaccgcccggcuaauuuuuguauuuucaguagagacgggguuucaccauauuggccaggcuggucuugaacuccugaccucaggugaucccccugccucggccucccaaagugcugggauuacaggcauaagccacugcgcccagccuaccauaguugauuuuuaagcuaccagcaugaugucaccaaacaauggguuggaaggagaugugcacaacuggcuuuaguagcugauaugagcuagcuguagugcacuacugaacaaagauuuaucaaauuaugauuguauacaagaagcacucugucaaggcacaaaauuguuuagcuccaacucuugcccuuaugguagugauggucuaaaugaagagaugauauuugcugccggaaguauuaaauaauacauauguauguaacuuuauaagaggaauaauaguucacacuuaauugccagauaaauguuguagauauuggcuuacagguggaaaaauugcaguguccucuaugggcaaauaagauuuuauggagaauuaacaaguuauuaaaucauugcagaauuugcauggaugaaaaggaaaacauucuaaauacugguaagaacaugaacaaaaaggguuauuuacaugaguuaaugcuuucaucaaagcagacugugaagagaaacuguagaacuccucucaaugaaaaauuuuccagcaaccgggauaaguuucaacaaugaucugccaaaaggcaagaggguuaaucagaugacauuuugaaauauuuuccaaguuugcugguucguauaguuauaacucauagccuaucugaccguauggcuauaucacugccuuuccagaaauacauucaugaagggagcauugaaaucuaaucuuuaaaaaugggauguucugauucugcaauguugagacucuuccucuggcuaaaauaaaaucuaauauacuuuuuugguaaauugugaaguuuggccucuggucuauuuccuaguaauaaucaggucugucuguugaugucuaauaugcugcagacaggcaccuugagaacuguaaauuuuguucaauugcauagauauuuuaaagaaucgauuaauacauguuaaucaacaacaacacuaucaaaaagaauggauggguuguuaaagggaaaggugcagaaagcuguuuucacauuggccguuucaauaaauggggaggagaagaagcaccauugaagaacacagaggaggaaguagugaagaggcagggccauggggaauggagacauccuagagcaggagagaguuucaagaagguggguccuuugcacuugcagauucuuaugccuagaauacuuuuuuuucuuuuuucuuuuuuuuccuuuuuuuuuucuuuuuucuuuuucuuuuuuuuuuuuuuugagacagagucuugcucugucauccaggcuggagugcaguggcacaaucucagcucacugcaaccucugccaccugguuccaagcaauucaccugucucagccucccuaguaacugggacuacaggcacacgccaccgcacccggcuaauuuuuguauuuuuaguagagguacgguuucaccauauuggucaggguggucucgaacuucugaccucaggugauccacccaccuuggccucccaaagugaugggauuacaggcaugagccacugcgcccggccuacucccucaucuuuuuaaaugucaccucagugaguuuccccagaucagguaugggagauagcgauuuucucuccccacaccauccagcccaaacuggcucccuauucuuccccugcuuuguuuuucuccauuucucugauaguuuaccauuugauauauaauuacauguuuguuuguuuauauucugucuucccucuucccccaagucacacauagguuagaaugucagcuccaugagagcuuguuuuuuuuguuuacuauugaaucccugguaccuggaacagugacucacacauaaugggcauucaauaaagacuaguuagaauacaaguaaaugaagauaugaucaaaaguggcagagguggucuaguuccuugaauagacuacaucuacagcauuggucagcuagauuaaacacaucuauguuaauuaaaaggaaagucaggccaggcgcaguggcucacgccuguaaucccagcacuuugagaugcugaggcgggcggaucaccugaagucaggaguucgagaccagccugaccaacauggagaaacccggucucuacuaaaaauacaaaauuagcugggcaugguggcucaugccuguaaucccagcuacuugggaggcugaggcaggagaauugcuugaaccugggaggcggaguuugcagugagccgagaucgcaccacugcacuccagccugggcaacaagagcaaaacuccgucucaaaaaaaaaaaaaaaaaaaaagaaacucaaacaauuaaguauggaagaagagaccuuaaacccauggccaacugcuaaagauaaauaaaauaaauccuuaaauccuauuuuuugugucaauaacaaacuuaauguaaugaacuuggaucuuuauuauaagguuguuguaaucauauccuuguguuuuauaaccuuaagaagaaaaauguccauugaguauggauuacuuuuuuaaaccucauagaucugccaaaauguuuuugcuauauaugugauaaaguuauuuuuuuaaaauauacuuuuauguuuuuccaaaaagggacuauuaaauagauauuucaguguguuuguuugcgggauaggggagugggagcuguugagacagagucuugcucuguagcucaggcuggaauguaguggcaugaugaauggcucacuguagccuugauuucucagguucaaacaauccuccuaccucagccuccaaaguugcugggaccacaggagcaugucaccaugcccggcuaauuuuuuuguuuuauuuuuuguagaaacagaggcucucuauguagcucaggccggucuugaacucccggccucaagcaauccuccugccucagccucccaaagugcugggauuacaggugugagccaccgugcccagcugauauuuaaguauugauuaucauagccaaaauuuuguuaaugcuuuauauaacugauuauuaucuuuuggcauguuauaggaagcucuauaaaaauuccuaaaauauuuguugagagauaaauaaaauuaauauguauuuacccaauuuggaugaaaacauuucagggcucuuuaaaauaauuuguauucuucuguuuuaaugguauuucaaauggcuugcuuuggaagacauccugauauuaauuaaucuuucauaaugcuacuuaugguauaugauuuuugcaacucugaacagcaugaggaaauuugcaaaauuugccaguugcuaagggaaucauuguuuuaaaauucccauuuauacuagcuucagcuaaagaaguagauaaguuaaaagagguaagaaauacuuaaauuauuuuuagaaagugaaguggcaaacaaacauggacaaagaaaauuuguggagagauagaugaauauucacagugaaauaccauuaugcaucuaagagcauaauuaaccaacacuuuccuugaauuaucuaauccauuacucacaguauaauacgaugucgaaugggacguuuccugauauccuaguaguaacucuagaacccaagacacuaggagcgaaagcugaagacaaagagaguuugggucucaacauuaccacugagugguugacaaggauacaugaguuuuguuugugccaaaugagcaccacagaaaguaucaguucuagaaccaucugaacugccacuaaggcugcagcugggguaggagaagagaggccauuggaagagguugaacgucuacauuaggaagauguacuggcauuuguaugccuguuguucauuagccagaaaggcaggggccccaacagucagucacacaguccaaucacauaaacaaucuuugccuucuguucauuauccaauuauucaauuacugguugcaguuuugaaagccugcauuauccaauuuaauucucauggcagcccugugagguacgcauuguuuaaaaaucauaccucuuuuuuggauuagaagacuuagaaauggacucaaagaaguuauacaacuaguucaaagucagaguuagugacagagccaggacuuaaaccaacuucuuuuggcuucauaucuccuccuuaauucuacuguacaauauagccucacauguauauuuguaucuccuaugaacaaggcauuguuaaauggauuaaagaguauauaaauauguguaagauguuauuguucuuaaagaauucuuaaggaagucuuuguuuaggaggagaucauaagcagcuugggugagaaugcaaugagauugugguuaguagaagauaacaaagaaugauaaaaugcuuuccauuagaaaugaacagaaauuuuggcaggguuuacccacuggaagauaauccagaauuuaagagagaggguaggauggauggcugaacgacuugacagaaaugcugaagaaauuuuuuuguuuuguuguuuguuuuucucaauaucuuauuacgaaaaauuuccaauaaauagcaaagcugaaaguuguuuuuaaacagcaaacacucauauacuuaccaccuagauucuacauuaauauuuuauuauacuugcuuuaucauacaucuguacaucuauccaccucuaucuacucagcaacucaucuuccuaaagaaaaugaauuucaagguacagugcaaacaauauggcuggaggcauuuuaaaaauaggaacguauuauauucaauuuacguuguuuguuuugcagcacuguaauucuucauuucucuuuaccuucgguaaagcucaccacacagagagucuuugugaagauggugucuuucaauaauagaaaucaaggaaaacggcuggguucuaaguguaaauagaugcagagagacugaaauaaaaaaauacauaagacaaugggaagaacccaaauuuauuggagucagggaauuagaacuagaggugaucacaagacuguaaacuuucaggaauuuggagaagucuuggggagggcaucagauuuugcacaaggugugaauagggauuuaagcccauuuaucuagaucauuuaaggaacaggcaaauaccaguugacaaguaaauuaccacuucguuucucaguuaccauuuacuggaacuagagguguucuaucacuagaggcaauauuuguggugggaaaaaggcaggaaaggaaggaagaaguuagacaggaaagaaaacccgaacuugucauaaaggauccagccacugccaaugguucuccucucuuuucuccaccuucccucacgccucucuaauuucccuuccucccucugucuccccuccuuccuuccuuccuuccuucccucauucccuccuuccuuccuuccuucccucauucccuccuucuuuccuuccuuccuucuuuccuuccuucccucccucccuccuuccuucccucccuccuccuuuccuuccuuccuuuuuuccuuccuuccuucccucccuccuucuuuccuuccuucccucccuccuuuccuucuuuccuucccucccucccuccuucuuuccuuccuuucuucccucccucccuccuuucuuuccuuccuuccuuccuuucuaaagaaaaugaauucaucuuucuaaagaaaaugaauuucaagguacagugcaaacaauauggcuggaggcauuuuaaaaauaagaauguauuauauucaaucucccucccuccuucuuuccuuccuuccuuccuuccuuccuuacuucccucccuccuuccuuccuucccuccuuuccucccucccucccuccuuccuuccuuuccucucuuccuuucucucuuuccccacuugccucccuaccucccucucuucuuucuuucuuucuuuggagagugaaagaaagaaacagggagagauagaaaugagagagaagguggcucacgccuguaaucccagcacuuugggaggccaaggugggcagaucaugaggucaggaguucaagacuacccugaccaacauggugaaaccccgucucuacuaaaaauacaaaaauuagcugggcgugguggugcacgccuguaaucucagcuacucaguaggcugaggcaggagaaucgcuugaacucaggagguggagguugcagugagccaagaucgugccacuacacuccagccugggugacagagcgagacuccaucucaaaaaaaaaaaaaaaaaaaaaaaaaaaaggaaagaaaagaaagaaaugagaaagaagagagaaacaggaagacaaaaaagggaaagggggaagagaaaaagaagccacuuugggagaugggcaauucucucugccuccaaugcugaucuuccucaauuucugcuuccaucuugacacuauucauuaguagaaauacagaugaagagaggaggaaacaaacuggggucaggggaguagaaaaaugggagggaagaggagagaaacuuaugugaauaauaucacuaauuuuucuaauugagucccagcaacucaaacucacuguuacagguagcucaaugauuuuuuuaucccuaacuagaaauuuauuuacagcuugcuuuuguaaacaaaagcuucaaacaucuuuucugcaagagaauacagcccucaagaguuacauagauauuauauuaaauauaggcuuuucauuuaccaggugugugacuugggaaaauuacauagccacagugugucucaacguccucaugucuaaaaugggaccaauaauaccuacuuucuuagauuguugugauaauuagagaugaguuguauuagagcacaugccacauggcacuuauuaaaagauagcuauuaauguuauaaggaggaaagcccuaaguuggaacucuagaugacaaacuagcaugaagguuaaaggagcucuuuugaaggacugacugacuucaagauaaagaucuaaggugagucagaaaaaaauguucuacauaagucaggggaugaaugaugccagauuguggucaagaaauacuuguuaaaauugaaggauuaguaaugaaguuaccauauuguauguacuugccaauuucuuuaaaaucuucacauaucuuuugaacauuuguaauguuauauauauugguuucaaaagaaagccuauauauauaaauauuuuaaggaaaaauugaggggagaaaaugcagcuaaacugccucuuuguuaaucagacuuaaagcugaagucucacuguucagacucuuaacaacuucaaugauaauagcucaugcuuacugagcacuuauugugaucaggcagugugugaagagcucugcauggaucgucucaucuaccucccacuacaacucuaggcagcaaguacaguuaauaggugaggaacccggggccuaauaaacaggcuaaguaacuuuccuaagugcacacugaaagcagugaagccaaggcaaucugaaucuauagcuuacacccuuaacugcuauauucuauguccaugugucccagagccaaagaggcagcccaacaaaaccacuggcaaaguccuaaggagaaaauaauuucacacagacuggauauccaaaacugaguguaaaucauccacugaacacucaaaauguucuaggcacaaugcuagguucaaugucacacgcagggaacacuaaaaugagauaagauccucccugccucgaagaccucaauaggucaauauuguuauuccauuguguuguuuauauuuaauguuauaaguuuaaaaaugauuaauugcaccaacuauauuaaguauauaugcaugauucuugcauaaaauaucaaauucaaucaaaauaauuuaucaguaauucuuuaauuuuggucccuuaaaauauuacgugacuagcaaaagauuugaauagacauuuugccaaagaaaguguaaaaauggcuaauauaccauuuuugaaauacuaauaaguaucaugaaucuggcaucacuagucauuaggggaaagcaaauuaaaacauuaugagacacgauuucacacccacugggauggcuauaaucagacagacaauaacaaauguuagcaaggaugcugugacacagaaacucucaaauauuauuggugagaaugguaaaugguaccauuuccaaacugcuacuuuggaaaacaguuggaucuuuuuaaaaguuugaaauauaugccgggcaugguugcucacgccuguaaucccagcacuuugggaggcggaggugggcagaucacaaggucacgagaucgagaccauccuggcuaagacguugaaaccccaucucuacuaaaaaaaaaaguagaaaaaauuagccggacgugguggugggccccuguagucccagcuacuugggaggcugaggcaggagaauggcaugaacccuggaggcagagcuugcagugagcugcgaucgcgccacugcacuccagccugggcgacagagcgagacucagucucaaaaaaaaaaaaaaguuuuaaauauaaauuuaccauaugacccagaaauucuacucuuagguuuauccccaagagaaauaaaaacauauauacuacauauauauacuauacacauaucuacacaaaaauuuggacaaaguauguauaagcauuuuuuauagcagcauuauucauaauagccaaaaaguggaaaugauccaaauguccaucaacuggugaauggauaaauaaaauauacuguaucuguucaauggauauuguuauucagugauauaaaggaauaaaauacugauacauguuacaaaauggaugaagguugaaaacacugugguaagugaaagacaccagucacaaauggccacauauuauauaauucuauuuauaugaaauguccaaagucagaaagaagauuagugggauggguacagugguuuacaccuguaaucccagcacuuugggagaucaaggcaagaggaucgcuggagcccaggaauuugagagcaggcugaacaacauagcgagacccugucucuacaauaaauuuaaaaauuagcugggcaugguaccacaugccuguagucccagcuauuugggaggcugaggcaggaggacgguuuggguccaggaauucaagaaugcagugagcuauaauggugccacugaacucuagaaaguagacuagugguugucuagggcuggcaugggagcauaaaugaaaugggaauuaacaauccuuuuaggaugaugcaaaccuucuaaaacuggauuauggugaugguuacacaucucgguaaauguacuaaagccauugaauuauacaacaauuucaugauauguaaauaugauauguaauuauaccucaaugauuguuuuaaaauuauaaaauauuauuauaugacuaaaauucucaggcuuuuauguaauaucugagaauuaguauggaaucuauuuccauuuuauaaaaugcuuauuuugacagaugcauauuaugguaucuauuaggagaguuuuuuauacuaaagcuuuauaauugcuugucacuaggugaugucacuucagauugaaacugucuuuauucuaaagcaauuacccaauuaagaaaucuuuucauaaucuuuuacuaauuaauauaguggguugaaaauguuuuggguuaaggcuggugcaguaacucaugccuauaaucccagcacuuugggaggccgaggccaguggaucacuugaggccaggaguuugagaccagccuggccaacauggugaaauccgucucuacuaaaaauacaaaaaaauuagcugggugucgugucacaugccuguaaucccagcuauuugggaggcugaggcaugauugcuugaauccaggaaguggagguugcagugagccaagaucaagauggugccacuucacuccagccugggcaacagaacaagacccugucucaaaaaagucuuggguuaaauaguguaugacucauuugaaaugcuuacuuuuauaguuuauaauguaagguaaagaaccauagaaauugccuccucuuuugcuaaauuuuugucacacauuuuccccuaaauuuuuuguuauauguucuuauuuuacucucuucuuauguuuuaggaagaauuuguauuacucucauuuuauagaagaggauauaugagcucauauggguucaguaauucaacuaaaauaaccuaacaccuaggagguuuaagaaccagauuugagcauaaaacaguaugucauucuaucacugaguaccagcgugacuucagcugauagauguucagauucuaauagucaucaauuauuucuauguaugagacugaaguggacuuccaguuuccaaugugacauguaaagagcuuggaaguugucaguuccacucucacaagaaaaaaagcugaacaaacugaaaaccaaccauucuucuuaguuccaucagagaguggaggucacaggacaaaccacugccccaaacacuggagaaacagacugaauauagacaaucacagauugucaggaacagaaguguggcugaagccuaguagggacacuuaaaggguaauucauuaagcgcuggagacuaagcuuguggacuagcuugagauauuaaaaagagcaacaauaaaauuccuggggcccuagucuugccucccccccacacacacccauuccugaguuuuaccuccaggagucccacuagguucucaggauaaagaucagggaaaaaugcucucaagcuuccuguggaaagaggggaaagcaaucauuugaaauaugcucagagcacuuuguucugcuuaaccaacgccugcccuuaaggcaaacuauuuuacccggguuuagcugagcugggggaaguaaaauacccaacuccagccuccuccagcauuccacauggaggaagagaaauacauaaccccagccccuacuggccuuccuaucuaacuugauggcagugucgggaggaggagaagaugagaagcacuugugaaguucacagcccagggagccaggcucacuaaaagacugaaagccaauaauaaaauuauggaacacuuccucugcuccugugcuuuaccaccacaucaguuaggguccuuuauacucacugagaaucacagcuaaaagaucuguaagcuucagacccuacuuaaaaaggagucucuagggaaacccaaagacaacaggcgaggcuaaaaggaggacucuagaggacauuugauauggcuuggaugcuuguccccuccaaauuucauguugaaauauaauccucaguguuagagguggggccuugguggaaaguguuugggucaugggggcggaucccucaugaauggcuuggugcuuuccucaugacaaugaguaaguucucacucugaguucaugugagaucugguuaagagugugguagcuggucgcaguggcucacgccuguaauccuagcacuuugggccaaggagggcggaucacgaggagggcggaucacgaccagccugaacaacauggugaaaucccgucucuacuaaaaauacaaaaauuagcugggcaugguggugcacgccucuaaucccagcuacucaggaggcugaggcaggagaauugcuugaaccgggacccgggaagcagagguugcagugagccgagaucacgccugggcagagugagacucggucucaaaaaaaaaaaaaagaaaguggcacccccuacccaaccccaacccuacuccugcugucaccauguuaugaacuggcuccccuauucaccuucugccaugguuguaagcuuccugaggcccucaccagaaagggaugcuggcacuacacuucuuauauagccugcagaacuaugagccaauuaaaccucuuuucuuuauaaaucuuccuuuaccgggcugggugcaguggcucacaccuguaaucccagcacuuugggaggccgagguggguagaucacgaggucaggagaucaagaccauccuggcuaacauggugaaaucccgucucuacuaaaaauacgaaaaauuagccggggugguggcgggcgccugcagucccagcuauucgggaggcugaggcaggagaaucucuugaaccugggaggcagagguugcagugagcugagaucggccauugcacuccagccugggcuaugcagcgagacuccguuuccaggaaaaaaaaaaaaaucuuacuuuacacaaugcaagaacacauuaauaguacauuuuagacacugacaccgcagcuauagcaaacaauaagcacagcuuaacuccuagccagaaaaacauaaaaccacacagugagggccuaucuaccucaguuccuuuuacccaauacaccauacuugacuuucaacaaaaaauuacaagaaauauugagaagcaaaaaguacagucugaauagacaaagcaucagaaccagacucagauauagcagagauuuugaaauuaucagacuagaaaucuaaaauaacuauaauuaauaugcuaagaacucuaauugagaaaaaaagaaugccaugugagagcaaauggguaauguaaacagauagaaacccuaggaaacaauaaaaggaaauacuagaagucaaaaacacuguaacagaaauaaagaaugcuuuugaugggcucaucaaaagaugugacauggacaaagaaccugugagccugaagauaugccaguagaaagaaaaaaaucugaacagaauguccaagaacugugggccgauuacuaaaggguaacauacuuguaauggaaauaacagaaggggaagaaagaaagaaaucaacagaagaaauacuugcaguaaugauggcugagaauuuuccaaaaugaaugagagacacuaaaccuuagacuaggaagcucagagaacaccaaacagcauaaauauaaaaaaaaaaaaaauagaucuaggcauuuucuagguaauuuccacaccuagaaauuaacauuacaauguauuggucucccuucuuuuucuucugacccuccccacccaaagucuuugcugucugggaaaugucacagaauuauuaugcggauuauacagccuaauuaguuuucccuuuaagaaguaaaaggguauuuauuuuuauuuauuuuauuuuauuagggacagaaucucacucuguuguccaggcuggaguauaguggugugaucacagcucacuguaaccuggacucaugcauuccuccugccucagcuucccaaguagcuaggaauauagguggaugccaccacaccuggcuaguuuuuauauauuuuuuuguagagacagagucucacaaaauguugcccaggcuggucucaaacucccagccucaagcaauccuccugccuuggccucucaaagugcugggauuacaggcaugagccaauaugcccagccuauauuuaaauauaaauaguaaaaaauaaaauguucuauuagcuugcacaccucaauuggcgugcagauuucuugaaggcagguauuauguauuacguaauucugaguuccccagagccucuaguucuauuauacuguacaagcaaggaaaauguauguuuguuuaacugauuggaaacaaguauaaaggccugacuacauauaugagagccugcagaugaggacuggaaacuggugaaaagaugagccaccaaugaaauggauuaaauaguuuugaaguauuauuugaauauuuaaaaagcaaaacuaaucuccucuaugcuuccauagugugugauacauuuaggcuuuguguccccacccaaaucucaucuugauuuuuauccccauaauccccaagugucaagugagagaccagguagagguaauugaaucauggggcgguuuccccaugcuguucucgugauagugaguuuuauaagggcucuuuccccuuugcuuggcacuucucuuuccugcugccuugugaagaaggcgccuugcuucaccuucgcuuuccaccaugacuguaaguuuccugaaaccuccccagccaugcugaacugugagucaauuaaaccucuuuccuuuauaaauuacccagucucaggcaguucuuuacagcaguguggaaacagacuaauacauuguguuaggccauuuuagcauugcuguaaagaaauaccugaggcuggguaauuuauaaagaaaaaagguuuaauugguucaugguucuucaggcuguacaaguaaucauaguaccaauaucugcccagaaagcuuauaaucaugaugaagggugaagcaggugcaggcucaucacagggcgagagugggaacaagagagcaaggggaaggucucagacucuuuuaaacaacagaaucucauauaaacuaacagcaagagcucacuuuuaccaaggggauggugccaagccauucaugagggaucugcccccaugaucuagucaccuucaaccaggccccagcuccaacuuugggaaucacauuucaaaaugaaauuucguguggauaaacauccaaaccauaucacauagaaucuuguaccuauacaagacaugcaaugauuuguuuagaaguccauuuuuuccgguuagacuauaagcuucucuaggacagggaucacaucuuucuuccucuuuuaauugugagagacgcuucauucauauuuuguaaauaaauaaaauuugagagagauuugaucagagggaagagagucuaaagccaaucuauaauaauaaaguuauguauuuaaaagaaguacuauguuucagaguaauuuugaaggaguuuucccugaaggaaauguacucccuugccccacaaacccaaucuuuuuagggagccuguauucucaguuauccagcuucucuccugugauguucauaucucuauuuccauuuccauuggccuuucucuuuuuuuucugaccuaguuucuuucucaugggggaaaaugacaaccaaaauucuuuucaauuacccaauuacacuuucaccuuccauuuuguucccuuccuucuuuuaacugcuaaccuucucaaaugagugaucuguucaauauguucacauuuauacccucaccacaccaucaagacuaguuaugucaacauuaaagcacuucugaaaacucaaaagucacuucucaguuucucaucuucuuuaaguucccaauguuuuaaaacauuuucauaaagcaaacgauccuuuuaugaggugaaaaagcacaugauaauuuaucuguuuccuguaguuguucagaagaaaaacagguuuccagguugggguacugccaaggaagacggccugaaccucuuagaguggaguucggguuugggguuugacccccuugacccucaccagacaacauauugcuguuccagagcugacucaacuuauaagagacccagcauaaaaaacaaaaugcugaguuauugacauuaucauugacauuauuaucacauuacugagaagccaaauacuauucauggaagccaaagaaucugaagguugcuuggucacaacagaaucaggauaaugagaguuaucuacauaauuugaauuuuuaaauaauacuaagaccaucauagccugaccuauuucuuuuccucauuuaccuccacagaauuggaaugugaaauaacuuuuuuuuuuuuuugagacagagucuuccucuguggcccaggcuggagggcacugguucaaucucggcucacugcaaccuccaucucccagguucaagugauucucgugccucaaccucccaagcagcugggauuacaggugugcaccaccauaccuaauuuuuguauuuuuaguagagacgugguuucaccaugcuggccaggcuggucucuaauuccuggccucaagugaucugcccaccucagccucccaaaguaccagauuacaggcaugagccaccaugcccggccugccaauauguucuaauucugcucuuucugugcuuccugacuaaccucucuucuuauuuauaucauauuuuaaucagguuauaauuaaggcuugcugucuuggaucuguaucucuacaaugauccauuauuuacuuauuguacaaauaaacuuucagagcuuagucuuaauuguaaguaauuggagaaugucucacugucaucuauauguccaucuaugauuuacaaauauggauuucuacauauuaugccauauuucuuuaagcaagacauacuugguuaaaucaccuugaucaccuacacacauauuuagcugaaaaaugagucuuuaugaucuuucuagaccagugaucuguuggcuguuucauuguucaggauuuccaaaaggauaucucccagaucgugaaaguaguuccaaguuagguuccaaauauuugagcaauggcaagauuauugggacaauaauaguagaaaaugacuuuauuauugguaugcaauauaaaaaucacagucauaaacauguguucuauugaagagaaacuauugaacuaaguaugacuggcuaacuucaaguuucauuaauauuuauuuacuauuuguucacuuacuuggucaucaauuagcacuugcugcaagacaaguaguaguagaagccgaagguuuaagaaacauuuguuggaggauaauuuaaaauugagaaauucaguucauaaauuccuuccccaugaauugggaaaugacugccauuauuugguuagaaugagaugauaccagugcuggagcauaauuugagaauugcuauauagggggagucgcugaauauuucugaugcuaugaacaacaauuuuauuauuucucuauuauaaauguaaaaugagaguagagaagcaagauuuuuuuuauaguauuugcuuuguaaaacuuggaagaaagaaaucucuugguuuagauuuuuaaauccuguaugacacccauuucuagagagaaaccaguagauuuuuaaaaguccuuaacaauauuguuccaaauaaauguauuuguaauaugaaaaauaugaccaaaaaugacuagaaugugguugaguaacauaguuugugcuucaucauugcuugcuaguuggaggagucacaaauucuguagaugcucuagugcaaguuguucucaaacauuaacuuacuucaaaaucaccuggacaacuuguuaaguuagauugcugaacuccgccccccagaguaucugauucugcagguuuggggcggggcccaaauauucauuucuaacgagaagcagaugcugcaaguacacuuuuaaagccacugcuguaugcucugggcuagcugcaauuuaacaagccucugguuaucucuguccuauuccucauaguguggcaacaaaacuuuaucaccucauacaggauuuacccugucauccucacuuuuucagcaaaauaguugcuuucauacauuacugaaaaaacugggaucauuagguauggucugcuucaaguucucauuucuuuuuuccaaucugccucuuuucuaauuuaagacucaucucacuuucugggcucuuuucuagggucuaauucuaucuuugcauccagugauuucgucauuagccuucgucuaucccaaguguucaaaccuucccuccuuaccagcuucuucucgaaagccuguaaauaaccucaagucuuuugaucuugaacaucuauaucauggcccugaauauuucuccagcuacucuuucucuuucacaggccaauuucuugggaagaauaaggaacuuauaggacuuuccaagucacuauaaccaagcuucuauuccuaccacucuauugaagcuguuuugccaacgauuaccuucaacuggcuaaguccaauuaauccugauucucguuuuagcaucauuaauaugccucucugaaacucugcucuccugguuucugugacaccacuaagcacccucucaacguuccuuguugacucuuccucuccuccucccauugacuguguuuaagguaacuguauaaaaucccaguggcuauaaccaguagcacaacuggaauauucaggcagaauggugcggauagaagcuagaauacagucuggagaucaggagaguauguggacauuuagaucugggaacuagaagcauugaauguggauauuuaggauuugauguuugacucacuucucauuguuuuaugcacugucucgggcauuucauugucuccuuuggcuuccgcugugcccacacagauucuugcgagaauguuucuaggccgaaucuaggaacagggcugugugucgcaugugaguuauguguguggaaugaugagugcugugugcuucugguuccuaaaccuaaaugugcagccacucucuugaacuacauaauuuauucuagcuucuaucuugacuauuuugccugaauauuccaguuugcuacuugucauagccacugagauuuuguacagucaccucaaacauauguccaaaacugccauuuuaguaugccuugucuugauaaaugguacuaccauccacucaguaagucaagaaaccuuggaaugauacuugaguuccuucuuugccuuacuucuauccucaugucuuacgaguacccaaguuauauaaaauucuacuucuuuagcauuucuccugccaucuucuauuguuuccuacuccauugacuuaacucuagcccguaucaccucuuccugaacuguuagcuccuuccaguuuuucacccuuccaaccugucuuacacauuacugucaacuaaaaagcaaacuaugucauugcauuaaaaaaaauuauuccaaggcucaccaucuuuuauuagauaaagcccaaacuuaaugcccaagacuuuauuugaucuggcuccugucaaauuucuagcuuucuuucucauacccuaugaucucaucaugcuggacaacuggcaguuuccuccaacacacugacuuugcuaauacggcucccucugccuaaauuauccuuccucauuuuguuaaaccaucauuuacucuucaaggcugagugaugcgucaucuucucaacaguaacgacaauaaugacaaaaaaacccaacauuuauuaagagcuuaucaugugcaaggcacuuugcauacauuuccauguaauccucaucacaagaccuugaagacaacugagguucagagaaguuaucuuccuugacaucuuucucugcuccagucaacacuuaguggccucaaaugacuacucccuaauugugucucugcuacaaucuauacauauggagguaagauaauuuauaucagagcauaguuuugaaggaaaugaucuccaauuucuuugagaaaaugcacuaauaggacgggcgcaguggcucaugcuuguaaucccagcacuuugggaggccgaggugggcagaucaccugaggucggcaguuugagaccagccugaccaauauggagaaaccccaucucuacuaaaaauacaaaauuagccaggcgugguggcauaugccuauaaucccagcuacuagggaggcugaggcaagagaaucgcuugaaccugggaggcggagguugcagugagccgagauuguuccauugcacuccagccugggcaaaaagagugaaacuccgucucaaaaaaaaaaaaaaaagcacuaauaagcugcugggugggcaguaagcccucaaagacuggagccugcuggaaucuaagaaaagaaaaaacuacuuaauauuaaaaacaaauaagaauuugugggugaggaagagcagaggacugaguagaaagaagaaaaaggggcacuguggagaagcacgauauuguggcaggagugcuuuuucaccaaggcuggagugcaguggugcgaucuucgcucaacacaaccuccaccucccagcuucaagagauucuccugcuucagucuacugaguagcugggauuacaggcaugcacaaccaugcccagcugauuucuguauuuuuaguacagacgggguuucaccauauugacuaggcuggucuugaacaccugaccucaagcgauccacccaccuuggccucccaaagugcugggauuauagguuugagccaccacaccuggccugcuuuuaagaauagaaauuuacaguacuuuuaaguuguguuucugugauguugugauguuaacucccuuucaucauuucacaaccuuaguaaaucugcugugcccacacagagcuuugugaaaaugcuuuugggugaaaccuaggaacagggauaaguuccacaucugaguggauguuuguggaauaaggacagauggcagcucauccaugaaccucacuaguuuaccguaaggggaaguucagagccaaagcgguucagugagaacaucagcuccccagaaauaagaaaaaaacuuggguugggcauuggacuugcaaaugagguggaauggagguucaaaccaauccuaaccgagagguuaaaacccagggagaucucagcugacacccagguuacauauuaucauaguaccuuugcucuuccuuguuuauauaccuuugucucuccuaaauucaccaguaagaagucuuuuugagagcagagacucuguuauucaucuuauauucccaaugucuaacaaugacaaauaguguacuuacuacguccucaguaaaugucuguuaaaagaauaauugucaaauuuacauaaguuuacugaauuaagaaaaaauaggcugggcauaguggcucaugccuguagucccagcaguuuggaugcugaggcaggaagaugacgugaggccagggguuugagaucagcuugggcaacauagugagaccccaucuccauaaaauuuuuuuaaaaaauuaacaggguaugguggugugcaucuguagcaucaggugggaggacugcuugagccccgaaguuugaaguuacagugagcuaugauugugccacugcacuccagucugggagauagagugagacccggucuuuaaaaaaaaaaaaaaaaaaaaaaaaaaaagacacccuaaugucuaauacuugagauaagauuuuguguuuaauaguacuaugucuaacacauuaaaaauauaaacauuauaaaauuacucaauaacuaauuauaauaaaaacuagaaaacuggccaggcacaguggcucacaccuguaaucccagcacuuugggaggccaaggugggaggaucacuugaggccaggaguucaagaccagccuugccaacauaacaaaaugcugucucuacaaaaaauacaaaaauuagcugggcgugguggugcaugcccguagucccagcuacucaggaggcugagacauaagaauagcuugaacaccggagguagagguugcagugagcugagaucaugccacugcacucagcccaggcaauggagugaaacucugucuaaaaaacaaagaaacaaacaaacaaacaaaaaaaaccccaaccacuccccccaccccuggaaaacaauaauaacuacaaauuauuaaauauuuucaaugugucaggaacuucccauuuaaaucugauaucaaccuuccuacauuaaguauuccuauccuuauuuuacaguggaggacacuuauuuucaguugaauaacuugcccagcauuauggcuaaagugacaccaaagccuuuauuuuuuacacuauaccugacugaguuaaagaaaugguuuuaaacauauucuggaaagaggaaaauacagcuuaugcugcaucuguaaaaagcuaaaaauaaaaacaaaguaaccuggugaaaccuguugguacaguucccugauuacuauuaacaaaugaucugagcauuacuuagucaaaauagguuuguugcauccaccuucagaaugugaaguaggaauaacagguugccuuagccacacuguaguuuauuuuauaugacaccaaauaacuuuugguccuguuuccacauguaauagaaaaagaaggcaguuauuugaauaauuuacugaaauagauucaguuucaaugaaaauacuuuggagaacuggauguuucuguauacucgucuuaacuuuauucucuacuuucauggauuaauagaccaaaaaauauuuuucuuuuucuuuuuuuuuaaacaaggggauguuuagcuuuucucaaacuuucuuaaagguauuccuugacauauauuagauaggucuaaauggaacuuuauuacaugagcaagauuagaaauuaauuuaauuauuauagaauguuacaaauucaaaguucucauuuccuuaagaacuuauuuauuuauuuacugagacagggucuugcuuuguuguccaggcuggagugcgguggcgcuaucuuggcucacugcaaccucugccuccuggguccaagcgauucuccugccucagccucucaaguagcugggauuacagucaugugccaccccaccuggcuaauuuuuuguguguuuuuuuuguagagaugagguuucguuauguuggccaggcuggucuugaaccggccucaaaugauccaccugccuuggccucccaaagugcuggaauuauagguuugagucaccgugcccggcccagaacuuauuuauuuuugauggcaaaacauuaaagauaauacaaacaucaugcuuaauuauguacuuauuccccaaacugcauuccugaucucuugcaccugcccagcauacuccaaccccaaucuuccccaucucagcuaauguaggcaaaucaauuuuuccaguugcucugaacaaaauuguucauccuucauuccucucuuucucuagaacccuaaauccaaugugucaacaaaucauauugguuuucaaaauauacccagaacccaaccaugucuuaagcccucuacuguaacaacccuaguacaagcuaccaucaucuuuugccuggguuacugcaauaggaccugucacucuacagacuauuuucaaccuggcagccaagguaaccaauuuaaagccuaaaucuuacgaugucaaucuucugccaauagccucucagugucaggcacacaaggccuuucaccaucuggccuagugcuucucugaccucauaucacaugauuuucuuucuggguuacucuucuuuagcuacaguggccuccuggcaguugcuucaacuuaccagaccuguccccacccuacgguuugcacaaguuguucucauagucuggaaugcucuuucuucagauaugugcagguaucuccuucacuuucaagucauucuucaaauacuacuuucucagugaggccugcuucaacugcccaauuuaaaaaugacaucuuccccauuucuccugugcuuggucuccuuccacaucccuuccuguauaaacuuuuuugauaacacucaugaccuucuaacauacuauauaauuuagguauuuauuuuaggcauuuauuuuuauugucuaacuucugcaugugaguuugaugauggcauauguuuuugucuguuuuguucacugcucuaucugcagcuucgagaauagugucagguacaugguaggccuacaacaauccguugaaauguagaaguuguuugauuccaguacaagaguuuuacauauuggauuccaugggaacgggaacaacuaaguuuucaugugccugaagagcucaaaggcucuuugaaacucugguauuccaugguucccuuaccauucugacucucaaaaacauaaucauuuuuucagcagccaagcacuacuuuuaaaagacacuggacugugaaaucuacaaugauaggucccuaagaggaugaucaugauuacaauucuacaagcuaccugguacuguaaaauuuuuuaacauuucuuuucuaaucauuguacugcuuuuccuuaugaaugcaauuggaagguaggggaagccaauuugauuacaccuuaauaauuuuguggcaccccaacccccugcagugcaucagcauauuugauacaucuuuucacgcugguuuuucuuuugaaauguguaacaucaggcagggcauggcagcucacuccuguaaucccagcacuuugggaggcugaggcaggaggaucucuuaagccuaggaguuugagaccagccugggcaaccuagggagauccccaucuauacacaaaauuuaaaaauuagcugaguguaguggcacaugccuguagucccagcuacugaggaggcugagguggaaggauugcuugagcccagaagguugaugcuacaguaagcuaugacugcaugacuucacuccagccugggcaacagagagggaaacccugucucaaaagaaaaaaaaaagaaaagcccugaauacuuuuguaauuuuuguagcacaaaugcugaaauuauucugcacaacuuuaguauccauccuuuggcuauucccauuuugaaggaacauagaauuuuagggcuguaagguuuuaguucauuugguucuaucaucucauuccacagauacaaaaacuggggugcaaugauguuaagugacuugcucagguacuaccgggcugaguaaucuuuuuggucagaacaacuugcucuaaacauaaaacaagauacuuuugagaaugcaauuggaaaacaguucucaacgucagaaaacaaauauagcaacaauugcaauauacgguucuaaacaauaugcaaucuacccaguuuauuuccauggugacaacuuaagcauuaaaaauagaaggcaaauauagcaaaggaugaaauaauugauaaauagaaaauaaaaaguccccacaaacauccuagcaaguaagaguuaugaaucucaaacaacaaagaauuuccaagucaccugaacugucacuguagcauccacaugagaagaaaccacuucuggccgggugcgguggcugacaccuguaaucccagcacuuugggaggccgaggcaggcagaucacaaggucaggaguuugagaccagccugaccaacauggugaaaccccgucucuauuaaaaauacaaaaauuacccgggcgugguggcacacgccuguaaucccagcuacucaggaggcugaggcagaagaaucgcuugaauuggggaagaggaaguugcagugagccgagaucgggccacugcacuccagccugggugacagagcgagacucugucucaaaaaauaauaauaaaaagaaaccacuuccauggaaucagagagaugguuccauauuagccaugacuucugcugcucuuuugagaaugugggcuuacuaccuaaucauuuuaagaugcccaugggcacuuuuacuuagauacaugcacuuucucuuugcacuagugagucuacgugaauauuacaugccagaggaacguuaaagucuacgcuaacaaugcuucauuuuucuuuaacaauuuuguccaggucauggagacauuuuuguggagugauaaauuaacuuggucuccugauguguuuuccccacaugccuuggaaaaucacuuguuuuucugagaggugguagucaucaaagccuuaacuucagcaacagcuucgcuguuuuagcuuuguuauaauuaagauacccuaguaccauugauaguuuaggauauuugauaugaauguaaugcaaaaauauuuuuggcccuuuguauauagcaauggucucaaacuaugagcaaaauuauggcuaaaucagauuuucaaaaauggauuuuaagaaauuccaggagguaggaaccugguuaacucaugugacuuuaaaaaucagaucucugccaacagcccaauucaguuuccuaagaauaaauuuuuaaacuuccuguaucaaugccuuaacucaguuucccuucuccaugugucacucucauuaacuuuuguugugcgugauuuuuuuuuuucuuuuuuugacggagucuaguucuguugccaggcuggagagcagcggcgugaucucggcucccugcaaccuccgccucccagguucaagcgauucuccugccucagccucccgaguagcugggacuacaggcacgugccaccacgcccggauacuuuuuuguauuuuuaguagagacgggguuucaucauguuggccaggaugguuucgaucuccugaccuugugaucugcccgucucggccucccaaagugcugggauuacaggcgugagccaccgcgccuggccugugugugauuuuaugcaggcuggacaccaguauccuagaauaagaugaucuggauucuauccugauaaacuggaucaaacagguacucaucugaugcaggugaaacuccagugcaggaacuucuaugauaacauuaacugaacauaauuuuaauugaaaugaucuacuuuuauguuucuuuagaugugaacauuaauuuuucucuuaaucuucuguuaacuaauuucuugguaauguacucaaaagagcuuucaaccagucuucccauguaagaaguuaucaccauacucacucuguuacuuucccuuauacugcacacuuugcucagcaaugaauugaucccugauuuacacaucaagcugagcucucacauccuaaauauaucuauucuuuuggaauuuuagguauuuggcaaauauugaagcguuggggagauuaaagagaaucaaacacaacacuagcagacucaacuacaauccacagaggaaauaaccaaauaaguugcuauuuuaaacaauuuaagcaaauagaaggaagggauuucagaacucacaguaucuauaggcaagaaaauaacugaagcagugaugcuuaaaaagacuuggugaggguuaauacuugaaucccuauaaaauacaguauuuuauaguauuugacaacacaggugugaaggugagcauggauaaccaguuuucuucucuaagcaggcaauaagaauguuaaauauaaauaagacuucauauaauauaaagagugaaagacugaaagcauugucuuacgacuacuguauuauuuaaagaacuacaucuauaucaauuaaauguggcaggacagaauguacaguacaauacugggggugcaagauuuuaaaaugaggaacaggccaaaaucuaaacacagaaucguccaaaaaaaaaaaaaagccuucaaguagaaaaaguuuucaauaacaaaacaugguaguuaaacgccugcgucuaguaacaugaguuggggaaaaaacauuaauagcagauuaaugaaacagauucugugcgaggucaggguagggagugauggcgcgcggaagcggcguaagagcugguuucgccgucccagaaaggguuccacauccacacgccuguacugcggcccugcggggagcguucagaccccuccguuucccuucaccauuguaaacgcgcaaucccauuaagaucccguucacuccaauuccuggaaagaagcuuagaacggugaaucucuuccucggaguugaaaaucaacuuccagugccggucacccaauccuucaaaaauccuagcccucucgggcccaauuccuaaagaauucaagccugcacccuguacacccugaccgaucucagcucguccccacuccgcucccagcguccccagcucuaaacgccgccgcguggcucagcgcugcccaagccgggcccugaaggccgcgcacaacgccccgcccccggcgagcguggcggaaguagcucgcucgggcugggagagcgcgcgccaccuggccaagcgcgcaugcgcccgcacugccagugcggggggcguccguaucgcuuacuccucagucuccgcaacccccgccccaccgagagucgggcucacgccaucuuguaccccccccaucgccccgucacacagccgagucaccuuuucccuuucuacacuccacacucucagucccccaccccgccccuuuccaagcgugucccgggccgcagcagcagaaaccgcaccaucuccacccccacauucuccucgcgggaagcgcagcagugccuccaaggguucuuaaagcagagguuguagggcuugcggggggcggugcggggauucgggcgggggagacgucagagagccgggagggacgcagagcggagaucccagcgucgcugggcccccgcgccggccacgcccuggccccggcucgagggcggcugccugggucuucguggucuacgccggaguguugaagggagggcggcugugggaggcgcuggccgggcgcagcgcccugguuccgcugccgagcguggaguugccucucgacuccucccuuuuggcgggugggcguggggugaggggggcugggcugugcugagaagcggggugcgcgggucgucuagguagugugggggcugccggaggaaucauuaaagagggaaauuguugcuuuauggcacggcgagagaagaguuagguaguuagugggaguguagcauccagaaagaggaaaagauccgcuguguucucuguggggugagcucacgucugugaccccuggggaaauuauuuagcuugucuuugccuuguuuuggucuguaaaauggcgaucuuauagccuauuucagaauugugaggauuauaugagaaaauacacguuaaacgcuuagaacagcgccaggugcugcucaguacauauuagcucugcuuuugcucuccacguuuuaggaguucagaaugacugugaccuuauuuucucagagaaucaggacacuuggucucacacgugagagugaaguuaugaagacagugauauguaauauuugacacucagacgauccuggacguaguauuacuguacacguggauaaauuagcauuucuccaagaggcuaauagaaauguuaaguuauuucgguagaaagaaauguguguguauauauauguauauacauauguguguauauaaguauauguauguguauauauguauguauguauuuggaaggagaggaccuggggucuuaguauaugugaagggcagacucuggaagaggaauuaaauucgcccugcaaagauuuacuugaaggacaaaacuuggggaauuucuggugaauguuucaaagaggcugaauuugccuaugagaaacaguucgugagaguacuuugcaagaauggaaugcucuucauugugcuauggaaaguuucuuaucucaggauauucgggacguuggagcgaaguaugccuaagucuagggcugcacuuuucacuagcaguuucugccuugauggagauguuccauaaucugugccuuuaggcacuagugguagccuaggcacaguggcucuucagcacuugaaaugugauaagugucacugaggaacuuaauuuuuaauuuuauucauaaauuaauaaauugauuuacguuuaaauacccacauguggcuagugguagcuacugcauuggacagcacagggcuacaauuuagauuuugagaguccuuccgagucuugauaugguugaguuuuaaaucagauaagccagcucuuuggaacauuuauugccauagggaauuguaauuauauucaaauaaugccuuucauucaaauacugcaguucagaccaugggucuguuaguacuuauuuacaucuugacaaauuaaagcaaaacguugucuccuagguuguacagcuaaugccagauucagagagcuaugacaguauuaacuggaguuuucuuuaaacauuauuguacuauuuugugauugucgguuucugcuaucuuuuaccacuuugguugguuuuucagugagaaguuuccagcucuuauucaaguuuuuuucuuuuuuaaccuuuuguguaauaaagcgauuugaaaaauuguaacucuugagcauuaggacauuuuagaacuaguuuuaugguuauccaaaucuuuuggagagauaagugaaauuagguaauagauguuucacaaaauuacuuuacuugaaauaugugcaucuguuuuuuuuuuuuaaagcaaguguauauaaagucaaauuugaaaauaaaacuaaaagaacaaauaaaaaaccuuuauagguagcgguagcacccuuaaccuuggccugaugucuguaaaauggugcccuugggccaggcacguuggcucaugcuuguaaucccagcacuuugggaggcugaggccagaggaucucuugaaccuaggaguucaaggcugcagugaaucauggucaggccaggcuuccagccugggcugcagagggagaccuugucucuuuaaaaaaaaaaaugaugcucuuggucuuaaggcugaagauaauuguuagaucuggagcaauaacuuaaagcucacgaguuaaaucagauggagagaauagcucauaauauacaaaucagaauggggugcuuuuaugggugacuauaguaucuuaauuuuucugagacagucguaguauaaagccugauuguuccagcacaauuauuuuauuuaauagaaccccuuucacuaucaaaauguucgaauugggaccacaucauaaugucacccuacuguuagccuuguugggacuuguaauauauaguuuuaggaugauuaaccacauugcaauaucagaaauacuuuauuauuuuugagauggaguuucacucuuguugcccagauuggaguacaauggugcgaucucagcucacugcaaccucccccuccuggguucaagcgauucuccugccucagccucccgaguagcugggauuacaggcacaugccagcaugccuggcuaauuuuuguauuuuuuguagagacagaguuucacuauguuggccaggcugguuuugaacucuugaucucaagugcuccacccgccucagccucccaaaguucugggauuacaggugugagccaccgugcccggccagaaauauacuuuaaaacagugacaaaauuacuguuuuugugucuaaauaauaaauaagauaccuggaauaaggccagcaagugacuuucccauuuaagccacugauaauuuuaaaauuuugcuuugaauauaaaccuuuagcagcuugaguuuugguucccucuggaagaaaaucaucuuuuggugggggugacugcaugguagucuaugucagucaaaucaggugauugaguauuuguguugaaauaacacugauuuuauuuuauggugagguugaauagugaaauccgucagaaaucugauuauguauuagaauguuaaagaaggguuuugcuuacaguuuacuuaaugaaaaauaauucagccauaugcauuauuauauuaaguuuauacugaaguggguaaaauauuuuauugaggcucuaacacuugauuugaguucucgcucugcugcuuccuaaccaugugauuugggacaaauuauuuaaucuuccuaagaauacuggguuccucauuuauaaaaugaagaugguaauggcaucugcuucuagguucauaagagguuaauuuaaauaacucaugugauggguugugugcaguucaguaacuguuagcugcuguagccuuaaguuuauuggauaaucuagaagugauaauaauguucugagauguuauguggguuggugaacagagcacuaagacccaauucuguaaaccuagcuuuugcccuuuucuggcacauucuuuugucauuucaguuaagguauuuaacuuauuaauaucagagccucaauuuccuuaucaguaaaauggaauuaguacccauccucaucccgcuuucucauaggacuguugguggcaucaaaugagaauuacauuuaaaaauuaucgucuuacuuuacaaacauuuuuauauugaauugguuuugucucaucuugucuaccuucagccuccacuaaagagugaccugcaaaaauuguuguguaaauuuuguguaacagcauggauaguguauaauaggcacuauuacugaagacaguucucuuuuacaaauaauauuguaagucacaggcugggugugguggcucacaccuguaaucccagcacuuugggaggcugagauggguggaucacuugaugucaggaguuggagaccagacuggccaacauggcgaaaccccgucucuacuaaaauuacaaaaaaauuagccgggcaugguggugcaugccuguagucccagguacucaggaggcugaggcaggagaaucgcuugaacccgggaggcggagguugcagugagccgagaucgugcacugcacuccagccugggcgacagagcaauacucugucucaaaaaccacacacacacacacacaaauaauauuuuaagucacaguaauggugcuuuuuugaucuggucacaauauauuuucuacggaaaacaaccccauacuacugcuaagggagaaccaacauuuucuugggcacuugauguguuccuuccguuguaucucauuuauccaaacauauucccaccuaauagguuauacuaaugaggcucuuacuuucuagaauuggucugugaggcuuuuuuguacuguaguucucccucugaaaauaccuggcccauaguuaauggguagugaagguuaaauaagauaaugaacaugaaaaucguggccggcucugugacuucaugccuguaauaccagcacuuugggaggccaagacaggcccggguugcuugagccuaagagugaugggcaauauagugagaccuggucucuagaaaaaauuuaaaacaaaaauuagcugggccgggugcggugacucacaacuguaaucccagcacuuugggaggccgaggcagguggaucgccugaggucaggaguuugagaccagccuggccaacauggugaaacucugucuacuaaaaauacaaaaauuagccgcgugucuuggcgugcaccugcuacuugggaggcugagacaucagaaucgcuugaacccuggaggcggagguugcagugagccaagauugugccauuacacuacagccugggugacagagcaaaacuccaucucaaaaaaaaauguagcugagcuuggugguuugugccuguaguaccaacugcuugggaggcugaggugggaggauugcuugagcccaggagguggagauugcacugagcugagauugugccacuguacuccauccugagcaacagagagagacccugucucaaaaagaaaauaguacucuguuugguguaugguauguaggaguuacugaaaagaugcuguugaauucacaggacaguaaauugaaacaauuuaugugaauauacuuuauaaacuaaaauaacauacaaauauaaaucauuaaaaaaucuugaaauguacuuuugcugauuuaaaugcuauagugguuuuaugacugaauucuguauauuucacuuuauucauauuagucuuuaaaggucuacucuuagucauaacauucuuugagaauauacauguuuaacaguaaucuuuugugauauauuuucaagaagcuaugcuuuugcaugaguuaaucaucaucaucagcaugaacuaaaugccuuauauguacaaggcgguuuacuaagggcuuuacguauguuauuuuauguaaccuauaagagaaguaauuuuaaucuccauuuuagagaugagggaacugaggcagugagguggcauaacuugcccaaggucauguguaaguguuagagccuauaauuuaacuccagagccuagcucuuuacugcuuccauugugguuuggcauagucagauauuaauauuucacaacacaguucacugugacauacacauuguggaggccuuuuggguuaguuaugauaaacuuuuauuuguauauucuuugauguauaguagaaagaacucuggaccaggugucgggggaccucaguuuuagucccagcuuguaucacuaaauaguaguguguccuugggcaguucaagaaaccccucuggacuucaguuccucaccugaaaaaugagggauuuggaggaaauuagugauuuucaaacuguaguucugaagucugcucagaugucuuugguucccucccaccaauuugcauauauguuugucuguuauaguugcuuauccaucuaccuaagauuuucuuuuaaacaaagaauuucuuaacugaguguuuaaagucaucagucuccaagauaacuuaaugaccauguaaguccccugacugcuauguuuacaacuuuucaguuaauuucacaauauuuuaguguuuuaggagauagagaucuuuuacuaaugaaaaaacuaaagcacuaaaaugagaggauuguuauuaaaacauaguauaucuaaauggccugaauauuucagguuaucugcuaucugggaucaaagccuguuguuuauuggauuugugaccuucagccagucuuaguuuccucauugguagagggagaauacuugucuuguaggguaauugugaaaaaaaaaaaaaaaagugagcuaauacuggugaaguacccuuuauaaacuccaaauuccucuauuuuuuacaugccuacaguaaaucccccaguccuuuuucuuuuuggucacauaaacuguuuuuaaacacaucagauauuuuguaaauuguuuauguuuaaugcagaauucucauaagcuuuaauauuucugaaaugugacucuagacuggaagagaguuuugauuuuuaagggagcugcuuauuuuuuugacauguuugucaaauacacuuaccucuuacuguuaggaguauaauugcugccaaaaucuuccacauaucucaaaaguuaaccauuaaguaacucuuuaauuaaguuuguguaagaacaacaguguuuuaauguuggaaaaguaagugugcuaugugccauuugucagggcuuaaggauaaucugauaggcacauuugcagugcaccuuagggacuguuuuugcaaagaaauuuuuuuuuuaaacucaauuuuucugugagaguacuggauaugaaagcauauggaauagaaacuuaaugugagacuaaagaaggaggauaugcuagaaacuccugugucucggagcagucuaucacugggcuccuaugucuguucaaaaagaugcucagguaggauauguaaugcugcacaguuuuagcuguuuaucauccagagagaaaggauggggguaguuuucauguuuacaggguguuuugauauuuucaauucagauuuuuuuuagugcccauuauauggauuccugugagauaaauuauuccugacagagaaacugaacuuaugagauuaguugauccuuauauccuuauacaaaguucuauuauauugauuaauuauccuuaacaaaaaucuugugaccauggcuuuuauuucaguuuucugcuuuacaacaucucucacaaagcuucugcagcuuuuuaaaaucuccacuugaaugucuaauaguugucucaaacuuaacauaggcccaacugaacuguuuuuuuuuuccuucccagucuucuggaucucaguaaauggcaccaccauucaaccaguuucuaaggcuccagaauucggucauccuugacugcgcuucucucacaccccacguguaauccaucagcaaaucaguucugcuuucaaaauguauuccagaaaucugaccacuucucaucaucuccgcuuguuaaacuaauucaacccacugucaucucuugucugcacaaccucaauaacuuccuaacuggucuucuugauugcacucuugcuuccauauaguauauucucccagcugcuggaguuaucuuuuuaaaccuaaaacauuucaaguaacuucccuuuucaaaauucucuaauagcuucacauuacacucaagugaaauguaaacuccuguggccuaaaggcuuuauaagaucugcccucuugcuaccccuguguucauaucuuucuagccacacuggccacaggauuuugguacuuugcuguucuuucuguugggaaguucuccagagcucccucccagaucuuauauuaaaugccaccucccaguugaaaucaacuuguuuuuuugauuucauaguauuuguuauuuccucaaauuauauuuguuuaugugcuugucucuugcauuauaauguauuucuuuuugucugacuuagucacuacuauaucccuaccucuuagaacgguguuuggccuguaguaggugccccguaaauacuuagauaugaagaauccaaagcacuggugguguuggcuuuaaauaagagugugucuuuauuauaagaggagggaauuaagggaggauacgauacacugucuuugguggaggagaguggagggaaugacuaaaugauagcuuuuuauuucucuggaaguagaagaugaugucaacuguccauagcuaggggagggauucacugugggacagaggcucauucaacaaaaauaauuaguaugcacuaaaguaauuuaauauuaaacuaauauaaacuaaaauaauuagaugucagagaaagaauuucuuuuguuuacauaucugggaagguuucuuggagaugggcuuaggucaguagaguuuggguagguugagagauacuguauuguuucaaaagguauugcaaguagagagaacuguagggguaaagguucaaaagaacauggaaugguucuggagauagugaaaguuugauuugacugugguagaaaaggaggcuggggaggucaggugugacugauuugagauaaguuuauaaaccaggcuuuuuaauaccuuccaaaguccacuuaaaauggggcauauauuaauauauugagauuaccuuuguguuauucuaaacacuaggucuagaaguuuuuauagauauuuuauguauuuaauuuuuaauuuuuuucauucucagugauugaccauuugguauuauuuuucacaucagaagaaauuuagaucaugauguaaccugauuauuuuuuuaaacaacaaaacgaaaacucagugcauaauaguguuggcuuaaccauaauuguuuccugccuuuggaauuuuaugaaaauaaaaauguucuaauuauaaaaguuuucuauuaauuuauauuaugugagauguucagguuaucauuagaauugagacucuguagaugcucaaaaucaguacauaggucugcugaaauaguuuucuucagcaauauagaagaaaagauuaaaacuucucucuuuuaguggauugacugauaguuuucacaguccagauuuugaugauguuuggagggugcagaaacuaguaauaagguucucaacaauuugaggucuuuuaagcuuaaagauguuucaugguauuucuucuguggucauuuagucccccaaaauaugagaucuaacuagaaacccaguagcauguucagugcauuuuguuuaacucacuuuuugugauuaacuucacuacaauuaaaacuuuuuuuuugauagcaauauuuucugaggaaaggcgugcauccuuaaauuccuucauuuuaaauugaaagguaaaugccaauuuuucuucucuggaacacaguuuuacagguguguuauaauauuagcuauuagcuuaaugaucagguuuaaauacuauuaaucagauaugaacuuauuccuuggguucacauuuaaacucuggcauguugaaauaaucuaggucccaaucugcacaucugaauucauuuuguaaaauauggcaaacagaugcauuuucaauugaaagcugaaacaacugcaggacauuaacccauugaaaagauuacaguagguuuucaguuccacaguaacuguauuuauuagugaaaauugacuugagugcuucugcuuuuaacagacuuuucuuuuuuaaugucuagaagaaaggaaauagagcauuggaaugauaggacuuugauguguaaagaaguuaaugucaaaagaaguuaauuaucuaaaucaaacaauguggguaugggaaauaauuauuuuaaagagucuaaugaccuaucagcucaucaugucaagaaaaauguuauucaccuguuugauauaaaaauugacuugacugugaaaggaugaucaugguuauaauaaacuagguuuggugacuggauuugaaaaugaaaaaggagcagauugcuccagcagugucucaggacauuugaccauaggauaaucccauggaauggcaugucugucaaaucagacaagucaacucaaaucauaacuuucuggaggcugggguuacuacuuacucuuugaguuuaacauguucucgaagauagcucugucagccuucuauugagacaagggaacauuuccugaggucuuugagaaauccaggcuccuuuuuuucgcauuuugucccaauucugcaggacuauuuagggaaguccuuuguuuccuguuuucccccagucuuggacuugugauuuuuuuuuuuaauccgagucucaaaugguuauguuucuuuuccuguguuauuuguagagaaaaguacuuauuccaaaagucuuuuuaaacaauggcacaaauuuaggcuuaaaaaaagcgauggucuuucuuagcauuauguucuucauauguuuuagaauuuugguuuucgggcucaguuuaaguggaacguuuuuguuuuccuucgcuuuuugugcucuugccuucuugguauagugguuuuggccuggcuguuagggcccucagacuagaccagagggauauugggauauuccaaaccuagucaccuagcuagugugcugcuugccuuagaucuguguccugucgccuucucaaaagcuucaaauaaagccuaucuccaucagugauuuguaguagcuuuuuuuccccaaccuucuuucguggggcccagcccuuccaucucagcccuugguaagugacccugguuuagauucccuuuaugaauuuuaucauuacccacaggagugguuagauuagaaagauauauuaagaagauaaauuuggcagcaguauggagaaugaacugagauggagauagaagauguagcuaagaguuuuuagaaggccauagccguaggacaagaggggaagggucugagaacauacagaaaguagaauuuacuugacuucuuacaaauuguagggugcaggagaaggagucaaagguagugacugagacuuugagcccaagugacuaguaguuguagugaugucaucagugaaaacucaacuuauaaagaagcuacuuaguauuuguuuaguugcauagaggucuuuuaguaaaaauguuuaaguuuuaaaaacuugccugauugugaaaaaaaggguaauacaucuaaauuuauauaaaaguuuuuagcagauaaaggaggggaauucuuuuuucuucuuuaacuuuccccuuuaacggaagagggaguucuuaaggucugcuuauuacaauagcuaacauuuauuguguauccacugugugcuaucaguacugcucuaaauuuuuguauguauucauuuaauucucacaacagcccuaagaaggugagauuaucguugccauuuacagaugaggaaacugaagcacagagaaguuagguaacuugcccaaagucuuagcaaaggagcggagcugggauucaaaucuaggcagucugaccccagaaccugcccucuuaguuuacugaaaguccucugcacugcuuuacuuuaucauauguucuaaauaucuuacauucuucuuuagaaacugcaaaaaauauuuugaggaaaauuacagcuuugcaaaguuuaugcaagcauaugaaauaauaacuaauguuuauugagcacuuccaguauaauaguguaauagaugaggguuuaccuacuuucaugacauuauuuuaauguuacuuugacuaaaucuugccaauuuuuuuaaugcauuaaauaaaaugucauacauuaggauuggcacccacuuuaucauuaugcaucaccuuaauuuuauugggaaaaaugucacauuuaaaauugaguaaguuauuuacccauaggauuauaaaauauaaugcuuuugaucuaccgauugacauuauuauuuguauuuuaggcuuuuguucaaauaggauuuagauuaugcuguaguuuucuaauuuuguaucuuucagcuguggaauuguuucuuuaaaugagaucuuacuuggaaccuucauauaucaacuagaaaaaucaggguuguuccguggccugaaugaaacugggaguguguugugcuugggguccaucuagaaugcccugaagcauugcugaugaaccguagggcucccugaagcacauuuugaaaaccaaugagcucuaguaaaauauguuaauaaauacuguuuuuacauuaccuauuguaaaauaggugcuaaaguauuuaucacugaagugaguaauuggcugacaucuuacuugacuaguuuuuuuccaccuugcuauuucauuuuaauaaagaacauuaaguauaagugaaucaguuuugugcaaaacaaaucagaaauuuaaauuuucucuacuuuuugaaguaauuuauauuugcuuucuuuuuuuuuugcauuuacuuauagcuagguacauuuuguaagcuuuauuucuccuuuuuauuuagaugaauaauacggcagcuaguccaaugucuacugcaacuucaaguaguggaaggaguacagggaagucuauaagcuuugcaacagaauuacagaguaugauguaaguaugucccugcaugcuauugcuauuacuauuuuaaauuuauucauguugaaagacaauagacauaacaacauuuauaaaacuuaacuuggaaauaauuuguuauuaaucaaguaaaaaugaaauacugugguaacauuuuaaauugccauauguagaggcaaaauugguuaaaaaugcuacagugguacuguauuugaaaaaugaguauuaguucaucuuuauaaaugauagaaugaauaaucagguggacacaauugcucuaauuauuugccugagucuguguuauguauuguuuauuucuauucuaguuuauagauuuaggaaauuuugagacugauuauauucuuggacaguugaaauguuuucacauggaaguucuuaguuuuucucaacucuuguaauaauucaguaagccuaauuuaaauuaguuuuuaguucugauaauauuugaaaucacuguguuucagagcauuggggaaaaacuuagagcauuugaaaaacauguauucaaucuuugggaaauugcagagucauuaagauuucuuaaggcucuguucaucuugauuucugguuucuugcauuaagugaaacuauaucucuugauuugauaagagguagcauauuuauuagaaaugucuguugacacauaguaguuuuucauuauauugguucaggagacaauuuugucuguauaagguggggggcaagauauuauagugcucuucuuuuccuguggauacauuauucaugacuuaacagguaguugaaaagaauauaucuguugaagguuuaagugucuuccucuuguggcuaaauugauagccuucauaguugaauuaacgucacuaugugaugauuacuguuaaaagguaaaaugaguuugagcagaugucuuauaauugcaugaucaacuuacuuuauacaauauugaaaacacuuaguucaggagcucucaaacuuuuuggccuuaggauccuuuuauacuuuuaaucauugaagauccugaagaauauuuguuuaugaggguuauaucuauuaauauuuauuaguuagaauuuauuauuaaauuuuuuuuuuuuugagacagagucucacucuguugcccaggcuguagugcaguggcacaaucuuggcucacugcaaccuucacuuccuagguugaagcgauuuuccugccucagccucccaaguagcugagauuacagagguaugccaccacacccggcuaauuuuuguauuuuuaguagagacaggguuucgccauguuggccagaauuacuuagaauuuaaaaagaaagaaauuuaugcauuaacuugaaaaguaguaaaccuguuauauguuaauauaaauaauauauuucuuauaaaaauauucuaaagccaaaaauugauuacaccuuucagaugagaugccaauaaauuugacauauuuagcaacugcgugaagugagccuauauuuuaaauuauggaaaauuauaaguguuuaugcuuauauacauuuuuguggauuaguuuaauuuuuuucauuauaguuuaguggcuuuauauuaagaauauuuuauguuguguuauguuaauuauguuuaaaaauacuaagcauguuuuaaaagguuuagaauaaggugaaaaaauucauuuucuguagagcugguucauugauuuacuuuguauuuuuaaaacuuuuaauuugggaauuuucaaacuuacaguguaaugaaaccuauauauccauaaucuggcuuuaacaauaauuguguuuuuccagucuuauuuaaccuuucucccuacucucccuuuuuaaaaaaauaugaaguauuuuaaagcaaaucccagacaucuuauuucaaaauuuauaguauuuauuaaaacaauauacuuguuaguaaaguuaaaaacagauguccuauagcagaagucaacaaauuauggccauggacuugcugccuguuuuuguaaauaauuuuuuacuguaccauacccaggcuuauucaucuaucuguugucuauugaagccuucaugcucugugccagaguugaguauuugcgacagagacuauauggccuguaaagcugauaauauuuacuauauggucuuuuacagaaaaaguuugauaaucucugaucuguaaaagacaguugccuuuaagaagaagacuacaaaaauuaaaaauaaaaauaaaaaaccuauguaccuaccaaaauuaaaaauaaaauauuaaaaaaaccaaacuguucccacaaaaauuaaaaauuaaauuaaaagcuguagaguauuauauucuuuuguuauuuauacuuaggagagcuucuauuuagugcauuugauggaccuugggccauuuuaaaaaaacugagaaaaaauaaaggcuaaauucagcacuuucuuauuaaauacuuuugcaaacaucuucccaaccaauguaccuaagcugaauucggaaugcaaaaguuauuguuggcuacagcucuggaagaaauguacauuuuccuucuauuucagaccucauagagaggccacuccuaauaguuacauucaucauuuauagucugaaguuauuuuuuuugcccuuaggaauuucuuuauagaacagggaaauagggccaaaauugggagaauccuuuuaaauuuacugguauuucuauuguuaugagauuuuuaggcuuuugauuguauaaaauuagacucaauauacauuuaauucuugcuuauguauauuucaaaugagaaaguguggacuuauucugcuauguuuauuuuguguuacaguaauuucauucugugacucccuacugcugcuguucauaguucuaagccuguuuauauugcugcuuuucaguccucugcugcugucuuccccaauccauucacuauuaaugaguuguuguucuuuuggcucccuggugucuaaauaaguaacaauauuguagugucauuucuggggaaugguuucacugaaaguugucuaguugucaagcacaaaugaaauagucaugaucugcuauuaaaucuagaacuggcaaccaaucuguccuaguauuagagccuugaagaacuuaccauauuuugaauuuggguggugaauaucaccagugaggcauucuuaacagaaguuguguuguuguuguuguuguuguuguuuuugagaggaaucuagcuuuguugcccaggcgcuggagugcaguugccugaucucugcucacuguaaacucugccucccggccucaagugauuuuccugcuucagccucccaaguagcugggaauacaggcaugcgcuaccacgccaggcugauuuuuguauuuuuaguagagaugggguuucaccauguuggccaggcuggucucaaacuccugaccucaagugauccaccugcuuuggccucccaaagugccugggauuacaggcuugacccaccgugccuggccccuucuuacagauuugaaaggaaaggauuaguagucuaacaaguguuaguggguugggaugauagcaguugugccuuaccuagugcauauaacugagcacauuugcuauaugcucuuuaucacagcuccuuugaauaaccuguacuggaaugguccagagguuuuucauuuuuagguuauugaacucaagcagccuguaaauuugaaagugaaaucuuuucaguugacauuacagguauuuuaacaaacuucuuaagaauuuuaauuaauuuaaaugcacuuugagagucuucacugaguucucugaguucuuccuuacuuuacccauuuauauauuucuugccuugucauguacuuuuucagaguuacaggccugaugauaaugaugccagauuucacagcucaguagugcuuaguaauuauaaugucaccacguuuuuaaaaauugggaguuuuggggauaaauagcaauaacauugaaaaaaucuuguuuacauguuacuuuuauauuguaagaauucuuccaaaugaaaauuucauccuuaucuaacauccacaaauuaaaaaaauuuuaaucagaauuuucuuauauauaauaaaauacauuuuaaaaauuguacaguucugcaauuuuugcauuuuaaaaaauuaccuuuguauuuuugagauggggucucuauguugccaggcugguuucaaacucuuaggcacaagugacccuccugcccccaucuccugaguagcuuggacuacaggcaugugccacugugcccagcuaaaaaucauucacugaguccuuauuauauggcaggaacugaaugccuucaagaggcauauagucuagcaguagagaaggagacaaauauuuguaaugcaauaggaugcgaaaaauuccaugguaguacaaaggagggaaugaggaacucuucugaggauaagcuaccuacguuuaggucuguaguucugcccgcuuccuggaaugucuguuaaguguucugcgagcaccucaaauuuagaauguccaaaacugaacuaacaauuuucucaguaagauuugcuucuucuccugagaguguuugggauaaauagcaaugaccauuuauucauugcugcaguguacuagagcuuuguuuuauaugugaaaugguaucauuugacuauuuuuuaaguauuaugaagauaugagcugugaaagaaugugugcccccuucaucugacuuuagagagcccugauauguauagucucugaauuuuuaguagauggguuuuuaagcuaacacaggcuuccuucaaauauuguuccccugguucauuuaaguuuuucaggaaacugggagaaagaaaaacccugaagguaaaaaguacgaacauacuguaauuccaagggugcuuuaauaauaucagugauaauaaugaaugcuuguauagaacaugcuguguaccaggcacucucuugaguacuuccauaugccauuucauuucauccucacacaacucugugaggguagaugcuauuauuccccuuuuauagacgaaagaauagagccacaaagguugaguaacucaccaaauauuauccuauagucaguggcaaauucuggauuaaugccaggaagucugacuccagauuccgugcuguugcacuuaugcuaaacuaauuucaguuaauaaacuuuuuauuuugauuuacaaaauuuaguuuauaaaugacuuucaacaguuuaugugugacuacugugcuauaaugaaauaaaaugugaaagcuaaauguuuuuucaguugauugcucgguuauuaguaacaaggaccaggugauccuccugccucaacaaguagcuggaacuacaggggugagccaccacaccuggcugauuuuuguauuguuuuguagaggcaggauuuugucguguugcccaggcuggucuugaacuucugggcucaagugauccucccaccuuggccucccaaaggguugggauuagaagcauaagccucugcgcccagccugucauuuuuauauuaucauagcauuuguugcaguuuccuauaucuaacaacagaucuuuuucagcaagggcauaucaguaaccaaaagaaaguauacuuuuucauagaaauuauauacuuacuauauacuuauuagaugcuuguauuuguguuauuucauaauuuuggauacaaauguggccauauuauuugaauauuuaaaugucuauccuacuuuuguguuuuuucacuguuaaauaauaauugaucuuccugauauuuaaauuacacuaaaauaugugguaaacuuacccauuuacuuuuugugaaaugcaucuguuugggauauuuuaagauauacuuuaguuuauaacuauaauaguaauuaggaauauuuucaaauuguaauguaagugagaauauguauaaaggcagauuuccugaaagugauauuauguauaaaagcagauugagaacauaaaaacacugcauaauggaaagucuuuuuuccuuucagaaaugaaauaggaaauguuuaaguuucuagauccagugaaauuaagugcuuguguuaaaaaauguuauuuuauaaauguggcuacauaaaauaauugauuuuuuuauuuaaauauuacuaucaauucucucaugagaagauaauaacuagaacuuucaguuuaggauuauauguguaauuaccagggaaaaaagugucuugcuuacuuacagaaaugaauucuugaaauucagguagaugaaguuauuugaguaauucugugaugaaaauccuuaguuauauggggaaaaauagguaaaaauucacagacccaucagccuaaaauugcaguauaauugcugauuaucacacuggagaguggcagucucuguucugaacuaauuugaugguagauccaugcuguaauugauauauagcuauuuauagucuuuuuuuauuuuuagagugaauauucauacguuucaccauguuccugaaugcuucucuagacucugcugaaaguauuaugugauuuauguacaguauuaacuuucaaaaaucugaaaacuuuauauucugcaauacauauuucagauaagagacugugaaccuguaucuaccucacaggguuaguacgaagauuaaaugagaugauugaauuaaaacacauaguguaguuccuggcagaugauaaacauugugcucuuguuaccauuaucuuuuuaaaaaauaaauaucaucaucaacauacugauuaaggaguuuauaaaaaguaauucaaguauagggggaaauauuugcaauuuaaugggaagaauuucauaauuauagagaagaaaggauuugucuacauuauagcaugcuguagaacuuuccacagugauagaaauuuuaguuccuuuuuauccggugugauagccacuagccauguguaccuauugaguauauuaaauaagccaggcagcugagcaacugaauuguagauuuuauuuaaguuuagccauaaacuuagcaaacagcuaccauauugggcagcacagaagaaauauaguaaauacaaauuauuuauagaaugcuucuuuucuggguugcaucuguuacauuuuuauugagaugggaaaaauacauuuuacauguuauaaccuguuuuuauauuugauuuuaacacggucauugauuacuuuuuuccugucucucuuuuuuaaguugucauugucccacaguucuuuauagcuuugaagauguuaauuuuuggcuacuuuggcaagucagauuugauugagaaguuuaauauuacauuuauguuccauuuuuuagaaaguaugaauaauaaagaaauguguucaguuucuuaaaaauguucuuuugugaauguauuuauauauauauauacucuuagucuuucugaaaaauccuaugacuguagcucugaauguauuacacuucauuauuaugucagcauguguaauugaauauguaaugucauugugaguuuuagguucucauuuuuauguagcuagauuuacaaaauuucugguagcuguaaaauuagcaauguuauguaguauucugucaauucauuauuuuuauuauggugagauuuugaaaacuuguuaguuuaaauguaccagcuucaaaauuaaucuuuagaaaagggggaccaggugugguagcucaugucuguaaucccagcacuuuugaggggcugacgucaggggagcucuugaggccaggaguuuugagacuagcccgggcaacauacuugagacgcugucucuacagaaaauaaaauuaaaagcaauuaucugggcccuguagucccagcuacuugggaggcugaggcaggaggaucacuugcaccuaggagguuacggcugcagugaaccaugauccugccacuguucuccagccuggguaacagagugagacugucucaaaaaauaaaaaauaaaaaagguacuagauaaaaauggauucuugaccgggcacaguggcucacgccuauaaucccagcacuuugggaggccgaggugggcgggucagaaggucaggagauugagaccauccuggcuaacauggugaaaccccgucucuacuaaaaauacaaaaaaauuagccaggcuugguggcgggugccuguagucccagcuacucuggaggcugagacuggagaauggcgugaacccaggaggcggagcuugcagugagccgagaucgugccacugcacuccagccugggcgacagagugagacuccgucucagaaaagaaaaaaauggauucuucauuacuaaaaauauaucagagagugguuaguaguuuuagauaggaaauuaauauuugaugccuauauuauauauugauuugccucguuacaguaaauucuguaaauuaaaaaaggugaguguaauuuuagaaaagaguaguaaauucuuaauauaguggaauaaaucuuguugauuuugacuuuuugcugguucugaagucccaugauaguuaaguuugccaaagcacaguuuugauuaucucuagaugugagacugauggacacuuuuacauuacagccaaagaaaugagaauugggccaggcgagguggcucacaccuauaaucccagcacuuugggaggcugaggugggcagaucacuugaggucagucaggaguucgagaccagccuggccaccauggugaaacccugucucuacuaaaaaaaaaauaaacauuagccaggcgugguggcacacgcuuuuaaucccagcuacucaggaggcugaggcaggagaauugcuugauccugguggguggagguugcagugagcugagauugcgccacugcacuccagccugggugacagagugagacucugucucaaaaaaagaaaaaaaaagaaaugagaauugauauauuccaauguguuuuaagauguuaacauauauuaacauauauguguguauauguguguguguuuuuaauauacuaaaauauauaaaaaauauauauucaaaugaguaugccaucuuuugcaaauauaucuuuuuuggacaccuauguagauuuuaaaaaaaaccuuagcugugaaauaccauaugccuuugaaaaaaauguuguuguagucauuagaaaguuuucuaauuggcauaacauuuuuuuccuaugacagaauagaguacacaaccacuuuucuagagaagaggagugagaaucuauuaucuuugacugcuuucuucuuaccuuucauagguuucugugucuuaaaacaacuacguuacaaccaguuuuugccauggcuaguagaguucuauuagccuuucauggcuuucucucuauuccuguauuacacugguuaguaauguguguuuaauagggaaagggggggaaauuaaauuuuugggguuggccuggcaaucaauuaauauuuauuuauucaacaaaaauaacauucuuuuugguuggaauuacuuuccaaacauucagacuuggaauacaacccauuucuaagucaagcacugauaguauuuuuuauucugccucuuccaauuuagaauuugugcauauuaaugucuuuuauauaucucuaauccuuuagaaguaugugaacauaguuaauguuuauuuuuaauagaaauaaaacuucacuuaucuggaauuuguaauuaaauauaaauauuucaaaaggcaaauugauacaaagaaaaauaaugcuacaucugagugauuaagguagcaugauacaguggagaagacuagguuuggagcugcaagaucuugguucacuucuuucuguauugguggauuuuauauuuuaggaacaauuaacccccacccccaaugaaaaacccuggaaauuuuauggguaggggaacuguuauaucaacauuuuauucuauaauaaaugaaguauuuuuuauacuuccucauagagacaguuuauauuauuuucugaaaaggaaaaaauuagaaaauacagaaaguucauaauuaacaccuuaauuauuaaauuaaauuaaauuaaagugcuuauuggagcugggcaugguggcucaugccuguaaucccaguacuuugggaggcugaggcaggaggauugcuugagcccaggaguuuaagaccagucugugguaccccaucucuaaaaaaaaaaaaaaaagccaggucuuuuggcaugcuccuguggcuccugaugcuugggaggcugagguggaaggauugcuuaagcccaagugguugagucugcagugaccugugaucguaccacugcacuuuagccugggugacagagugagacccugucuccaaaaaaaaccucaaagugcuauuaaggcuuugguauuuaucuuuccaguuucuuuccaaugcauacaaaaaauuaaaaaauaccaaaagcccauauuauaauuacuacuguguaacuuggguuuuuacuuaauauauaucacaggacuuuuccauguugauaaauacacagcauuaucuuuauaagcugcacuauaaacccuagccucaagcgauccuccugccucagccucccaaaguacugggaauacaggggugacccaccacaccuggccuaaaacuuuuuuuuucuuuuuuuaaaugugucuagagaucucugcauagcaacauauaggagacuguguguguguguguguguguguaugugugcgugcauuuguguaguuacuguuugaauaaaucaggaagccuuaaaugcagugaagccccuuauuauccaaggaaacugagacaaucccugaaugaguuagcagcggcaguagaaguaaugagauccucacacagaugagcaaaaaagaagaucauaaaagcaucuaugauuccuuuccaagcgaggcauacacuuugggguguguacauuugugugugacuuaauuuuuauguucuuaguaauuuuuagucauuacugugcuuuuuuggcaacuguccuuuuuuccuuucaccugcuauauugugaacaacuauguuaucagaucuuuuuauuucauuguguguauaucuaucauauuauuuuuaaucccugcuguuaaguaauuagguuuuguccaguuuuuccacuauuauuaaaaaugauauaauggaaucuugaaaccuacuauuugaaagucauagaggaauuuuugagucuaaagacuuuuuugauacuaacuuccuaauuuuuccuacaggaaaguugaacuaauguauuucuaucaaguuaugagagcaccucccuccaucuucccugacaauuuuuaacaguaaaaauauuguguuuucagcuuuucuuugacaacugagcuugaaaauacuuuggccauuuuuauuucuucuuuugugcuugucuguauucuuaguauaauucuacuguauuuuuuuuuccuauuaaggaccuuugauauacuaaaggcacugaccuuugguugauuauauuuggcauuuucccuauuuuccccgccagcaccuaaaucucgugguugccuuaagguuuguauauagugauuaaaaaaaaaaaugaguuuucauugcucauauaguugaaucagucuuauauaucuuauugcuucugucuuugacagaauguccuacccuugauuuugauacauaucuucaugcacuuucuuacauuucauauuuuuaguuucuaugguuuaauauuuaauccauuguuuuguuuuaugaugucagggaggguucuaaguuagaauaauuuuucuucaaauugauuugccaguguacuuaccaucucaaauuauauaagccuuuauuucuccucagaauugaaauacuaccuuuaucagauaauaaauuauuuuaaacuuuucugcuuuguuccguugaguagucuauuccuuugccaguacugcauuauuuuaguuauuauagcuucuuaauauguuuuaauaguuaguauuauaguucaaguccauccgcauaacuuuucuuuuuaaaauauuuuugacucuuuuccuauuuuuauuuuuccagaugaauuuuuaggaaucauuuuaucaaguuccaaaacaaauucuaagugcaaauuuuaaguaguuucauuuuucuuuucuuuuucugcuuuuugcuguguacucagauuucagacauuggucugugcaauucauuuuacuuuuaaaguugauuaaugaaaucauuuuacauuuagaaaguuuauuugaaacaacacuggagagaaacaguaaaaacaacugacuaaugagugggccgguuaacuacuguacuauuagagacucugaagaacuucucaguuuucuuuaauauuuguuuuucuugcuagaauguagaauugugcugugacugcaguauguaaaaaucagccaaacuauucccucaauuuuaaaucaugcaguuauugucuuaauuuugaaugguagucauagcuggaaauaaaugaccaguuuaauuuuuuuauagauauauaaaacugcauucugacuaauagaauuauauauauguagauaucuaugcaauauaaguaauaaagaauaaagguauuuaauguauucuuuauuuuguaaauacaugaucuaagugaucaaaugguucuauuuuaaagaaauuauuucuacaguagauuaugaauauucaugacuacuuauaaacagaauacuagguacaguugcuccauaguacucuacuuguaauacagugauguccuagugaaucauagaagcauaaaauguacuuuguuccuaggauaaauagucccaaucuguaauuuuguuugaauuuauagauuuauuuuuauaguuuuuguuuucucuccccuuggcugguaauuuuguugcugucauaccagacuccagcaauguuucaccuucuuuccuuuugaauguugcuuccagucuacaacaguauaguaaucaaauuuauuagauuuguaucuauaauaagaguucauaaacuaggaaaacuugauacacuuucuuuucugaaaaaaacuacuugaucuuuggugcauaaacauaauaucaguuuugagagggguuugcuuacuccuugguucauauuuuuuauuguauuuucuaaggcugaaauugucagguagacgaucaaagguuauuuguaaguccuuugggacugacucuuuucucaaugaaauacuguuaggauuuuuaguuagauugcuguaguucaguacacuucuuuugcuuauaaaaaaggucagguaauauuuauuuucagcuaugccuaauuaccauucauaucauuuuaaggaagcaggcaagacagcugguugggauggcaaagauuugagguaggggaguuugaagagagugguaaagguuuguugugucagcgguagaauuagggacagaaagcuaauuaggaguauacuaauuguugccuaaguugucagugacucagcugagcuuagucagcauuuauaaggccucuaacaggcuguauuacucuuuuucaaagugcucagcagcugggcauagggcugggaaagaaagauaauuggguuaauuuagguauuugaagggcagauguggcagaaggcuauugaaauuugagauguuggagguucugaucacuaacuuugggcugguugggagggauagaauagaaaguauggaguugaucaauuuggagaaaaauggggagggagaagggauuggagauuuuagugaaguauaaaacuagguagaguagaaguaguaauuaagagagcuggaggaacagaaaauguaacagaaaauacaaguaucaccuuggaaaucucaucguccuggaagucuucuuugacaucuccacucaguuuccuuucugugugcugugguaacuuauaauacucuuuuaaguccucauuuuacuauguuacagugaucuuuuuauuuuucucucuuccucaccauaagcucccugauuauggggauuguuuuaaauuucauguuuuacagugccugguacguaaguaugccugguagguguugaauuuaguagaaugcauaggaaguugugaucuugauggguuaguauagcguaggagggcagucucugugggaguggcugaagugaugagugaguuguauacuugaaguguuuucacuaauuuagagcauaauuuuuuuguauguaucuuaguuucugugaccagcuauuacagugguccucaaccauuuuggcagcagggaccaguuucguggaaggcauuuuuuccacagaccuggguuggugggguggggacauggggcguaugguuuugggaugcaacuguuacaccucacaucaucaggcauuagauucucauaaggagcgcagaacuuagauccuucgcgugugcaguucacuauagggucggagaaucuaaugcugcuacugaucugacacgagguagagcugaggugguaguguucgcucuugcugugcagccugguucccaacaggccacgaacuggaacuggggguuggggaccccugagcuauuauaaauccgucugaaaauguaaagacuucauucauuuagacacuacugggauaucuuaaauuuccugauuagaaccuggcauuuagcugacaaaaagagcuuauccuuaaaauuuuuuguuguuuucauguguuuuauaagcuuccuuuaaaaggcauaguaauaugauuaugaccacaucuuagcagccagaaauuauuuuuagaaauuauuauuugcuuugaaguuaguuuucaucccccuauuuuucccucucauuucuacucucaacauuuagucuaaagcaguguuacucagcaaguuugugacuauuauuggucuucugugagaaagcagcuugagccaaaauguaaaccaauucccugcuuccuuuguugaaauaguuuucuugugauaaaaggagaaauuaaaugguguguauuacaaauuaccuaauguaauugauuuacauucuggugcaaauuccuuguauuuuauuguguacuugaaacaguuuuuagacuagcaccuguugggcagaccacauuuaaucuagaagauuauuauauacaaauguuuuuuguuuauucauucacaauuaccaagugggugccuacuguguacuaugcaccauucuaggcucuggagauauagcagugaauaaaacaaacacaaaauccuuaaucucagggcuacauucuaauuguauuagaaauaucaauuuuauuucucauuucucagaaauacuuuuguuuuuguaguaaacuguauucuugcaguuuauaguuuuguguauaaaaacuuuagacuuaauuguauguaucuuuacauauaguggcaauacuacuuuauauuuuuggcucuaguaauuuuuuuuccugugacuaauaaaaccuuugaaaacaguaauugcuuauuugagucacuucccaauuuuacuugaaauuagcuuuucugaagcaaagaucuuuuuauuuaaaaggagauguaaaaggaauuaauuuugaauaaaagagaacauugacaacaugaacugauuaugcaguggauggaauuguauguuaagcaaucauuguuugguugccuuucuuauauucugacagaugaccuguuugucagacuucagaguauuuuagagacuauauugaaauaauauaauuuuaaugaugaaauauaaagagcagcaaauugaugaaaaccagugaaacaaccuaugacuuaaaaaaaugaaucuuccagugcaaugguucccaaaccuuagugugcauuagaaucaccugagagccuugcugaaccauuaaacugcugggucucaccuccagccuuucugauugaauaaaucaagggugaacucagcaauuugccuuucaaauaaauucccaggugauguugauguuggugauccagagaccauacuuggaaaacuagugcuuuuauauaaugucaucuuguagugccccgauuuaucaauaaguagcuaauuuaaucauagccguagcagauggugacuuaaagaaaacucagcagguaaacugaaagccaagaaagaacccacauuuuucuuaauccuuauuuuaguggacucauuaaauggaagauugugggacaaaauauagagaauuauugugauuccauaauugugacuuuaaauauguagaaguagacugaaauacuagcgauauucuuuuuucccccucuaguguaguugucccuagaagaacuaaauugaaauuuaaauaccccauuuguauuauaggcaguaacauuuauaaucaggaucccacugauuuacguaaugacagaauuuaaugauaccaguggaaagauuauaaaccucuuuccacucauaaauucauuuauucaacauuuacuaaguacauguggugugccaugaacuguguauacauuuguggaaauaaauaauuauaaauugugauaaggacucugaaggaaaauguacaggauacuaugagauaguguaaugggggaacuaaagccucucaaagagaguucauuuaagcugaaacaugaaggaucgauaggaauuuugguuacacagaguugugggaagaggaaauaucacuuccaucacuaaauagguaaugugcacuaacaucuuccuauauauuauuucauuuaaugccuuguuaguugaaugauauuauugccaauuuuuuuuuuuuuuuuuugaguuggaguuuuacuuugucacccaggcuggagugcaguggugggaucuuggcucacugcaaccuccaccucccggauucaagugauucuccugccucagucuccugaguagcugggacuacaggcaugcgccaccauaccuggauaacuuuuuuuuuuuuguauuuuuaguagagacgggguuucacuguguuggucagucuggucuggaacucuagaccucaagugagccuucuaccucggccucccaaagugcugggauuacaggcgugagccaccgugccuggcuauugccaaauuuuagauuaagaaaaugaggagacgauaaaacuaaugguagagaauuuuuuuuuagaauuuagaauuucuuuaauagaaauuaaauagcuuuccagagucauccagcuauucagugguagaacugggauuagauuuggucuuucugacuccagagucagacuuuuaacugcuauguuauauuagauuuaaacuuauuuucuuaauuauuaaauaauguaaguaugccccuuuuuucucauuucuauggaaaugagaaaggugcugcuuuuaacguaaaaacuauaagcuagacauaagcaggccauuuagagggauacauacacauauccacauauccacacauguguacacaugcauacauaccuauuuauauaacuuuaaacuuucucugauuguaaaaguaaugcauuuguuugagauuuuggaaucucuagaaccaaggagggaaauaauuuuuucauucacagguaaccauacugacauucuguuucauuauuucaguaggcauguaguauuuuuuaaaaauaguaauuacaaugugaauacagaauuauucucugauaaauagacaaacaguguuuuaaugaaauauacgucuuuuuuuuuuaaaaaaaagaauugugaaguucuuuuuuggauguagaaaaauaaaguauuuggauuucacucuucuauuuaaagggaauaaucucacaggauuauguuucuuuuauuuaaaauuuuuuucucugucaugugcauauucccuugcuuuugcagacagaccccaagaaugcuggggaauuuaaaaauauauggaauguaagccuugcugcauuuauguuuauuaaccaguuuaaaaaauauauuaaaggucagauuuuguuuuucucaaacuuaacaucuugccuauaaugauacauggauauuccuuuuggguucauuaugugccauagugauuuauguugagguauuucuuuuguguacaucuaccaccaaaagauuuuaaauacaauugcagaacuuuacauuuguaacuugagaaagaaggaaauacaucuuaaaaucagaacacuguucccuaacagucauauauauaucagugaaaucgaauucauuuuaaagaaauuuaauuauucacuguaguuuaauuuacuauaucucuuaauucuaagguguugaauauaaauuaaauuuagauguuagccagauaucccauuauuucacuuaucuuaauaugauacauguaaauaauucuuuagucuuagcuucuuucuuugauaguaaacucacacauauuugugggguauuuuuauuuaaaauguguucaauuuuuaauuauauaaaguaccaccucucuuuucagccauguaaguuauuuuuaaggcauuuucuuuucuuauauaguauuucuuuagcuguuaccacgucccuuugcuaaguccuccuacuuuuuguuuaggcacuuguuuauuuguccauccacuuccaccuaauguuucauuaauucauuuaagaaauguuuauugaggcccggcgcgauggcucacgccuauaauccuagcacuuuggggggccaaggugggcgaaucaccugaggucaaguuugagaccagccugaccaacauggugaaacugggucucuacuaaaaaaauauaaaaauuagccaggcaugguggccugcaccuguaaucccagcuagucaggcagaggcaagagaauugcuugaacccaggagguggagguugcagugagccgagaucgcaccacugcacuuuggccugggcaauagagugagacccuaucucaagaaaaaaaaaaaaaaagaaauguuuauugaauuccuauuauaugccaggcauuuggcuagaugaugugaaaagaaaguaagagugggagagagggaauucuuguguaucugugcuaccaagagaguguguaguuuaguguacuguauuguaucucugugcuuaaugaaguugccuguggggcugcucaggagggcaugcgagguucuagcuacccucucacccuucuucguuucaacccuguagacuccuuuaaaaaucuauuuuauuuauugggcuuucucauagcauuuccuaugaacaauggauuuugcaauuuaaaaacuucaguaucaccugucuaguagaauuauauauauuuacauauauacauaaguagagugagaaucuuacacacauagaaacugagagaaugacaggugguagaugcagguaaguaugugaaaagaguuacagauaugcuacuauaggaauauggagguggaucagagaguuuucaauuuggaggaugaaagccagugaaaauagugucguuugagauuuuucuucaaggauaggcaauauuuagcccuguagagauuuguagguagggugacagugaggauagguagggaauauugcaaguacgggagacagcaugaucaaagacacagaggcagggaugaggcauuuggagcaaauagcuuacugugucuagagagaaacugggucauagaaaauacagauaaaacaugauuaguaucaaaauguggcaagcuuuggcagacugaggaguuaagucuuuuucaaagacaauuggaaaccuuugaaaaauguuugaaagauaaagguacggugugcauugauacucauuaagaagaauugauaaugcaucauguaaaaugaguuggcuguggaaagaccuauuguaguaguccauguaagagggaaugggaaugaagaauagcaagcaaguguaagugauauugcauagguuagauuguuaggucuuggggauuuaugagauuagagaauuaguuaccaaaaaugauuccaagguuucuaucuuagaggacuagcaagcugaucgugccauuaagcugcagguuugagcguugguuuaucauuuguauccugguugaggagucuaucauaauuauuuauaauacuaaaggauuaaaaaauggaaauugagaugaagccugaaaggaauagagauacaaaauuaaucuagaagguaaaagucugcagagaugcauauaauaaagucccucugguugcugagauggggcaaaaguuuuacugucaaccucauagcaaauaggaaaacaugucauuugagcaugacauuuuacagucuuuaacaaucaagugaacagaaguuuuauuuauaauacuaaauuguaauagcuuaucuuugauauuuuuauaaagugucaaagauuuuuauaaguauucugacaucuuguauuaauaucucauuuaaaucucaaaacauccaugugaggcagcgcagaugaguggguaguuucuccucuguuucaucccaugaggaacguuuuaauguacagccuuuuuguuacauaaaucaguuugcuaaauucugauucagcuaggugaaacagauuucuaaacucaccagaaugaagcuuggcuucagagcauaguccauggcaacuacuaaacuauccugcuuguaaagagucccuuaaacuucagggauuuaaaaauucuguaccauuaguuuuaccgucucccuugucauagucugaaucuuggcuuacugcauuuuuaacuucugaaguggccuucuuuuuuagguccaccaaguauauuucucuuuugucuuaaaggcagacucaccuuucauauuuaggauuuuuuuucucuaggcuuuccuagccaaccaugaagagcuaguuuauacacuuuaccuaaaaaguuaacaugcuuuugacauuccugauuuuuaauggguuuuaaauuugugguaggcauagcuuuuuguggccucuuaauaguuuuuguugugcauaucguaaagcaguuaaguacuuaauugauaauguuacuguucuagacguucaaaggaaaauguacauauaugggcucuccacuggauauuuagaaucuaaggcacugcucauuuggacaugaaugaaaaaaaaaaccaucagagaaugaaaacaauaaagcacugcaugaaugggcaacaaaguacauuguuuauagcuaagggcaagucaguuuuaaggguggagagcaaaaauaaguauacagacaaggggaaguuuaggccaaguauaaaugaagugguucccaacuguauaagaaauaagauugaaaauucugguucaaguagucuaagaaaccccugcagaggagcuaaacuucuaggaacuuugucauggucuaacucuuuguauacuacuaaguauuuaguggauguucuuucucuuugucauauccacuucauaucaacuuuuaucucuccgaauaaaaggaauuugaauugcucuuuaguuugacaauuuuucauauauacaauugucucauauuuucuguuuuauucaauuaguagucauggagaggaaaaaagacaggaauaggcaccugugauuguaaaauauuuuaccaguaaacaacuaguauagaauaucaagggcaacugguuauaaaaugaaagccuguagaccugucagguggaggucuuugauggcuaagauucuaauauggguuauuaaaagcaugauuuuaagcaccuagaaggugaguaguuggagccaaaugguuuuccucagcaguagucaugccucacaaacuucuguguuacaucagagcuacuggauagcugucucaggaacaugggacagagacaccauuuuuaaacuucaucaaggcuuuucacaagcuuguggugagacaucauugacaacaugaagaaauauagacuaguagcuaguucguacuguuaugcaacuuaauaauuugcagaaugucucaaauuauugaaggcauuuuuuacaagagagaguuauguacauaggaccuucucucuuaaucagucauuguggguaaacugagggguguaugaaugugaaaauucuauucagguuugaaaagcugccuuuuggaggugcaauuauuauagauuagaugaucucuguuagucucucgaguccuucagaauuaagaguaaacuaccaggugcucuucacucaguaucagaacucugaaacagaucaagugaacaacuuuagggaccuuuaguagagaagggguuucaccauguuggccaggauggucuugaucuucuuggucugcccgccucggccucccaaagugcugggauuacaggugugagccacugcacccggcugagauucugcauuuuuaacaagcuuucaggucaugcugauucugcuguuuugugagccacacuaugaguaugaguuuagacuuaagaugauuuaagguuuggaaaguugauuauauuuaauaauuguaaugcuuuugucagaucaguguagacacuuuacauuuuauuuaacuggaaacuuucaagguaggugguaauauuuuuacagaugaggaaauugagacacagggagcuuaaauguugguugcucaggguuauguacuaggcgcuauaacuggaauuuaaacuuaacaccaaaaccccugcuguccuuguguuuccaugacauucuaugguuuucaugagaauacuuuuucgauuuacaaauaucuuguaauuggaggacuuuguucuguuucuuacaacuugagcaugaaaaauuaaaaacauuguucuucauauguauuuuuuuguauggguucaggaaaaauaagcuuuuaaaacauuaacgcaaacuauuaacuaaauuuuugaaauuuuauguauugaugguuuuuaauugaaaaauauuggcaaauaaaaaaaaaggcuuccaaaauccugcuacuguguaaaccuuauauuaugacuguuuugaguuccucugauauagaggcacucucauauuauuuuuaaaaauggagauuguagggcugggugucguggcuuaugcguguaaucgcagcacuuugggaggccaaggcggguggauuacgaggucagaagaucgagaccauccuggccaacauguugaaacuccaucucuacuaaaaauacaaaauuaucugggcgugguggugcgcaccuguaguccuagcuacucgggaggcugaggcaggagaaucgcuugaacccaggaggcggagguugcagugagcugagauugugccacugcacuccagccuggugacagagcgacacacugucucaaaaaaaaaauugagauuguguuauauauaacuuaguauucuauuuuuuuuucacuaggcacaacuguagugacaaagagaacucauucuauuuauaauaaaaacccuuuccuauuuuccucaugaucauuggcaccaucaaccauucuguccuaaguggcagucucauuuuccuuauucuuugccucuuccauaacugcugccaaauucuucuguuaguuucuuuguaauaucucuucaacuugcccauauuuuucaguccagucuccguuuuuuuuuaaugcuagguuaauaacuacuaaaucaccauguuauuugugaauuuauucucugcuguuuugguugacuguucuggcuguacacagaaccuuuugucuaucuucauacaucuuuuuaguggcuucugaugaaauaagugugaauaauuguaggguuuaaacuaaaagcgaugaauuaucuuagugugucauuuuuaauuuguaaccacaucuuuuucuaacuucuugccuucauugccagauaggguaccagaaucugagaacuuguaauaauauugcuacugcugaggacuuuuaacuaucuguuauuccguaguuauuuucauguguauacauuuugccauuucauuccuuucuuuuuguuaccucgagucuuaugccauuguacucuuuaugaaguugcggagacaaacucacuuuuaaccuuuuucaguggauguuucuaaugaaaacuaauaugaaaauuuguguuuuccuuuuaaaauguaguuaugacuuuauacuugcauauguauuuauuuuagugugauccuaccucauguagcuuuuaaaaguuguuaguuugcucauuaaaauauuaccuaucaaguuaaauauaggugcagaaugauuggagaagucuguugagauucauagauccccaaacagcuuuucucuuuuccuuagugcuuuaucuuugcaaaauaucucauguaucauaucauaaccuaugguuucuaaucagcauuuuuucucaaaaccauauagacugaaaaauauaaucucauagcuuuauuccuacccucugccagagaaaaaagcggagcacuuuuguggcuuguuugagaacuuuuuguuuugaguaauaauguggauaauugugguuaaaauuggggugaauaguacaugucaaggauuuacuucuuagaaucuugugcaguauuuuuuugguaggcacaggaaaaaguacacuuacuaguggauuuuugugaauaucaaaugaauuagaauuuaagaaauuauaauuagaaguuaaagcuuagaaauaaagguugucuggaucacuuagcauauguguagggguauaggucuuuguaaauggggcuaugagaccauaguauaaggaaugcuacagauaaauauaggaaguaggauuugauuccagaucugacaccaaagccuaugauuauaaucauauuuaugauacaagauuauuuuaauuuuauaaaugaggauuagacauucuugguguuuaaguguuuaauuuuuuaccccuaaauuauauuuuuauaucacauagaguauauauguguauuguggacauuaagacuauuaauuauaaugauuaagaauuaucuaauuccuugaaacuuuuuuuuucugaucaaacucgaccuaaaggccaggugcgguggcuuaugcuuauaaucucagcacuuugggagacugaggugggaggaucgcuugagcccaguaguucgagaccagccugggcaacauggcaaaaaccugucucuacaaaaaauuacaaaauuaucugggcgugguggugcgugccuguaguccaagcuaccugggaugcugagucgggaagaucccuugagcucaggaggucaaaguugcagugagcugugaucaugccagugcacucuagccugggugacagagugagaccuugucuugagggggaagggggcuuaacaaaccucaccuuaaucuuauuccuugauauacuuuuauuuuuucuuaaucucuuugguucugucagauuaguauuucuuaaagauauguggcaggguaauuugaagacuccaggauuaucuucuuguuuguauuuuauugguuuaauaacuuuagaauaauuauguuucugagaacuaacaccuuuacagaugaaauugauugaggacuaggaaguaacuucauuuagaucauguauaacacuguaaagugguaauuaagaguuaaaaggcuuggguuggaaucccaucucuucaacucuguaaccuugagcaaguuccuuuaccucauucucagcuuccucaucuguaaauaauuaugauacaugucucauauaagggaguuguaagaauuaaaggaaauaauguuuauaaauggcuuagcauaguacccgguacaguaaacgcucgacaaugaaagcuaacaaaguacaguuucaauuaagguauacucuauaaaaauuauagacuauguuaguuacauugauuuuucaaaauauguugucuaauuaaauuaaaacuuuaauaaauuuuaaauaauuuaaaacaacauuuaaaauaaaguuuuggauuagauugauuauguacuuagaauagcuauuugaaccuaauagaaaaauaagaauauuaauguuuuuggcuauagucaucuuauggaauccucuguacuucuuauuuuccuuauuaauauagcuuguuaaacacaacuuuauuuuucuuauuaauauuacugguuaaacacauaaccauugacuaucaccucuauuggaagaaaaggaaggaaagaaaggaacuaauuuuuucuugugaacaagcuuuacaaauguuuauuggggacacaauuuggaauuaauauauuuuggauaugcauuuugucuuuagcuuauuucuaggaguauuaaaaguuggcuaucuauuggcucacaaucuuggcuaauuuaucuagggaguuuuguuuuaaaaaaguucugaaggcuuucucuccacaagcugcucuuccccaagacuuacuccccagguaauucuguugaucagccagauuuggauaccacuguaacauaagaagucuuguauaggcuagugaauucuuuaauggaauacucuuucaaucccuuuuuucuuaaagccuuauagucaaguaauaagauuacuuagccuuauagucaagcaauaaggccauaacuaucuuaguuugcaagauauuuauggcaaguaugucuucuuuaauguaaauauucuuauuuuuaauuuuucuucuuauauuaccuuauuucuauguuuuaugucacccugcuuauuacaugucauuuuauacucacaugaguguaaauaguuuauacuuaugugucuucagcucaggacuagaauuuguaugaggcaagcaaagugccuagggcacaaaauuuaaggaggcugucucuuugaggacugugcaagagugaguaccuccuuaaauuuugugcccuggaugccucccuugucucauccagagaaauaggcugcauauaaauuauuuuuauuuuaguuuagcauaaucucaugcauacuuggauguuuuauaaaaaaauugaugacaaaacgaaauaguauagcugaacccaaauuuauauugcccaguauaaaaauaaauuaacuauuugagaaagauaguauuauuauuuuuaucacauggucaguaacccucagagcuuccuaaauuccaguucagcagaaucuuguuugacacugaaauacacuugguuguuuuaccuacuggcagcuaccugaaaucagugcucuuguagcugucaaaguuucuuaauucaaaauauaguaccaucagcuuuuuauauaagcuuauaugugaucauuugaaguaaucagaaaugauaccaguuuuauuguauuuuuauuacugauuuuagaauuucuugagaaguugccuauaauuuuuuuuuuuuaugagagcuacaucuggaaaugcucaaaaguuguuugccuuuuuugagagaacaaucugcagugaaaguauaacuucuuuagaggugauguuuaaguuagcaaaugcugaaccauaaugugaggaagcauaauauugugaauuauuuggcaaacauaccuaauacaggcauuagcuguugaaaccauuuguaaaguacaacuuacagaaagcuagaaagauaggcuacacagaacuuuaucuguaaacucugaggaugaaaacuagaguacaacuuaaguuuauucaauaaagacuaaauucuguaaguuuaaguuugauuuguuuauagguuccaugauuaauguguaauuagaguaugaaagaagcauuuagaauccuuuaaaauuuauaggugauaacaucauugucaagucaggaguuuuguuucuuaaaguuagaauuuacuuaaauauacuuuuucucuaaaaaaauaaaaucuuauuucuacuuacaguaguaccaaagugaguuuucgcaaaaagaauuauuuaauauguauuuaauauuuguuucaaauaaacaaaaauaaacauaacaaccaacaguggaggggcgucuuagauuuguuuuuagcuuucuuuuucauggcuucuagaaguguaucauauuauaaauacauucaaaauguuuugcucugaggauauguagcauuccuauaaagguuaaaucaauaaaaaugauuuggacacauuccuaagcauggcuagaacagguaguccguuguuuuagguacccuugaguuucuggagcagaucauuauggcguagcaaaagaacuuacuaaaaguugcuuucuauguguagaugcaucagcuuaaaaaaauaagauuuucuggccuucuagaaaugaguauuuuuagaguaacccuuguauauauugauuuaauuauauauuuuaaaugcaguuaaaguuuuggagcuuuuuuuucuucgaaugcuggagauacaccauaauugauaaggaagagguacguacaggaaaaaugcaauggcaagcuuuuccagcaaauuuagaauaaaugacagucuuaugguuaaagaaaguaucacacauuauaauugcaaaauagggauuggaugugauucuuuuuagucuugccaguuuagaaaaaaauucuguaagucauuggcauguuguucuguucauaugggcaguucaaaaggcaagcuuuaauuugagcuuuuauuuuagaaagcauauguauaucuccuauguucgggguuggcuucucacuauauuauuguugcuauguaguuuuaugcauuugcuugcauuuuuuguguucaugucauaaguuuuaaguauguaaguuuucagaucacacuguuuucacagcaaguuucaaaaaauauuuuuaugccaguuuauaauaaugaguaaggccauuuuuauuaaaguuuccuuuaaaacagcauuuaagauguuucuggaucaaaaaaauuaagugaauugaccauguauuugaaugaagaaaguuuaaaacagagguagaaaauuugaguuacauguauuauuaaugaaguuauauuauagaaaaucacuuccuaucuuuuuguacaucuaauauguauuuacuuuguaaguaaauacuuuauuaaaaauacuguguuacaguauuucuuggagcacaggauuuaauuuuauagucaagaaaauuguuugaauacgucugaguaaaaauuuauuguacauauauagagugguuuaaccauuuaauaauuaaauaauuuagcaauuuaagccaaguauuuugauguuuuaaaaaauauuuaaguguaucuugauagauucugauuuuagugugucuugugucuugauaggaccagaauauuuaugaaaauaaaaauaagccuaauaaucagcacauggcucuaaauuuucuuccuggguacuugugagugauaauguuaaaaacagaucacuuuauguguuuucucuaguccuauugguguacaaaaauauucugcaauaugcuuaugcguguuauaagggagggauauuguuaaaucuuuacuacauaaucaagaauaaagcuuucgugacaguacucauuguccuuaucuagcuaacacuuuuaaaaugaagugguuacuagugguaaaaaguuuuuaaaauguuaaguuuuccuucuaaauuacagagagagaaauaauguauauguguuugguuuugaaaacugggagaauagaagaauucuggguggacacuggaguuuauaauaugugaaaaggaguuucuucuguggaaaggagguuggauuaaugaucaaaaguuggaguacauugacuuguauauuuccauuucuuuagaaauacacuguagcacauugucuuuguaaguaguaucuccauaggcauuaucuucuuaaauauuucauuuuugcauugacucuuauaagagcaguagcaaguuuuucugcauuuugucaaaagcugaauuaccgaaaugcuuuacagauuucaugagagguaaaaaaauuaaucuuauuagauuaucuuuuguaaccauuuauccugccuaauguuaagaugcuguugucuugaugggaguuuucucauagauuacuucauggugucuuaauauuuuugaauuggguguuagguucuuaguaugaaaugcuuauguacuuucacagguaucagcuuuauggaaaacacagugauugauauaauguggauuguuagcauaaagaaguuuccuuucugugauccuguacaguuguuacagauaucuguaaucugacaguuuaugaaauaaaaugagaauuuacuuuuaucuaaaaaaauguauuuuaaugagcuguguuugcauuaaaguaucuuauaauaaaauuguaauugauugaagagaauccauacuguguaccuuuuugauacacauggauuuucuaggaucguuauagugauacagcaguagguugacauguuguaaaauguaauaccauauuacauaguaaaauaaaugucaugauccuuucuuuuaagcuucaaaguaaauucacauuguuuagauacauuuaaauaauuuguaaucauuuaguaaaauuauaucuuuucacuuaaaauuauauugggaauuugaagucuuaaacugggaaguucaguacagaaauuuaaaaagaaaguuaauucuagcaauuaucauagaaaaauuagaaauucaaugcuuaaauuguuuacccagguuacauggucaaugagaaaauauaccuguuuagcuucaagccagaguuguucuuugagauaauauuuauaaauaggaaucuauuagcaaauuaauuccauucauauuugcccuuauaaacucuaauacuuuguuuaacugauaucaguuuuuaauuauuguuacuuaaguuuauaacuggaaaauaacaucuuuggauuuuauaagauugauuauuuuagucuugaaauuccuaguagaugccuaaucccuguuacugguuuuauagauugacauuuguuaacuuacaugcaaaaaaauuuugauuauauuucaugacagaacuauaguaccucaguuacauaauuuacaauuuuuuuccugguuuauaaucauuauuacaaguucuguagucauuggugugaaugcauucacacucaugcauguguauaugccauguauaaaaauguuaagacaaacauagccagaagaaauuuaaguugaacauauaugacacguauuuuguuucgguguaaaaauacaucguguucaugugaaguucuguggaauaucacguuauuauucugauauuucuaaagaaagacugcauauauauguauucaaaccuuauugaugauuguuauugugauuuggcuagcauuuaacuuugucuuuuuuuuuuuuuuuuuuuugcuuuuccugaagcacaaaauagauguagguguaagauacaugacuauaaggaauauguaaauaaugguaugguucauguaauuuaggggaaccuacaaauguguauuuaaguucuugaguuuuaacuuagucuauuauguaaauauauguuuauaguugaugguauauaaugauucugguagacaucauugauguaaaaaaucgauguaacugaaauguaaaauaaaauuaccuuauuugacuuuguggugaaaauuauuugccuuacauaggauauuuagauauaccuuuuuagaaaugucacuaaucugauguaacuaauguauaauuaagagaauuggcaauaggaauaguagagauaaaagagucuuuaaacuguuugccaaaauaaucuuagauauauuucugggaauaauguuaacuugguaaauuuucuaacaucaguaugauaauuuuuaaauaucucaaacauuaucgaaauugcguauguauauaugucagagauuuccuuguuuugugggcaguugauuuaaaagaugaaaaucaucuaaucaagguaaacauuuaucuuuuauuuagagcucaagucacccuugguaugauuuuuguuccuuggguguauauuggauuuaugaguauuaacaagaauauagaguagaggaagugcaugaauaacaauuuuuuucucuucauguauuaaguacuuauguagcaacuagccuuuaaaggccuguuuuaauucuacagcucaucuuauuuggggauuguuuuuuauaucagguuaaaugauauaaaaaaugauuguuuuuuauaucauguuaaaugaugcaguuucuguuuauuaguguuuaugaaaaacuuugcuuuaguuaggcuucuuucuauucagcaguaacaacaaaaccuaaaguguuugauaacauguugcuuacauccacucaacacuguuccaaaucuugaguccuaugcccuuaauaaauaguauaaaggggaggaaauuccuaagaauucuacauaaagugaagauacuguauacaguaaaagagcauuuaaucugaauugcuauacaggucuuaaaacaguuguaugggaauguauggucuguuucauguguaugugcuguugaauggacaaaagcuugugguugacugugguuaaaaauguaaggaaacucccuuuuaauaagguauagaauuucccuguuauuuuuugaaucguaacacauuaaucaaaaaauauauccagugaauuucauaaucuuuuugaaauggcaagagauuauauuaaggcauaaaauuucauuaugugagacuucuuuuaaagauuuguuuuaagauacuaacaucucagauuugaugaagaauuuucacaugcuuuagacaguuagcuuagaauauuuuauuauuuagaaaauaccaaguauuggaguucauuguuaucuuuauuaugggaguuuuaugauuuuuuggggggugaggagaggcagaauuuuaucuaucuucaguggaaguugcagcguucauugguauaggagaaaaaauaguacauuaagguaacguauugagaagucucugcuuaaauuaccauuggaucugcuagcaccugauuaguaaugucugacuugugagugacuagaaaaaauaguuaugcuuugccauaauuacaauuuuaguauuugcaggaaggauuuuuuucacauugaguugauggcauuugucuauuuggucacauguuuuuauauauuuuuaauagaugcuauagagguagacuguuucggugaauccuucauauaaaaugucuaaagauuuuuguuagguaauaguauuugcaguuuuaaugcauuuaaugagcuuuugcaugacuucacuauugacuuagaguugucauaucuuaguauccuagaacaaagguuagaacaguauggaagauugguauuuguaugcuuuggagagggauuugagauguuacccuguuuugccgucaauuuucaaguaugcacgggugcaucauuaaucaugagaaaugcaaaaauaaauaauauagucccauuggauuuuuuucuaugaauacuuaccuuuuccuuuuuuuuaaauauauauauacaguugagguauuuagguaaccccuaaccuuuugcuucaacaaagaaguacaguauaaaaauauuaccacaguuuucaugugagcagcucuugaaucggggggagggggaaagcccucuagaugaauauuuguugaaaaaaaaaguugugauacagaaugucuuaacucagccucaguacaguacuugaggaccaccaguguguaaaauugaaagcacaugaauuuugaagcacuagaaaagguuuguaauugauuagcgcugcuuuaaaguauuggaguacagugaguuuugauuugugaaugguucuauucaauaaauauuaauucuguguguuugauaaaaucuuagugccuucaaugaguuagcuccccccgccccugcaguuuauuuaaccaucaaauauuucaguguucuuuuaacaaacuggaacauuucuaucuuaccgaauuuaacuuuagcaugacugauuuaaacaagucaaacuaucaguuguuagcuggaagagaguaauugaauaaauuaauauuuuguucuuuuaagauaacuaaaauauaucauaauguaaucauguauauuucaugccuugugauauagagacggauugaucaggagagucagacagaccagccagaucuuuuuccacaauuucuuuucaguguuuuagauuucaaaacauuuuuuaaaaauaaaaacuaaaaaucuuuaacaguuuguaauguaaaauuaggauuauuauaauuuaaaauaauuuauaugagucuuugggaauuacuuugacauuuuuagcuuuugauauguguuagagugauuuucuguguuuguucuuaacuuuguaauucugcucccuaguuuuggaauuuagcucuguauuuuaaaaagaagcuauaaaacuuugucacuacugaaucuugaaacuauaaauauauuauugauauggaccacaauugcuguuuuggaaaucaguguucacacaucauguucaagcaguuacaaagauuuuauguagauaaucagucagcugauauauuuucaugagucauuaauuuuaagauacucuaugagucacaucugugauuuucagcaagcuauauuuaugauaaaugauggacagauuuugaguaguacagauugaaaauuuuugauuaacucaaagugaaguaugcugagagaucaaggacacagacauacucuuucucuagcaugugcgcgcgcgcgcgcacacacacacacacacacacaccacucauuguauuugaggugaagcaguuguuaaugugugcuuuguaccucaccuaggaaaauccuaaacuuucuuuuuaacuauuuuacaaaauuggggcacauacuuaagacauuucauuaggugguggugauaaucauuauauaaaaaucuaaagccugaagugagguuuuaggcuuugcauagauuauagaauggggaaauguuugcaaugugauaacauauacaugauguccacuacucaccuguaauuagucugagguaguggguugauguuaaguucucuauucaggcuucaagauacuguuugggggcuggcggggagggaaggugcagcccacuuuucaaaagaggaagaacugguuguaauguuggaaaaaaaaaagguucacuaccaugccuugcuuagaauccugucaaguuuuggaaauuuugaauaguuauuaagaauguuacagaaguauaagaucccuguuaugauagaauaagaagcaguuuaauauauucuuugugagaauuuuaacauauucuucaugauaacuuuacuucuaauacugaagaauuuuuugaaacuuguguuguuccugaucugguuuuuaaaauguguuuaaaauaaauaguuaaacagagugauaacgugaaagaguaacuuaacugccucuguuaucccucccugauaucucuguuaucccuguuucaaguuaucccucuguguaacaguaguuuuaacuauucuuuuuccuuuuaucucuuggguaguaguaacaaaacuuucgauguauaagcuguaauuaugcuauguguuguaauguagucuagcuguguuuauguccugcuuccuuaauauagaaguuuuuagaguaauacuugguacccaucauuaaaauuuuaaauuaaucugugauuauuauauuguauauauuauaacugagggggcccacuuacagcuauugagggagucacuaaagcaauuuuacauuuuuuuuuguaaaauacaaaguacauuuccucacccuguaagagaaaccauuuuuucucccuucagguuuaauuauuucuguuugaccuaaacugagacugauccucuaguaguauccaguuaaaaugugugaaguaggaggaguaaaggaaacuccagucauuaguuguaaguuaaaagcagaguuaauauagauguacacagcaagaagguuuauuuuaauggauauaagaaaaauuuuugaaaacuugccuuguaguuggaacauguuggagaucauaaagagaaucuuguaaguguguuuagauauuuugcuauaauaacacaucagcugaugaauguuaaagucauuuacauaucuguaucaacaguaacuugaaauuaaauauuaagggacaagauuaugccuacuucuuuuaaaguccagcaugguuuaauaguuguggcuuuuaaaaaucauacaggguauccuuauggagcuuuauuuuucaugagacuaaacagcaguuauucauuuugguagguccaagaaugugauuaaaagaaucuuagacguuucaguguuucaguguguuuauaacaaggucuauggauaacaguguguagauguaaaauuaaaauuacauagaaaaaugcaguugcauguaaguuuuaaaauacuuccaugaacuuuuuaauauccugggcaacuauaaagaucuuuuaaaaauggcugugaugugcuuaucauaauuuuauuucagcugaauguauacuuauauaaaguuguuuagaaacaaacuuauuuagauaggauacaguuugaauuuauaaguagauuucuuuuaguugagcugguuaaaauguuaacuguacuacagguuuauuucuguguuauacaugguagaccauaauguugagauaauucuguggucuguuauuuuguaaaauugcuuccuuuuugaaguuugcucaaauauugggagcugccggagucaauaauuuauaaugcuuugauuaauuuaggaucugacuuuucuucuggugaggguuaaugagaguauuaaacuguuucuuuuacuguuuucauauccucaccucuauaacucuagaaaacauuuugaucaaugugagauaauuuaauuuuguauauuucaagucauuacuuugaaaauuagauacauuacagauaccaaaugcaaauauauacagaaauuucauuuuucaauucuuaaugcaacaagauagcauaauuaggaucuuuaauaugcuauuuggaaaagcuagcaguuuaucaaagaaucauaccuuuauguuuaacagguucauaucuuacaggauuuuaaaaaugguaacacuuaccccaaaagaaguuuugcugacauggugucacugugcugaagaggcuguuugaugccauagucccuccuuuuuuuuucagauagaacuuguacccucuguuguaaauacugcuugcagccuuaaacugaaaauacaaaccauacccaaaccuuguuuuaguuuuacaguaugccuggaguacauagacuuuauauuuauuuuuuucugucaagaaauuauguagcugguaacaugugaaaagcaaagaaacaaaacaaaaagagaaugagcaaauauuugaaggaccuacuauuacugcauagacugugguuagagagcacucacugacucuguuggucucgguggcugguagugaccugcggagauuaaccauuuaaaaaccagagacuucuugcuguccuccuggagaaaguuugcaccgcacuugugguucugugguuguuugugaggcgaaugaagcau

SEQ ID NO: 21315 - RNA, 16280 nt, Homo sapiens
uuugagaucagaauuaaauucuuuaauacaaaaugcuuuuuuuuuuuuaagauauaucuguauuucuuugucguuguuuaaaaauaaauauguacuacggaauaucucgaaaaacugcacuagagacaaagacgugauguuaauaucuuuuccccacaauuauuacggauaaacaguagcaccaauaaauaaaugauaacaaauauuaaaauuaaaaaaggagagagauuuaguauguagaauucucuauuuuuucuuguuuuguuuuuacauauaaaaaacagaauagcaaugucuauuuuaucagaaucacauauauacauaaacauauauauauauauauacacacaaauacaaguugccaaauauauauauaguauguagauguauauugaaaccuuauuucaaaggaaugugugcuggggagccaggggaucggggagggcagagcugaguguuagcaaaauuaaauaucuguucaagauaagcuagugacugucaccgaucagggagagagagauuggaaacaugaauuuuauauacaaaaaccgguacaaauaagagagcaagagagagcaaaagauacaucucauaaauaguugaaauuaaauauuaaccaagaauacugaaaaaaaacccuacucuuuaauuaaauuaacuguuuuaauuucuaauuaaaaagggauauuaaauaaguaccguauauaaaacacuuucucuuuucucugccuccacaaugggcacguggauccugcccugucucucugugccucgggaagggaagggaaggaccaggggauggaggaaggucaaccacucacacacacacaaccaggucuccuggggggacagaacuagugguuucaauggugugaggacauagguccuuuuaggcugcaccccaggaaggggagcaggaagaggaugagggcgagucccaggaaggggagcugucaugggcugcuucuuccaacaaugugucucuucucuucgccgggacaucugccaguggucuccugggcaacucagaagcaggugagaguaagcgaaggccgcccaggcuccugaaucuuccaggcagugccccugggggcgagaugcgcgugcagcauguggagggaauccccaaagcacagcaauguccugaagcuccccaaacuccuggucagagccgguguccucaucccuguaccugugaucugucuuucuguccgucugaccugggguagagaggcucagcgccagggcuggguuugucgguguucccaaaacugggucauauuugcccccaugcccuggccuugcacauuccugggcaggggagaggacccuggccccaccaagugggacaaaaaaaagaucaugccagagucucucaucuccuccucuucccugucaggaucugagugggaacauuccccucccaacucaaguccacagcagucaaauacauccagugaagacaccaauaacauuagcacuguuaauuuaaaaaaagaauauauauauuuuauauauauaaaauagagauauuuauuuuuauauauauauaauauauauauauauaaauguauguaugugggugggugugucuacaggaaucccagaaauaaaacucucuaaucuuccgggcucggugauuuagcagcaagaaaaauaaaauggcgaauccaauuccaagagggaccgugcugggucacccgcccgggaaugcuuccgccggagucucgcccuccggacccaaagugcucugcgcagagucuccucuuccuucauuucagguuucuggauuaaggacuguucugucgauggugauggugugguggcggcagcgugguuucuguaucgaucguucuguaucagucuuuccuggugagagaucugguucccgaaacccugagggaggcuccuuccuccugcccggcucaccgccucggcuugucacaucugagggaaauggaaaacaaaggcugggguuagggccaagugaggaggccuggcgaugaggcaggcggccuccccauuccugggggccccugggucacugcagccuccggcaccauaagagcagagaggacaggaaggugugguccuggggcagaaagccccaguaugagaacagccccagcccugcccucagggagccccggccugagcagcagcuccacucaggggcucccagucuacccuccugagcuugcaaucuacuugagacaagacaaggacaugggaacacuuuacaaagcaacaaaugaacggauaccaaagaacaguccccacuugacauuuuaagagcugaugggugaccagagcuggaugaaguuaaucagaagaggcucccugcugaggaggguuuucaguucagucucuaggggcugguguggggaagagagugggcagaucuucugggagaacgccugaggcagagaggcuuggccgggugaccaacaauggcaagggccugcccuggggacaggaggcucccgaggggguagcguagagcaggaggccccaggaaggugagggaccaucuccauuccccauguccccucccacuguggcuguaggccucaucucucuugagcugccuggagguugcaggcccagguaacagguugucuuuccuuucaaauaugcugcuucacuuaggauggggagagacaauucggcggcuucacuacuccagcugaagcaaagggggccuccaagaacuuucucagcaugccccugccccugggugauugugagaaggaggcagaacaggcccuacccuucuggggagccccgaaacggaguccuaagccuccaauuuuggaaacugauauucccagauacagccagcuuggggguuggguaaagguauugggagguuagaguaacuucaguuagcucccaggucacuucacacaaacccccaucagcagaauaaucaccuaaaaacccuaaaaugucaagucccuuaucuuucccaaggaccccuggggaacugagacuccccucauccagcccugaaguuaggcagagcccccaccccagcacuaauauacgcccucuugguuucacauagggccaagacagacagcaccccacaccaacuacccaggccugguucccagcauccccugagcacacacaagccacaagaacauugcugggggaggggagacacuccaaggacuucccuaacacagccucggggugagcugggggugccuuggcccugucuaggaaauccccacaaagucuugccucccugacugacgcuuacccugacccccagggccucccucacucugagcacaggccaaguugguauaaagaacauaagcuaaggcauuaaaagaugccagccaccugucccgacccugugcuccugaccucacccucugaacugagucacacauucacucaugcacuugacacuuccuugguccccaguaugggcaaaggaaagagguacagaugcccggggcucacaaagguacguaaacgaggcccgggcuuacggagcucacaggcuaaugucaggagaaugggcacagaccccucccuccacgcauccugggggcacuugaaaaugugugggcugcuugggguugucaccaugacugguggaggauuaaagguaucuaguauucuuggaugcuacagcuccuucaguguguaggcaaaagugccccauccuaaacgaacagccagaccccuugcccucagagccccagucugaggagggagacauagcccuggccugagggagccucagucugagcggggagacagcccuaucagggagcccaggucggaggggagagacacagcccuacccucagggaaccucagucugaguggggagacacaacccuuuccucagggaggcccagucugaagugggagacucaauuccuucccccagcaagaaacacugagugagugagaagcccagccaugcagacuucaaagggccgaggcaaggccccagcgagagcaucugugcuuuguugacauuguccacaccuggaaucggcuuucagcuucucagcauuacuaccagagguaguaauaacaucaggaccaacagccacuaugagcagaaggaccacaggacacaacacacagcuugcguccacaccacuacacuaagccacaccagccuaccacucaggcaaccagggcaaccucggaacaggccccgccaggcuggaccagugccugcagcccaccacaggggccuuaaaagcagagaaggcagcagucaccaggcaggcagcuagaaacugagcaagcagcuggccccucucaggcgcucucccgcucgcucgcucgcucacucucuuucucucucucucuccccaucucugugugaugccccucucugacuugcuugcccucugggaaccaaccugcaaguacguucguuuaacucaagcugccucgccuugcaacgcgagucuguguuuuugcaggaacauuuacacgucugcggaucuuguacaaacaaaugcuuucuccgcucugagcaaggcccacagggacugcaaaaaggcaaaaggaaagacaucuaagcuagagcaucagcagagagagagaaaaaaaaucaccaugcaacacccccuaacauguccgcagcugcacccccacccagccggucagcccccaggcccuggaaggauccgagcgcuacagcaaaagacagagagagcggcggaaagaggcagcacuggcuaggacaccugccgcaggaagaggcgggcacagacgggcagagagugcagggagaggcugccauaaggggcaaugcugugucucugggagacaagggugagucucaggccacagggacccaacugcuguugcccccaucggagcacgccuugacucuucaccugcuggggauggcaaucaggggccaccuucuccccgugcaaggcucauguccaggcccuuccaccaaggugggcuaaaguagggugugaugggaggcuaagcccggaggcgguguccccaggccaggccgcugguggccagagggcccagggcagggcccaccacagccuccgacccagaggaagaggcugcccugcaaggaggccucugugggugccauggguugggccggaauagggggcuccccuccagaggccccaccuccgugaggagccagggcacuuccaccagaugaagggaggccgccacauggugucugaucccacccaagcuccuccuucagccaaggagucauucagcaagcugccuccagucauucacagcccuucuugggccaugucugcccuccccaccacccucagcuuccagacgagugcagaagccuagagcaauggaaaccaguugggugagcaggcaccugugccaacaugggcccgccaccagugcccagugggugagagaaaaucggugcccagccaagccaggguccccucccuuaauccuccaggccaagucggcacccccauucaccccaacccuggaccagcaaugccaccaccaaaucuacccguuggugccaauuaguggagugagagagugagagagagacacgggccaggaggaugagagccagggaaggaccaggggagggaggcaggguuacagggaauggcaggcggagguuguacugggggccagggaggcuccagggcauuagacagcagcgggcaccaacguacacgcuccaggacuuauaccgggauuucuugcgcuuucguuuuugccccuuucccuuuccucgaacugauuuucuggaaaauaaaaaaacagagacagagagagagcgggggcgguggggggaguaaaagaagugguaaggugggcagggaugggggaacgaccaaagcaaagccacacagggccgcuucccggaggaagugucaggaggcagguggucucuggggaggcaugcgcgggcgcacacaggcgugucugggcagcaagcacucgauggcucuuucuucuccucacgcugcccaccaugggauggcaaacccagccccugacaaggcuuuggugggaagccgagacuggguggagggcacaggacccaaaggucuccacacucacaguggcucccaguccccggcagggggcaaagccugagggaaggcucuuugcccagcagcccuguccaagucugacccugaagguccgggggugauaaaagguaggccagacuuuggggagaaggucagagaccugccuggauggggagcaggagugggagggagggcuguguaucaggccuugugccuucauuugcaacugcgacagaaccucugggaaucccggugugggggaagcggcuaccuugggagcuggcacggaaccaagagcaacaccagccugcucagcacgaccuggacugggaggcagggcuggguguccuggagcccugggcaggcagcaggauggggugggaguuaaggaggucuggggaggagaggcuugggcgguacuuggcagggaguucucuccccagccugucaaagccugcuacaccaucucaccagacacucuuccgagcccaggcgagcccccuacucuccccauggcagagcagucauuuggggaaacaggaaggggggcaggcuguagccuguccccuucaagagaaccagagcucuccaugccugccaagcccaagagaacacaccucaggaugucugucacagggaagaaaggagggggagaagggaccagagagggcaagucugucccccuuaggagaaagcaccaaaggguggaaggaagguuuccgcauccccucgcucuggaagcugggagcugagggaagaggcaagggguugaggccuggugggggcuucaauguccgcacagcacuggaggcagacaagauggugugggggaaagggcagggcacaggugcucucucucagucucucuuucccugcaagcucuugcugaugccagccgcccacccugucuugaaggguuacugccgccagaccuugucccccaccccauccuaccugccccuuaacacggagcacucacaagccucugaaaaugaccaacauucaacuuuuucucccuggccaagagggcugugugucugccgccugccgccuacaggagggcaugcacugagaaaccacccuccagccggccucgcauccaacugcaccgucacagcagccaccaaaagaggccauuuccucugacacacaaaagcuggccucucugccacccacucccucuccccacuguggguguccuagagcaagccagugagccaguguccacagugcccccugacacaccgaaacagcaaguccuggucaggaaugaucuggagacccagaaggcauugucccuuccaaaggaagugccaggcuccuggcuauguuuucucacuagcccuagagccaucauccuggaguuggcuccaucccauuguugcugccaccacaagucccccacaagaccaagucccugacccagggaggcuaugggagcccccaacagagguagccaagagccccaaaccaagacaaccggccauggagagggagaagugcuaaagucagggccacuuacuuuucuugucuugcucuaucuuucuuuggucugcaauggguagggagagagaaaagagcaaaacagggaaggguuaagauggugaugauaaugauagggauaacaacaauaauaaucacaguaaaaacagcauuuauuauggagcaacacuguuuuaaucuuuucauauauaacuuguuuaaucauuauaacaaugcuaugaaguauacuacuauugugcccauuuuacagauguagaaacugaggcacauugaaguaaaaugccaaaggucacauagcgggaagcuggacgggggccaaaaaguacagcaugcuuaacccuggcacagaucaggcacccugcagccacuugcugauaaugaauccgugacuacauccucaccugcauucacauuuguugugcuguaggaagcucaucucuccuaugugcuggccuuggugagguuugauccgcauaaucuggaaaggaaggaagcagaucacagagguuagugacccagccagccauacccagaugggacaacccuggggcuccugccacucagcacccagggguucugcagagcagggaugggugguggaggcagggaggaccaagagcucuagcaggaaagaggcucaggcccaccccaacucccccaacccugcuggccucaaggagcccuuguuccacuugaggccaagacauggcugcaaggguuggccaggcugggaauucaaauccuagguucuuaccacuccccauccccuccccuucuuucauccucucuaggcuucacccugacuccuaguagauacccgaaagcaacccccucccuguguuucacagcucccucccacccuaucugggcugagaugugccccauuaccagguaacaccaaaagacuuuuuaaacucuccauggaccaggcucauccagcuucccaaacaaagcccccaagaagggggggcacucaggacucucuccaagagagggagagaggggcuccugacacaggcauccaucuguccccuccugagcccaugggcaaccaucagggagaaggagaugguuggggcuugcugggaaccugggcugggaaugaagcaucuucuccacagaaggcaagaccccaccauaccuccccugugcaacucaggggcaggagccagacaaggcaaaucuagccaggaaacgaccugggaccaccuguucccaaaguguuaccccccucccuaucccccccuugccccacuucccaaagaugcccaccugcauggugauguuggacuccucagugggcacacacuccaggcccucgucauugcagcagcccccgcaucgcaucaggggcacacaggauggcuugaagauguacucgaucucaucaggguacuccuggaagauguccaccagggucucgauuggauggcaguagcugcgcugauagacauccaugaacuucaccacugcaugagaggcgaugacacaugagcccggugggcgacacaaaagauggcuagccccucucuccacccagcucuguaaugccacucuuuggagcuuccgaaucaggcaaguccuuccaaaaucuaacguaagucccuccuacuguguuugaagcacuucccuaagcuuuccaccaucaacacuggugaaggccuguuuucauuccagagaucacacgauguacucaaguuccaagggacauggccugccacaucugaucccgccaccucacugugacagcugaacugaauccugggccaaccucgaugccagaggacagucugaguauggguauaccccauggggaugcucuaagcuuucccuaaaaggaggaagagccagcuuugccaagcuagucuccaguuuccuacguccuccccacaaccacuaccauaacgucaaccauaccaacagcuguuuauugagcacuuacuacauccugaguacuguguacaguaguccacagcuaucauuucacacaaguuucuccacaugguacuauuagacacuauugagauuccauuuuacagauggggaacaggaggcucaaagaggcuaaguaaguugccccaaggccgcacagcuaguaaguaaaggagucagaauuagcugacaucaaaguguucccaagccuauauuaggcaaaaacagaggaggcaccuuucaggaggaggcaccuuucccccugccaguccucuuccccagacaugagcugagaagguggugggcaucagcacaggggcugggcccuccuggaacccacagguggcagugggcggacacgcugugccagcccugccagccacugauaaccccgcccaagagggcaaacugcuugcaucauggaaaaaacagugcugccacuguagccacgaaacauuucuagaagcugaucugaagggagaccaggguagagacaguuucccaggcuggccacgaagccuggggugcacuggagcaugaagggguaauucugggccacagaggcggggcccuugagaauaaauaaaugcaggacucuggcaugacuacuccaaauuguggcccagccugccacgccuaucgcaccccaccaccacuaccacauagcaauccugucccugaaauagguucccuacccagagggaagaaauaacaccuggccagugaggaggcccaggcucuggccaugaguugguaugaccuugggccagucccuccccucucuaggccuccaacucugcucaacuguguaaguggguugggcugaucucuaaagaugcugaaacaggcugaaaaaggugguguuuuggcuuccauuuccagcccuaggaacaagugcucuuuuuucagccuggguaauaugaaguuuagaacuucaccaaagcaucuuaaguguaugcuucguggacuuccaccccagcucccaacccccaccccccagagaccacagcugagccucccccucacuccucccuccaaggucugcuuuccagaagaauaaaggacaaugaggggggcuauguacacaauagguugauugggaagaagguggggagaaggccacaggugugaaaacagaaagaacaguggggaaacaggccaguccacugcuuccugugaggucucuauuucuuuuauccagaccaccaaugggcacagaauccuucucuacccacgaaggguuacggcaaagcaucaucaaaaagagugaacgagacuagaagucugaaaaggucauuuuuuaaagccaagucgauaggggagaagaugacuaaucaagaaguuuugaacugccccuucaucacaauugggacagaggagggccaggcuuguggcccaggaggggauagcaggaaggucuggccugggcaagggguugguaacugaggguaaaaagaccugggguaggaauucccccaaaaagcuuccccuuggaaugaauccccaagucccaugggagguggaggcggggaaccucacccgcauccuucaucaggcagccgccccuccaaggagggcuggccuccacugccugggggagcacacacguacacuccaacaaccaggcuuucgugguuuuccuuauuuaucgcagacaaccuuuucuccagcaaacaaagaccuuuguccugccucucccagaccagagaccacugggaagcuggaagggguaaguggcgcacuggaagcagggggccggucaguggcugagaagccagguccuaggccaaggaaagggcuccugggguggggaaggaggaggcagaacaggcugggcaucaccacugcuggccacuacccagccacgccagauuuaggucagggaaacucgcgggaaggaagaccccagggccuucccuccccagagguggagagcacaggccacagucagugguggggagagccaggguguccccagagaaaugggaggauccaaaccacaacggaacaaaaggcaggcggacucgggguugggcaggggggcggggcgccugggagcuacagccagcccucugcuggccugggagggaaguucacagcacccgaacauagucaaaugggguuuucuccacccccaaaggaaugcaaaccagggaagggaggagagaucccauuaggcugagcccucugugccuccagcucacacaggaagggucacaguucccacaaaugggacaugucuauauaggaaaugacacuaaauguccacucuccccugggagcuaggggaaacaagggacacuucccccaacaccuaggaucccugaacacugucuuccugcucugugcgcacgacuccuucuccaaauaaaauuuuacuggaaagagcagaagaaaaaggcaacaaguccuacuucuagcagagaccugaacagcggagaguccucacgaaacugagggugaaccucguggugcccagcucuuucuuucuugauccuuauauuccugugccccuuccccuuccuccccacaguucugaagaaaaaggaauuaggccauccacccauccccugagaggacagggaaccccauccaacagccagggggacucaccuucgugaugauucugcccuccuccuucugccaugggugcagccugggaccacugaggacagaaagagagcaaggcaugggcaugggcaggggcuggggugcacaggcccagccacccagccccuccucccuccucacuucccucccaccaacagccucuggcuucuccaagucuucugagucgaacaggacacaaccggggguccccacgggcacagaauaugcccaccacuccuggacugcuaugguuaugaacccgaggaaguuaaagacuaaccagauguugggggcuggggagcucgaaaugcaggaggaaaaccccagaaugcuucacugucgagguccccuguaccuuccccacacuucccucucccugcucucacuaucccccuaguucccugguccaaagccaugguaaguauuaaggucaaauaggaggacaaauuuggacuggggcaggaaggaaggacuaggggcgagaaaaacaacauggugaccuucuccugcugacaugacaaauaccagggugagcugguguuggagacggaggggggugccgaggaccgaagggcaccaaccacccucccccauccaagcucuucuaguccuuaggaauaacccagcaugcccacagguugcuuagaggguaaaaacccaggaggagacccugggggagaaccacauuuuccucucuacacaaaucucuccagagccucaauagauuuccaaagccucaccugucucccacuccuaccuguucccugguuucuucucccucccagggugaggaggugccaagccccucucaccugggcaccuucaaaugccaccagggaccagggaaggcuuuuaugccuuggcacugcccagccccuagggggcccccugcaccaccuuaggccugaggccuccucuaacccuccccacccgcaucagaucauuccuccccucgccagaagcugugaaggucaacacgccaagacaugcggaccugacagcacccaaaaggaaaggcuucugccagcccuuccugggggucuccagcucucaccaacuccccucccgcccagcacucgcagagcagaggggcacucuagccuacggaacaccagacccugcuaggggagagucccacuguccaucuuucuuucccucuccuucccacacaccccaaaugcaccccacucagguaccccagcccugcucccagagacagccaaggucacaggaagccccucucaagagaaaacaacaguuaccaggcuuccagcuggacagcuuaccacugcggcuccugcagggacccccuggauucugcaccucagcccccucacccauucccaugacacccccugccuucccccugacaauauucucccgggacccuccacuccuccugggccccaaggaggaaaggggacggaaauuucauaccccuuccaaggccagggagcacaggaggggcgguucuaggcaggcaggggccagguguccuucucugggggccucugaaggucacacuguggccaggcagccacuccucccccuccucccuacuuggaggccuguagccaaggccuuugugccagggucugaggaacuugcgguguuagcagcgaccccuguccauggcuuuccucuugccuccucuccaagggaauucuggcugagggaaggcgucagagaggagcggaaagggacccuuuagagucccuuucagaagcaaguugggugggcagguuuggaguuccaaaaaaacaccugcuccagggcugccuuucaccaggacaaagugugugcaaggcuggcaggagcuccuuuccaggguucaggaaggacuauucccaugcugcccgugucacagcaaauuucaagccauuucuccaaaaggguaaaguggggcaaugacucuucaaauccucccuugacccacccccacgagagcuaaagcacagcucacucggaacuguuggcgagggaagggaagcacacugucaccaagucgggacuuucgguggaaugugacaaagcgcccagugggcucccgcgccacgacuucugacagugaucauccuuucccuggacucuggggccagaaagggguuagauggaucuucuccgcagagagaaaugaaaauaagcggggugacaggggcuucucuccaggcuaaaaaggaaaugggugaagagaaggggcgucaggaaauuccuccuagcacugggcagagguagggucuggagacaguaggaagggguagggaugguucucuggauccccgggcuggggcuaccucgagaggucaccuucccgcggagggcuggcggggggaggggugccgcucgccacucugggcuccccauucgggcagccgaggcuccgggaacacgcggccggccaggcccgggcugauguaaucggcuccgcgccgcgcgcacccggccgggcgggggagggcgggcaccgagcgggacgcgagcggggacgggcgggguuggcgcggcgcagguggcccagcagggaggggggguccccgcagcaauccaccccaaaacuuuucccaaacucgcggcgagggcugaagagaccgaguggcagugacagcaagcccccucucccuccugcgcccugcccccuccacgcucucugcccucccgcgguccaagguccgagcacccccugcccacuggucucuggcucccgcccccgcugcucagacuuccaguucguccgggaccagcggccgggagcaaacuucagccggcagcggcaacgcaagcccagcccccucggccuccuccuccggcucccgcccucggcuggucggcccagaucguacgugcggugacuccggugggugggcagggcccgcgugggcggugagccucucuccggguacccucccaccuagcgcgcgcgcccccucccccugcaccuaagacgacagagggggacgccgcacgccuggugcccauggacccgcguggggcacggagcccccacgcgcgcgcucgcacgcacguccccagccgggagaggcgcucgcagcggcccgcggcgccagcagggcacgaccgcuuaccuuggcaugguggagguagagcagcaaggcaaggcuccaaugcacccaagacagcagaaaguucaugguuucggaggcccgaccggggccggcgcggcucgcgcucccucuccggcucgggcuguggggcggcccgcucuccucggcgccucggcgagcuacucuuccuccccggcccgaggcccgggccagggccuggggagcgcgcgcggcuggagcacugucugcgcacaccgccgccucacccguccaugagcccggcuuccgagcgccgagucgccacugcggcccccucuccucuuccuucucuucuuccuccucccccuccuccggcugcggcuccucccggcccgagcuagcacuucucgcggcuccgcucggcucggcuucccccgcgcggaccacggcuccuccgaagcgagaacagcccagaaguuggacgaaaaguuucagugcgacgccgcgagccccgacccccuccaccccgccuccgggcgcgggcuccggccccugcccgcggcucgccgccgcguccacuguccgccgccggccggggaggaggugguagcuggggcugggggcggugucugucugucuguccgucagcgcgacuggucagcugcgggaucccaagggggagggcucacgccgcgcuccggcggucacccccaaaagcaggucacucacuuugccccugucgcuuucgcugcucgcacgcccgcgcgcucucucugaccccgucucucucuuccucgacuucucucuggagcucuugcuaccucuuuccucuuucugcugguuuccaaaauccacagugauuuggggaaguagagcaaucuccccaagccgucggcccgauucaaguggggaauggcaagcaaaaauaaauuaaaacgagaaacaauacaguuuuaaaaaaaaauguuuaagaaaaaagaagagggauaaaacccggaucaaugaauaucaaauuccagcaccgagcgcccuggccggugaguccgcugaccgguccaccuaaccgcugcgccucccgacagagcgcuggugcuagcccccagcgccacgaccuccgagcuacccggcugccccaagccuccgcgau

SEQ ID NO: 21316 - RNA, 16330 nt, Homo sapiens
aaggaggugcugcgucgccaagguggcauccucggcuccgccccggcgcucucccagggccccuagcuuuccgcugggucgggcggaaaugagccguggcuuuuggcuggcggagccgcuggcagggaccgggccccacccugccccaguggcugccgacucacgcgggugcagcucuguuccgcggaggcacgcccccucccgucucuccgucucgacccccucgcggggcccagguggggcccaagucgccgccagcgucugugccgcgucccuugcucugugaaggacaggccucgcgccaggaccccgguggacuucugagguggccagagccccaccgcggccccuugcuucuccuucccugcccacuagcccaucgagccucgcgcucacccaaccucgguccccauccuaccgugccucgggguucuagcuuauggggccuaauccccucucccccaccuuaccgcgcgccccuggcuucuccagucuccaaccucgguccccaagccccucgccuaccuggucugugcacccugcccugggucucgcggcgcccucaccagcccucuuguuccaguugcuccagucggaggcgccuccaacccaccagugccuccuccuaguccaucgcgccuugcccucccacuccaccaccaguucucaggucucuuaacucugcgaucucgggacucuuaacuugggucucgcacucccaugcuccaauccuuagagacagcaccccuuuucacacacacucacgaucucccucccaaacauaccccucugggcuucacauaccccauagguugcugccuguuccaaggccuugggauucacuuguaacuccaaggcugcccugcccccacuaguccgcccacuguuccauaucaacccacuccaggccacagggucuuggggaccuuccuuuuagcccccaaauuuuguguucuuucacaacaaacaccccaguguucucugcuuaggccugcccccacccagcgugcagcaugcaacuccugggccuggcuuuaccccaccccgccugacagcuguugccauuugcuuccccaccuccuggauaucuuugauuuucugaccucuccuuccucuagcuugucuguucucuuuuccuugugugcuccaggugccaggauggugggagaacuccgcuacagggaauucagggugccccuggggcccggcuuacaugccuauccugaugagcugauccgccagcgcgugggccaugaugggcauccugaguaccagauccguuggcucauccugcggcguggcgaugagggggacgggggcucuggccaaguggacugcaaggcugagcacauccugcuguggauguccaaggaugagaucuaugccaacugccacaagaugcugggcgaggauggccaggucaucgggcccucccaggagucugcaggggagguuggggcccuggacaaaucugugcuggaggagauggaaaccgacgugaagucccucauucagagagcccuucggcagcuggaggagugugugggcacuaucccuccugcuccucuacuucacacuguccacgugcucagcgccuaugccagcauugagccccucacuggaguauucaaggacccaaggguccuggacuugcucaugcacauguugaguaguccugauuaucagauucgcuggagugcaggccggaugauacaagcccuguccucccaugacgcuggugaggggcaguguggggaggaagggaaagcaggagaagggcugggucggcucagggacucacaggacacuguggcaggagccucugaucucaucaguacguaaaugauucuguugcccuucucuuagaguuggaagaaaaggaggugggcaugggagugaggguggggguuaucugccaaaagaggaaagacuaucuucaagaaccucauauuaauuaguugcuuuuuaugcaaaggaagaauuuagaguuuagacuauuguagaucguguuuaugugcguguguguguguauguguauaaguuagcaaauuuuagcuuuugaagcaaaucaguucuuucucauugugugguggcaaaaggauuggauugaaagaguagagggucuaagauuucuaggaagggugagauuagggagaaguuaccaacugggguguggguuacagggacccggacucagauccuucugucacugagccaacaagaagccauugagaaacaccuggauuuugacagccgcugugcucugcuagcacuguuugcacaggccacgcucucugaacaccccaugucuuucgagggcauucagcuaccacagguaaccuuuggggguguaagguggggggaacuugugaacaagaucuaggguccaggccuuugcaccuaucugcagaggaugguauggagagaggggcuuaaacugggacaagguggauauaggccaaagguuguaucccacaggucccaggaagggugcucuucucccuggugaagcgguauuugcaugucaccucgcuccuggaucagcugaacgacagugcugcggagccaggagcccagaacaccucugcuccugaggaguugaguggggagaggggucaacuggagcuggaguucaguauggccaugggcacccugaucucggagcuggugcaagccaugcgcugggaccaggccucagacagaccaaggagcucagcacggucccccgguuccaucuuccagccucagcuggcagaugugagcccagggcuccccgcugcccaggcucagcccuccuucaggaggucaagacguuuucgcccucguucugaguucgcaaguggcaauaccuaugcuuuguaugugcgggacacacugcagccggggaugcgagugcggaugcuggaugauuaugaggagaucagugccggggaugagggcgaguuucggcagagcaacaacggugugccuccugugcaggugaguggcacaugguggugggauacuguugggggucuauuugggguagggcagagcugggacuucuauaugggggggcuccagcaggccacccaaagagaaagcuuuagguaagauuggaauggugaaaagagucaguaguugagaggggggccauucugagagcugggaaaaucuggguuuaggaggcugugaagucaagaagacucacaccugggaagaaacugauauagccagacuccuccaaaggucagggucagggagauggagugguggaggccagaaggaagugugggggcauaagccaugaaagacagggugagaggagagacaggcccaucccccaaaggagaaggcauccuguguguguguguguguguguguguguguguguguguguguguguguguguguguguauucuccauaugcugcuguuuuguuauguggagguuuuucuaaaaccuggccagguggucacccugagggcuauaguccucaguacugggccacagccagucauuugugaguccucccuuccccuucccucuuucuuucccuaugcuccagguauuuugggagucaacaggccgcaccuauugggugcacuggcacaugcuggagaucuugggcuuugaggaagacauugaggacaugguugaggcugaugaguaccaaggggcaguggccaguagaguccuggguagaggugagcucagggaggaagcaagggucagcucugagcagaggaauggugguccugcugaguugcuagugacauccuugugccccuuggcccauuuucacagcccugccugccuggcgcuggaggcccaugacagaacucuaugcugugccuuaugugcugccugaggaugaggacacugaggagugugaacaccugacccuggcugaguggugggaacuccucuucuucaucaagaagcuggauggaccugaccaucaggagguucuccagauccuccaggagaaccuagauggggagguagagccagccuggagacacucagagguuggagggcucuauugcaagggcuggacuguauagagcauuuggaaggcucaggaugaaaaguggaggucagagaguggaaggggcugcagaggaggggucuggaauuuucagaggugggagggugagcuguuugggaggagccagcugccagcugugagaggaucaggauggaggguaugugugcagagagacccccaccccuaccaagugcucccuggggccucugggucggcagggcugucugcagugagagcuucuccuugauggcagauucuggaugaugagauccuagcugaacuggccgugcccauagaauuggcccaggacuugcugcugacucugccacagcgacucaaugacagugcccucagggaccugaucaacugccaugucuacaagaaguaugggccugaagcccuagcagggaaccaagccuacccaucccuucuagaagcccaagaagauguccuccugcuagacgcgcaggcccaggcuaaggacucagaagaugcagccaaaguggaaggugggugccagacacagcagcugagcugacacaccuucagggcaguagcacaggagagaugucugugcugauuuuuaugcaauccuuucuggaagugaugccaccuuagaagcugcaacuuagagagaagcaacaaacggagaagcaggcauuguguucccucaaagaaugaaggaggauguaaaguuagaaaauugcaagagaauuuugaagacuuaaaaaagcccccacauuuagcuuuuucucuuguacagaaacauauuccaugcuuugaaauaaagggaagugcucuccuguuuucagaugaagcuacuuugcuauuuuaagaauauaaaggccgggcaugguggcucacgccuguaaucccagcacuuuggaaggccaaggcagguggaucaugaggucaggagaucgagaucauccugccuaacauggugaaaccccgucucuacuaaaacuacaaaaaaaaaaaaauuagccgggcgugguggugggcaccuguagucccagcuacuggaggcugaggcaggagaauggcgugaacccaggaggcggagguugcagugagccgagaucaugccacugcacuccagccugggugacagagcgagacuccgucucaaagaaaaaaaaaaaaaaagaauauaaaauuugucaugaagcugucuuacaaugacauucagagauuagauccccaaaccuaacuuuuagggggauuaaaaaauuuaaaacauuuuuuaggagaaauuagagaaaaagauugagaguuaugaaucuauuucugagccuucacauuacuaacaauggccaacuccugugacuguccccuuccuguagcaaaagaacccccaucucagagucccaacacuccccugcagcgucugguggaggguuaugguccagcugggaaaauccuccuggaucuagagcaagcccucagcucagaggggacccaggagaacaaggucaagccacuccugcugcagcugcagcggcagccgcagcccuuccuggcacugaugcagagccuggacacuccggagacuaacaggacccugcaccugacugugcugaggugagagcauggugacaggugggaucucugagggcaaaggggguccaugaggcuggcuacacauuucucugcccccagaauccugaagcagcugguggacuuccccgaggcacugcugcuccccuggcacgaggccguggaugccugcauggccugccugcgguccccaaacacugaucgagagguaccccugcccugcucuggggagaggcugggggagaggauaaaggcagccacuggcaaggcacaccugcugggcaaggcucuggagggcgugauagagccuuugagcucuugguuugaguuuugcuuuuaaaauugaauuuuauuuuuuuuaaauagguaauacauucacaugguucacaaaucaaaacgcucuaacaagguauacacugagaauucuugcucucacccaaaucucuguucccccagggucccccacacaccccuuacugguaacuacuuguauuaauuuauguaucuuucccguguucccuuaugcaaauauaagcaaacccaaaugugugaucuugccacucucuuuuuuacacaaaaggauauggagauauuauuacauaaaacauuaagagcuucaauagcuccauuuuuggcugggccugugggagaaagggggaugaaggaggcagagcgcccaucacauaccagaguccccugcaagagcuacagagaaguccugggcacagaaggcuucagaagggcucagagaacuagggucauggugacaguagguauuugcaguguggcuauauuuuuggcuguuaccuagaauuuacuuucuaaggcaggcucauuggguauaauacacacacaaacccagucccugucagccccuucccagccauccaggugucugugccugaacaucucaaaacacagcccuacaacugguuuuugggacaguagggccuggaugaaagaacccagggaugcucucugccguuuuugccaacauaaucagcagccuagaacccuagaguagcagggcaucuugugcccuuuuccauuuugguuugucuuugguucucuaaccaccuggcucuugugucuccccaucccugucuuuucacuucgucacucugccuugcucacuguagcaccccuagcacccaguacacagaguacacaguggguaccugcuacugcaggugcccuuguggcccucgcccugucuucauucaucuccucccuuauguccccacccaggugcuccaggaacugauuuucuuccugcaccgccugaccucagugagcagggacuaugccguggugcugaaucagcugggagcaagagacgcuaucuccaaggcccuggaaaagcaccugggaaagcuggagcuggcucaggagcugcgggacaugguguucaagugugagaagcaugcccaccucuaccgcaaacucaucaccaacauccugggaggcugcauccaggucaggaggaaggggagcuugugggcuuagaguggcaucagaauaugaaacccaagcaguggcggguaagggcuguguucccauggcugggaacagcaggugacucuagugacccuggggcauuuguuccccuuccccucugccccaucugggccugcucugcuggugcuguagaggaagucccacugcugcauggucucuccuucauccguguuuccgugugugucuccguguuccuucugccccugugccccuucucucugauguucuggcugcagauggugcugggccagaucgaagaccacagacgaacccaccaacccaucaacaucccuuucuuugauguguuccucagauaccugugccaggguucgugccuguugccguguugcuccaccuccccacaccuaugucuguuuccccucuacacccuaccugaccgugaccaccaccccuucccacuugcccccaggcuccaguguggaagugaaggaggacaagugcugggagaagguggagguguccuccaacccgcaccgggccagcaagcugacggaccacaaccccaagaccuauugggaguccaacggcagcgccggcucccacuacaucacccugcacaugcgccggggcauccucaucagguaacucucccacacaugugcuuugccacacacgugugcuuuccugugacgccccuguguuuguuuugggggaagcaccacccccuggacuuggccaugggcccugucuacaaguuccaaaugguuuuuccuccccacucccaggcaacugacucugcuuguggcuagugaggacucgaguuacaugccggcccgagugguggugugcgggggugauagcacuagcucucuucacacggaacucaacucgguaggaccccagggccauuagccauuacuccaccccucacaggaucugcccuccugcuucuaucuggcccuauccuacuuuuuucuaacucccaccugucuugagccccacagaaaguaguguccuuuaucccugugcuugugccaccaggcccugaacaaugaggguggcaugaggacagcuuugucaggacccuacacaucccagggcuggggaagggagggaaacagugaggggacuggagccuagagccaacuuggcucugcauguguggaggugacagcuuucucugcccccugccaggugaaugugaugcccucugccagccgggugauccuccuggagaaccugacccgcuucuggcccaucauccagauccgcauaaagcgcugccagcagguggggccagggaugugggguguggcccuggguagggggcucugagccccauaaacaggcagaucuuaagccagaggaccagccugggucucgagcagcuccaggggugagguucgagggcguagcugaccccagcccaucccaagguguggagcgagugaagauaguccuguguguguuucaggguggcauugauacgcgcauucggggguuagagauccuaggccccaagcccacguucuggccaguguuccgggagcagcucugucgucacacacgccucuucuacaugguucgggcacaggccuggagccaggacauggcagaggaccgcaggagccuccugcaccugaguucuaggugugugagagugugcguguaugcuugugucugugggaaagguaaggcuauugcaaauagcuggcaggcagggguccauagaagcugugagauggagguuuaauaugcguggggagggggcuggaguuuucugagcugugggaggggaagaaaggauaaagagaaaagauuucuccagugggcugggaaugggauauaccaguuagcacagagcaguucugaaguaccagggggccuucgguuugggugcugggguuagcuggcagucuuaggaaggguggacacugagauaacauaugcuucaagccccugacaccuuccuccuccauucucacccccagacucaacggugcucugcgccaggagcagaauuuugcugaccgcuuccucccugaugacgaggcugcccaagcucugggcaagaccugcugggaggcccuggucagccccguggugcagaacaucaccuccccugguaaccauccugacaucuggacccauuacuaucucagggcuugguuccacuaauuaguuccuucuugcucuacccuagaaccaccuggauuauguccuggcccuuuuggcaccugcauuuguaaucccagugcugucuucucacagcccaggggcugcccccuuucccaugucucucaagugucaggggacaccauaagugcuggaggugccuuguuacccacucccuuuaucauucuucuuuuuuuuuuuuuugagacagauuuucgcucguuacccacgcuggagugcaauggcaugaucuuggcucacugcaaccucugccucccagguucaggcaauucuccugccucagccucccaaguagcugggauuacaggcaugcaccaccaugccuggcuaauuuuauuuuauuuuauuuuauuuuuuugagacagaguuucgcucuuguugccuagacuggagugcaauggcgcagucucggcucacugcaaccucugccuccaggguucaagugauucuucugccucacccucccaaauagcugggauuacaggcaugggccaccaugcccagcuaauuuuguauuuuuaguagagaugggguuucuccauguuggucaggcuggucucgaacucccaaucucaggugauccacccgccucagucucccaaagugcugggauuacaggcaugagccaccgcgccugacccacaccuggcuaauuuuauauuuuuaguagaggugggguuucuccguguuggucaggcugaucucgaacucccgaccucaggugauccacccaccucagccucccaaagugcugggauuacaggcaugagccaccgcaccuggccuuuucuauuuuuuuaugcuuauuucuuauuuuuaaagaugggguccugcuauguugaccaggccagucuugaacuccugccucaagcgauccucucaucucagccucccaaagugcugggauuacaggcguaaaccacccuaccuggccccccuuccuuguaucauuccguccaguugcucuaucuccacacuccuguucagcccaaccacucccacuucccugcagacauggcugugccuugguuuguuuaucucacccucuagaugaggauggcauuagcccccuggguuggcugcuggaccaguaccuggagugucaggaagcugucuucaacccccagagccgcggcccagcuuucuucucgcgggugcgccgucucacucaccugcuggugcaugucgagcccugugaggcacccccuccugugguggccacuccucggcccagugaguaguggagauucagguggggagcucuagucaggagcguuuuccugggccccauguguacaccacaggcuucuguccauccccauccuuccccucccuaugggcucagccuguucaucuuccagguuugugucaccuccauccaugaacaucauuuuggguggcagcaugucaggaaaggccucagggaacccccuuggauggggacuugggaguggaggggcugcacccuccuugccucugccacuuucuuggucucuacagaaggcagaaacagaagccacgacuggagcuccuuggcuacccggggccuuccaagcagcaucaugagaaaccugacgcgcuguuggcgggccgugguggagaagcaggugggcaggagcaggccugcgggagagaggggacaccauaaugguggcauguuggguugugucuucaugcuccugccccuuccuuccaggugaacaauuuucugaccucauccuggcgggaugaugacuuugugccacgcuacugugagcacuuuaauauucugcagaacucaagcucugaacuguuugggccucgggcagccuucuugcuggcgcugcaaaauggcugugcgggagccuugcugaagcucccuuuucucaaagcugcccacguaagccucuacccuugccucauccuugggucucuuccgacaaacucucccuuccucaccuccuccaaaugacccacccuuccauucccauucuaugaugaacauauguuaguauauagccauguuauaagaaguuuaaaaaauugaaaaaaauaaauaguggccaggugugguggcucaugccuguaaucccagcacuuugggaggccgaggcaggcagaucaucugagggcaggaguuugaggccagccuggccaacauggccaaaccccaucucuacuaaaaauacaaaaauuagccaggcaugguggcacaugccuguauucccagcuacuugggaggcugaggcaggagaaucguuugaacccaggaaguggagguugcaguugcagucagccgagauugcaccacugcacuccagccugcgugacagagcuagacucaucucaaaaaaaagaaaaaaacaaaaaaaccccccacaauugaugagcuaaaaugcaagaagcacccuggaaagcaggguacagagcagcaggaacaugaggcuccuuguguagccuccaguccuaguuuaucagugacacugcaucaggaccaucuuuguguauguaacuuaccuccuuguguccgucuuucuuucucucucucuuucucccuuccugccuuccuuccuuccuuccuucccuccuucccuccuucccucccuccuucucucccucccucccuccuucucuuucucucuuucucuuucuuuccuucucucuuucuuucuucuuccuuuuuuuuuuuuuuuuuuuugagacggagucucgcucuguugcccaggcuggagugcaguggcucgaucucagcucaccacaaccuccgccucccagguucaagcgauucuccugccucaaccucccaaguagcugggauuacaggugcaugcuaccacgcccagccaauuuuuguauuuuuaguagagacggaguuucaccacauuggucaggcuggucucgaacuccugaccucgugauccgcccgccucacccucccaaaguguugggauuacaggcaugagccaccucucccuucccuucccuuucccuucccuuccccuucccuucccuuccccuuccuuucccuucccuucccuccccucuuuuccucuccuuucuuuuucuuucucucccuuucuuucucuuucuuuacuucuuucuuaacagggucuuacucccucccacacugggaugcaguggugcagucacagcucacugcggccucaaccucuugggcucaggugguccucucagccuucuggguagcugggaccauaggcgugugccaccaugcccagcuaauuuuuucguauuuuuaguagagaugggguuuugccauguugcccaggcuggucuccaacuccuggguucaagccaucugccugucucagccucccaaagugcuggaauuacaggcgugaacugcgccuggucuuauuuucucauuuugaaugauuauuauuaguuugauuuuuuagacacaaugugaaaagacacuuuccauaauuguuaauauugcuaauuuguacaaugguuaaugaucuuauaaaauaguuguaugaaagcaccaaccaccuuagaaagcugccagcauucauaucuacuuuccagacccucaucccuccuccccacucaccugcucugcucgcucauucauggcuuuccugugcucugccauugcucaggugagugagcaguucgcccggcacauugaccagcagauccagggcagccggaucgguggagcccaggaaauggagaggcuggcacagcugcagcaaugccugcaagcuguccugauuuucuccggcuuggagauagccaccacuuuugagcauuauuaccagugaguguggaccuaaggagcgggagcuggcgggaggcaggaugaugguggcagagccagcucaugggccuggaagucugggauagaggcaggcuggagccuuggagugggaggcugggccacacuggugcccacacugaggcuuggcccgggcugcaugcacugcaggcacuacauggcggaccgucuccugggcguggucucgagcuggcuggagggggccgugcuggagcagaucggucccugcuuccccaaccgccucccccagcagauguugcagagccugagcaccucuaaggagcugcagcgccaguuccacgucuaccagcuccagcagcuggaucaggaacuccugaagcuggaggauacagagaagaaaauacaggugagugccuuggaagggauaagcaaauaagaggguagggggaagaggggcguggagcagacuggaggaggccauggcaucugggaacccugugcuccuucaggugggccuuggggccaguggcaaggagcacaagagcgagaaggaagaggaagcuggggcagcagcagugguggauguggcggagggagaggaggaagaggaggagaaugaggaccucuacuaugaaggggcaaugccagaagugucugugcuuguccugucccgacacuccuggccuguugccucaaucugccacacacugaaccccagaaccugccugcccuccuaccugaggggcacuuugaacagauacuccaacuucuacaacaagagugagcagccaggcagagggacuggggacuggggagagggugggcugcuaggaaaggaccugggguugggggcagacccugauguugggaggcuugauguaaaaagagauagucuuuggcugggcacagugcucacgccuguaaucccagcacuuugggaggccgaggcaggcagaucacuugaggucaggaguucaagaccagccuuggccaacauggugaaaccucgucucugcuaaaaauacagaaauuagccgggugugguggugugugccuguagucccagcuacucgggaggcugaggcaggagaaucacuucaacccacaggcagauguugcagugagccgagaucgugccacugcacucuagccugggcgacagcgagacuccaucucaaaaaaaaaaaaaaaaaaaaaaaagaguuggucuuuuaauuuacauuuuuaauuuuuguuuuuauagauucagggagagauagucuuuagggauaagaauucccuaggccaugggaaaaacagugguuuugagaacaaagggcaggagcuugguggcuggggguggcaggugcugucagauaccugauccccagaccauugcuuuuucuguucuaaaauaagaccugggaaucucuuugugggugacggggaggauggaggcaggaggcaccugaggccaccagauaugaguaggugucuggcucuuuucuggucagucaccugucauccuaaacuccccaucgggggcugaucccugagcuggcagcaacacaggagggggaagaggcucagaccuguggucagggcgccuccuaauaggggagacauuguuuccugucauaauauuccagcuugauaagagccccaguccuuccucccuucaugguuuugucucccuaaaaacacauggggcaauccucgaaggcacugaugagaaccugcuuggcaccaggcuaggcauaggauagcucccagauccugaggcuugccauagaggcaggcccagagaaggcugagaucuggaagcucagaccagaagccccaguguccauaaaugcuggggucacacgccuugcagagauaaacagagcgugaccagcgugcacccucccuccaacaccaacucccuccuuucaccugcucuuugucucccucccccuuccugguccaggucagagccacccugcccuugagcgaggcucacagaggcgacugcaguggacguggcugggcugggcugagcugcaguuugggaaccagacccugcauguguccaccgugcagauguggcuacugcuguaucucaacgaccugaagguggcccagccccgcugcaccucucuccugucucccacuuugucccuugccucucuucccaaaaccuugacucccucugcuucuucccuccauccucuucucuccacuccuuggggaggcccugaaugucucccaucuguucucugaaggcggucucuguggagagucugcuggcguucucagggcucuccgcagacaugcucaaucaggcgauugggccccucaccucuucaagaggcccccuggaccuucacgagcaaaaggauauaccaggagguaugcacuuagggccagaggggccucugcucugaggcagggccaggcuccucgugggcucuccacugagugagugaucagcauuuauuucagggguccucaagauucgagauggcagcaaggaacccaggucgagaugggacauugugcggcucaucccaccucagacguaccugcaagcugagggugaagacggccagaacuuggagaagagacggaaucuucugaacugccucaucguccgaauccucaaggcccauggagaugaggggcugcacauugaccagcuugucugucugguaggcaggggugggcacaaugggugacagaucuuugcugggguugggggagcagucuacaggacaaggugggugcacguguggugaggcaccugguucacuguguagccuguaggagugugaggagugaggucgggauguaccucguguccuuggggcauccuguccuagcagcuggugguuggaguggaagcucaagcaaggaggggucagcugccucuaaacuaccgcuucucccuuccucccccacaccaggugcuggaggcuuggcagaagggcccguguccucccagggguuuggucagcagccuugguaaggggucugcaugcagcagcacugacguccucuccugcauccuacaccuccugggcaagggcacgcugagacgccaugacgaccggccccaggugcuguccuaugcagucccugugacugucauggagccucacacugagucccugaacccaggcuccucaggccccaacccaccccucaccuuccauacccuacagauucgcucccggggugugcccuaugccuccugcacugccacccagagcuucucuaccuuccgguagcccuagacuuggggucaggggaagguagagcuggagcuuuuacagaaauaaaacccaagaguuugauuaua

SEQ ID NO: 21317 - RNA, 29901 nt, Homo sapiens
ucccggcggcggcggcggcagcggcggaggaggaggaggaggggacccgggcgcagagagccggccggcggcgcaguugcagcgcggagcccacgggccgccggggccgcuccagcgggcggaagccgagcccggggccgaccccccgcgcgcggcggaggccgagggggcgccggggcccggggcgcgcagccggggggcgggcggcggcgggcggcgggccgagcgggagccgcaugcguguauggauccgggcgccgcgcugcagaggcgggccgggggcggcggcggucugggcgcgggcuccccggcgcugucgggcggccagggccgccggaggaagcagccccccaggccggccgacuucaaguugcaggucaucauuaucggcucccgcggcgugggcaagaccagccugauggagcgcuucaccgacgacaccuucugcgaggccugcaaguccaccguggguaagggcgccacggcgacccugggccgggccuccuggcgcccgggcaggugcccuucgccccgugggcuucgagucucaucgagccugggagucuuucggggaugggccucucggugaaacuaggggcgggggucuccuuggagcgcccugcaucccaaucccaaagccuggcagagguuuucgugccgccuccgggcagaccugcccuuggcccccggcccugccucagagguccuggcagcccccggggccugugggggcggcucuccacggaaacuucggcccuuagcauacucgcccaagaaaaagcuggguucgaguggagcgcaggcaggcaggggagugaacgccuaaggccgcucucgcccggcccgccaaggccagcgcgcgccgucugcugcgggugugaucccugcgcaaccagggcaguuuucuuauuuugaacccauuuucaagaaaugaaguuuaaagucaccuauggagaauguuaaaacuaaaacuacaguaaguuucucgugcuagccguacguacggggcagaggagcuucagcuguauuuauccaugaccucaaacaacccggugacuggcgggcaugggguugauuccuccaguaccgcuguuuucggugagggacaggagugaaguaaguacaggaacgcuccagggucaaggaggaaaacagccguggaucugaaauggaaacugcaggggaaauuuuuuuaauuaagucaugcuuagaggacuugacauugagauuucucaguuggauguggguagcaguuguuucuauggaaaaccccuuaaaagauguccaaacuaggagaaccccguucuuuaaaauaaagggcagucacuuccgugauaggaagugagagauuuccccaggggcgguccaagaaacugaguagucaggagauuugauagaauuaaaagcauaauuucauguaauucuauuuauuaauaguguuauaaccagugguaguuccaaggcugucaguacgauuuugagaugacuugauuugaaauugucauguaacaaaacaguacuacauuuaaagugucuuauuggaaagugaaaccuccaauuuuuguacugucuuucuugguuuguuuucaagaacuuacuucccuuaaugcuuuuuuggaauagaucauuuuggaaauauuugugaugucuguaccauauguuuuuaaaauguugucguuggagacauuauauuaaaaugaguagcauaacuauaccuguuucaaauauccagucuuggaucaugcagaguacagggaguuguuaaaccaucaaaugaggguuaggcuguuauuuuaguaccugacauaaauaaaguaggguuaaauuccguuuagaauugucaauauuuuauggcuccguacuucaguauauaaaaaugagagauaauagaguugcacugugugaugaagagaaaucagguacccauagguggguaacugagggcuugaguggauggagggugagauggaugagcaaaggugugcuuuagaaugcagaagaggagagaggaagaaggauuuucuaagccuggcagcaguggagcagccccccaccucuggggaggguuccuuaggggacuugggaauggaugcugcgagaccuugaccgccaugcuaaggagaauggacccgauccuaugggcaccuggaaccaaaagacuccuuaguaaggcauuggcacgaaaacaguuuggcagaguugcauaggauguuugggaauaaggaagagcugcggaggaugcuugggaauaaggaagaaaccaggaggcaaggagaccaagcaguuuguuucugugucccuuaacaaacaugcacuuacccgagcacauacucccuacucugagugugguugaauuucugucuugcucauuuuuguuugcuucacauguagccuauaauacuuagaguacuggaguacuuuaguacucagugcgugcuucuaacugugggauguucagagaaugaucauggccccuggccugcugcagagcgggaagacacugugagaacgccagccagcuccacuucaguuucugcuucagaguugcuuuuccccuccacucaucagaucguuuguugagcaccuacuguguguuggguguuaugcuacccaguggggauucagugguaaacaggacaucgacucuguccagaaguggaucggagcuucugggagcugcgugaccgcuugucagggcagugacagauguguauggguauuugggagcacagugaaagcgccuccagucgaggcuagugaugaggccuggucagagaaggcuuccucgucauuggaauguuugaagauaaguuuguuccucuaguuccuuuagaaaaaugcaaauuaaauaugguacugggugugguguagaauugugguugccuuaccugaacgcuuaccauuugagcaguuagcucccgggguucuucccaggcugguuuuucuaguuucaucuucauguagugcagugaauuccauauagagcaagagucucuuccacaguaggaguuucucccuacccugucagggcugcucgcgacagccgucugggaaagaccgugagccucacagcauggcccagggaagagucccugagugugccuggaccaagaugggucacuagagugguaguauugucuaauuccuaggcuaggagaguguuuccauuaagagccuuuuuauuuuuauuuauuuauuuauuuuugagacagagucuugcucugucacccaggcuggagugcagugguacgaucauggcucacugcagccucgaccugccaggcucacacaaucuuccugccgcagccuccugaguagcugggacugcaggugcacaccaccaagcccuuuuuugauuuuuaguagagacaaagucuugcuauguuguccaggcuggucucaaacuccuagucucaagcacuuggccucccaaagugcucagauuacaggcguaagccacugcuccugaccaguaagugcccuuuuaaaguaaaugggauucacuugaacuuucuauaaaagauccguaguggaaguccuuagggauuugagaugaugaacuauuauguaaaauuauaaaugagcaaaauguuguuuuuuguauuguuaaucaaaucagaaacugguuuaaaagauuuacaaaauucacaaggguaugaaaaacagagguuguauuuacugauuggucuguuuaauggaaauugucuaauggaauugucucauauuuucaaaugggauuuuguuuucauggaauuuaauuagucugauuauaauuuacaaguucuuuuaaaaaguacaggagcagcuuuuuaaaguuugagaaacagaaaaaaguaauugacuaaagaaauuuacaacuaacaugccugguccacuauuuuccucauagcagugccuguaucacaagcauacuuauccaccaugaaucugugugugcuuuugcaaguugacauuauugcuuccugagugaagcuguagaaaccauuucuaucuagcaaugccgaauucuugaucuugguuccuucuguuugacucucauuaguuuuagcauaaacagguaaaugugcuuuuuuaaaaguauauuucaaaaaacaacuccauaaaauuacauaucugucaaucuuuguuuuauuucuauguuacuguuggaagcuagcuguuaauuuuguuuagguugaaaugguuuuaccuuuuaaaaaccuacccccgcccuugcuccaacagcauugcaugcuggaaaaaacacuagaguaagaauaagaaauguggguucuugcuccaggcucugccacuaacuaguuugugacuuuggauaaguaauguaguugucugugccuauaaauagaaguaguaguaguaguaguaguaguaguaguaguaguaguggucacugcuauauggugagcacuuacuacaccagcagaaggccucaucacagcccugaaaguuauccccguuuuacagaugaggacgagaagucucagagagguagaaauuuaccugcuguggcacagcugcucagcaaguggucagggccaagggcugcaagugaauucuuuuuaacuaucuuucugucuguuccuuagcuuacuuucagguuuagauugacuuugcuuuguugaaaauacuaauggcucacacacauaaaggucagacaugauggagcccuuuccucauuuuagaauuugguccuuguuacagcccugugaagauagugacauaauuauccuaugguauuagugaaacugauuuucuuuaagugugccccugucauuacuugucacuugccuuuugaauuaaaauaaugcuacaagaacugcuuuuuaaucuauauauuccaucauucaaauucaagugucuuaagccuuuuacauaccaaaauagguauauuugaauacaggagaagucaaagaaaggcaaucuggaccagaauucugauuuuucuggguaguaaaguuuccuucagaaugcugguggccagcauaggauugccaguucuuuauuuugccaaguaagaacauuaaaaaaaaaaaaagaaaaaaaaaagacuuaaaaaaauuaggaaagauaagauaccacaguuuaaaaguuuuuuauuuuauuuuuuauuuuuauuuuugagacgaagucucacccugucacccaggcuggagugcaguggugcgaucucugcucacugcaaaccuccgccucccagguucaagcaguucuccugccucagccucccaaguaacugggauuacaggcacucaccaccacgccuggcuaauuuuuguauuuuuaguagugacaggguuucaccauguuggccaggcuggucucgaaauccugaccuugugauccacccuccucagccucccaaagagcuaggauuacaggugugagccaucacccccagccaaaaguucuuuaaauuuaucuucauuuuucucauugugcggcagugcucuaaacuucacagccuggcccccuuaaaggauggcagcccuucggugaagcccuuuaacuccgcugcaggccgcaguccugugugcucucugccugacuccccucuagccuguguugacaugggggugcacucaggaugcccacugguggggccucggccugagacugcuuacgcuggggaaguaggguagugcgagugacuccguuucuuuggaccugcgguugagcuggcagcagaauggagggguccgagaaacgggugagugugaaucccuugcagaaaugcucucugggggucugcccuugaauguuaggcggcaugacaagucaaaugcaguccaccagggucuucaccuggaaauugacuacuuguacuuuauucuggaaacuuagggcagagauuuuuguuagaaaacccagaaugagcaucucauacuggacuuaaaugcuuaacuguguauuuuauuuugcuauacuguauuuguacacagucuucuaagccaugaccgaucugcccguguuucacuuaagagagaauuaaggaaaaucauccagaauucccacuccaaaagcccaagcucugcagcccugcagugugguuuugcuccaucuggagagaaccucacacagacuccccugccaaaaugauguaacaugaugacucagggaugugagcgugagaggaaccaacauuuaguucuuauacccacauaugcuguguguugugugauuagguuuauuuaaugaacuuaaugcaagcugagaggcuugacaaaacguccccuuuuguggacugaaguagcuaucuuucagagaaagcaugcagauuuaguugguguuagguuguuuauguugaauaaaaaucuauuuaaagaccuggcugaagugcauucagccuuucacugucugcacuuacaauaaaaaagaaagauuuuauuaugcaugacagagauccagauucuuagagauugccucuuucccucuggucuguggaaucugccagaagccaucuguuaauggaucuuggaacuggcuguagaaggcagaguagguuccuuugagaacugauagguccaaauuauucucuauccuugggugccagauacguuguuccaaauaagcauuaguuugaauuuguaaagaaaacagcuuuguacaguagucauucuacaaauaguuuuaagcagcauuuuguauuuauauaagacaccauccugcucgaccuuccccugggcacaaagcucacaccugguuuacccuuuucagagaggaggugagucacggagguagccauaauaaguguuagaaaagagugccuccugcuucagcugaggaagacauuuaucauccuccuuuuguccuuuaauucacgucuuugacauuuggaaaguauuuggaaagccaaaacuacagaccaaaaauugugcccuuaauugagugugauuguuaaaaaaaaaaaaaaaaaaaaacuugugaaacugggaagcacagcacaggcugaacagagcacuggauuccauagaaaauguuuucccuccaacucugacaaacuccacccuuugguuucuggugccuaguuaacaaaacaaccugcaauuccaacuccacgucagcacuugggcgaaggaauaggccccuauaaaugaggagcuuuguguuuuucgcuggcuuccucucaccucuucaagccaugugugugguaggaccucaacacacuugucgauuggcuaaagaaucacacaccugcagucaaauuuucacuuuuaauuuuuuacuuaaaaagaaaaaagagcagccugggcuacauggcgaaaccccaucuccacaaaaaaaaaaaaaaaugaaaaauuagccuggugugguggugcacaccuguggucccagcuacuugggaggcugaggcaggaggaucacuugagccagggagaucuaggcugcagugagcagugaugaugccacuguacuccagccugggugacagagugagaccuugucucaaaaaagaaaaaacacuccaccuucuccuuggccaccacugucuucccaagccauggcacuuguggaaagagauuuuggaggcaggcauacaguccugcauguaaguuucagcuccaggacaggcugccagcuguccuuaggcaagcagcuuaccucagugucuucacuuauaggaagaaaaacaaagugggauuuacacuuucuucacaucucacaguauaggcauaaaugaaguuaaaauaucuuacaugucuggcauagaaaagacaauuuuuaauucucuuuuccuaauuuauccuguagauccgaaaacucugaaacacuccauaaaaaaauccuuacccuuuaaugauacacacugauauauacagaugauauaaauuucaaaauguaaucacauguccuggguaaaacauaaucuguuugacagucccuguguuuucauggauccauucugaguaguagugaaguucaauuuuuuugcauaugaagaaaauguuaauaauccacuguuugaucaugguuuuuuuuuuuuuaaucucuucccuuuaaauauucuccuccucuuuugaccaggaacucaaauaacaugguagcauuucagauggggguuugucugaaggcaaggaguagagaaggccuccuggugcagggauggagucugucccagccaaccagccauccacccugucuuacuguuaauuuuauauacuugccuagcaaugcaaaguucuuuuucagccuuaaauauauguucuuagcucccuuccagccucugccuuuuguucaucagguggggcugcacagugcacagggaggagcacagccgggagccaggcaacccagguucaaaucugugcccucaugcucaccagcuugguuaccuuaggcagucuaccagcuucccugacuucuguuuuuucaucuauaaaauauagacaguaauauauaccucauaauauuguuaaugaauauacacugcaauaaguuaauguagauaaggcccuuagaauauuaucugaaauauagcaaacaccacaaaaguucuuaaucuuuucauuugugaagagaacauacaccuuucuguggaauucucauacguguguacacuuccaugagaggaacuguccacucacucugcugggcuccagccacgccucuccuuggaggcccaggaccuccaacugucccucuguccuccccucccugaugcaguccguggugucauuguuuguuccagucaagugcaaggcugucuccuugugcuucuguguacagggugggcuuuauuugcugggugggagcgugccaacccuggagugcaagcgaggacaggucuucuuguaccuggaugcaauuugacauccucaggccuggauaagcauuuuuuuaaugacgcauaguaacauuaggauuuuaauaguaccugcuucugaguugaucaaaauauuuuauaguuauaguacuuaguuucuauuuaaauccuuaccacacagguuagauaggaaaagccagauaauauuaaauaguaggaugucacaagacaggucuacuagcagugaguuugcauccccuuuuccucuuuuuuuuuuuucuuugagacagagccuugcucugucccccaggcuggaguacaguggcgcgauauuggcucacugcaagcuccgccucccggguucacgccguucuccugccucagccucccgagcagcugggaccacaggcacccaccaccaccacaccuggcuaauuuuuuguguuuuugguagagacgagguuucaccguguuagccagaauggucuugaucuccugaucucgugauccacccgccuuggccucccaaagugcugggauuacaggugugagccaccgugcucagccacauucucuuuuccuuauaugggacgagaauucauuuugaacucuuccccgguaggugguagaguuugggcagaagacuggccuuaugcccacaugacuugauuuuaaugcuagauuugccucucucuguaaccuuaacauguuccuuaauuuauuuucucacaacucacugaaaaugcuuacaauccaaucccuuaguagaauauuauauccaauuuaacauuauguaagauacauccuuggaagaacagccacuauauaaaacuuaaggucauuauuauaaauuggcagugacaacuacuguuuguauugagacuuacuuccaagucuauggaaauucuucaacuucuugaaaguauuaaguaaaaucuauggucugguccaaacuccagaucuuugguggaacgaggagaagugaccugggcauggaagaagagggcacaguccgcuuggccguaguccuagauguggaccacaguggugguuaggcuuuuuacuggaaaggaguguaaagaaagaaguuuccguguguuuuugccauuuucacuuuuguaacuucuuauggcccagcaaaaagaaacaguagugugcaaauguuucgcuuuaaggggaacauagaaaucuuacaagcacuaaguccagggauuccucccgcuguugcuagacaugugaaagacagccagcaagaaggcagagcgcagagucaggccuugucuuaacagcuuggcugugggagcuaugagccacuucagaacaucucacgcuuuucucucuuuucacccaucugacuuuuauuauaauaaccuuucauugugggcagugguguaaauuugagucuugguucugcugcuucucugucaugugguaugacuguaggcaaauuacccuguccucucucugcucaucauguugucuuccuuuauaaaauggggguaauaguuuccccgucacugggcugcugugaggcuuggauauguuggguauuagacauggaguauuugacagauguccacugucauuaguacuaaaggaaauuaaggucaagaauaagacaccggcacaguugcucaugccuauaaacccagcacuuggagaggcugagguaggaggaucgcuugaguuugagaccagccugggcaacauagugagaugcuaucucuacaaaaaccaaaaucaguuagugacaguggugugcuucuguagacucagguacucgggaggcugaggugggaggaucacccaggaguuggaggcugcagugagcuauauaggauccugccacugcacuccagccugggugacaaagccuucuuuuuuuuuucuucuucuuuuuuuuuuuuuuuuuuuuugcuucaaaaaaaaaaaaagacugacuuaaacagagcagucuaagaccuuugauaauacuguaucucuguagccugcgugcuuuuagaaagcauuguuaaaauacuuuuagaaagacuuccacaaaacugguaagccuaaagaaaagcaagcuccucucaccagacuaauucaccugguagaccaguucuguaucuaagggacugaauggagaaacuguuaccguaauccucugagauuaguguguguagggagaggcugugagcaaggaugucugccccauccugugaggaacuguaggagaaaugagagguuguguugcugcacacacucauauuuccccuguguccugggcaccccugcguucacugcuuccauuccacaccugcuacucagaugccuuuuuuuuuuuaacuaaucaguccugaauuucccuauuuuuucccaaaaauaauuugcauuucuucuuacauauacagcauuugauggagaagagggagcaguuuccagccaucaaauuuauugaguugcuguugugugccaggcaguguccuagacuuuagggggcugaagaugacuacauccucggagggcaggcacguagccugucggggaggccagcaaagaaggaacgaugugauaugggcuagaagagaguucagggccaagaacuggaacauagauaaagacaaggguaaaggugggugcagucagaagaggucagaugggaaaucuagggcuucagaggguucugggcagacaaggaguuucucuaagaagagagaacagcaaagacagaugcuuugccaagugcaugguguguuaauuuaggucaguaugacugagguuuucaaaggcagggacuguccccaucaacaguggugggggcucguugcuuccucccuuagucaagauaaccuguaggaaaccgguuuucaacaggguuguagacaguagugaagucgccacccucuuugucccuugguuguuuguaaacauuuccucuucuguaacaggaacucuguugacuuuuccuaaaucaucugccagauauuugagguuauucaugacuuuuuuccuuuuauugaggaucauuaucacuucuaugacaucccaguauuaaaaauagacaacauuaagggauauuuuugacuuuuaauauaagaaaguuuuuagaaauguuuagucauguacuuugauagagguauauguuucuaagccaaaaauuggauuaaguuuccagucauugcaggcuacuuaaugucuguuagaugugguauagguauaggauauuuuguuuaagagcgaggacuguuuuaaggaacugguuuuacucauggaaccguagaucuggccacuggguauuuuucuguuguguuguuaauugucauucaucuacucacuauaagauagucuucauuuuggcuaaacagauucuuuuuuucuuuuguuuuuuuccuuuccagcuuuuauuuuagggucaggggguacaugugcagguuuguuacaugggugaauugcgugucauggggguuugguguacagaugguuuugucacccaggcagugagcauaggaccugauagguaguuuuucaguccucuccuuccuccuacccaucacccucagguaggccccagugucuguucccuucuuuuugucugaguacucaaugcuaaaacagguucuuagcccuauuuacugucggguaaucuuugcuuuguuuuccuauuagaacuaauaauguguuuauaauuacauagugauaauguuaccacuuauuuccugauuuugaauauuaauguccuagccuuuuauuuuuauucauuaaauguugugauuacaaaauaguccuaguguaggacugcuggaguucgguaaguuguucaaguugguugggaaaggcagucugacauauucagacuccauuguuagcagagaaaacuguagucaaaacaaagauuaucugcucuagcuguuucagggacucuuagucaauuugaagcagagcucaaaagaaauaucaucugccaguuauuuucaauaaagucgcagccacugccacaagguuuacaaaaguuacagcuccuuuaauuacauuuuaaaaacuaacuuacuugaagaaauuggaaacaaaaguaaaauagaauauuggggaaccugccccguuagucacguagguucuuuucuauuuucccuaagcgucggccgguuugagaaauaaagggacagaguacaaaagagagaaauuuuaaagcugggcauccaggggagacgucacaugucgguagguuccgugaugccccacaagccacaaaaccagcaaguuuuuauuagggauuuucaaaaggggagggagugugugaacaggugugggucacagacaucaaauacuucacaagguaauagacuaucacaaggcaaguggaggcagggcaagaucacaggaccagggcgaaauuaaaauugcuaaugaaguuucaggcaccauugucauugauaacaucuuaucaggagacaggguuuugagagcaaccggucugacccaaauuuauuaggugggaauuuccucuuccuaauaagccugggagcacuacgggagacuggggucuauuccaccccuacagccuugaccauagaagacggccacgcccagggccccccgccaccccguagaccuacccccaggcgaguauucucuuucccagggauguuccuugcugagaaaaagaauucagcgauauuucucccauuugcuuuugaaagaggagaaauauggcucuguuccgcccggcucaccagcugucagaguuuaaggugaucucucuuguucccugaacauugcuguuauccuguucuuuuucaaggugcccagauuucauguuguuuaaacacacaugcucuacaauuugugcaguuaacacaauuaucacaugguccugaggcaacauacauccuccucggcuuacaagaugacaggauuaagagauuaaaguaaagacaggcauaggaaaucacaaggguauugauuggggaagugauaagugucgauggaaucuucacaauuuauguuuagagauugcaguaaagacaggcauaagaaauuauaaaaguauuaauuuggggaacuaauaaauguccaugaaaucuucacaauccacguucuucugccauggcuucagcuggucccuccguuuggggucccugacuucccgcaacaauagaauaguagucaucacagauuaugcauuugauuaguaaauuccaucacagaguagcauggcagcagugaaauccuaacucuacauuaauaugaagacaguguuuugucauuaaacugugcugcuuuaaaccagauagcaaauaucugcgcuauuuugugcgucuuguguagugucacuugaaauugcaguuuccuugcagcugaguguuaagccacugucuucaaguucuccaucaugcagaaccugcuuccugggucaaggcagugucugagcuuccuuugacuuuggaaagcaaaucauuuccagaacugaaagugaaauugaauuaaguagcuuuccuucagggacaucugaaauuauguguuaugugagagguuaagaauugacauggaguagugcucucuagcuuuguuuucuugugacauuuuauauucaugcaacuucucuccuagggcaggagggcugccucccuggccacacccugccccagggcuguaaacaugccuuuuguguggcauugguguccacaguguuacuaauuauaaaaaucggucacaugucuuccacuuccccucaagagccucaucugacugcagcaccucauuggugcccagagacgggcagucaggggcauggccagggccuugcccucugcagccaccauaccacucacaaacaugggcaccugcuggcccggggagcugggaucgucuacacccugggucccaaggaagcugucaggaagucguuccuguagggaaggugccucuaauucuaaauucagccagcaucccuuuuguuucccuuaguuaugaaaauuguguaauaaaauauuguugugaaauauuuacauuuuguauaacuggaaggcauauaagguagcauacacaaaugaaaacuugguuuuaaaaauauaucugaagcuuuacaggcuaaauugaaaaggaaauauacaugaugguuugcuuaguaauauuaaaaugaauaaaaauuaaaguuggguauguuaauuuguguaagaguaaauuuuaaaaucuucucacuguugaucauauaauguuauguuuauauuuaccuaaaauuuucaugaguacugaaauuuuuaguacaauaauuucuaaauucagacuaaggcuauuugacuaaaguugauuaaguuugauuaaguuuccaguguuccauauaagaauuuucccugagaaaacauccuuuuaaagccacuuauuuguugauguaguuauuaaauguaauuuuaaacugguuucuaugcugaacugugguaguuauaaguuguguuaugaacagcaaauacuagaccgaucacucaggauaagacauaacaugggcugaccuucccaguguggacugaagcgugagagaugggagguuauagacacuggugcagauacugcuuuuccuuggaauuaagugaugucagguuucgugggguuuucuuuuuuucugauaaugauaacaaaauacacaaauaggauuauuuuguaugacaaauugcaucuuuguuguuuuugcuucacauuuauuuguuuuauuuacagguguugacuucaaaaucaaaacuguagagcuaagaggaaagaaaauuagauuacagaucugguaagugggagagugugcacccaguaaugugcuguguguguuuaacaguccauguacuugucuaauaaaaugaacuguuugagcugauuugccucuccuacuuucuccucuuuugcucauuuuaaaauuaaauggacaguguuuccaucaagagagagaauuuagauaaggcuguuauguuauaugccacuugcacauggggagcaguuguggacagaagaauguuacuuuaaugguagcuaguuuggaaccuuuuugccucuauuuucaaauuauuuacgugauaucaaaacugucuccacuaaaaugauugcucaaauguuugucuucaugucuuuauuuuguaugauaguauucaaagaaagcccaauauguucauaaccagauuugcacaaucugaaggcagguccccugcagacaguuccagagcuucuugguggcacaaugugacuauuacugcgggugggcauacuccuuccggcuguacugcugauuccacgggaugugagcccccacuaaugccuacuagaaaugaauccaggccccuuucucaaaucacaauuggaaugagagacucaaccagcuguguuauaacugcacucagcacuaagagcuuucuguuagcuauuaaccuguuaacagcccgcaggugcuagcgaccugucuguggaagaagggauaagaucuggucugguggucuggcgguggcuuaaaaguagccccauugaggugcucugagaaugccguuuuguuuugaaugcuacagcugcgguguacucagcuuacuaacuccucuuggcaggucacccucagcucugauuguuuguccaccauguguguguuugcuuucaucugcguuaauugcugcuucaucuguggcaucaucggucaccuaaugcuugaauguuagugccaugucuucauucuucauccgugucccugucugggccgcagcugcagccaagccgcagugccugccuucuggaggugucugagguaauaucuucauuuggucacccuucacuguauaacacacuucuaagauuuuuugauuuggguuuuuguucguuuucuuuucuguugugcauuuggucugcauauuuucauuuuuggcuugauuaugaaacauuaggucuugucuaaauacuugaauaaacaacaaauagauauuucuuccugugcuagucccgcagacuuuuugugcauugcugcccagcuuuuaaacgcuggaaauggcaacaaaguguuuggcacacaagcugcuguuucuaauuauaagcucuauaagguaaagaccaucuucacaaggauuugggauaugccucucucuguuccuaguaccugugugagguacuuucugaugagaauauugccccacaaaagugauguaaacauuauuagaaugugugacgccugccuuggugacagccaugccugaugacuguggcacaugucuuaauuaaugcauuaauacuuccaucuucaucuuuggcggcaguauucuuuauaaaguauguccaaaugauuuauaaaguauguccaaauguccuggugccucccuggagcucugcccacuaagucuaugcuggugacauuguacacuccuggaaucugacuacaauguccuugacucugagauaagagggcccuaccugauggaaucccccucggggagaaagugagauacuguggcuccacgaagagcagcgggcacucagaaaccauuuuucucuuguauaugaaagcauucuccaaaugaccccucucccucuccugauucucccuugacucuuuacuacuuuuucauucucuaaaucugugcagcuguacagcaugggcaaagagcguaacuaagggaggaagaaugaaauggauuggacuuacggaaugguugauugcaaguuuucuacauggaauauuccagugacucuuuuccugcaggaagguuuugaacagugacucauauaucuacuacaggccagccauuuuguugaucacauaauacucaaaauaagauuuuuaucuucugaaauauuuuauuuaaaagaugaaaaccuuuuccuucauuauugcuaugcagcagguaaaaaggaaguguuagaaucaugauuguaauuuguauuacuguuuuaaaguaaugcguggcuucuuuaggagugaggcacagcccuugugcugcugcugguguaaccugcuuuguugugggcguguugucgucguuucacucucauccauugagggcauagaaggcgccuguguagcuggaaacggucccucaaggaggcgcaguggauugugcuaugcuaauaauagauagcucugcuccgauuuucuagacuggcaugaaagcauugccauucgguuuucauaggaggaucuuguuggaagaagugcauuauuuacuauagauuccuaaaagcuaaaaguaccaaaagcugcaggugucuguuacauuuuuacgucacguuuuaugucauugccacauauuucaguuuguugauuaccuguggucagaaaaaggaccauuuuucucuucucuguacuuuaaaguauuucuacaugaauguuagaacuuuauguaaguagcuaaaauaaaacauguugacuaggauguaguuugaugaauuuauauccaaaugguguccuagaaauuauuuacagugaacuuggaguuguguugaaauggacuugaagccgugaaauuugccucuuaccuuuaggcaaacacagaauugaaaugcuucauauaagggcccuuuguucugccugucggaccaguccacuguugggggacuuuguuuuaaccagcguucuuaggucagcaucauuccuuuuguucucugcuuggaagagggggaauauuucauacccuauauuggcgugugcccugaaaauuaguaauuaaauaauuuaaguggcuauauuaaauacagcaaauaagaggcuuugaauucuccaagcguuguuguaucaccaaacugggaaaacagaauugcaggaauuuuucaauugcacaaaaaccagauagaaaaaucagaauaagguggcaugcuaacuguaguaaacgaugauugagcugacguucauaacuugcaaaccucuagaaauccgcaccuuaucauuacagugaaaacucaaguuuauggggaaaaagagggaaauauuaggauucugccuuuucauagaaaggugaaagcaugaucagugcauugauguaaucuaauuuucugaaaaggagagauuugugugggauuuuuauggugcuggcacacgguagauauuuaagaaauacuugcugaauggaaucaacauuucauuuauuauucuuuggccguaccugauaguagauaauuuaguauguaagggaaauaaaucaagcaaaggcacuuuugagaggaauagaaaauaaaagcuuucucaacccaaauauuuugggaguguggaaucgucucucaaagaaacaugcuuuucuacccccagccuucagagccaggcccaaacaguggcauuuaaggaaugggcuuaaauggggagugcugaacuaguucauguuuccucauugggauuuuugucaacuaaaucaguuugcucauuugcguuaggacgauugccucagguuuugaauuuugagguuucuauccucuuucuuuacauuggacuuaaagucaguagaggcagcugacuucuuaauggugagcuucuuaauguuucuaagauuccugaguaugcuauucaugcaaaaacauuuuaagcuacaucaaaauugccuuuuacuaucccuguucuuugauuguuuuuauuaaaacuccuauuaucuguaauuucucugguuuugugccuccaguuucuggauucuuaagucauugaaugugaauggaagugcaugugaguugacuuauacugaaaaccagauuaaaauuaccuagaauaaaaguuuauuaaaguauguaauuccuaaaaugcuuauugaagaccuuaaaucugauuguuauuuaaauuugugguucagcgauauuguguuaaccacugauuucagaguagaaaaaaugcuuauuauuuuuaacuuuuuaaagaaauggggaauguuuuguaacaguacucaaauagcacagaauauuuuucaacauuaaaaacauuugauugaauccuaauuuagacaagccauaacuugggaggaugguaaaccauccucugaaagauuuaacucuuuauugguuuggaaguaguaaaguauaccccuaaaugccuaggauuagagaaauaauuuuauucauugacucuuuauggaaaccaaaugguaucuaacucuguuccuucucagccaccuugaaggugacuauuaguguggucuuuaaguugcuuuuagaaauccugaagaauucagucuucgucuaucauauucuucagauuuccuuuuuuguuuuugcaguucugaggccaaaagaugaaguuucuuugccuugccugauguggcaucaacuuucuaauuuuuaaacauguuaccagcgcaugucuacugaucguguacugcaggaccuggguagacagaaacauacccaccucugcccuccucaccuuccagucagggcagcaggggauccucauauccucugaggcaaagcaaauggcuucacuuuauguggaaaugaauuugccagugagcuuucgugcuuguuugacaauaaggcaucacugaugugaacuaauuugguggcaggucuccucugaaggaaaccagaaauuguaacagcauggccaagggguguuucuagggacccagucccacaggugccuaagggaaguguucuccuccccuuucaggaacucccugcuguguggugagaggcucugguggccuugcauggaagagccuguugccccccagcuuacuccacuguggcgcacuugguugggguucuuuggguaaagcuaaaucauagauggucuuuaaagaaaucgcuuugcaaguguuaguccuuccugauuggaagccuucuccauugagccuuauuggaauuagaaauuugcagugguucucaguuucuaggcuuaucauaauauaagauauaaaccaaaaaguaucugagacaggucucaaucaauuuagagaguuuauuuugccagggcuaaggacacaccuaugacacagcaucaggugguccugacaaccugugcccaaaguggucaagaguacacuuugcuuuuguacauuuuaaggagacauaauacaucaaucaauacauguaagauuuacacugguuugaucuggacaggugagacagcucaaaggggcuggggcuuccaggucauagguagauuuaaacauauucugauuagcaguugguugaaagaguuauuaucuauagaaagcaaugucuggguuacuauaagggguuguggagaccuagguuuuaucauguagaugagccucuaaguagcuggcuucagagagaagagacuaaacguuucuuaccagacuuaaaguguguguucauguucaugcuggaggguagagugaggaaugucugacccccacugcucaucauggccagcaccagccuuucagguuaaauuuuagagugcccuggccgaaggggagguccauucagaugguugugggaggacuucaaauuuuauauuugguuuaaaaaggagaaacagggcucagcuggcaucuguacugauugaugugcuuacauucuucauguggauguggccagugucagccuggagaaaaaagaacgcuuuuagauuucaaaggagcaguuggguaauaaugaacuuuaccauauuugcaaaccuaucugguaucucuccucccuuuuccuuugaccaccuauucugucuaggguuaagaaaauaacaaagccaauucugguuuguuuuuguuuuuguuuuuguuuuuugagauggagucuugcucucuguccccuaggcugcagugcaguggcgcgauugcaguuaacugcaaccucugccucgcaggcucaagcaauucuccugccucagccuucugaguagcugagauuacaggcaucugccaucaugccuagcuaaguuuuauauuuuuaguagagacggggguuucaccauguuggccaggcuggucuugaacucguggccucaggugacuugcccaccucagcuucacaaauugcugggauuacaggcaugagccacugcgcccggccuaacaaggcuaauucuacagcauuuuucauaagugugggacuauuggucaucuuuucaacaaaaccagauauuaacaaucaaugucaguuaaaggagaguuguagacuuaaauagugucaauuguccuacauuuucauguuguugauaacagccuaccauagagguguuacagcuuccaccauuuuacacaggaggaaacagagcucagcucagagagguugaguuuuccaagaagccaagucauggggccaagaauagugcccgggugccaugagacucugcccacuacugcccugcuggcugcagagcggcucagauacggcugucauccaagccagggagccuuugagccagugcugcugagaaaauugggaaaaagcccacugcccgguucccagcacaucuucacuguuccucgggcucccuccaugucuguuucccucugaguguaguagauuggggacucagaaccuucuagaacagaaguuaugguuuuguaaggggaagaaauauggucaagugcacaucuauaauuuagaguauuaaauuuccuuguacccuuaugauuuauucuagaaggucagcacauugauuacaaagcuaauguuggcuaacauuaauccuucagguaugagguaagaaauaaaaaauuacuuucaugcuucauuucugcacaaaauuucacucuggaaagauauuucauuugaaaaaaaaauuaaaaguuuuacucuguaaaggauuuucagaucuuuucugcuaugaaaauucuuguuuucuaauuuucaaaaucuugguuugaaaguaauuggaggcugggcugguagcuuacaccuguaauuccagcacuuugggaggccaaggcagguggaucacaugaggucaggaguuugagaccagccuggccgacauggugaaacccugucucuacuaaaaauauauuagccaggcaugguggcgcaugccuguaaucccagguugucgggaggcugaggcaggagaaucgcuugaacucgggaggcagagguugcagugaaccaagaucaugucacugauugcauuccagccugggugacagagcuagacucugucuccaaaaaaaaaaaaaaaaaaaaguaauugggacuuauugauguuuuuguuugaguguaacuuguucagaaaagcuacuguggcugacaguaguggcugugcacggaugucagugcagacuugaggagcuuccaguggccggacccagacagaggcauucucaagagcuggcucugcuugucuccacagacucagugcugcuggccugacugugccugcuaggguuguaacuguggaucuucuuuucuuccugaaguggucaucguaagcugccacaugugccccacgccugcccccagcacucuagguggugguuagugagcucugagaaaugaauucuuuguggcuuggagggcauucauuuucacaauccuaggaugcccaccauuuauugugugugugagcggggagugggucaugcauguguaucaaguguguguuucuuguguggcauuguugcucuuggguaugacaaaugguuuuguaaaucaccuacaaugugaauucuuagggauugauuguuuggaaacucuguauuuuaaaaacuuuucccccauuuuauuuuaggaaaacaucauauauuuugauguuauauuagcauuccuguugcugauuuucugucuugagggaaaaaguuauucaggagaguauguugaucuugguucauaauccaucuccauuaaucuaauuuaguuguuaaauauaaagguauuuucuaugucauaguuuuagucaaccuaaauuuuuccuacuuucuuuaaguguggucaucaggucaaagggaaauagggguuacucucguucuuuuuucgcagaaaaacugcagcauauaaucuauguuugcauuggaaugugauggugcucacuuugggcauuauuugggaacugacuuuggcugcuuuuucuuagggacacagcaggucaggagagauucaacagcauuaccucagcuuauuacagaagugccaaggggaucauauuaguauaugauaucacuaagaaggagacauuugaugauuugccgaaauggaugaagaugauugauaagguaaauguugcauuuuucuguccaaugugaacucucugcuugugagucuuaaucauuauuaaaagaaggaggggaaacacauguauugagcauguuuucauauagacuaaacaucauuuagcccauauauagccuucgggauagggauguaguccuguauuguggaugaggcaaagaagaauuaaauuuauccagaaucaggauuuuucgucugguauccuggacugucucaacuacagaggccaaacaugcucauuccacuacauccagcugcuuucauggaauagauauaagacauuucauuucugcggaaaggucaccuggacacucaucucaugcacguccacugagugacaaccuugaggagauggccuucuccacggugccugcggaugucccacgcgccuccgucacccacuggacaucuguccucgcaauuauagaugcccuuuagcuccucauuuugagcaagaggagcucgaguucuccuuuggcucgugauggaaucauacagauaggcugugucccugugguuaaugugaaccguggguucuccgcuaagaaacauguucccaaauacacauuuagaaggcagagcaguugggagugggaugugaugauauaccauugaccacauuuugaguuuucuuccccucgugcaguaguuucauguuuaguuccuuugcauaacaagcauaugcaauauaaauuggauuuuaucuacacauugcauuuaaaccugucugcuagauaacauuggagaauguuugccagcuuuaccaagcaugucauugaugauguaugccucuuuaaaauguguuaggauugguggccaggcauggugacucacaccuguaaucccagcacuuuggaaggccaaagcaagaggaucacuugaacccaggaggucgagaccagccugggcaacauagugggacuccaucucucucucucucuuuuuuuuuuuuuuuuuuuucauuaaaaaaaaaaguuguuaggaucaggguugcaagguuggaucagaccugaggcggggccccugccccagccugcucugcacugggcaucagucauaccaggcccuccauuggcacaucaguggauacugauguucccugauacggaagucacagagugcaauccuguggaaauuagaaguggacaguccucauagucuaaaacuuuuagaacuaauaggaugaauacaaaaccaaaagaaauggccuaaauccuaccccauuugguacuugaguuugugagucugugcccacccaggucuugaggucugaugcugucuuccuuuugucaucaacugcugcuuuucaccuuacuugagugagagcaucauuuccugagugcggggcccauugccccagcccugcggugggugcugucacuguuacccacaccucccugauaaggggccggcacuccucaccuggcugcguaacuggcccacggccacaccauucagguuccuuuuguugcagucuguuucaaguaacuuuuuagaacgacaaguuaguugcucaagagauuuuaaccucauuuuuaaagacagaaaucucauuguaccuauauguauuuuuaaacuuagaaauguagcuuaacuuuuuuccugguuauaaaauuaaugauaccuucauuauagaaauuuggaaaaugaagaaaagcacaaaaguaaagaagaaaucuguaccucuggcauccugaaaaaccaaauuggcuucacuguauuuagcuuuacgucuugcuuauuuugugaauauucugucauggaguccuuccugugucauucucuguucuucugaagcguguguuuuuuuaaaugccuguguuuuuaaaauaacuugauucuugagccauuuuguuugacuuguagguuuuucaguugauaaccauuuugaguguagagcuuugccuguauguugaaucauuuccuuaggaagaggucuugggaauuguugggucaacagccaagagcauugugguucuuaaugccugugcccuaguucuuucuaagacacagugagcccugccuugcacugcugcccaguccugccugggaacugguagaaccucaaagacaguggaagugaauggacaaauguaaauuagcgaaaaauacuguaucgguuuauauuucugcugucaguauauggcgaugcccaucuuugaaauguggcuucuuuuaaaauuccacaguaugcuucagaagaugcagagcuucucuuaguuggaaauaaguuggacugugaaacggacagagaaaucaccaggcagcagggggaaaaggugagagggcgugggaggcacgguugccacacacugugcuuagcgcuugagguacuguuucuuuuaauaaauuacuuauuuuaaaaauuacaaagaaauuaucaauacagugauaacucagucacauccuccuaauuuguuugcacuuuuuugacuucgugcuccuuuaaauucauucugaaauggagggagaaaaaaacacaucaguguauacaacauuauuaucuaaccugacauuuuauacagagaaacauauuuuaagccauaaaguugcuuuuauaauuuacuuuaacguacuuuaaacuuccuugguuuuugcuaaggauugaaucauggagaaacgaugcuauucacauuuaaaugucagauauguuacacuuuuagaaacuuaggcaacugauuugacuggaaggucccggcaucaccuucaggauuuuuauugucuuuuguuuugcuaguugcuuauaauguaagaauuugcuacacuugugaacuuuaucuuugagcgucagugggacuuucuaccccuuaaucccagcccuucccuugaagcugagcccagagaccucaugcucgcacgcuggucugugaggccccacacagaggaaauagguguguguuucuucucaguuugcacagcagaucacugggaugcgguucugugaagcaagugccaaggauaacuucaauguggacgagauauuuuugaaacuugucgaugacauucugaaaaagguaaaaaaaagaaucuacauuauaaaaguauaucaucugaaaccuguuguuuccuuuauugcuuuuuuauugagaauuuuguauuuagaaaccaaaauacaguaguugugcucaggcgcaagaaccagguaugguuguuaacucagccacaggcacccggccugcuguagccguuucccacccaggggcuucugguguccuugggguugguauauggcauacuugcuucgccuuaagauacagcaggguagacuuaacaggguguagcaauaugcuguguuuauuugacauuugcuuguuuucccacccccguuuuucugugagaauucaguuggagaccuagccaagucugcaggugucuuagcggaaaagagagccccguggugcugcgcuugcaucccuuccuguucugcucccuggugggagccacuuccuuacagagaccuuuccaugaugcugaguugcaagaaaauugcuagacagcuucauugagcagcagcaguuucuucaggcaucuuuaggcuuacauucaaaaauuguuaauaagaacugaaguuuauguuauuaagugaaauuugcucaguucauacauaauucagaagcuucuaauaaaguaauuguuuaggcugggugugguagcucacaccuauaaucccagcacuuuggaaagucaaggugggaggaucacuugaggccaggaguucaagaccagacugggcaacacagugaagccccaucucuacaaaaaaaauuuaaaaauuagcaagguguaguggcauguaccugguuguaguaaucccagcuacccaggcugaugcaggaggauugcuugagcccaggaauuugaggaauuugauacagugagcuaugaucguaucuacacuccagccugggugacagaaugagacacugucucuauuuaaaaaaaaaaaaaaaaguuuauauaauugccaagguagguuaugucugucuuuaguaaguaugcaacuccuuggaaugcagaccauuuuuaaaauuuauuaauguauuuuuauuuugccugguucugugaaaauauauguuuaugagguugaucuguucucuucuaccauaggguauuaagcaggcugggcauuguucauguugugauaugaagugucuugaacauggcuuuuuuuggcuuaauauuuuaaugucuaauugaucuuuaacgaucggaggacuuucaauaauaauacuuuuuuuuauauaauuguauaauuuggaaagcauuuacaguugacccuugaacaacaagggggcuagaggugcugacccccuaaacagucagaaaucugaguauaacuugacucccuaaaaacuuaacgacuaaaagccuaucacugacuggaagccuuacugauaacauaaacagucacuuaacacauagguuguauguuauacguauuuuauaccauguucuuaaaguaagcuagagaaaagaaaauguuauuaagaaaaucauaaggaagagaaaauauauuuacuauucauuaguggaaguggaucaucauaaaggucuucaucugugucaucuucacauugaguaggcugaggaggaggaggaggaggagggauuggucuugcugucucuuccggguggcagaggcggaggagaaggugaguggggaggcaggagaggcaggugaaacuuguauugaaaagcagcuguguauaaguggaccugugcaguugaaacucauguucaagggucagcuguauguguaccuuguaaaguuaaaacggauuuuuuuuuguuuguuuauacguuagaugccucuggauauuuuaaggaaugaguuguccaauaguauccugucguuacaaccagagccugagauaccgccagaacugccuccaccaagaccacauguccgaugcuguugauuuccuacuuuggagacaaaguggaaaugauuccuggaaaggggaaaaaacguucuauucugcacuacaaucauuuugacaauuuccuuucgcacuuuguaauccaagucagagcuauacacuaacuuguaaauaugcauauaugcaauccuggguaaguuuugguuauaaguuaccuauuucccuccaaauuauuauauuucauucauuaccccagugucuaguguacauacacugggaaaccuaguacuucuaauaugaagaaugggagaaaugaaagguauaauguuucuugaaauaaauaauauaauuguccuuauuaauuauauuaugaggacagaagauauucugauaagagagaacguggugcuuugcuuaccguuuuaaagaaaauuuguaaaacuaaagacuuuuugaaaaaaagcuaucuuaagugcuuuuucuuuauuuacaagacauuucccccagugguagcaucugaaguauuggaguguuucugccacgaagcaaagcuccauucauggccgucauggaagguuauuuauuaauguuacauaaugguagaauauuacuaguuagaggguuggauuugacuugguccuaaggccacagaaucucucucauggcuuccuaagggauguaccuuuaugcuuuuaagaacuacaaagauucaauaaagaaagaaauguuuuugaaacuauagaaaaagauuuuaaaacacgcugcuguccuaaacaaauccuguuuaaaggaauuuuaaagagaugcauuuuacuauaucaaagaacauacguguauuugccuaaacacucuguaccuuuguaaugauaaaacuucccccuucuuuacggugaagcuuauucugauuaagccuagacuguguucuuuuuuuuuuuuuuuuuuuuuuuuuuuuuuuuuuuuuuuuuuuuuggucugaugaugaauuugugaacucuaucuuugguauaucuuuuauuaaacugcacuguuuuguuuagucaagguaauuaaguaauuauguauuugaauaacuuggugugucuugaguguugugguaugaaaagcauuguggucuuucuacacuaaugaagugcaaauaaaauuuuguauuuaugaaugaag

SEQ ID NO: 21318 - RNA, 139615 nt, Homo sapiens
aguucgcuaguaggaagcuccagcgcuacaccggcggcggcgguggcggcggcggccgcggcggcaccucagggcagccagauuccccaacaacgaccuccgguccuuccccuuccccgcgagaccuccgccccagcuccgccccgcccggggcucuugcguuucggagucccaacuacgcggagcgggcgccgcggccggagcgucccuccacacguccucccccagccgccagcuccgccgcggggccagaccgggcccgggagugcagccccggcgggcgggcggcggccgcggcagagggcagcccggggcggcgccggcgggccggggaggggcggggggccuggccccggggcgguggugcgggaugccgccgccuccgggccgcguccguucuccacggcugguaccugugucggguggguggccaggcgcgggccucgccccccagcccccucgccagggcuagcccggcugcgcggcgcccggagggggccgggccguccgguggggccgcggcccuguuccgcgcugcgagcucgcccucucgcggcucccuggcccggccgccgccgccccucuccccgcccagaggcgccccgggggcaccaugcaggcgcagcagcugcccuacgaguuuuucagcgaagagaacgcgcccaaguggcggggacuacuggugccugcgcugaaaaaggugaggagcacgcgggaccccgcuucccggccgcagccccccagcgcgggcgcuggggaagggcuggggaggcggggcgcgcgcagggccgucuuucuucccggucucgccgcgucuccaaaaggacggcgcacacggagaggccccccucauacggcuggcucucgguguugacauccaccgggugugugggaaugccgcagggagccggggggaguuuauccggauaauccaaccccugagaggugaaugcuuugcccuuugauuccaggacaacaacaguuggaggagccucaguuuucagcggaggucaaagcaggccacuuuuccgucuucuuggucuuagcccggagcugcugucagccuaccguuuuagguguccaguacgcugguuuuaguggcuugagaaugcccuggccguaaggcuugcucaaaggaauugcgagcucgccugccaguaggaacguggccugcucugcucgccgucaguauucacuccucauucuccugguuucccccgcuccuccgauuaacaggggcuggugcacaugcuaccaauuucagggggguuuuguuuuguuuuugcagcguucgagauucuuggugcugucauuuggcuuguuaagaauuuuuagccuuuguauguuuaaguuugcuacauuguuaccugaaguuacauacccccgaucugugcuuuuaaauguuuuaguauaauuaggaaguguucuuacguuuuuaaagcuucuaaagcagcagugugacaaccagacuauuuuuguuuucuuuucuucauuuaccuuuucuguaaagauugcuuuacucuucuaauaguguuucuaaaucccaguuucuugcugcucaaagaauguuucaugcuaacugcuucuacuaagaauggagauuauguuuuaccuuuuaugcuaaacauuaaaaggugucugauauuucucaaaggccaguaacuuuuacuuucccuuuugcccuguucuccuccggucccucuugcugucuuacaguggaaacuauuugguuuuucaggagaauuugcucauauauuucuggcuuaaauuacggacauuuuccccuucaagugucugacuagucacaaacaucuauguaauuuuuuuuaaaaaacagaagaaaagaugccauauaucuuacauacuuuacuccuuagaaaucccuucaggcucucacuccuuacuuuugcuuuacuugcaaguuugacuucuuagcuuguaauggaagggguguaggaggucucugugaugcuagaagcugguguccggauagaguaaggggagacacggaaauuguuuaaaaacguguaaaggaacucauaaagcauugccaaauaggggccauuuugcuuagaggcaaaagcagcuccuuucccaggggaaucaccaagguaucagcugaggauccuuugaagcaguggaaagaauauuguaggaguugacagacguuguuuaauucugccacacugguggcccuugcugaaaucuguccacaaaagcauuuuguuuggcuggcauaguguuguuuuauuuuuaaauguaauuaguugcuaauauuugaaaaugggagauauuacauaaaaccugaauuuucggcuuuucuugaagaauaggaaggucuugucauuuagggccuguauucaagcgaggcacuaaacugcuggaguugaguaaauggcucccuucuuuagacaggucauguaucuccaccuuaccacagcccccacuuguccuuuuugcauauuuacauaaaacagcuuuugacuuuaaguuagagauacuuuugcaguagaagugauaggaggagguggaaguguacauaaucuagcugauauguaagguucuuccaauucuuauuuaaauagccacuaacaaugauucuaaacaagauugaaaauacaguauguuucauaucuggauaugcuguugguagcucaaaaccuacguuuuuacuugccugcuggacauuucauguggauaucuccauaucuugauuucuuccuuugauuuguuauugaauuauucguagauacauccgacuuguguucucuuacucuuaccugaggcucuuuggauaugcuagucccuucauccuucuuugccugguccaacacuacucauccuucuagacucacucaaccugaacugucaaaucaucagggcugaguuggauauuacuccuuuguuuucuuuuugcacccuguccuagcucugugaauuuuaaguuccuauuuacuugccuauaacuagauuggaugcuccuugagaacagggaugauaucuuacccacauuuuauuccccauacuuauagugcuugacaucugguaggcacucaauuugaauaaauaggugaggggauauacaaacuaaaacuaucacuucucuccuccaccugucauuucaguuuuucuucucgauuaauggcuuuauuguuacauuugacugguuuaaaauguuggggucaucucuggcuucuuuguauuacugugcacacucagguagagccuguauguucauuucccuuugacauguucuucuagucuauuccuccuccgacuucucuaauugagucuccuuugucagacuacugugauaacuucuuaaugggguucacuggcccccaccucaccuucuguuuuucaaaucucaccaguuauaggacacuucugaacaugucacacucagaauuguugaugucuuuugaguucaaccuaugcuaaagugcacuuuuuagcauagaauuaacagcaauugauauuuggcuucauccugcuuuucugacuggauugucuaccauaaccuuuuaucuccuuuuugcuuuagccaguccggacugcuacuuuuccugaauauggcuggaaugucccacuguaucuguuucaccgcaucuaugagucuaaguccuaucuuaucuauugcacaaauauaucaugccuacuauagaccagguauugcccuugacacucaggcuaaaaagguaaaugacagggccgggcgcaguggcucacgccuguaauccagcacuuugggagagcaaggugggcggaucacgaggucaggaauucaagaccagccuggccaacguggugaaaccccaucucuacuaaaaaauacaaaaauuagccuggcgugguggugggcaccuguaaucccagcuacucgggaggcugaggcaggagaauagcuugaaaccggaagacggagguugcaguggggcgagauugcaccacugcacuccaaccugggcaacaagagcaaaacucugucucaaaaaaaaaaaaaaaaaguaaaugacauaaucagaaaagacuaaauuagaacaugaugggaaguggcagggcaugucuggagagacaacugguuuaugaacaguuuuuauauauguuaagcuaaggaauuuaaauuuuuucuuggguaauuagaagccauugauaaaguuucuuuuguuuguuuuuguuuuguuuguuuguuuugagacagagucuuaacaggcuggagugcaguggugcgaucuuggcucacugcagccuccaccuccugggcuuaagcuauccucccaccucagccuccugagacuguaggcacacugccacauccagauaauuuuuguauuuuuuguagagaugggguuucaccaggcuggucuugaacuccugggcucaagccaucugccugccucagcuucccaaagugcuaggauuacagggugagccacugugcccagccaauaaguuuuaaguaggggaguaacagcacauuuuaauuuuagaaaauucacuuuggccauagaauggaaaaugguuuggagaagaaugagacguaaagugaggagaaaaguuagaagccuaguuuaauaguccagucaagagauaauacacauuugaacuaagggugcauuugaacaaggauggaaauauggauguggauuuuauuugaaagaaguuuacaaggcaaaauugacaggaucuaguaacucacugagugauugggggaaugguaauggaacaggaauagucuuguuucugacuugauugucuuuagucaggauagagaauguaggagaagcucuuaggauggagagaggaguggcauaauaagaugauuuuuggaaauguugacuuaaaaguuuggguuauucaagugaacuucuccaacuggcuauugguuguugguaucugauuaagcagauuuggaacuucuagauguguaaguaaagccauaaauauagaugaagccucuacaaagacuuauacaugaauguucauggcagcuguuuucagucaaaaacuggaaacaauccaauguucgucagcaggugaaugaauaagcaaauugugauacaaacaguggaauacuauugguuguugguaucugaugaagcagauuuggaacuucuagauguguaaguaaagccauaaauauagaugaagcuuauacaaagacuuauacaugaauguucauggcaucucuuuucagucaaaaacuggaaaaaauccaauguucgucaacaggugaaugaauaagcaaauugugauacaaacaguggaauacuacucagcaauaaaaaggaacaaacuggcugggugugguggcucacaccuguaaucccagcacuuuaggaggccaaagugggaggauuacuugagcccaagaguuccaggccagccuaggcaacauaaugaaacccugucucuacaaaaaacuuaaaaaauuagccaaaacauuuaaaaaaauuagccaggugugguggcaugagccuguagucccagcugcuugggaggcugaggugggagcauugcuugagucugagaggucaaggcugcagugaggugugauugugcuauugcacuccagccugggcaaaaaaaugagacccugucucaaaaaaaaaaaaaaaaaaaaaaaaaagagagagaacaaauuugauacaaaugacaacauggcugaaucucaaaauaauuauacucaaugaaagaagggaaaccaaaaaagaguauauacuauaugagucuacuuauagaacauucuagaaggugcaaacuagugcagaucagugguuguuuagggagaggcuuuuuauguuuacuuaucuugauugugcugaugguuucagggguguguacauauccugaaauuuuucagauuguauauuuuaaauaugugcaguuuauuguaugucaguuguaccucaaugaagguauuuuaaaaaguagaugagaccacacgcugaaaaugauuuuaguaagacugaaaaagggcuggcauaagaagugggggaagggagugggaaauaguguauagggagauagcagaggaaaaggaaugauguaaggagaccgagaagcaaggagucaggcagaaggaaugaaacccuagugucugagaaguugagagaggaaugcuucaagaaaagaguuggcugugugcgauggcucacaccuguaauccuagcauguugggaggccaaggcagguggaucaccuguggucaggaguuugagaccagccuggccaacauagugaaaccccugucuuuacuaaaaauacaaaaauuagccugacgugguggugcacgccuguaaucccagcuacucgggaggcugagacacaagaauccugggaguuggaggcuucagugagcugagaucacaccacuguacuccagccugggugacagagcuagacucuguuucaaaaagaaacaaaaacaaaucagccgggccagguggcucacgccuguaaucccagcacuuugagaggcugaggcgggggaucaccugaggucaggaguucgauaccagccuaaccaacauggagaaaccccaucucuacuaaaaauacaaaauuagcugggcgugguggcgcaugccuguaauccuagcuacucaggaggcugaggcaggagaauugcuugaacccaggaggcagagguuauggugagcugagauugugccauugcacuccagcuugggcaacaagagugaaacuccaucucagaaaaaaagaaaaaaaaaaaagaaaagaacaaaaagaaaaacaaaaaacaaaaaaaauuagccaggcuugguggcacgcaccugugguccuggcuacucaggaggcugaggugggaggauugccugagccugggauguugaggcugaggugagccaugaucgugccauugcacugccgucugggugacaggguaaaacccugucucagaaaaagaaagaaacaaaaauagaaagaaaagaaagagucauugaucauaccaggcuauagaaaagucaaagggccugaaaaguguuaaguuuggcagcuaaggggucauuggucacuaugucagagcaguuuuauugugauaguagaagauggaagaacaugggaaaaguaagaauagcaagggcugcugaccuuuuugcucagauuauuuuuuucuagaagcuuggaaaggaagggaaaagagauagugcugaggcaaaaaagagauucaagauuggguaagacauuuuugcuucuugcuuggagaugacaaaaacuuacuaagagccuuugaggaaggagcuaauagagaaugcuggugaagauucaggaacacaaagcaaugggauuugccuugaacuguuugggagauaagguaagcacuucaccuguguucucauuuaauucucauaggauacuauuacggcuuccuuuuuacaggagagaaaaucaagguuuggaaaguuaaauuugcccauguaauuuaguuacagaaucuuuauuuuuauuuuuaaaauuauuuuauuuauuuauuuuugcaccauggccucccucccccaacucuaaaaucuguauuuuuaaacacuauauugcugggcaugguggcucaugcuauugacgccaacacuuugggaggccaaggcaggaggaguuugagaacagccuaggccacauagugagacccugucucuacaagggaaaaaaaaaaaaaaaagaagacagguauggugguacaugccuguagucucagcuacucaggaggcugaagugggaagauugcuugagcucagguguuugaggcugcagugagcuaugauugggcuacugcacuccagccuggguuacagagugagacugugucucuaaauacauuaaugaauaaaacacuaagugaugcuaccucuggcaggggugaugacaucuuuucuuaugagauacaggagggaaagugauaaagauggguuuguagguuggggagcagggaguucaugcuaaauaaucacuucuauuuucuuuucuuuucuuuuuuuuuuuugagacagagucuugcucuugucgcccaggcuggagugcaguggugugaucuccgcucacuguagccuccaccucccagguuccagcaacucugccucagccuccccaguagcugggauuacaggcgcacuccaucacacgcagcuaaucuuuuguguuuuaguagagacaggguuuuaccauguugcccaggcuggucuugaacuccugagcucaggcagucugcccgccucggccuaccgaagugcugagauuacaggcaugagucacugcaccuggccaaaucaccuccauuuucaugaugaaaugaaaggcaaauuuuuuuuacagagugaagaaaaggaaaguaguaaggacuuuagaaggaauaaugaagucugggaauugcugcuguggaguguagaggagccaaccagugccuuagaaaggaauugcaagccaggugcgguggcucaugccugcaauuccagcacuugggagccugaggugagaggaucacuugaaaccaggaguucaagaccagccugggcaacauggugaaacaccgucucuaccaaaaaacaaaacaaaacaaaagccuggcauggugguacgcaccuguagucccagccacuugggagacugaggugggaggaucccuugagcucaggaggcugaugcugcagugagccaugggaaagaaagagcaagagagagagggagagagaggaauugcucagcagugcugaauguggagaccauaaacucagaguaggguugaucuggugguugugagauuuuccuccaauagcgcuuaucuguucagguaagccgggagagaagacaguugguugcagguagcggcaguagagauuaagaagauagggauauuucaagugauagagaggaaguaaggguauauaagagaaauaauggauuggaagaaaaauuagggcuccauggauucaaaaucuuggugaguuagaagagaaggauagugggaguagauaggggaugugauuagagaugaugacaauuguuauauuuuggaguuuuaagauuccagagauagaggccaaggagggcagaucacuugagcucaggaguucaagaccagccuggccaacauggcaaaaccucacuucuaccaaaaauacaaaaauuaucuggaugugguggugugugccuguagucccagcuguucgggaggcugagguaggagaaucgcuugaaaccuggagguggagguugcagugagcuaagguugugucacugcacuccagccugggcaacaagagcgaaacuccgucucaaaaaaagaaaaaaaaaaaaaaaggauuccagagaugaagcagguaagacaauuaggagcucuaaaguugauguauuggguugcauaugggaaugaugaugaaguccacagagauuauggaguguacuguagcagagagggagacuguauucuaggaguggcaggaagguccagaaguaacagcaguaaggauguuuuaaacaaauaauaguaaaaguggcaacuacuucucaccuccucugauguaguauuuauuacagcuauagacaaaauaggaagaaacuuuguacuucauuuuagaauuuugucuugugauaaaguuuuuacccuaacauuuugucaugaagauuuuucaauacacagaaaagucuaaagaauuguacaguaaacacucguauacccaucacccagauuuuauaauuaacauuuuauuacaauuuuauuauguuugcucuauggcaugccuauccaucccuucauccuugaauccaucuuauuauuauuauuuuuuuuugagauggagucuugcucugucucccaggcuggagugcaguggcacaaucucgucucacuguaaccuccgccuccuggguucaagugauucuccugccucagccucccgauuagcugggauuacaggcaugugccaccacaccuggauaauuuuuguauuuuuauuacagacaggguuucgccauguuggccaggcuggucucaaacucuugaccucaggugauccaccugccucgcccucccaaagugggauuacaggcaugagccaccaugccuggcccauuuuuguauuuuuaauagagaugggguuucuccauguuggccaggcuggucuugaauuccugaccugaagugaucuacccgcuucagccucccaaagugcugggguuauaggugugagccucugugcccagccaggaguuuuuaauacugauggagucaaauauauguuuuuuucuuuuaagguuauugcucucuuauaucuaagaacccuuugccgauauuuuccuaauguugucuuuuaaaagcuuuauacuuguagcuuucauagacucugugguccauuucaaguuaauuguuguguugugauacaagguaggaauugaaauacauuuauuuuuaaugcugauaucuaguuauuucagaacuauccguugaagaaacccucuucuuuuuuuuuuuuuuauugcuccuugcagagcagggcugugccauaggcaguaugccuagaguaguagccuguugaagagauuuucuuuucucuauuggauuguguugauauuuuuaugaaaauuacaugauucguguguauguauauaugcagucaguccucugcaucugugcauucaaacaacuguggaucaaaaguaucugcgggaggaggauggggggaaauugcaucuauacuaaauuuguacagauuuuuuuggucauuacuccuuaaacaauacaguacaacuauuuacauaguauuaguuauuauuaguaaucuggagaugauuuaagguaugugggaggaugugcacagguuguaugcaaaugcuacaccauuuccuguaggauuacugagcaucugcagauucugguaucugagggagguccuggaaccaaucccccauggauaccgagggaugacuauauacauacaugcacauacacacacacacacacacacacacacacacacacacacacgcacacacacacaacuguaucuguaucucugucaguuuauuucuaggcucuccauucuccauuuaucuaauuguugauuucucuacuuauaguaaguuuugacguuagguaguguaauacuccaauuuuguucuuuuaaaagcuauguuuuaguauuucuagaucuuuuugaauguuaaucuuucauugcuguguuaaugaaccauggcagauaguauuuuauugaguuccugcuaugugccaguauccuaggcaauauuguguacaugcuuaucucuguuguacccauugacuuuugaaagugguaaugucccaguuguacagcugaggaaauagauuuuaugaggacaaacugcacaagauguuaugacuaguaaggaguagaaucaggauuugaaccuaagucagaauagcuucaaagacaacucuuuauauuccaguguguugccuuuuuugaguaggaaguauaaugcaguacgauggugcucuaauuguccugaaccuuagcuuuuuaaggaagaaguaucucaggagagggggaggcugaauggacagggcuuugaaauccccuacuuuaagcugaggagcucagcccuuuuacauauuggggcuuugcauagaauuucauuuggaaaaaaaggguucuguugcauuaaaaaagguagaauuuuaaaagaugcugguuaauggaaagauagcacagaccauaaaggaacuggcugagauuaauggucuuuagguggcaaugagaagcuaggagacuguccuuguaugcuuauguuuggaagugauggaagugacauuuaauuuauuuuauuucauuuuauuauuuuauuuuuucgagacaaguucucgcucugucauccaggcuggagugcaguagugcgaucauggcuuacugcagccccaacuuccugggguccagcaauccucccaccuuagccuucugaguagguaggacagcagacacaugccaccacacccagcuaauuuuuguauuuuugguagagacgggguuucaccauguugccuaggcuggucuugaacuccugagcucaagcaguucaccugcgucagucucccagugugccgggauuacauaugugagccacugcacccagcccauauaauuuuuuuuuuuuuuaaagacaccaggucuuacucugucaccgaggcuggggugcaguggcauaaucauagcucacuguaaccuugaaccucuaggcucaagcaauuuuugcaccucagccucccagguagcuaggacuacagguguguaccaccacuccuggcuaauuuuuaaaaauuuuuuuuguagagacagggucucacuguguuacucaggcugguuucacacuccuggccucaagugauccuccugccuuggccucccaaagcacugggauuacaggagugagccacugugccuggccagaagugacuuuuuaaauggaagugggaccauaaaugggugaaugaaugaaugaaugagugaauggaaaugagaguuagccaguuaaggauuaggaggaaauaaauuccaaggauuugugguagcuuggaggccaagaggaacucagcauuuuuggaguucugaguagcugaagucuggagugggggccagaucgugugaaucaaauuauugcauuuuaucuugucagcaguggggagcaacugcaggguuuuaagcagggaacugacacacaugaauuuugaaggacugcuguagacuguauggagcauggauuaaaugggaacugaacuguaggcaggaaagccaguugaggagauuuugcaguaguucauggaagggaugauagguggcuuugauuagagcaguagcuguggggauggagaaaaguggacaaauuaauuagagagauuuagaggcagauuggugauugaauugagcagggcagugagaggauucccagguuucugacugaggugucuaaguggggauggugaugaaagggggaauauugggagaggaucacguuuggagggagacuaaggcaccaucaguauucuagagauuagagggcugugagagaauugugauaggagggauuuacucuuuggcagauauccaagcguggaaggccuguuugauggacuguccuugauaaucacaggcagguauagccucaaggcuuugaggauggcucuaaaguacauuucaaacaccaccuccuccacaaagccuuucuacuacaacuccauccccugaguagagugaaucucuucauauucuuaguaccuacagaauuuuggaauagucauguuuaguauauuuuguuuuagcaaauagggaagcaaauacuauauuuuagaaauaguuaauguaaaauggcuagguuuuuuuuuuuuuuuuuucuuuuuagugugaugcuucaaggggagccuuugucauuguauuaguccaggaccucuuagaagcagaugccaagaugggauuaagcacauaagaaauuuguuaggugaaaugcuugugaggggggaaaaggaaggagacagggagaguugucagacugaugaaagucugacuccaaguuaaaagagagguaaggaaggaaggaacuuugagugaaagugucuuagacuguagugcaauacuaaggaaaguuugcaaggccucagaaagucuuugagugaaaggugccuguuggaaaaaugaugugucucccgggaacaggccugccaugcucagucagugacugggaggagcuagugagaaacuggccucgacacaaacacagugauggauuugagugcagcugcugcagcacucagucuauuauccuuccuguagucagagaucugagaggcucguucucaugaucaauuagggucaucucuggcuaugaauugccuaauucgggauaaaguacaguuuuuccccauuucagguggguaauuuguucccaaaaaaccccuguauuuaaaagaaaaaaaaaaggaugccuuaaggugaauucuuaaaagucagaaauuaauuuucauugaaauuaaugguacacaauuuacuucaguagcuaaucauauaaacuuugcauucauauucaauguuuauguaauuaaauacuuaauaugcaaaaccacaaacagaacaguaagacaaaagaaaacaauucaaguaacaccccaaauuuuuacucuaugaacuggugaaccaggaguacuugaggcaaaccagcaguaaguucgugaauaguccaaccauguggccacgaagaugacuccuuguugguuuuccuugcuagucugggcuaccucacaggcagaaaggcgcaaaccagugaaugaaauuccucagaaugucaaauucugguaacuuccuguuggaguugggaguggagauauacaugggaaaauaaguaauuuaaagauuugguuuuauggacccugaauuacucagauguuuuguuuuuuuuuuuguuuuuuuuuuugagacggagucucgcucugucgcccaggcuggagugcaguggcgggaucucggcucacugcaagcuccgccucccggguucacgccauucuccugccucagccucccaaguagcugggacgacaggcgcccgccacuacgcccggcuaauuuuuuuguauuuuuaguagagacgggguuucaccguuuuagccgggauggucucgaucuccugaccucgugauccgcccgccucggccucccaaagugcugggauuacaggcgugagccaccgcgcccggccacucagauguuauuuaagaaaguuuuuuuuuuaaaacuguaacaggaagauuacuugaggaaccuuuaaugcuacuuuaaugcuucaugcugauuuguguguguguguguguguguguguguguacaguagcacagucucagcucacugcagccuccaccuucuaggcucaagugaaccucccacaucagccuccgaaguagcugggaccacaggcacguaccaccaugcgcggcuaauuuuuuuguauuuuuuguuagagacaggguuuuaccauguugcccaggcuggucucaaacucuugagcucaggagauucacccgccugggccucccaaauugcuaggauuacaggugugagcuaucacgccuggacugauuuuuacuguuuugauuuuucuuuuucuuuuugagacagagucucacccugucgcccaggcugaagugcaauggugcgaucucggcucacugcaaccucugcacccagaguucuagugacucuccuaccucagccuccccaguagcugggauuacaggugccugccacuacacccagcuauuuuuuuuuguauuuuuaguagagacaggguuucgcauguuggccaggcaggucuugaacuccugauuucaggucaucuacccaccucggccucccaaagugcuaggauuacaguugugagccagcaggccuggccacugguuugauuuuauuuaccaaauuaguugagcacuauuuguauggcaagcauggauauaaaauuuaaaaauaaaacauaauuguugcuuuuaugaaacuuauaugugguguucaaaaaaaaucuguaaucuguccauaugaguuaagcagcccaacuguaaauaugaucaauccuaguauguagaaaguaguuuggcagccagccuuggugccucacagcuguaaucccagcacuuuaggaugcuguaccagcuugaggccaggaguuugagacagccugggcaacauggugagaccccaucucuauuuaaaaaaaaaaaaaauaguucaggauuuaaaaaaaaaugaaaaacaagucuugacagaauuuaaguuguuuuuaauugauacaaacuuuuuguaguaagcuaacuuaaauuucaguuguucuuuuuuaaugccugaaacaauuauuuucuguguacggcucaguaauuuguaauggaaugcacuuacugauaauuaauucauagauguuuuguuuaagagcuuugcuagggcugauuucuauagaacauuuaauaacuuuuucuuugauuuuuuuuauuguggugaaauauauuuauacaacauuaaauuugccauuuuaaccacuugaaauguacaauugaaggccauuaauuacauucacaauguugugcaacgauuacuaccaucuauucuuucccaaucccuaguaacuucuaaucuacuuucugucucuaccaauuuaccucuucuagauauuuaauguaaguggaauaauaaaauauuuguauuuuugugucugacuacuuucauuuaguauaauauuuucaagguucaucuguguugcaguauguaccagaauuucauuccuuuuuaaugcucaguaauacucuauucagguggacauuuugcaccuuuuggcuaaacuggauacugcagugaacauuggcauacaauuauugguuuaagucccuauuugcaauucaucuggguauguuccuuggaauggaauugcuggguuguuuuuguaauucgcugugguuagcuucuucaggaacugccauauuguuuuucacagaaccugcaauauuuuacauuccuaccagcaauguacacaugucaauuucucuaccuccuugcccacacuugcuauuuucuuucuuuucuuaucccaucuuaguugguguccuuuugguuuguauuucucuaaccaguaaugauauuaagcaucuuuucaugugcuuauuggccauuuguaugucuuuauagaaaugucuauucaaauucauugccccuuuuuaaauuaguuauuuauuuauuuauuugagaugaagucuugcuguugucccccaggcuggagugugauggugugaucuaggcucacugcaaccucugccuccuggguucaagcaauucuccugccucggccccaugaguagcugggauuacaggcaccuaccaccaugccuggcuaauuuuuagguuuuuaauagagacgggguuucaccauguuggccaggcuggucuagaacuccugaccucaggugauccacccccgccucggcuuuccaaagugcugggauuacaggcgugagccacugcgccuggaccauugcccauuuuuuaauuugguuguuuguguuuuugauguugaguuuuaggagauccuuauuauauauucuugauauuagaccuuuauccaauauaugauuugcaaauauuuucucucauuuaaacccaaucaaaaguuuaucuuuuuaguuucuugauaauguccucugaugaacgaaaguuuuuaauuuugacgaagucagauuuaucuguuuuuucuuucauugucuugugcuuuuugugucagaucuuaagaauucauugccaaauccaaggucaugaggauuugccccuauguuuucuucuaagagauuuaugguuuuagcucuuauauuuaggucauugauauauuuucaguuaauuuuuguguuugguaugaguuaggaguccaacgucauucuuuugcuuguggaaauccaguugucccagcaccauuuguugagcagggucuuauuucuccauugaauggacuuggcacaaaucaguuggucauagauguaucaguuuauuuugguaugcucaguuuuaugcuguuggucuauaugucuaugcuuuuucaguaccauauuauuuugauuacuguagcauuguaguaaguucugaagucagaaagugugaguguuccaacuuuuuuuuuucuugauuguuuuggcuuuucagugucccuugcagcucugugaauuugagggucagcauuuccguuucugcaagaaaagauuuuggaauuuugauagagauugcaucgaaucuguacauugcucuagguaguauugaugucaacaauauuaagucuuccuacucaauaacucagaauggcuuuuaauuuauuuugguuauuuuaaauuuucugcagcagcguauuguaguuuucaggguaaaacucaccuccuugguuaaaucucuuucuagguacucuuuuagauguuauuguucuuuucaauguuaaauggaauugcauuccuaauuucuuuuucagauuauucauugcauaugcauagaaacacaacuacuuaaauuuuuuuuuuaaguuauuuauuuuuuugagacagggucucgcccugucacccagacuggagugcaguggcgugaucacagcuaacuguagccucaacuuccugggcuccagcaaucuucccaucucagccuccugaguaguugggacuacaggugcaugccaccacaccacacaucacacuggcuaauuuuuguauuuuugguaagacaggguuuugccuuguuggccaggauggucuugaacuccucugcucaagugauccaccagccucagccucccaaagugcugggauuaugggcgugagcuaccaugcccggccgcaccagucuuucuuuuccagaaucuauauaaccugaucuucuggacuucaaaauccuuguuguuuccccucaccuauaacccuuuuaaaacgaagcggaauucuucuuuuuuuuuuuuuuuuuuuuuuuuugagauggagucuugcucuguugcccaggcuggagugcaguaguaugaucacggcucucuacagccuuggccuccuggguuuuagugauccuccuaccucaaccuagucuagcugaguagcuaggacuacaaguguguaccaccacacccaccuaauuuuuuuuccccuuugguaaagaugaacucucauuauguugcccacacuggucuugaacucguaggcucaagcuauccuccugccuuagccucccaaagugcuggguuuacagguaugagcuaccacaccgggacaaaguggcacuuuuuuuuuuuuuuuuuuuuuuuuuugagacagagucucgcacugucacccgggcuggaaugcaauggcaugaucucagcucacugcaaccucugccucccagguucaagugauucuccugccucagccucccgaguagcugggauuauggggccugccaccacgccuggcuaauuuuugcauuuuuaguagagaugggguuucuccauguuggucaggcuggucucgaacuccugaccuagugauccgcccaccucagccucccaaagugcugggauuacaggcaugagccacugagccuggccuaaaguaguacuuuuuaauuaaaaaaagaaucaaaaugaaacucaauacauaggcaggucauaaaaaaugauuuuuucuuuugcucaagcagugaguagcauuaagcuguucccucaccuucaccugguguuaccuggaguacauuugggaaguccucaacuuugaaaacccuuuuucccuauauacugcugguaauuaaaagcaaaaaauuauucugaaguuugucaagcauuuuauggaggagacauugcuaguuuguuuucuguuuuuuuuuaaguauauuuuaaacauuuccuuauacuccuaauauaaauguugcuuugucagaaauuucaacauuuggaacaaaauuuuuauaguuucuaaauaaauauaauucaaaccagguauaguuaggaugggugccuauaaugcugucaggauacauauaaugcuaugcauaaaguuuauuucuguaucaucuaguuguucaacaguugaucuaggcauaauaaugaaacuacuuuugcaguuugauauaguuuggauauuugaccccuccaaauuucauguugaaauuuguccaccuccaaucucacgucucaguguuagacagugggggccuggugggaaguguucggggucauggggcaggucccucaugaauggguugguaccauccuugucccagagguaaugugugaauuccugcucuauucguucaugugagaauugguuguucagaagagugugacacacuuccccucucucuugccaugugacacauuugcucccccuuuggcucugccaugauuggaaaccuccugagguccuuaccagaagcagaugcuagcggcacgcuucuuguacagccugcagaacuguuagccaaguaaaacucuuuacuuuauaaauuacccagccucagguauuucuuuauagcaaugcaaauagacuaaaagacaguuaaacacauuuuuguuuuuguuuuucuccaugucuccuugcuguauuuuauuauuuuuuugagacaaggucucacucuguugcccaagcuggagugcaguggugcagucucggcucacugcaaccucccccuccugggcuuaagugauccucccuccucagccucucaaguagcuaggacuaaagguguguaccaccacacccagcuauuuuucuuuaaauuuuuuguagagacagggucucacuguguugccuaggcuggucuugaacucuuagucucaaggaauccuccugccuuggcuucccaaacugcuuggaucacagguaugagucaccacgccuggccugcucuuuuguuucuauauguuagacuuuuugcagauuuccauauauaagcgaugucaucaguauuuucuuucagugucuggcuuauuuuacugaguguaauguccucuggguuuauuauccguguaguugcaaauggcaguaucucauuuuuuaaggcugaaugauauuccauuguguguaucuguguguaucacaauuucuuuuuucauucaucugucaguugacacauuguuuccauaacuuggcuauugugacuaauacugcaaugaacacaguagcacagauaucucuaccaggugcugauuucauuuccuuugaguacauacccagcuaggucauaugguaguucuauuuuuaaguuuuugaggaaccuccauuacuguuuuccauaauggcugugccaauuuauauucccauccacagucuacaaggguuuccuuuucuccacacccucaccaacacuuguuaucucuuaccaaaagagucauucuaacaggugugagaugauaucucauugugguuuugauuugcauuucucugaugauuaaugauguugaguaccuuuucauauaccuguuugucauuaguaugucuucuucagaaaaaaacagucuuggccgggcacaguggcucaugccuguaaucccagcacuuugggagggcgaggcagguggaucacuugaggucaggaguuugagaccagccuggccaaaauggggaaaccccaucucuacuaaaaauuagcagggcccguaaucccggcuacuccagaggcugaggcaggagcaucacuugaacuggggagguggagguugcagugagucgagaucgugccacuucacuccagccugggcacagagugagacucugucuccaaaacaauaaaaaaagauauaugguuuguaaacauuuucucccagucuguagggugccuuuugauuguguugauuguuuccuuugcugugcagaagcuuuuuaguuugauguaguccaaguuguuuauuuuugcuuuuguugccugggcuuuugguaugccauccaaaaaaauaucaaggaacuaguauuaaccuauacaauucaguaguuuuuaguauauuuacagagcugugcaacuauugcacaaucaauuauaaaucauuuucaucaccucagaaagaacuccauacccuuuagccaucauccuccaaaccuccagccccagguaaccauuaaucuauuuucugucuuuauggauuugucuguucuggacauuucauauaaauggacucauaauauguagucuuucaugacugccuuuuuucacuuagcaaaauguuuucaagguucauccauauuuuagcauguaucaguacuucauuucuacgacuaaauaguauuguguugcauugauguauacuacauuuugcuuauacauucaucaauagaugaacauuuggguuguuucuaccuauuggcuauuaagaauagcugcauauuuucauucccacuagcaguguggaaggcuuucaguuucuauauuuucaccaacacuugucuuuuuuauucuagccaucuuaguggauaugaggugauaucucauugugguuuucauuuguauuacccuaauaacugaugaugaacauuuuuucaugugcauauugaacauuuguagaucuuguuugaagaaauaucuguucagauccuuugcccauuuuaaaauuggguugucuuuuuacuguugaguuguaagaauauuuuuuuuuugagguguggucucgcuuuguugcccuggcuggagugcaguggcacaaucuuggcucacugcaaccuccaccuuccggguucaggcaauucuccugccucagccuccugaguagcugggaccacaggcgccugccaccacaccuggguaauuuuuuguauuuuuaguagagaugggguuucaccguauuagacaggauggccuugaucuccuaacuucgugaucugccugccucggccucccaaagugcugggauuacaggcgugagccaccgcacccggccaaauuuuuuauauauucugaauguaaguuccuuaucaaauauaugaaucgcaaguauuuuuucccauuaugugaagugaagucuucuuauagauauaguauugugauuaauaacaaauaguuaauuuaggagaguagaguacaagcuguagcagugggaguuuugucagcacacgcuuuuagaagguuucuuccacuguaugaccguguauugaugaaaggaaugugccugaaacuguaaccaaaggagacaugcuuccagaaaaaucucaaggaaaaguauuguaagcaacaguagauguuggaucagacucuaaaguaaaggguggagaguuaaccaguuaacauguaaguuggagauagaguucucccagaauauguaggcaccaaaguaguucuagacaacaaggauuacuucucauuuaaagauggugacauucuugcaaacuauauagacugaaauaaaucauauugaaauggcaucaacaugaagcugcccauucuguaauucugaaaucuucuaucauguaaaauaauuuucaugucuuucuuuuguaauaaacuaaugauaucuaaacuaaugaugcccaguguuucuaaaauuuaguuuugcuguauugauauaaacauuuccuaauaaaaauauguaaauuuaaaaauaguuaauuuaaagcuuauauagauuccaagaaauaauaauguucagcacuuaaacuguuuuaaucaaggguuaagaauuaacuucacugggcaaaguggcucacaccuguaaucccagcacuuugggaggccaaggcacguggauugcuugagcucaggaguucaagacaugccugggcaacauggugaaacuccaucccuaccaaaaaugcaaaaaauuagcugggcaugauggugcaugccuguaaucccagcuacuggggaggcugggaugggagaaucacuugagcccaagccugggaggcagagguugcaaugagcugagauggcgcugcuguacuccagccugggugacagagcgagaccccaucucaauaaaaaaaaaaaaagaaaaaaaagaggucuugugcuuuagaucagugguugccaaacuuuaucaagcaucagaaucacuuggacagcuuguuaaaacauucuuugcuagccugcauucccagaguuucugaaucagaaagucuugaguggggcauccaggaauuuacauuuuuaacagaacauguugaugcuuugguucauggaccgcuuccuuaauggucccuauaacugucauaaagaauuagcuauaugcugauauguaggaaauucuaccugauaaaaaugacaaaauuuuaauuuauagcucauauuugcaucucuucaauuugcauauauuuguauauauaaaguguuauauagucaugguuggugccuaaauuguuggauuucuuuuaaaacucuugccauacauaaagucuacuuuuuuccguaggcuugucuccugucagauccucaugaauuuccuugaguuuaagaaaauaguaaagaauguuacagcuuaaagagauuuuauagaucauccaacucuucccaucccucauagagauugguuaaaucucuuaauccaagauuguguagcuaauuauugguagguauagguagcucuuagggauuuuauuucuggcaauucuuuauauugcuugaagaaaaguaaauauguauuucagccaagauuuuuuuuuuuuuugagauggagucucgcucuguugcccaggcuguagugcaguggcgcgaucucggcucacugcaagcuccaccuccuggguuuacaccauucuccugucucagccucccgaguagcugggacuacaggcgcccgccaccacauccggcuaauuuuuuuguauuuuuaguagagacgggguuucaccauguuagccaagauggucucgaucuccugaccucgugauccgccugccuuggccucccaaagugcugggauuacaggcguggaccaccgugcccggccagccaagauauuuuuagugacuuucaaauacagaucucuuugguaacauuuuauuagguaauaaauaagcuuaagauauuugaaaugacuugauucugugcuaaaugcuauuugauuauuuuacaccaaaguaauacaugaauauagccugauaaauaauuuuuaaaaaguaugucucauaggcaucucuuuuauucuggucuuaaaacauaugagaaagaagauaguugaagaguaugugcuagugagauggggcacagauuuccaucaauaaacuuauguaaaauugaguagaaugaacagguuguuuccuagagaugucuuaaaccuauuagaaaguuuagagggaaugaugaggaagggauauguaauguaaaaauauaaggcuauccucuuccuucuuuuaaaaacuuuaucucuagccaagucugcuuaaggagaaagucuugcuuuccccugucuagguuauagcuuguagauguucauuuuaauacuuacugaauuauuaaaaucuuuuuuuccuuagcccuucaccuuaguagucaaucaagguuuguuuuucuaaauuagaugaucuguguuguuucuuuuauaggaggaauuuggguagccaaauagcuccacauaaacaucuagcuucucagguaucaacuguaaaaugcauagaaaaugcuauuaaacacuaaaaagagauugaaagcaccguugacugacuugugaaauuauuuccuaauugccuuuggucagcacauaccuagacuucuacacacccaacagucuaucucaaccauucuguaauguugcuaaaauaauuuuccugcuucauuguuaaaacucuaaugauuccucucuguccucuuugcacauggcucuauccuauauaaauuucagaauauguggaacugaaauaauuuuuaucucagaagcaaguacuccuauuaaggcuugguguguuuucaucauuuuaauuuugacuagaauagagaacucauuagaguaggaaacgcacuucugccccagauucaggagaaugaggacuuauuucagugucucaaacacaaacuuucgaauguagccugcagaacucugguacuuaugagccacauuuugccuggcuguuaguucucuugauaaccuaggaaauaugccuuaccuuagcuuuuccuaacugaaucucucuucucugcacuaagacuuuuccccuagcuuaaucauagugugucuuccuacaggaagccuuuucagguugaccuguacccaucuaccaguccucaaguaguuucucaaacuggagucucuagauauucucaggagucugagaauucucugagauauaaacaguuuugugguucucuguguagaugcaaacaccauacaucuggugucuacuggaggguggaguugaaaaugaucauugugaaacaaugccagaaucuuucugaaacuuuugcaagcagcaaauuugaacagcugguuuguaacugagguuuuuaaacuucauucagucuaacuguaugaagugccuuacguggcuguuaugguagcugagaggaaggaugaacuggagacugaggacaccacccccauuuuaaccugguuggcccuacuuuuauuuguauuauauauuguggcucagugaagauuucucuugggagcuucucuccaucuaaaaguuuugaaaaccacuggacuaacagguuuauggcuugugguuuugguaggggaauagggaaaaguagcaauguauccuuauaaagaggcuguauguggcuaaguuauuuguaaauagauuuuucauaguuaaccaaacaaagaguccuuagaaauuuuuacugcuaauugggaauguuauuccaggguuaucuuagauugguagauaguaguucucaaguuuuucggucucagaacccccucacagucuuuauuuauuuauuuauuuauuuauuuauuugagaccgagucuugcucugucguccaggcuggagugcagugguacagucucggcucacugcagccugcgccucccagccucccggguucaagcaguucucugccucagccuccugaguagcugggauuacaggcucucgccaccacaccuggcuaauuuuuguauauuuaguagagacgggguuucaccaucuuggucaggcuggucuugaacuccugaccucgugauccaccugccucggccucccaaagagcugggauuacaggcgugagcuacugcacccggcccccuucacacucuuaaaaaauuaucgaggcuccccaaaaguacuguuuguaugcauuauacccaucaauuuuuaaauaaaagaaaaaauuucaauaauuacugauuuauuuaaaaauaaugaacccauuacauuuuaacaacaguaacauuuuuaauauuaagauaacuguuuuccaagaaagaaaaaagaaaaagagaaaacuguuuuccaaaacaaacaaaaaaaaaauuagcagagaguggcauuguuuaguauuuuuugcaaaucucuuaauaguacgaucuggauucucauuuucuguuucuacauucaaccgguuugugauaugcuguuuuaguugaaauauaugaagaaaaacucagccuccuacauucaauauuugaagagaguuaagguauguaacagcuuuuucagauauuaucaauacuguauuuuucuuuaaugucaaaccccacaagugguaguuucuuuuagguuaauugcaacauggaaucugaaacuauagcaaugaacuuuugguuccuuccaguaaaaguagcaauguauccuuuuaaagagacuggaaaggccuuccauuuggcuuuccaugauugccacuccaucacauucaaaagucaaagucguuaagugaucuggccuccuacuaucucucugaucucaucuccagcucugcuggcucugcugacucugcuguagucacacuggucuccuugcuguuugcuccucuaaacaaucucgugucucugggcuucugugcuugucauucccucucauuucuuaacaaauagauuagauauuguguuaaauaaucuuaauuuagugaagaccuaccagaauauauuuguugagugugaaaauuaucucugaacagaacugcuuauauacuuggcaauggcauuguaaucagaaagacucaacaccuuuaugucggacucugacccucuuaugucuugguggaagugaaaguguaagugguaccaagucauuuggauugccaguacuuugcuauagaguacacaaaugugccucauugcaauaacacuagaaguuguuuacuacuguaguuuacuaagaacuaaccacauagaugaucaugcauuucaggaaaauaugauagaaauaggaaagauucuaacccaggucuuaauuauucacauacggaagaauggccuguauaucuucauuauauguguaggggaaaauagugccuaucuuucaagaucauuggaagguuagagauccuuuuguuaaaucauguuaguuuaaaaaaugcauuuauuuaaaaaaguauuucuguaguauuaauaacugauuuuuugacaucuuuguauaugcuuaacguggcuuuuuaagagucacaguuuaccaaagaaguaauauugccucauuaaauuucugaaguuaacauuguagcacuuugauauuuagaaguaaauuaucauuuucauuuuaaacuuuuaauuugggaauuuaaguauuaugaaguuuuucucaaaugccuaguuuggagagacuauuuuuacaacuaauuuagagcuuucaaguggauuuaaauuugucuugcuuugaagauauuuuauuucauaucacgcuuucagauuucuuuuaguuuuguaaaauuucaaguugcuuuuucuugaauuauaaauuuauuuaguguguuuugguuuuuaaucauuucauuuauucauucaacccaccaacagaaaugccaagcaguguucuagauaccaggagaaaucgggugaugagacaaagucucuuacauucugguaggagaaagcagacaaauaaacagacaaagaaauacuguaguuuuagauaacaguaaguaaaauaaagaaaauaaaggagguugugauaaguagggucugagaggcaggagagcaggggauacucuuaaaaauaauggucgaggacagccucucugaggaggugacauuugagaagagaccagaauguucagaagcagccaauaaugcaaaaaaucugguggaggagcacccuagaagaggguaguuaguguaagaucuugaagcaagacaagcuuggggugcgcaagaaacaucaagacaagcaguaugugcagugagccaugauccucccacuacacuccagccugagugaaagagugagacccugucuccaaaaagaaaaaagaaaaaaaaccaguaugacuagaguauagcauaugugaagaagagugagaaaaauuacguuuggagacagagacagggaccacuucauguagggcuuuagcacuagugauaguagaacacucaaggauuuuaggcgaaggagugacauaaacuuaaguuaaaaauuuauggucaauuugugaagaaaaacagacuuuugugggcguaauaaugaagcaaagugauuauuuuagaagaaagaggugauggcaguaugaacuaguaguguagguggugagaaaugaucauaauugggcuauguuguguccauuggaguaaaccauuaggagagaauggugacuuggaaguuaaaugaagaaggaguggcaagaaaguggaaguggucaacugucauacugccaagaggucagaugagaugcgggcagggauuuaguccuggccguauuauagaauggcauccccuggugaccaugacagcccuggguggagaagccuggggggcugguauagaaaaggugacuguggagauccuuuugaggaaucugccucugaaaggcaaagaauguggugaacacugggggaugugaggacaaggaaaacuuuuuuuuuuuuuucgaguucuuuuauaugccaauaggagugaucccguuauguuuaaguucauuuuuuuguucaugaaugaggugaggcuuuccugagcuaaaacaguagaaaaaaggaguuggaaaagaguuaaggggcuuauagacgauuauuuauaccuaugggaaaguugaauuuuucauuuggauucacaggugaaacaucaaaaguugaacacgcugcauuauguaauuucauucacuuauucauaguguaguacuugagcugcuuaaguaccaggaacuaggguacaaagguaagacaugcucacuacccucaaggagguaaaaauccagcaaauaaacagauguguacacucucacugcacaaaggacauuccucagaccagcaguguuggucccaccugagagguugauaaaaauaccaaaugcuuggccaggccuaguggcucauaccuguaaucccagcacuuuggcaggccaaggcggguggaucaccugaagucagggguuugagaccagccugaccaauauggugaaaccccgucucuacuaaaaauacaaaaauuagccaggugugguggcgugcaccgguagucccauuuacucgggaggcugaaacaggagaaucgcuugaacccaggagguugagguugcagugagccaaaaucgcaacacugcacuccagcuugggugacagaaugagacucuguuucaaaaaacaaacaaacaaaacaacaacaacaaaaaauguucuacccaagaacuacugaauuggaagcuguauuuuuuacaaaauugcuaggugauuuaaguuugaaaagcacugauauacauaaacuauacauuaaaaagaugugauaagcacuaaaguuuuuguuuguuuguuuguuuguuuguuuguuuugagauagaggcucguucugucgcucaggcuggagugcaauggcgcgaucugggcucaaugcaaccuccaccucccagguucaagcaauucuccugccucagccugucuaguagcugggauuacaggcgccugccaccaugccuggcuaauuuuuguauuuuuaauagagaugggguuuugccauguuggccaggccagucucgaauuccugaccucagguaauccgcccaccucggccucacaaagugcugggauuacaggcaugagccaccacaccaggccugcuaaagauucuuacaaacaaaaaauacuguauguaagagcucaguuacuauguuacuaugucaaccagcccccagcccccacaaagaagagaaaugaucauagaggaaaaaguuggaucagacauuucucuggauuggcauauuaaaaggugcuugauaagaguuuguugaacuaaacuagcccuaggcgcuaccauuugaagaugaauuauuugcuauuuaguagucugcauuuaguguuuaugcacagaguguuuuuuuuuuuuuuuuuugagacagggucucacucuguugcccagacuggagcgcagugguguuaucucagcuuaccacaaccucugccucccaggcuuaagugauucucuggccucagccucccaaguagcugggauuacaagcgugugccaccaugccuggcuaauuuuuuuuuuuuuuuuuuguauuuuuaguagagacgggauuucaccauguuguccaggcuggucucgaacuccuaaccucaaaugauccaccuuccucugccuccuaaaguacugggauuacaggugugagccgcugugccuggcccagaguuuuuguaaauagauuauuucaauaaaaagagugagauucagaucucagaaagagaggauaaaugaaagccaagauuacaucaguugauugacuauacuaguaccaugaacaugggaaguguuaggauaugaagauaagugagacagucacugcccucuaguaggagacucaaggacauuuauuuuacuuuuuggguuauaauccaauacuauugcuacuuauuuuguuguguaaauuguugcagcguuggucauugggagcuuuuuuagguuggcuucuuuucuuucuuucuuuuuuuuuuuuuuuuuggagacagagucuuguucuuguugccuaggcuggagugccauggcacaauggcucacugcaaccuccaccucccaggcucaagcaauucucaugcuucagccucccgaguagcugggauuacaggugugugccaccaugccuggcuaauuuuuuguauuuuuaguagagaugggauuucaccauguuggccagucuagucuugaacuccugaccucaaggugaucugcccauguuggccagggauggccaaagugcugagauuacagguaugggccacugugccgggccagguuggcuacuuuugaacacuacuuuaugagucaacuuucuugcucguuucuucccuauuuugagggcugccuaauauugaaucaguguuuuaugaagaauaugaucucuuaacuggccacucugucaguaucacgagagguguuuuguuuuguuuuguaaaggcacacucaucauuagcgaaaugggaaugaaaaccacagugagauaccacuucauaccaauuaggguggcuauuauuuaaaauaaaaaaccaaaaaugaaaaccaaaggacagccauauggauguaaagaaauuggaaacugugcauugcuggugggaaucuaaaaugguauagcuucuguaaaaaacaguauggcaguucaucaaaaaacuaaauauagaauuacuauaugaucuaguaguuccacuucuagcuauugaaagcagggauuugaacagauauuuguacaccaguguuuauaggcagcacuuuucacaauagccaaaagguagaaacuaaccacaugucaguuaccagaugaauagauaaauguaguauauacaugcauguaauagaauacuauucagcccuagaaaggaauagaauucugaugcugcagcaugggcgaaucuugaaaauauuuuacuaagugaaagaagccaaaaauaaaaggacaaauacuauaugauuucacuucugagauaccuagaauaguucaauucauagagacagaaaguagaaugguaguuuccagagccugcagggaggaggaauuggggaguuauuguuuaacaggugcagaguuccaggccaagaugaugaaaaaguucuggagauggauaauggugaugguugcacaacaaugucacugaauuaugcauguagaaaugguuaaaugguaaauuuuguguuguguguauuuuaccacaguugaaaaaaaaagucacuuccuucgcuccaucucaggcauacuaaaguagaauuucuaguggucgggcccagaauccugcauuuaaaaaaaaagaaaaaagcuuuucaguuuauuguuaugcaugguuuaagaaccacugauaggugggauuaucuaauggaaagugggguaaacuggauuuuguugguauuaucuuuaaagagaaauuuauccgauugaugaauuaaaguauaaucuucaucuagauuuuuauguuuaauucagcuguuaauauuuacacauuacuucaugugguaaugugaauaaugacuacuaauaauuauuuagcauucuaccacauuuuaaagcacuuucggcugggugcaguggccugugaucccagcacuuugggaagccgaggcaggaggauuacuugagcccaggaguucaagaccagccugggcaauguggcuaagccccaucucuaaaaaaauuuuaaaaauuagcugggcaugguggcacacaccuguagucccaguuacgcuagaggccgaggugggaggaccucuugauccugggaggagaggggaggcaaagguugcagugaaccaagauugcaccacugcacuccaaccuggguuacagagacucugucucaaaaauaaaauaaaauaaagcacuuucugauaugugaucucauuugaucaucauguuauccucugguggugauaauugccauuuucaggcgagacgcuugagacuuuggagauugaaugaguugccuaagaucauacagauaaagucagauguccaagauagaucugauuacaacuccucuuagcagucuccaagaaaagagcagguguuauucaggccauuguaaauauucuguguuuaauuguuuugugacaaaaauguaaaauuacuaaguuaaucaugaaccauagacuuaagaccacuuuauuauguaaacauggcuguuaucauaugacagcuccacuguucuugccauguuggcagugguuaauauuuacgaaacuaagauacuuuauuuugucuaggaaaguauucuuaugaaguauuacuauguuaauacuuaauaaauacuaauuaauaugauuuaucuggaaaucuaaagcagaucuaugauucuguggcaguuuuucuucccuugcauugaagcggccucuauacccaaccauuugugcauaauacuauaauuuucaaaaacugucaccagaugcaguggaucaugccuauaaucccagcacuuugggaggcugagguggguggaucaccugagguuaggaguuccaagaccagccuggccaaaauggcaaaaccccgucucuacuaaaaauacaaaaauuagccagaugugguggugggcgccuguaaucccagcuacuugggaggcugaggcaggagaauugcuuaaaccggggaggcagagguugcagugagccaagaucaugccacugcacuccagccugggugacagaaugagacuccgucucaaaaaaaaaaagaacaacaacgcaacugugacuauuucccuuuugaagaauguauuugccacaguugagcccaggagucagcagacucccuuccuuuccuagaacauccagccauguuuuaguaaaguagaaagauguggggaaaagccguuucuaguguuccuguuuuacacuaauuuuccucuggccuuccuguuuaccaacauggaauugucggggaagggcauuuuuauuuuauagugauuuaauaucuaaccacuucuuauuuugauaggauagggcauuauaugauaaaaucauuaaaaauguaauucaggcuugcuuaccaauaucuaauauguuaaacugccuauuugcuaauugcaugucugaaagaucucaagcauaauggaguccagaacucuugaucucuuguucccucucccacuuaugaaaacaucugcucaucuuacaguauuccuuauccuaguauaugcaccuguaucuggccagugaucugggcccuaccuaacuccauuucauuuccuuuacucuucccuucacuuguauauagucugcuuccuuugccuagaauguuaucccucucacuucaccaauauacuuuucaccuaaauucugcucacccuucagcuuucaacuuuaaucuuuuccgaaccacuagauuaacuuaggcacccauuuaguagccucuugguauccuguacuuuaacaagaacaucaauaauggcuacagguaacguuuauuaaagauuggcaauauauugguauguaauauuaccagaaggaguaaguaauucgugcaggguuacacucugguaauugaaagaacaaagauuuuaauguaggcaauguagcccacacuuaaccuuuuuacuacucugccucuuacauaguuauacuuuuguuuauuauuauguuuaaauaaauuauuuguuuaaugucuaguuccccuauuguacuucuaagcuccuugaggguggggccugugucucuuauacuaucuguugaaugugugcauauaucauauuugggauauagccuuugcauuacucagaaagucugaaaauugauaaaaauuuguagguggaauucacagaugacauugaccguuuuauugucuacaaaugaugguuucuauaaaugugaagcaaucuguuuaguucaucuaguaaaucaguuuacugugaagugguuguauaucaaggaacgugauucauuuggagaaguuugaauuugaaaaguuuuuuuccuugcuuguuauggcuuugguuuacuaaaaacuagaaucuccugcuuagagguuaugggcaaauuaauuggugaagauaguagaaagacacuuggaucacaguugcuaucuguuggcauuuuaaggaagacugccaaugauagacaguagacacacaucacauguauugugaauugccauuccagcuuaaaaauaccucuuaaaaugugguugaaacuuaaaauaggguaggauaacugcaugugguggcccaugccuggaauaccaauacuuugggaggccaaggcaggaggaucgcuugagcccaggaguuugagaccauccucagcaacauagugagacacccauuucuacaaaaaaaaagaaaaauuagcugagcauggugguguaugccuguagucccagcuucucaggaggcugaggugggagaaucacuugggcccaggaggucaaggcugcagugagcugugaacacgacacugcaguccaaccucaugacagaguaagacccugucucaaaaaaauaaauaaauacaaauaaaaauaggauaggauagaugggaacacuagcagagaaaacacugggaauuugauaaagcgccccaucugugucaggacaucauugauaaagggauacaugccacuuuuggaagauaaagagcauaguugaagaggaacuaaaaaaucaucagagacucuuuucuugagucaguuccuugcuuuauuggugggaacucuguuaucacauaguaauauuuuuaaaaaguuguuuaggaaggucauacuguuuuuaaagcaaaacacaugaaaaaugauaugaauuuagcacuugacacauguuuggaauuugauguguauaguuauuuucugugggaaaggacuuuaaauaugucuuucccauggcuaauauauacacuggcguaaaccacauaccaaugaaaauuuuuaauuaaauuuauauuuuauuuuauauacacauagacauaaauguuauaaaugugcacaaauaugaguaauuuuuaguagagcuuugggggaggaaugauucauucuuucccccuuuuucuucucuucucuucacaucccugccuugcccaggaccauuuauaacccauguugacaacaaagguuauauucuuccauauuuuucuccaugcuguccugcucguguauaaauauauacuuaauuuauaauuacacauacacguguauauauguauaugugguuuuuuugagaauucuauguauuuuacauuuuuuaaugaguuuucucacuuaagaauaccuucuuuuuucacuuaagaauaccucacuuaauagcucuaauauguucuuuuuaauggcuacauauauaguuguauuaguuugcuaggggugccauaauaaguaccacagacuaaguggcuuaaacaacagaaauuaguuuucucauaguuuuggaggcuagaagcccaagaugaagauguugguggguuguuuuuuucugaggucucucuccuuggcuuauagauggcugucuucucccuguuucuucacguggucugucuucuguguucaaauuuucuccucuuauuaaggauaccagucuuggauuggauucaggccuacccuaaugaccucauuuuaacuuaauuaccucuuuaaagacuuuaucucaaaauacauucacauucugaggugcuggggcuuagggcuucauaugaauuuuggagggacacuauucagcccauaacaaucauauuccacaguguauccaaccauucccuuacugguggucauuuacauuauuuuuguuuuuugccaccaugcaauaaaaucuuuguauguauauccuuuuauuuuuacaggauaaauucccaaaaguggauuuucugggcaaaggauauauuuuaauuuugauagugguugccagauuacuuuucaaaaagucuuaucaguuagcauuucuacuuguaagguaugagaauaacuuuuuccaagaacagucuauauugaggaucccucuucccaucuuucuccucccaucuacuccucaacugcuuauaauuuggguuuugcuccagcuacucuauucauauucuucuccaaaggccacuaauuaugugcuauugcuacauuaauuguucuuuuaaaaauauucuguuugcguuuugcaacauuugaagcuccuggagacugguuuuuguauauuacuucuccugacuuccuuaagaauauacccuaaccaccauuuccugauucuuuugccucaucuucaucugcuugcugcuuggauguaggugcuucacuagauuccauucugcuuuaaauugcuccuguccaccuuggacugggagauuuuuaucuacuuguacuauuucuauuaccugugugaaaguuaaucauccgaauugggucauuuuugucauacccaacuaaaucaguagaggggccaaggggaaaaagcauucagggucuguaacauugcucuagaaauguaauucucugcaaguccagcagcuagaacugccuauuuauauaaacaaaaaccaauuuuaucuacgucugcugagauaacuugcuacaacucugggacuaauuuugcucaccaacuggaguuugccagcuccccaaagccuuacuaauaccgauaaacuuucuaucaagaccacauauaacauuuccucuucuuuauaaaacccccaaccauaucuuuguuguuuggacauacugaagaccacccagucuacguguaugccccaaaguacaauucuuucuucccaaauaaaacguuaaauuuagagguuugcaucuacauuuuuauuuugaccuugacaccuguaggugauugguugaauuccagauccauguuuucggccuuaagcucucuuuuuuaaaaaaauuaaaauaaaaguaauggaacgcuucacaaauauacaugucauccuugcgcaggagccauccucaucucuguaucguuucguuuucaguauacgugcugccaaagcgagcacuaagcucuuuuuugagccucagaccuagcuagauuucaaccuguacucuaauaaauuuaaaguaaaauuuaccguaagauaccucugggguuuuucucuguuucucuuuauucuuucauuaacauagauccaguuuuuugguuuuuuuugccagaaauguagaggaaaaggaaaagaugcaguaccacaaagcuaacaauagagcaagugauguaaguucugugaggacuggaacuuugucuuauucugcuuuucccagaugccuacuauacugcuuagcauaugugaacccaucuaaaaacaaaauccaccaaaaaacucuuaugaauuaaauauuaauaauuaacuauuuacuauuuccaauuagucuuaaagauugaacaggcaaguuuuguagcggggauguggggauggcuacuggguacaaaaaguaauuagaaugaauaagaccuaguauuugauagcacaacagggugacuagucaguaauaauuuaauuguacauuuuuaaauaacugaaaguauaauuggauuguuuguaacacaaaggguaaaugcuugagggaauggauaccccauuuaccaugacauaacuauuaugcauuacauaucuguaucaaguaucuuauguaccccauaaauauaugcaccuauguacccacaaaauuuuuuuuaaaaauugguuuuaccaaaaaagguugaauaagcaaguuuuuauaaaaauauuuaccaauauuuauuaauuuaauaacuaugaacauucuuuuuuuuuuugagacagagucuugcucuguuggccaggcuggagugcacugaugcuaauugcaaccucugccuccuggguucaagugauucuccugccucagccuuccaaguagcugggauuacaggcgcccgccgccaagccuggcuaauuuuuguauuuuuaguagagacggcguuucgccauguuggccaggcuggucucgaacucuuaaccuuagguaaucugccugccuuggccucccaaagugccgggauuacaggcguaagcuaccgugcuuggcaaauuuccuuuaucuuuuuuuuaccgaggacagucucacucuguugcccaagguagaaugcaguggcgcgaucucggcucacugcaaccuccgccuccaggguucaagugauucuccugccucagccuccccagaagcuggcauuacagcugcacauugccauggccggcuaauuuuuguauuuuuauuagagacgggguuucaccauguuggccaggcuggucucgaacuccugaccuccagugauccgccagcccacgcuucucacagugcugggauuacaggccugaaccaccacacccagccacuaugaacauucuuuacuaauaaauaaacacuaucuugcauuacagcuacaaaaauuauuuuuuguucuuguuuuugagacagggucuccagccacuccaggcuggagugcaguggcaaaaucauggaucacugcagcuuugaacuccuggggucagcuuccugaguagcugggaccacccaaacccagcuaauuuuuuuauuauuuuuuuuuuggagagacaaggucucacuuuguugcccaggcaggucuugaacuccuaggcucaagcaauacaccugccucagccuuccaaagugcugguauuauaggcaugagccacuguuccuggccuuacaaaaauuauuuuguagguuguauuuuagcuagccuaucacaauucuuccaaguuuuuaaaugguuucuguugcuuauaaaauauuauuuauugauagccaacaaauucuaauuuggguauugcuaggcuaucagugcaaaaaaaaaaauugcaguuaaaaacuuguaaaaucucauaugccuaaauaccaggaccgcguuuauaguuguaucaauuuauuuguuuuucucaauacucagcauccaaauuaaaaauaggaguauuuuuguuuacuuuaaaaagugauauacuguuuauguuuuguaacauucauugaagaaaauacuuaagacuuucaaaacuagaaaaauauuauuuuaauuucuuaaagcuuugaaauauacauugaaaagaguacauauaaccucaguuuaaauguucaguuuaaaucagggguccccaacccccaggcuacagacugauacugguccauggccuguuaggaaccaggccgcacagcaggaggugagcagugggugagugagcaaagcuucaucuguauuuacagccacucaccaucauucgcauuaccgccaaaacuccgccucuuuucagaucaguggaggcaucagauucucaggagccuguugugaacugugcaugugaggcaucuagguugcguacuccuuaugagaaucuaaugccugaugaucugucacugucucccauucccccccauaugggaccaucuaguugcagaaaaacaagcacagggcucccauugauuguacauuauggugaguuguauaauuauuuuauuauauauuacaauguaauaauagaaauaaaguaaacaauaaauguaaugcacuugaaucaucccgaaaccauccuccccacccgagucuguggaaaaguugucuugccuagaacugguccuggugccaaaaagguuggggaccacugacuuuaggcaugcuuccccacccaccuccuccuagucuguggaaaaauugucuuccacaaaaccagucccucaugccaagaagguuggagacugcugguuuaaauaauaaugaaaugaacauguauguaccuaacauacagguuaaaaaaugaaguauuucuggccaggcacaguggcucaugccuguaaucccagcacuuugggaggccaaggugggcagaucacgaggucaggaguuugagaccagccugaccaacauggugaaacucugucucuacuaaaaauacaaaaauuagccgggcaugguggcacgugccuguaaucccagcuacugaggaggcugaggcaggagaauugcuugaacccaggagguggagguugcagugagccgagaucacacuacuacacuccaaccugggcgacagagcgagacuccgucucaaaaaaaaaaaaaaaaaaaaaaaaauucgaacacuuuuaaaggcuucuuugguuuccuuacugauuacaucuucuuucccuuccccuggagguaauagcugaguuuuagauuaaucaacuacuuaaauuacuuuauaguuuugucauuaaguauaaauuaauaaacaaugaacauaguuugguuuugcuuuuuuaugaacuugauauaaauggaucguauuguuucuauuguucuguaacuuauauuuuugccccauuuuauguuuuggagauuucauuuauguuauuguguaacuuuuaggucauucauuugugcugguaaguaauauucauuuucuaaaucuacugcaauguauuguuaacauuuuugugcuuguucaucuguugugcacauauaagaguucuauaauguagcaguccucaacuuuuuuuuuuuuuuuuuuuuuuuuugggagacagagucucccucuugucacccaggcuggagugcaguggcgcaaucuuggcucacugcaaccuucaccucccagguucaagcaauucuccugccucagccucccaaguagcugggacuacaggcguaugccaccgcaucuggcuaauuuuuguauuuuuaguggagacaggguuucaccauguuggccaggaugaucucgaucucuugaccucaugaucugccugccuuagccucccaaagugcugggauuacaggcaugaaucaccgcgcccggccaguccccaaccuuuuuggcaccagggacugguuuuguggaagacaauuuuuccauggugggggaauguuuuggggauaaaacucuuucaccucagaucaccaggcauuagauucucauaaggugugcaaccuagaucccucacaugcacaguucacaguaggguucacggucccaugacaaugagaaucuaaugcuccuauugaucugacagacagagcucaggugguaaugcuccccgguaggcugcucaccugcucuguggccugguuccuaaugggguuugaggagauuuauugguuggcagccagguguuggggacuccuccaauaauguacuuagaaguagaauugcuggaucauaauguguguguguauuugacuuuacuaaguaauguuaaacuuuaauccaaauuguuauuuuauauucccaccaguaaugggugaaaauucacauuucuuuaugucuuuaccaauacuugauauucuuagauuuuagaauuuuugucaaaauaguagguguaaaauaaugucuuaugguuuuuauuuguauuuacuugaauacaaauaaauacaaggcugaggcuugagauugagauugagauugaggcugagcaccuuucuaauauuuauggggcaguuguguuuccccuuccaugaaaugucuguacaugacuuuugcccauuuuagaaaacugaggauuuguuuuuauuaaaacuuuguuauuauuuauccuggauauuuccuuuauagguuauaugugucccagugugugacuuaucuuuccacuuuuugugauauguugauuaagcaguaguucuuaaugaaauugaauuagaauuuuucuucauuuuauacuucuugugucuuucuaaauaaauucuuuccuaacucagguuauaaagauauccugcuaugcuuuuacuaaaaguuucugaaucuuuugcuuaucaccguuauguacuugauccaucuucaguugguuuuuauauaugguaugugauagggaauaauuugccaauguccuagcacuauauauuggaugauccauccuuuccucaugaaucuauacuacuggcucuuguuuuauauuauuuucauacaagaucuguauacaagcucuccauuacgguggucuuucuguuucugcacuaauaucuuaguaucuuaaucacuguagcguaaucaugucuuuaucuggcaggaaaaauaguuuuuugccugauuuuucuuuaggagugccuuaguuguucuuggcucuucuaaauuuaggaucagcaucucaauuuuucagaaaauuguuucaauuuuaauaggaauuauaauguuuagaguauaggacaauugacaucuugagauauuaugguacuuccuuaauacuauuuaaggucuucuaaaugucauucauuaaaguuuaaaaauuuuucuucauaaaggauuuucuuucuuuuuuuuuuuuuuggagaaggagucucacucuggcacgaucucggcucacugcagccuccgccuccugggaucaagcaauucuuagccucagccucccaaguagcuaagauuacagaugcacaccaccacacccaguuaauuuuuguauuuuuaguagagacaagguuuuaccauauuugucagccuggugucgaacgccugaccucaagugauccaccugccuuggccucccaaagugcugggauuacaggcgugagucacugugcccagcccauaaagguuuuauacacauuuuauaagauuauuuuccuaauuauucuauuacuuuauuuuugcaacuaucauuaaaaaauuauauuuucuguuuguugcuuauguaggagugcaacuaucuuuuauagauuauuucaacaauuuuacuaaacucacuuauuaacucuuguaauuuuucuauagauucuuuuggguuuucaauuagaauaauuauauuaccugcaaauaauaacaguuuuauuccuuccuuuccaauccuuuuuaucuuauuggcuaggaccuccagacaauguugaguagacauugugauaguagguauccuugucuugucccugguuuuaaagguaguucuuuuaguauugcacuauugauuaugauuuuuguuguacacuuuuuguuuauauccuuuaucaaguuuaggaaauguucuucuauuucuaggcccugaguuuuugcuuguauauuuguuaggaaccaugaauuguuaccuuuucugcaucuauugucauuuuucuccuuuuaucuguuaaugugagaaucacaaaagauuuacuuuuguugaaccagucuuaguuccugaaauaagcccaagucggucaugguguaguaucuuuucuaaacauuccuaaauuugguuugcuacccuuauuuuuuuuuuuuuaagguaaggucucagucugucacccaggcuggagugcagugguugaucuuggcuuacugcaaccuccaccuccugggcugaagcaauucucccaccucagccuccccaguaacugggaccacagaugugugcuaccaugccuggcuaauuuuuguauuuuggguagugaucgguuuuugccuuguuacccagacuggucucaaaacucuugagcucaagccucagccuccuaaaguggugggauuguaggcaugagccaucacacccggccaaguuugcuacuuuugcuuaugauuuuuuuucaucuauguccaugaacaguuauucuuuccuagauaguguugguuugguuuaaugucaguuguacacagcacacauuguauaagguuggaauugucuauuucuggaaagguaaaauuacauucuuugugggaagauuuuaaaccuuugauacaauuucuuuaaugauuagaaaaccauuagaaauguuuuauuucuuuuugagucaguuuugauaauuuauaauuuuuaggaauuuguucacuuuaccuaaauguucaaagcuugauuugaaguuuuucauaauuuucucuuuuuaaacuguuauguuuguaguuaugccccuccuucuuguguauaauacaguaguauuugugccuucucuuuuuucuugaucuuuuagcaauuuuucuauuaguacuuuucaaagugucaacuuuguuuuuuauuuuuuuaauuuaaaaaauuuauuauaauauuuugagauggagucugucuguuuucuccaggcuggucucggacuccuagacucagguaauccuccuguuucagccucccaaguagaugggauuauaggcgucaaccaccacacgugacuuucaaguuuguuuuuuauuuauuaacuguugcuuuucuuuauuucuuuccuucuuuuagaggagaaaaaaaggcugaaaaaauuuaggagccacuugauaaaaaaagaauuucagguuuguuucccuagauguaauacaagaaccuuaaauucauaugucaaacuugaauuucuuaucuuuccuggaaaauauugucuucuaguauuuccuguccuaaguuggugguucacucuuguugcugcccccaccacccaaaaaaauaguuauccaagccuaccuccuucuaccuuaacaggcccuucuuucccaccucccacuguuugugccucgguccaggucuucaaucucucuucuuauggagccuguggcaucauuccaacuaguuuugcuuccuucaaccucaucucuguuaacccauccuucauacugacauuuuugacuucagcaaacaguccaaugauguccgugucucacuuaaaaccuuacaauuauuuucugcuacccugaucacuucccaacuccuuagcaugauauacaaccugcgccuuccagucucccuacauguacuuuuugguccaugguccaacuuaguuuccccaacacaucauuuuguucuuagucucugugccuuuuuuuuuuuuuuuuuuccuguugaggcagacuuuugcucuuguugccuaggcuggagugcaauggcacgaucuuggcucaccacaaccuccgccucccggguucaagcaaaucuccugccuuagccucccaaguagcugggauuacaggcacgugccaccauacccggcuaauuuuguauuuuuaguacagacaagcuuucuccauguuggucaggcuggucuugaacuccugaccucaggugaucugccugccucgaccucccaaagugcugggauuacaggcaugagccaccgugcccagccagagaaaauauuuuuaguuuauuuuauuuaugggaaagauguaagugcucugauuuguuugauuuuugucuuuuuuuugucuuuugcucugccucucggguucaagcaauucuccugccucaguugggacuacaggugugcaccaccacggcuggcuaaguuuuguauuuuugguagagaugggguuuugccauguuggccaggcuggucuauuuuuuuuuuuuuuucuuuuuucugagaugcaaucucacucugucacccagacuggagugcaguggcaggaucucagcucacugcagccucugccucccggguucaagcgauucuccugucucagccuccccaguagcugggauuauaggugggcaccaccgcaccuggcuaauuuuuguauuuuuaguacacacgggguuucacuguguugcucaggcuugucucaaacucgugaucucaggugauccacccaccucggccucccaaagugcugggauuacaggcguaggccaccgcgcccagcccaggcuggucuuaaauuuuauuucuugaugaaagauuuuugccuuguuuuuuaaccucagagugauaagcaccuaaagcaucaaacauugacuaaagaauuguaacacuaagaaagagauuugauuauuccgaucuuuauuacguuuuaucucaaauucugucuuuauauuuuuaaauaaaaguaacagaucugagcucaagacaugacagagcauaauuuagaagcuuuuccaauucuccagaaagccauuagcuagcaagggauaugaaagauucaucagaauucaacagaguauuuucuggcaguuuacccaagggguucuugaauacacuuggagaacucauguaucaaacaacuaggaaucgauauacaccuaaaucccuuugccuuuucagacuccacaaaaccuggcaauaauagccaauaaaguugcuucagaaucugcuggaacuuacuagagacaaaaugaacugucaagauagaaucaaguaguccuuaaggaagguuuauaauucaagaguuuucaucuuuaauugaauauagugauuacuccuuaaaagaacaguuacuauaaaauucuuauuaaggcuguuguuaauuauuuaguaaaguauuugcauuaauuguacuuaaauuacuuuaagaaaauauaaagaaguauaugaaauuuucugugucaguaaacauaaguauaaaauguaauguuuuuugaaaacuauuagguuggugcaaaaguaauugauguuuugccauuaaauggcaaaaccgggaaaacccacauaguuuagucccaauuugaaaugcuuauuuauaauugcucauaaacacacaugcaacucugaaucagcuguacauggcuucugaagacugccguaagauuugacaggguaaccuauucuguauagaguuaaauaacuuggaucauuugaucuauuaaaugucucugaguaccauuuaugauggaauggagcacuuuggcuguaacacuaucucauggaauagaaguguguuuauucugccuacaugugaaauauaauacuacuucuguuugcucuuuaaagaaauauccuaacagcaucuucuugaaagaauaaagaacagccuguguauuuuuaggaguugguacucugcuugcguuuuaaguauggaccauugccuuuguuuuucaguuagaguuuuuaaguuuuauuuuuguuuuuaaggggguaaaacaauuuauugaucucuuaaauacauggaugaguuuugugauucccauuugacagauuuuaagaugugaaaaugguuaaugucuagaagcuuagaagugcaguuggcaucacguguuauuuucuguuuaagcuaauucuuuguuugauuuauuuaauaguucuuauuuggauauuaguaaccaucaauaaauaaaacugaauaugaauuuccaaaauuuugcuuauacaaagugccaaacuuaacauuugaauuauaugugcuagaauuauaagcaguaucacguuguugucuuuaaccauugcauuuucauugcauuguggcuauauacaacucuacauaauuaacaucuguuuuaguucuaacugcuuuuguguugugaaugguuucugcuuuaaaggcuuaugcuccugaaaucaaccaaacaaccaaacagacucucuagucuuaccaucacaccuuuucaauuuuaauuccaagaaagaaauauuuuauuccccucaccucuauaacacagaagccuugaguauccccugaaugucagggguuuagagugaaaagcaaggagaaaauuauaaguacauaaagcccugcccaguuggaacaucacuauccaaaaaaggaaacagacaagggaacauguaauuauaagucaacaugauaaacccaauaacagaaaugugauauauaguauagggauuaacccaguaagaguauaaggaccauacaagcagggauuauauuugauucauaucuguauauccaauaccuaacagagggucuaguauuuaauagauucaacaaaucaguuaaaugaaugagauuaauucugccuuagagauaagaaacaagaaagucuuccuaaaugggguguaaucuggguuuugaaauucaaauagcuuagaagaagaaaaggacaaagaaaacaaguugaaaaaaaaaaaaaagccaaauaggcagauaaaaaaacuugagagaaugaaugacaggcauggggaacagugugagcgaaacugcaugccguguuuuagcaaacugcgaauaguucagauugcauuagcauaaaguguaaauugaagagcagcuggaaauggagcuauauuagugaagaauuauauacauggguuucuuugaaaaacagugaacuuuacaaaaaaaacuuaaucauacuuucuugaauacuuucuaaaacaucuuuucgaaugucuagaccccuucuucaaaggccugugauauuuuuaaaagguaauucgaauuauugaugaaauacuuucauuuuaacauuuauuaucuucucuaacauuugagauuuauaucagauuuugaauauaauuuuauauaacuuauaaacauugggauccuuuguguaaccaaugaugauuuucccuuuucaaauuguaaagauuuauaggacuguaguuguauuuaugacaugagauagauguuuauuaaauaguaugacaacauacuucaagccaaguuuuauauggaagcccacuauauaaguagauaugguccaugggcauccacuccguacacuaggguacuccgcagauuccuccagguucaacagucaaggguuuaguggaaagaggcaggaggcccagguucaauauuugcaguauuacuaguuagcaacaggauuguggguguaucauuuuucuuucucaucaucuaaauagagggacuggcugggugcaguggcucacgccuguaaucucagcaccuugggagguggagguggguggaucacuugaggucagggguucgagaccaaccuggccaacaugguaaaacccggucucuacuaaaaauacuaaaaaaaaauuagcccaacgugguggcaggcaccuguaaucccagcuacuugggaggcugaggcaggagaauugcuugaacccaggagguggagguugcagugagccaagguugcaccacugcacuccagccugagugacagagcgagacuccaucucaaauaaacaaauacaauaaauagaggacuuaguuaaaugacuucuaaagucccuuuuaacucuuaagucugugguuuuauaaaucuguagcuauaguuuaugugaugcuggggcuuugaacuggaauguaacccccaauuauagcuacauuuucuaggacuacaucuaagugaaaucaggagcagucuauauuguguuuuucuaaaauacuuaaguucuucuuuuuuucauguuaaguuugagauuuugguagaauagguggaacuauccuacagguaauuugaaguuugggucuaaaacugaggagagaaaucaggacuagggauagauuugggguuauccaugcaggugacuguuaaauguggaaguaaaugagguuacuuagggggcagaagagaagggagugaacauacaagaguagaagggguggaggaauggaggaagauauggaacucuacaaggacauggaaaaggaauaaggaaauuagggaagaaauugaauagaguauguccuaauacuaaggaaagaguuucagaaaugaaaggaacuugacugagaaccagauagaaauagccuaccauguggugguagcauucacugcaaaaugaagaucuuguucauuaagauaaagguuaucugaaaagacaguuuaagccauugggggcaugcaaaucaguguacaaaaagaaaacuuuugcaaguuccaguuuuguuuuuuuuaaaggucaugcuaaguauugaagaggaauaaguuuauaugguuugauaccuacacacguuagucagaguguggugguauggugaauggagagcacagaacucagaauuaugaauucugggcuguaguacacacugucuauuauuuuaacuguacaaccauccagucaccuaacagggauacuuguaaacagauaaauuauaaucagauugguaauuguuguagucaauaugaucaaaaguucuugggcaaaugauuuaagccuucuggguuucuucaccuguaaaauuaaauuguuaaaaaaauuuguuuuaggccaagcacaguggcucaugccuguaaucccagcacuuuggaaggccaaggcggguggaucaccugaggucgggaguuugagaccagccuggccaacguggugaaaccccgucuccacuaaaaauacagaaauuggccgggugugguggcaggugccuguaaucccagcuacuagggaggcggaggcaggagaauugcuugaacccaggaggcggagguugcagugagccgagaucacaccacugcacuccagccugggugacagggugagacccugucucaaaaaaauaaaaaaugaauaaguuuuguuuuaaagcucauacucuguguaguaccucuucaugcaguucuggauuguuacaaugcuauuugccuuuaaaauguauaugaaugcauacguauguauauauacauauauguacuuuuaaaaaauuauuauguaggauacuaucuuuuauuguuguuuugagacagggucucccucuguuggccaggcuggaguacagugguuuaaucauagcucacugcagcccuggcauccuggguuuaagcgauccuuccacgucaccucagccucuggaguagguggggacuacuacaggcaugugucacccuacugggcuuuuuuuuuuuuuuuuuuuuuuuuuuuuuuuuuugcuuuuugguagagacagguuuucccuguguugcuuaggcugguccugaacuccuggccuuaaguguuccuccuuccucagccucucaaaguguuaggauuguaggcauuagccaccacacucagucuaguacacuguuuauaaaauuuucccuguacacugaggcugucacacccucucagcuaaugaaguguaguaggacaggccauacugugugcucugagccagugaguacugugcacuuucauccaguaagugcccuaccaccuguuggagaguugagcauguuuuggaacauguauuguuucucuccuggaacugucuuuucuugccauuuauuuagggaggaacaaagggaugcaaguaaagacuaucaugcuguuuauuaacaugcaagcuuuacagaggccacuggccugagauucaacuaaagaaauggucaaggcuucuuuccaguguggacucuuaaguaaaacuuuucauaaaaaaaaaaaaaauuaaagaaaugguugaggagaaagaagguaaagauuuuuaggccaccaauauuccugaaguauagacaguuacaaauuuuguguccuuugauacagggugacuuuguguucacaaauacuauuuaaauuuaucaagcuuguaauaugcgugccugcacagugcuugcugccauagauacacuggugaacuugaugagacaugccccuccuggauuuuaucauuuauuaggaaugguaaaguuaaacaacagucagaggcccauaggaggucaguuuugcccaagcagaauguugaauaaauguucuaacugguuccuggcaaaaacauacaaacuguaucuuuuaucaucaccucagccucucucuuccuuuccccauuucugcaucauauuguaaccauaguaugagaaaaaacauacugaaauuauuuaguuagguaaacuggaucuccaggaacauauaagcauguggcugggaaaaaggguugagaacuccugacuucuaggucaguaucauucaaaucuguauuugcaagccagaccacauuuuuaaauacaaacccacuucuuauuuuugagacagagucuugcucuguugcccaggcuggagugcaguggcaagaucuuggcucacugcagccucugccuccuggguuccagcaauucuccugccucggccuccuggguagcugggauuacaggcgcacaccacaaggcccggcuaauuuuuguauuuuuaauggagacaggguuucaccauguuggccaggguggucucaaacuccugaccucaggugaucugcccgccuuggccucccagagugcuggcauuacaggcaugagccaccgugcccggccacaaacccacauuuuuuaaaguuuuaaaaauuuguuuaaugauauggaacccacauuuuaauuacuuugcuuuuuguuuauagguccaggggcaaguucauccuacucucgagucuaaugaugaugcucuucaguauguugaagaauuaauuuugcaauuauuaaauaugcuaugccaagcucagccccgaagugcuucagauguagagguaugacaaauguugucuuguauuuacuuuauaucuaauuuguguguugguuguaaugucagugaacagggaaagaauuugcucucucuauauauaugguauauaagaaaaugaagccuggauuuaacucuuuacagguugaguaucccuuauccagaaugcuugggaacagaaguguuuuagauuuugagguuuuuuuuuuggauuuuggaauguuuucaguauauuuacugguugagcaucccaaauccaaaaacccaaacucugauguguuccagugagcaucaugucagcaucuagaaguuuuggauuuuggccugaugugguggcucaagccuguaaucccagcacuuugggaggccaaagcagaagaaucacuugagcccaggaguucaagaccagccugggagacaaagugagaccccaucucuaaaaaaaauuuguuuuuaacuagcuaggcaugguggcaugugccuguagucccagcuacucaggacgcugagucaggaggaucacuugagcccaggagaucgaagcuacggugagcccugaaugaaagaguggaaccaugacuccaaaaaaaaaugcuaaaaguuucagauuuuggauuuuuggauuagggauaaucaaccuguauugcauauaggauaguuuguauauauucuagcuguuaaacuauacauuuuuuuguuuguaagcuaaaacgaacaauuucuugaugauagaaugauauacccauaccuuuaggaguggcauauguccaagcauuucuuuuauuaaagccagcuaacauuccaaaaagauuucuguuaauguuuugaucuucaguuguuacauguauuuuaggugguaagugaauuauuucccaccaauugagagagagggagacaucuaaacaccuaggaaggagauuguguaaucucuuagaaagaugauauggcccuugucuuuuuagggcuuaugauuuaauggagauacagagagauauguagucaguaacauaaugugauauucuaugaguaaagaguauaugggaaaccaugaaaggggcaacugauagaugcuuugggguuugggauagcuuccaagaaaaagauacaucuaaacugaguucggaaggagucgaaaguuggagagaagaauaagguuuuugaaguaccaauuguagaaaaugggagauacagcuagaaauagaaagaguucccuggcaaugaugaaggaccguuugacuuuaaugacuucaaguguacaguacuucaaaucuuuggguuucugugacuuugcuuuugcagcacucaagugugagcacaaaaaaagauaguuggacugaaugguguuuccucauggauguauagcaggagaacagcagggcaagggaauuguaaaaacugguaauggcagugcuuugcaaccuuuucaggacacaacacacauagaaaguaauguuuuuauggcacacauaaaacauuggguuuuaugugugauuggguaggaaguaaucucuagcaaccucaggccuuguccuucuacccugaaggcugagggauugauagacaggcauauccaaugagaaacugcugagaagagcaucacugaaucgaaauuggauaaggaaaaaagugaaaugugauaauagcugauggguuugcuauauaguauuaugcacuagucugaauacuuccauacuuuacauuucauuuaaacuuuguaauaaucccaucaagaugguauuaguuuuuucccuacuagaauguaagcuccagggaauuuuuguuguuguuguucacuguugaaucaucagcaccuagagcaauaucuggcacagagaagacacucagaaaauauaaguugaaugaaugauucaacugaagcacagagagguugaauaaccugcccaaguuauuaaguagugaagccaagacuuuuaaccagaaagucuagcuuuuugagcaugcauucugauaccagguaggagagggcacauauaauggaaaaacauggagagaaaaggguacuagaguucucaguaaggucagagaacugauaauauuaggacaucugaaagagagaaauagagcagauugagaucagagaaagaguuguuugaauguaagauuucauaaguaacauaguuacaaagcaggauauggcuagaccaggggugaaggucuccaagaugaggucuuuauagaauuaagaggcugggguauuuugugugucccuaauguaaaccauaaaguuggacagaaugguagcaggacuuuacaugagaauggaagagugauguuaacaccucuuaauaccaccacaguggaguuuagguuucagcaugaauuugggaggggcacaaacauuuggaccauagcaaauggugucuuacauucuuuuaucgggaaauaauuuuccauuuuccucauugacuaggauucgguauuucuuuaauacacuuacaaagcuuucuauuaaaauaauaagggcccuaaauuuagcaagcccuaaguguguuuugggaugagucauaaaauauuuuucuuaaguuuugagggucacauaagaaaaauguauauagagacugggcauaguggcccacaccuguaaucccagcacuuuggaaggccaaagcaggcggauaaccuaagguugggaguuugagaacagccugguuaacauggugaaaccccaucucuacuaaaaaaaaaaaaauacaaaaaaauuagcugggcaugguggcaggcaccuguaaucccaacuccuugggagcugaggcaggagaaccacuugaacccgggaggcagaaguugcagugagccaagauugcaccacuguacuccagccugggugacagagcaagacuccaucuccaaaaaaaaaaaaaaaaaaaaaaauguauuuuaaaaauagaucaaucugaauuagcagaauauacacauuuaaaaaucuuucugaagaauacgcuucauaaugguucccagaggcuguguugauuggagagaaagggaacuggggaagauucguucaaagaauacauauuuacaguugggaggaauaaggucaagagacccuauuguacagcauggugacuauaguuaaugaugguauauucuugaaaugggcccuuauuauuuuaauacaaagcuuuguaaguguauuaaagaaauacugaauccuagucaaugaggaaaauggaaaauuauuuccugauaaaagaauguaaggcaccauuugcuaugguccaaauguuugugccccucccaaauucauguugaaaccuaaaccccacuguggugguauuaagagguguuaacaucacuugaaaaugcuaagaauugguauuuauuguucucaccacaaaaauaacuaugugagguaaugcauuuguuaauuagcuagauuuaacuauuccacaguguauauguacuucuaagcaucaucauguuguacaugauauacauguacaguuuuauacaucaauuuaaggaguaaauaaauuuggccggugugguggcuggaucacacauguaaucucagcacuuugggagggcaacgugggcagauugccugagcccaagaguucaggaccagccugggcaacauggcaaaacccugucuuuacuaaaaauacaaaaaauuagcuggccauggggcuacaugccuguagucccagccaccugagagguugaggugggaggaucgccugagcccaggagguugagguugcaguaagcugugaucgcgccacugcacucuugacagagugagacccugucucaaaaggaagaaaaaagaaguuugaaaaaaaaaauguuuaaagaauacacuuugcuuuaaaguauaagcauaauucaaaguaugguagcaauuacugcuuaauuugguagcuccuaggggauaugucuaagagugauuuuuaguugcuguauaguuuuaggaaaauaggugcuucaaaaguacuugaaaacagauagauugcauacauguuuugcugaugguaauuaaaaaguuuugauaaauuguacuacagauuaucacaaauuauaaaguaucauaguccaaaugaauggaauuuuguuuuauugauguagccaauaaucacuaaucgguacugccaauauauuaguauuuaccaucaggcaguguugcagaugaauaaggaaguagagucgugcuucaguuuccaugggggauugguugcaggcugcugccugaagauaccaaaauccauggaugcuuaagucccuuauauuaaauggcauaguauuugcauauaacuaaugaacaccccucccauaugcuuuaaaucaucucuagaauacuuguaauaccuaauaaaaaguaaauguugcgaaguguaguggcuugugccuguacucccaccuacuuaggaggcugaggugggaggaucacuugagcccaggaguucaaggcugcaggaagcuaugaucaugccagugcacuucagucugggugacagagugagacccuaacucuuaaaaaaaaaaauugaauucuauguaaauaguuauuacauuguauuuuaaauuuuguauuuuuuuauuuuuaaaaaaauauuuuugaucugcaguugguugaauccacagauguagaaccauggauauggaaggccaacuguauuauauauauuuuaaugcuggggaaugcagaagaaggguauauauuauuuggcucuguugauuccaauucauucaaguauuaaaagauaguauaaaaauugcuucaaucuauuucuuucccucuuuuauaauaaauauaauuuucuguauuuaaacuuugaaaaaauagaggcaaaagcuaauauuuuuuuccuguguuugacccuaguaaaguauauucuuuaauuucuuaggucuuguccuuucauaauuguacuuguucuuuacuugacuggacugauuuccuuuguuguuccuucccuuucuggucuauauguaccuauauuuaaccagcuuugauuucucaggacagugauacauuuuucuuuuccucauucaucucaggcuuuuuuuuuuuuuaacuucuuuaucuuagacuuuuuauugucauuagcccuucaucguaaaauguaaaacgucugcuuucguuuuccguucauuuuuuuucuuuagcuuuuuuucccuuggaauccuaaagaauccuuauaauuucuuucuuucuuuucuuuucuuuuuuuuuuuaauuuuuuuuuuuauuuugagacagagacucccucugucacccaggcuggagugcaguggugugaucucagcucacugcaacuuucgccucccagguucaagugauucucgugccucagccuccugaguagcugggacuacaagcgagcaccaccaugcuuggcuaauuuuuguauuuuuaguagagacaggguuuuacuguauuggccaggcuggucuugaacuccugaccucaagcaguccgcccaccuccgccucccaaagugcugggauuacaggcaugagccaccacgcccagccaagucccuauaauuucuaauaagcuuuccauuaacauuuagauuccccaaauaauuuauccauauuuucuaccuuucuaaacaaaaacaaauuucucccacacauaccaaaguauguggggaucugauuuuuuuuuuaacugaaguacauauguaagaauuuauauaggaccuagaauauuuauauuggaauugaucaagauuaucuuuuuaaaccuauuuauuauguaaaggagaagacaggguucugcuaauaauagaggugaaucuucagcuuagcucuguaucucauuaauguuucccagagguacuagauauuaaucaagauagaguuucucauuuaauacaaauaaaauuauuaaucuugaaauuaggagaguaauaguauucuaauucaugaaucuuucauuguucaguccuccuugggcuucuuuuuaaaaauacaugaaggccgaaugcaguggcucauguguguaaucccagcacuuugggaggccaaggcagaaggaucacuuugagcucaggaguuccagagcagccugggcaacauagcaggaucucauuucuacuaaaaauaacaaaauuagcugggcauggugcacguacuuauagucccagcuacuugggaggcggaggcagggagaucacuugagcccaggaggcugaggcuccagugagcuaugauugcaucauugcacuccagcucgggugauagaucgagacccuguucccccccaaaauaaauaaaaaguaaagaaauauaaaguguuugugaaagaaauuuuauuuuaucauaaaauuauaaauuugccacuacaagaaauaaaguaauuccuucaguauggccucuccacauucaaaacaccuuuuuuuuuuuuuuuuuuuuuaacccuacgaaucuuuccgcaugcauuuugacccuugacauugucuccuaaguauguauuugguaauuugauuucauuaauacccuuguaaguaaguuuaaaaugugcuaugcuucauuauuaccacuuugccuuuuuaaaaaucauucgagauuuucuuuccucuucuuuccuuccucaaaacaauaaaccuggaaugagguagacauaauugauauggacagggguugcuguucuguuuucuuuuucuucuaccucaaccccugccuacaauuagucucuguaauuccaccgcuggugauuuuuuuuuuuuuucaaagacauguaacucuauuuagaauuaauuguuagguugaguucaacuucuguccuucucuacugcuuuuauuuuuuuauuuuuacuuuuuucuacugcuuuuaugucuacacuguucaccaguguuuuuagacuccaggucauggccauuaguaagucauaaaauuacuuuagugcauugcccaacccucauuuuaaaaaauaaaacaggccgggcacaguggcucacaccuguaaucccagcacucugggaggcugagguggguggaucaccugaggucaggaguucaagaccagccuggccaacauggggaaacccaucucuacuaaaaauacaaaaauuagcugggcaugguagcacacgccuguaaugccagcuacuugggaggcugaggugggagaaucacuugaaccugagagugguggucgcagugaacugagauugcaccacugcacuccagccugcgcaacagagcaagacucugucucagaauaaauaaauauacaaauaaaaaacagaauagcaaaugccagugugcuacauauaauaaggacagguuuguuuuaggaaacuguuucauuugaguaugugugcaguauguaaggguauaauguaaaaauguguugaaaauuuauucuuacuaugaguugagguuuuaaaaaauguuggaaagccacagggucauaacaugauuagguuuguaccaugguugcacuuaguuaaucauggguuaaacccaucacuauaaacauuuuaacugaaaaccacguaaguuaguccuaaauaucuugucauuuuuggauuaacaagucuguaaaauaaacuuggaaaaaagaaaagaauucuuguuuuggauguucccuucucucccuuuaccccuucccuuuucucccuuuucaccugcgaugccuccucaauauuuugggccuuuguauugcguuuuacugcaugaggcugguguccuggcaaacagcuuuucaacuagacaguugaaaagguuuguaaaccccauuuuuaacugcuauaauuucuuucaacaugcuucuaauuccauuaauuagaauuaaaauaacuuuauuuggaagcugacuuagccuuggacauaauggaaauuuauuaaaauugaauggauuacacuccuuaauuuauagauuugcucuuaagauuuccaagaaucauuguguucuccaccccucccucaccaccaagggcaucacauggcaucacacuuuuuuaauuuuccauuuuacuagcaaauaauaaaacuuuuuauucagauuuauaauuaugaugauguuuaauuucaucuaguaguuuuuacauacuaguugaauacucauuuauucaaaacacauguguaaaaguuauguaauagcgaccucuacugguuuuaguuaugguauccugcaaguggauuuuuuaaaguuuugagaggaugaaagcgccuuuuugaagugaauuauauuaguuuaauaaggaaggaaauucagcugugauaguaaccugaguucuuucacucucaguggaaauuuuaacuaaagaauuucuggaaauuaaauugaaguauuuuguuaaaaacgaaugacuaugggaggacuuuaaagaaacuacaauguauuaaaauugcugucaccaaugcaaaccauugcuuuccaugauuuguaaauaguuuugaagugccuuugcaugguggauaaagaauauucauagagguuucaauugaaaaaugcugcauguaauuaccacugaaaguaaggacaagugagugagaacuggauuuagauauuuacuucuugaucuuggguguuguuccuugaaauuuuauacaaguacuauuuaaaguagcuucuacucauucuuguaauuagcuuuaucacagugaaguugaaauucaggaugugauauucccccuagauaauagaaagaauguuuagucucuuauugucuaauuaaggaacuaauacauugacaauuacuguuuucucuuagcuucauauguuuguaauguaaauuauaccacaugugaaaagcucuacuuuugguauucuuugauuuuaaaaguaaauuuuaagugaagagcacuauuuaauauauuuuuugcuuaguuguuauuuuccuauuuuccaaggaacguguucaaaaaaguuucccucauccaauugauaaaugggcaauagcugaugcccaaucagcuauugaaaagaggaagcgaagaaacccuuuaucucucccaguagaaaaaauucauccuuuauuaaagguaaugcugaacuacugccuucuugccuuuuaagggaaaaauaaaacccaccauuuuuauacaauaagaauauauuuuauggauaauugagucaacuuaagaguaaaauucucucauucuaaguuuuccagagauuuauguggugagaagggaugcuaugauaauaagaaaauauaaacugggcaacaugauuuaaaguaauuucauaucaauaguaauaagcaaguugagaggacuaagaaaguuauuguggauuuuguuuaucucagauguaauuaggaccacaaagagaauuuauaaaacuccuccuuucuuguugguuagaccuaaguguuccuauaaauccuuuugauguuaguacuuuguguagagaccucugugaaaaggcuacaaggcuauguguaaucuuggaacaaaaagauaaccuaaacucuccaguccuacuuaucauguaaauaagucagucagucaguugaaucucuauagaacuaauagaauaacugccggaagcucgaauaaugcuauuucuauuuuaguuaauguaacgaacuacuauuaccuuucacaacaaaaauauagguauuauaauaauuaaaaacuuagaugccaguaauuuuguacauacuauaauacagacaaaaugcuaauacuuguauacauugucugaguuuuauuauucaacaaaguuauuauuauccacaguuuguaaaugaggugacagaggcagaaagugauuaaguaacuucuaugccaaguucacaagacucuuaagugauaguguuagaaaguucagguuugcuugauguuguccaaaauuuaaaguuaaacacuugaaugaguuuaagguuguauuuugcauucaguucuuugaauagaaauaccugccuuauggaaaaggcauucaucauucucuucaugauuuucauuggccauauguugaauuguauucuaagggaauuaacaaauugagguauauaaauauuauguuaauaauccuaaauuuugaguuuuaugugcuaauugugaauaucauuucaauuuauuuuaauacaccuuuaucaugauacccuuauuaguuuuuauauacccuaaaagguaaaugcagccugucuccaauuuguaacaaacuucuuauuucaaaguuguuuuuuucccuuaaauggguuguuuggaaaauagaauuuguuauucuguaugaacagaccagucccacaaaagcccauauucucuuugaaguuuaauauuagggcuauuuaacauuuucuuaacagcaaccauuauucaguaggacauaacaugaauuuuauuuucguagaaauugccaggaauaccaggaauaugcccgcugugguuuuggggagcucaucuucccuuggaaaaguuaaaaguauaagccugguagagauuccuagauaccaauaauauauuaacucucauuuuuuguaaaagaaaaaacuuguuuguuauaguuacuuccagguauucugaauuagguaacaaagagcauuugcucccuuccccaaacuugggccuuccuuuauagguuagggauuaucuauuuguaaucuccgcuuaaguauuuuacaucauuagagguaauuuugccuugccuuuucuuagcuuacauuuucaauaguaauacauauauuauucauuguugaaccacuuacaauuaaauguuguugguaagcacaggccucaggaaaaaaaguguaaguuaaggugcaaauauguuuuuuauuuuuaaucaguguguuaaauguacaguauaugauguuuaaacaugcuuuucuuuuaauuuugcaggagguccuagguuauaaaauugaccaccagguuucuguuuacauaguagcagucuuagaauacauuucugcagacauuuuaaagcugguugggaauuauguaagaaauauacggcauuaugaaauuacaaaacaagauauuaaaguggcaaugugugcugacaagguaggaaacugagcuuuucuauuuuuuucuuaaguuucuuuuuaugacuuauuagaugcuaacguacuauucauauagaauaaaauuguauuauguguuggggaauaucuccaguaaccuaauaguagggauucaagauaccacuuuauagaaauaagacauuagauauauaauauuaaaauguguuuaaauaugucaugcaguuuuuuucuucugugcuguugcaacuaggguuaauuagaguaaucucuuaauaguuaauuucuuuucuuuuuucuuuuuuuugagacggaaucucacucugucgcccaggcuggagugcaguggcacagucuuggcucacugcaaccuccgccuccuggauucaagugauuguccugccucagccuccugaguagcugggauuacaggcacacaccaccaugccuagcuaauuuuuuuguauuuuuaguagagacaggguuccaccauguuggucaggcuggucucgaacuccugaccgccuuggccucccaaagugcuggaauuacaggcaugagccaccacacccagcuaguaguuaauuucuuaaaauuuauuuggauugaaagauuuguaagguuacggauuuacuuaaaaacaauuuuucaaaauguaaaaccacaaaacgauaguuuuacuucagcaccuagcuuucuucagauacuacuuugugguuuuacaauaauaauaauaagagcaaacacuuauugaagguuaagcauauauguggcuuaucuccguugguccuuaugauauuccucuaagguaagugaucuuagcuacauuuuauaaaagggagacugaaauucacagggauaaagaaauugguccagaauuuucugagaaguuucaaagccuagacuugaacuccaggucucucugagucuaaagcuuuuagucauuaccuaaggauguucacuuuaugaaaacaacuuugcagaaaggaaaauguuuucugaugaagcauuucauuccauuuuccucauuauacucuuacugauuuggaauauuauuucugauugcugauuccacuaaauuauguuuuaguauuuauuuguucuuugagaauguggccauauagagugaaaaaacccaccugauuugaagaagaauuucaaauguuuggguauuuuuaacugaagacacgaauacgaaauacuugaugcuuuuuaaugaaucagauaaauaaaauauuuuugaguaccuacuacauguuuacacagagaggagaugcaagauaaguauauauaaaacaaggcuccagaguugaugaagguauacuuauauucaugaaacaaucagaaagcacacaagauaaaauaauauuuuauuguguuauagagauaugaugcuguagaaguucucaagaaggggaaagauguguuguagcaagaguaguaacaguagacuucuugcagaaaauaauagcuuauuuugaccuauucccaacaaauguaggaaaaucggccgaauagacagcuauaaacauuuaaauaugagauacugaggccauggaauaaagugaugauggcaggguauaaaacagagaaaaccaagucagggaaauuaaagacaggaucuggaaacaaauuggaaguaauagguuaacaagagagacagacagauaaauacuaguagugauagagaacuuggaggaguguaguaaguuauaucacauguugaauucuguuuuagagaagcuguggagggaugcuggcaauauauccaagaagagaaauuuguuugucugcuuuuuuaucauuuaagaacuuuauucagagaacuuagagcauuucacaucaaauucuacgaaagcuucauauuuuauuauacuuuuuuauaucucugacuguauagguauugauggauauguuucaucaagauguagaagauauuaauauauuaucuuuaacugacgaagagccuuccaccucaggagaacaaacuuacuaugauuugguaaaagcauuuauggcagaaauucgacaauauauaagggaacuaaaucuaauuauaaaaguuuuuagagagcccuuugucuccaauucaaaauuguuuucagcuaauguaaguaucauuguauauaugccucucauugaauguguugugaaauuugcaugaccacuucaaauuugaaguuguacaguucaucauuacuaauuuguuaauuuuuuuaaguugugggacuuaauucaugaucacaaaguuuuacaacaguuucaagagauuuaacauuagaaauuaagagacaaaauacaaaguagacugauuauguaagugaaaaugaauucacagaauucuccauguacuccaaaggauaaagcuucuuguuuagguggaagauauguuuguuugagucauuugaaucauucaaccuacacuucaucaaugccaacuguauugucagguaccaugcuuggcagcagggauucaaagaugaauaagaaacaguucugcugggcacgguggcucacgccuguaaucccagcacuuugggaggccgaggcgggcagaucacgaggucaggagauggagaccauccuggcuaacacggugaaaccccaucucuacuaaaaauacaaaaaauuagccgggcgugguggcgagcgucuguaaucccagcuacucgggaggcugaggcaggagaauggcgugaaccugggaggcggagcuugcagugagccgagaucgcgccacugcacuccagccugggcgacagagcgagacuccgucucagaagaaaaaaaaaaaaagaguuccuuuccuuaaguuuagucuagucaagacagagauauaaacuauaaauugcaauaaaauaugguaauuaccauauuagaaguaugacagcaguaguauugggagcacaaaggaaggggccaguaacauugaaacuuagacaaaggauuacugaucuuaagauagugaucaaacuaaccuaauuggguccugaagaaauguugaaugagaacaggugagacggucacaggaauuacacacugguaauuccuggaacuguagccacacagccauaaaugacugauaagagaaacagugcucacuacagaggcugggauugggcucaagcuauggcgaugagugaaaauuaaaaaauaaaggagauuauggugaugguuguacaaaucuguaaauauauuaaagaccauuaaauuacucacuuuaaauggacacacugcaugguuucuaaauaauguuucaauaagguugcuuuaaaaaaaguaaagaagaggcaaagguuucugaggacacaaaaaucaagaaccaaaauggccaaaaagcacaucaaaagguguucaacaucacuaaucauuagagaaaugcaaauuaaaaccaugacauacuacuacauacucauuugaaaggcuaaaauguaaaugacuuauaauaccaaaaguugaaauggguauggagcaacuacuugugggaauauaaaauucccacauuaccugagaaaguaaacuaguauauuuuggaaaacaguuuggugguucucucucuuuuuuuuuucuugagacguagucucggccuguugcccaggcuggagugcagggccgugaucuuggcucacuguaaccucugccucccagguucaagcgauucuccugccucagccucccguguagcugggauuacaggugugugccaccacgccuggcucauuuuuguauuuuuaguagaggcgggguuucaccauguugaccaggcuggucucgaacuccugaccucaagugaucugccagccuuggccucccaaaaugcuggaauuacaggcgugagccaccaugccuggccaguuuggcaguucuuuauaacaauaaacauaaacuaaccauauugcccagcaauucuacuccuagguuuuuacccagaagaaaugaaaacauguccaugcaaaaacugguucaugaauguucauagcggcuuuauuuguaauagccccaaacuggaaacaacccaaauguccaucagcaggugaauguauaaacaaacugugguaugaccauacaguggaaugcuacucaggaauaaaaagaaauaguuaugcgugcaacagcaugggugcaucucagaaauauaagcaaaaaacuaggcacaaaagacaauauaugauuccauuuauuuaauauucuagaaaagacaugucuauagagacaaaaaggagaucacagguuuccugggagugaggcauaguaaggguugauggaaaugggggacaaagaaacuucuuaagacgaugaaaagguacuguaucuugauugugccgaugguuagaagggugaauaacuacacaaaaucucaccaaaagaacauuuaaaauaggaguuucguauauaaacuaugccucaaagucaacuugauaaauauagucacugauaaaaaaaucaaauaauaguaaccaauuuuaauuuaaauacaaaauggauaugguugcagauucuacauugcaacuaacccuuaagaaacuaucauuuguugaauuuuaguauaguaucauaaaaggauagucacucuauuuauauggaaaguccagaauaggcaaauccauagagacaaaguagauuagugguugucaggcacuggggagaggaaaggaauggagagugacuuuacuggguauuuagguauccaccuuccaaaaaaaucauagguuuucuucuugugguaaugaaauguucuagaauuugauacuggugaugacugcacaaccaauauugaaaaccauugacuaguaacuacacuuuuaaugagugaauuuuaugguaugugaguuuuaucucaauaaaaaaauuacacagaaaagcuagauuuuucguauacuuugaaauaaugugucacaacagauuguaugcagaaauagauaugaaaauccugcugucuucuaguacgcuauguuagagauuugcaaauguaaaacauugccauucuucuacuaaauguuuuuuguuauggcuuaaaaaaaauuugguuacuuuuuauaaaagugcuauuuauguuaaacacauaauggguuuauuauuuuuaaugaauuaaauauuuuuugaaauuuuugguuuuaacuucuaauaugguaaacauugaaauacauaguuauaaacaaaagguuuuuagaaucuucaauaauuuuuaagagugugaaggaguccugagaccagaaaguuacaagaccacugaccuagagaaauguauuugcaaauuguacaccuuugcagaaggaauucuugaauuguccuuuauucauauuucuaagucauuaaaauuuuucacugugucugacauguuaaauuuugugauuauaaaaugacuuauuggcucaaaauuuguuuaauauuauaauaauacagccucacugaauuaauguguuuucccccaaacaggauguagaaaauauauuuagucgcauaguagauauacaugaacuuaguguaaaguuacugggccauauagaagauacaguagaaaugacagaugaaggcaguccccauccacuaguaggaagcugcuuugaagacuuagcagagguaaguacuucaauuauauacccgaaaagucugcauaaaagccuacauuuacauuaaaauugagagucuuacuucuuuccagcuaaagucauagauacuaauuguugacuauuuaucuguuauugcuccuuuuucauagggucauugucaacauauguuucuguuaucuuagcaaacagaaaaaguggucucuuguuaauuauagaaagacagauaccgccaaggggggagguauuacagcugucacccaauggccuacuguaaaacguuaagaaaugucaaugaaugacuauuaaguaagagaccacagaacuugcaccugaggucagauuacuuguguuccagucuaagcucugcugcuuauuaguugugugaccaguggcaaguuauuucauuucuuuaaaccuccguaucuuuauuuguaaaauaagaaugauaauacagguugaguauuccuaauccaaaaaucccaaauaugaaaugcuccaaaaucugaaacuauuccaacaugaugcucaaaggaaaugcucauuggagcauuucagauuugggauuuucagacuuggggugcugaagcaguagguauaauacaaauaauccaaaaucugaaaucuuaaacacuucauuuuggguaagagauacucaaucuguaaucucaggauuuuugugaaaaauuaaauaaccuaucugaaauauuuaccuaucuaccuucacauaguaagcuuacucaguaugugauaagugcauuauuauuuagaauaggaaugagguaaauaggacaauaagguccaggaccugggugauucagauaccacgagauagaaagaaagguaacuaacuccucagauauuucaaaugcuaaaauaacaugagucaguccuaauaaguuagcauuaagagucauucugagguuucuagcauuugcuguguucucacucuaaaauccacucauuaugauacagcauugagcuuguaaaauauuuuuuuaauuaagacuuucaggcaaaauagaaugguaaguucaagcaucaccacagcccuuccauuccugcuccaaacacacauaaguaauaaaguauaaaaagaaaaauguggaauauauauauaacuagacuugaaaacaagaucaggaauggaauagacauucaagguagugaacucugguaucuggguguucaggcuguuaaggacaaugaauuguuucaaauguguuccaugaaagccagagcaagauuucuugcucaagucccuccuuauaacaggaugcugggaaaaucugccaaccugguaucuacaguaaaguuuucuaaaaaguuguggacuugauguggggagacaaaaacguugccuuacaauaauaacuuaacaaaguuucccacaauauuaagucaauaugaagccugaacccgcaaagucauuuuaagagcagguucugguuuggaagagugaucauaaugggagaaaaaaaggaaacaaaacauuaagucucccacuaagaagcauauaauacagaauuccaaaaaacaaggcaaauucuaauucucagaaugguaauuaauaaaaucaacaauuacaacaugaauuuauuccagaugaaauugauuuuguauaauagacauacaaaaaguuuaaaagaaguuuaggaugcugaaagagauaagugaaggaauaugauccauuuauaaagaagauauugugaaacaaaaauagguggaaaggaaaugagcagauuucuagauaucaaaagacagagauuucgagaauuaaauauacaagcauugaaauaacucauguaguauaacauuugcuggacccaguucaaggauaaaauuaguaaauuggaagauggaauugaggacuucacugagaaugugacacacagaccaagauaagaaauaugaaaggccaauugaaaguaauaaggauagccaggcaugguggcucacgccuguaaucccagcacuuugggaggccgaagcgggcagaucaccugaggucaggaguucaagaccagccuggccaauauggugaaaccccaucuccacuaaaaauacaaaaauuagccgggcguggugguacaugucuguaaucccagcuacucgggacgcugaggcaggagaaucacuugaacccaggagguggagacugcagugagccgagaucgcaccacugccguccagugacagagcaagacuccaucucaaaaaagaguaauaaggauacacugagagguuuaauauacaucuaauaggaguuccagacaaagagugauggagaaacaauauuugaaaagauaaaaauggaaaauuuucaagaaaugaggacauuaguucccaaaucaaaaaugaauuccaaauaucguucaggacaaauaaaaauaaacacacagcuaaaaacauggcagugaaacuauagaacaucaaagauaaagagaaaaucuuggguuggguccaguggcugaugccuguaaucccagcacuuugggagacugaggcagguggauugcuugaagucaggaguucgagaccagccuggccaacauggugaaaccccaucucuacuaaaaaauacaaaaauuagcgaggcaugguggugggagccuguaaucccagcuacucaggagacugagacacgagaauugcuugaaccugggaggcagagguugcagggagcugaguucaugccacuguacuccagacugggugacagagcaagacucugucuuaaagaaaaaaaaaaagaaaaucuuaaaagcuguuaagacaaaauauuuugcgaaggaacuauaauuagaauggcagcacguuucucuuuaacaacagagguuaacagucaguugaguaauauauuuaaaguacuaagguagaauaggauuuucuacccaacuacaguauuauucaagaaugaggacaaauuuuaaaauaaucaaguuuguagaagaaagcauaaguguucuucaugaccugugaaauacacaaagauuucuuaaacaggacacaaaagcacuaaccaugaaagaaaaaaauugauaaacuggacuucauuagauguaagaauauccauucaucaaaagacaaaauuaauagaaugaaaaggcaagcuauagacuggaagauaauauuuguaauaugcauagccaaugaaagacucauaucugggguauauuaagaacuccuggcugggcacgguagcucaugccuguaaucccagcacuuugggagacugaggucaguggaucacuugaggucaggaguuugagacgagccuggccaacauggugaaacccugucucuauuaaaaauacaaaauuagggugggcauaguggugcaugccugcaaucccgguuacucgagaaucugaggcagaauugcuugaacuugggagauagagguugcagugagccaagagcacaccacuguacuccagccugggcgacagagcgagacugucuggaaaagaaaacaacccaaaaacaaaauaacuccuacaugccuacaaaucaauaacuaaaacuucaggguuuuuuuguuuuguuuuguuuuucagaaaauaggcaaaagacuuaaguagguacuucacacacaaaaaagaugcucagcauuguuacucaucaaggaaauguauuuugaaaccauggagcaguuggaagucuacuugcuggugggggcuaggguguaauuugguacagccacuuuggaaaaccguuugguguaucuacuagagcuaaguauacaauguacccugugacccagcauuuuaacucuugggcauauaccaaacaaaaaugagugcuuauguugacugaaagacauauugaagaauguucacaguagguuuauucauaagggauaaauuagugguauauucacacaauaaaaugcuaucuggcaauaaaaaagaauaacugcugauaaaagcagcaacauaauacugaguauaauaagacucaaaguacauauauauugauauaugggaaguucagaaacauguaucuuuggaaacagauuauuagaguagugguugacugggaaacaugaagauuucugaggugcuagaaauguucuauuucuuuaucuggguggugguuacagaaaugcauuguauacauauguuaaaagucaucaaauugcagacuuuauguaaaguuauuccugaauuuaucaaaaaugaggaagaagugaggaauaaaaaccauuucaaacauacaaugaccaagagcguuuacuacuuguagacacucauuauaagaugcauuggaugguguucuuuagcaagaaggaaaguuuuacucaaagggaagucaagaaauauaagaacuaauggugaaaaagaaauugguagauguaggccgguggcuugcaccuguaaucccagcacuuugggaggccaaggugggcaggucacuugagcucaggaguucaagaccagccugggcaauauggugaaaccccaucucuacaaaacaccaaaauuacccaggugugguggugcgcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaagacacugucucaaaauaaauaaauaaauaaaaaauuagaaaguguguugauaaauuuaaugaauugcugaauaguuuuaaaaauaaguuuaaaguuuuucgucuuggaaagacuaaacuauauuucuauguauuaguaacaaaauauacaguauguaaaguggacuuguauuugugauagaagaauaacuugaaaaauuuauagauaaccguauuuauuuuuaaaaacauguacgaaaaucaccaaaagaacagaaauacuaccuguagcuuauaauguacagauagggaaaaaggaacuauaguaauuuuuuaaaucauuuucacugauaauaggaaagaaugaagcaaacaaaaacaaugauaagauaaaaugauaugauauaaaaaaauccaacuacauuaguaacucaguauauauaaacugaugaaacucagccuauuuaaagagaguaauuauauuugauuuuuaaaaauucacuuuaggccuggcgcaauggcucaugccuguaauuccagcacuuugggaggcugagguggguggaucacaaggucaggaguuugagaccagccuggccaacauggugaaacccggucucuacuaaaaaaaaaauacaaaaauuagcugggcaugguggugugcaccuguaaucccagauacacaggagucuaaggcaggagaauuucuugaagccaggaggcggaguugcggugagccuagaucaugccacugcacuccagccugggcgacagagcaagacuccgucucaaaaaaaugaauaauaaauaaaaauaaaauccacuuuaugcagcuuauaaaagauuuucuuaaaacagaaccacagaaauauuuuaagauaaagggaugaaauaucauaacauaaaaacuaaucaaaccuguauaacaauauuaauucaaauuaacugauaaaauuacacaaaguaagcacugaggaggaaaaaagagaaacacuuccuaauaguaaaagggauacuaucaugaagauacaacagccauuaauguguaugcaccugauuauaaagccucaaaauauaagaaguagaaacugacagaauuauaagaaaugaaaaaaauugcuaucauaggaaauuuuaacaggucuccaucagaaauuaaaagaucaaacaaaaaagauuaggccacagaagauuagacuaacacauuugauuuuacacacacacacacacacacacacacacacucucucucucucucucucucucucucucucccucucucucucauucccucacacucaauuagcccuccauauccauggcuuccaccucuguggauucaaccgacuguggauugaaaauauuuuuggggaaaaauaagcauaauuguaucuguacuaacauaauguugagcacauuacaauacauuacaucaggguacauuacaauacccuaaacaauaaaguauaacaacucuuuacauaacguacauuauauuagauagaaguaauauagggaauccucugaagguuauaugcaaauauaccauuuuauaucagggacuugaacaucccuagauuuugguaucugcaugggauccuguaaucaaucccucaccgauaaaagggacaacagagugugugugugugugugcgcgcgcgcgcgcauguguguguacacagucaucccucaguauauguggggaauugguucuaggacucccugcagauacccaaauccacacacgcuuaagugccacaucagcccugcaaaacuugcauaggcccuguggaacccauauauacgaaaagccagcccugaguacgcaaggguuucacaucccacaaauacuguauuuuugauccucauuugguugaaaaaaaucugcauauaaguggaucuaugcaggucuaacccacggguuguucaaaggucagcuguauacaucuuaauacuguugccuugaggauuaaguuucaacuauaaauuuugcagagagaaguuuacaguuuuacacauuuuuugaaaaaauaggaauaauuaaaaaugaaugaguuaagcuuucaaaccaagaaagaagaaagauaacgugauacaccuaagagaauaauauguaaggaaguaacggaacagaauuaaugaauuagaaauugauauaacaaaaguucucauggcugaucaacgggaaaaggaaacacacauacuaggugugaucuuggcucacugcaaccuccgccucccagguucaagcaauucucaugccucagccaccccaguaguugagauuacugugccaccacuuuuggcuaaucuucauauuuuuaguagagacaggguuuugccaugauggcuaggcuggucuccaacucuuggccucaagugaucuaccugccucggccucccaaacugcugguauuacauacgugagccaccguaccaggccuguuuuuuaaaucaugaaagaacacuaagauccacuucaaaauguuuuagaacuguaaugaaauaaccuuuaaaauauguaaaagaguagcaucaauguccuaaguuaaaaaacauuaaaaaaugaauagucaaaaguguauuucaacaaaugacuugcggcauagaccagguguugugaaugcugugguuucaauguguccccauauuuuauguauuggaaguuuaaucuguauauauugauuggagguggggccuguggagguaauuaggauuagauaaggucaucagggugggguggggcccccaugaugucaggccuguuuuuauaaaaagagaaagagaccugagcugacaugcuguaguucccuugccaugugaugcccugcaccgcgucaggacucugcagagucccuaccagcaagaaagcccucaccagaugcaccugccugucuugaccuucuagccuccaaagcugugguaaauaaauuucuuuaugaauuacccagucucagguauuuaguuauagcaacagaaaacagcaugugacaaugaguuuugccaaucuucaggaaacaguuacucuuuugcaaauuguuacaaugaauagagacaugaaggguaacaaguuuaucaggauuguaugaauacauuaucaaaacuacauaacgacaguaaagaaaaaacuaugagacauucucagauaucaaugaaauggcaaugaaaaaucaguuuaugauacaauaaaacauaugucuauauaucuuaugauguuuacucuuaugugguuugacauuuuaaaguuuuaauguaguauucuacuuuaguagguuaaaaucucaagaaaaaggcuuucuuaaaauuaaacauucacucaugaauuucuuuaaaauguugggcaaacaagcaauagaagggaacuuucuuaaccuaauaaaggacauuuacuaaaagucuguaagagauauaauaauaguuaaacuauagcaaaacuaagaaacuagaaaagaauaccacuaucaccacuucuauucacucuaauagcgaguacuacccaauacaaaaagacagaaaaggaauagacaagacaaaguuguccuauuuguagucaauauaauuaucuauauagcaaacccaagaaaauuuguauaauauuaaacuaguuggcaaguucauuauagcuauuggauaaaagaucagccuguaaaaauugguagcauuacugugcucaguuacaguccauugaauauauaauauuuuuaaagacugcauucacuauagaaauaagaccauaaaguaccuggaaauaaaccugacuaaagauacacaggaccuuuguuuuuaaaaaaaaaaaaaaaaaaaaucauaaaauuagcugggcacaguggcuuacuccuguaaucccagcacuuuuggaggcugaggcgggcggaucacaaggucaggaguuugagaccagucuggccaacaugaugaaaccccaucucuacuaaaaguacaaaaaauuagcugggcguaguggcgggcaucugugaucucagcuauucaggagguugaggcaggagaaucacuugaacccaggaggcggagguugcagugagccgagauugugccacugcacuccagcccgggugacagagugagacuccaucucaaaaaauaaauaaauaaauaaauacauaaaauuagauucacaaggaagaucugaauaaauggaaauauauacuauguucagggauggaaagacucaguacuguaaugauaccaguugucccccagauaaucuacaaauuuaaugcauagcaagcugauccuaaaauucacaugguaagaaugaggagcaaaaauaacaauuuugaggaagaacaaguugaggggacuuguucuuguccccuuaaguacuuguuagguaaaguaccuguuagauaaagucuugccacauauuaagacuuacuaugaagccagaguaaacaagaguguaguacuggugcagguaacaauuagguagcagaacagaauaaagagcccugaaaaaaauauauacauagauacuucuccugaaaugugacagauauuacauuaaucaguagagaaagagugaacucauuaauaaaugacacugggucauaccugguuaaauggaaaaaaauucauuccauaacacauaauucacagaaaguacucaacagauuaaaaaucuaaaaaugaagaguagaacuucaaaagaaaauauaggagaacauauuuaugacuuugacauaggaagguuuguuaacacauagaguaaaccagaaaggaagagauuaaguuuuaaaacuucuguucaagaaaagacaccauaguuauaagggaagcacaaaugaaugaaguuggaaccauguaccauauccgaaaauuaacucaaaauggaucaaagacaauguaagaucuaaagcuauaaaacucuuggaagaaaacaggucugaaucuucaauuuggcaaaggaugcuuagauaaugccaaaagcacaagcuauaaaagaaaaaguagauaauuuggacuucuucaaaauuaaaaacuguguuucaaaggacaccaucaagaaagcaaaagacagccuacagaaagggaaaaaauauuugcaaaugauauuucugauaagaguaguauucaguguauauaacaaaaagauaacccaauuuaaaaaugggcaaaggauuugaauagauauuucuccaaugaagauauauaaauggccaacaugguacauuaaaaaaugcucaacaucauuagaaauuagagaaaugcaaaucaaaaccucuaugaagccugagcaacauagugagacccugucuuuacaaaaauuagaaaauuugcccaggaugguggugugcaccuguggucucagcuacucgggggcugaggugggaggauugcuugagcccaggagguugaggcugcagugagccauaaucacaugauugcacuccagccugggugacaagguuagacuccaucucuaaaagaaaaaacauuaugcaguaccacuucacaucuacuaagauggcuaaaauuuaaauaaagggaaaguaacaaguguucaugaagauguggagaauuugagacccucguauuuugcugauagaaauauaaaacagagcaacugcuuggcagacaguuugcugguuucucaaaaaguuaaacagaauuaccauaugauccagaaauuucacuccuagguauauacccaaaagaacaaaaagcagagauucaauccuauacuuguaugccaacauuuauagcagcauuauucacaauagccaaaagcugggaacaacucacauguccaucaacagaugaaugguuaaauuaaauguauaugguaaauacauuacaguagaauauacaguggaauauaauucagcuuaaaaauggauaaaauuccaauacaugcuacaacauggaugaaccuuggaaacguuaugcuaauaaaauaagccaaacacaaaaggacaauauuguauguuuccacuaauaugagguaacuggaguagucaaauucauagagacagaaaauagaaguuaccaaggguuacggggaagaggcaaugaucaguuacuguuuaauggauacagaguuucaguuugggaugauagaauaguucagaucuggaaauggaccguugcacauugucuauuaaugccacuuaauuguacacguaaaaauggcuaaaauggaaauuuucauguguauauuuuaccacaauauaaaaaaaauuaggccgggcacaguggcucaugccuguaaucccagcacuuugagaggccaaggcgggcggaucacaaggucaggagaucgagaccauccuggcuaacacggugaaacgccaucucuacuaaaaaauacaaaaaaaaaaauuagccggguguaguggcgggcgcuuguagucccagcuacucgggaggcugaggcaggagaauggugugaaccugggaggcggagcuugcagugagccgaggucacgccacugcacuccagccugggcgacagagcaagacuccaucucaaaaaaauaaaaaauaaaaaaauaaaaggggguguugaaacaugcuacaacauggaugaacuuugaaaauguuaugcugaacacaagaagccagucacaaaagacuacauauuguaugauuccauuuacauguaauauccagaauaggcaaauccauggagacaaaaaguagauuuaugguugccuagggcugagggguuuaggggauugggagguaauagcugaagagugugugauuucuuugagggggugauaaaaauauuccaaaauagauuaugaugguaguugcacaauucuguuaaacuaaaaauaaucucauuuugcccauuaaaugggugaagugaauguauuagaauuuuaucucaauaaagcuuuucuaaaaacuauaaauuaaaauguaaagucaagcuaauaaaaauggucaaaagcuauuaauaaacaauucucagaagagaagauacaaauaaauggcgcacaaccauauaaguagauucucaaccuuacuaguaaucagggaaauacauauaaaaauaacacuggcauagucucacaacaucaggcuaacaaauuuuaagucugauaguaucaaauguugacaaggaaguggacaacugggaaaaaucacugcugcuaaguauauaaaucgauauaaucacuuuggaaagcaacuuccccuucuaguuuacaugcucuaaaaaauauucaugcauaugugcacacuaaguuauacaggcauaccucagagauaucguggcuuagguuucagacuacugcaauaaagugaaugucacaauaaagcaagucacuauuuuuuuggcuuacagugcauauaaaaguuauguuuacacuauccuguggucuaguaagcaugcaguagcauuaugucuaaaacaacauauauaccuagauuuagaaauacagcuaagaaaaugcuaauaauccucucagccuucagugagucauaaucuuuuugcuggugaagggucuugccuugauguugauggcugcugaagguuggggugacuggcaguuuaaauaauaagcaacaaugggguuugacacaacuguucgcucuuucuuuuaugaaagauuucuguguagcuggugauguuguuugauagcacuuuacccacaguagaaauucuuucaguauuggagucaauccucucaaacucugccaccguuuuaucaacuaaguugauguaauauucuaaguccuuuguugucauaaaaauguucauaguauuuucaccaggaguagguuccaucucaagaaacgacuuuuuuuuuuuuuuuugagacggagucucauuuuguugccaggcuggagugcaguggugugaucucggcucacugcaaccucugccucccagguucuagcgauucuccugccucagccucccgaguagcuaggacuacaggugugugccaccaugcccagcuaauuuuuguauuuuuaguagagagaggguuucaccauguuggccaggauggucucgaucucuugaucucgugaucugccugccuuggccucccaaagugcugggauuacaggcgugagccaccgcgcccagccaagaaaccacuuucuuugcucauccauaagaagcaaauucuccauucaaguuuuaucauaaacuugcagcaauucaagucacaucaucaggcuccacuucuaauccuauuucucuuucuauuuccaccacaucugcaguuacuuccuccaacuaaagucuugaacuuuucaaagccaucccugagaguuggaaucaacuucuuccaaacuccuguuaauguggauauuuugaccuuucccauaaauaacaaauguucuuacuggcaucuagaauggugaauccuuuccagaggguuuucaguugauuuuauccagcugcagcagaggaaucacuaucuaugucaguuacagccuuacagaacauauuugugaaauaauaaaacuugaaggucaaaauuauuccuugauccaugggcugcagaauggauguuguguuaagagacuugaaaacaacauuaaucuccuuguauaucuccaucagagcucuuaggugucuaggugcaaugucaauauuuugaaagaaauuuuuuuuuuucugagcuguuggucucaauagugggcuuaaaguauucaguaaaccauguuguaaacaguuguacuaucauccaggcuuugcuguugcauuuauagggcacacccagaguagauuuagcacaauccuuaagggcccuaggauuuucagaaugguaagugaacacuggcucaauaguaauggugaagaaguuugaaauauuucgacacagagacaaaauuagcacaugcuguuggaaaaauggggccaaaagacuugcuucacacaggguugccacaaaucuucaacuuguuaaaaaaaaaaaaggcaauauaugcaaagcacaauaaagugaagcaccauaaagugaaguguaccugcauaccaagugcaaauuacagaauuuuuuuuuauaauugugaaaaacaagaaacaguuaucuaucaguggagaauggauuagagaaaacugauauauucauacaguagaauauuauaguuuuaaaauaaacugaaaggaacuguaugaaucaaaauagaugaaucuugaaaaauuuuugaguauaaaaggcaacuuauagaugaauguauacauuaugauauuuggcauaugaucauuucugaauuggaagagaccuaagcuauaagcaucucuucacauuuuuagucuucucuuccguccacuguauucaugccugacuccauccucuuguuguuuuugaaacuuuacuaucaauuucuguaaaacguaauagacuccaauuucugguguuauauuaugauagcaauuuuuaguugagaagaaaguugaaggaguuaaaaauugggaagucaacuaagagccagcucaaggaauccaguaugacuuggaaguuuacaugccauauugcaaaaugcaacaaccagaacucacgucuucugauuucugaucuggugguauuacuguucaaucauuucuuaaaaagcaaucugaggccaggcgcaguggcucacaccuguaaucccagcacuuugggaggcugaggcaggaggaucacuugaguccagcagaucaagaccagccuggucaggccgggcgcgguggcucacaccuguaauccuagcacuuugggaggccgaggcgggcggaucacgaggucaggagauagagaccauccuggcuuacacggugaaacccugucucuacuaaaaauacaaaaaaaaauagccgggcgugguggcggaugccuguaaucccagcuacucgggaggcugaggcaggagaauggcgugaacuugggaggcggagcuugcagugagccgagaucgcgccacugcacuccagccuggccgacagagggagacuccgucccaaaaagaaaaaacaaaaaacgaccaggguggucaacauggcagaaacccugucccuacaaaauacacaaaaaauguaaccaggcgcgguggugugcgccuguggucccagauacucaggagacugaggugggaggauuguuugagcccagggggcagagguuguagugagccaagauugcacuacggcacucuagccugggugacagaguaagaccaagauccuguuucaaaaaaaaagcaaucugaaaaauaacauuaagggugauuuaauucauaacaaccuuucguuguuucauucccuucugccuuuuucuacuaugcuccuccacuagauguccuauuccucuugcuagaauuacccuuuauggaaaugagcucaugcuagaaucuagagcaccauuuucauaauaguuuuauacaagauagaagaguagcgacucuauuucuccugcuaaaaucaagauaccuacucucuuuuuccccagaaaucuucaaaaccaguagauucuggucuuuuuaacugagccauuagaauuuaguuuauugauuggugauauuaaugauggcaaaauuuugggcaguucggauuuuguuuaauuguuuugugaaauuaucacaaugaauuuuagaugacaugaacuguuacuucugguuuauagaauacgaaaguacauguccaccacugagaacuauaaaaacaugucuggcuucaguauucuaaauguuuauaccuuaccuaguuguacauaucuauauucuuuguuguugucaaguuaagauuuguuuucuagaaccaaaagucugcccacucuuauggccauguuuguugauaauacucuacuggaaaccuuuaaugagagcuguuauaacauauaaggauuuuauuauucaucagaaagaacugauuuacucucuuacuugagaauauugggaucucuucuauuaaaauuauaauuaguagucauauaauuuuugcuuagagacuuucaaagacauacauaauugugcucgcauagucgugccccauaauuaaaucuuucuguguuuguaaugguaaauuauuuauguuuuaccuucuuuauuuucuaaggaacuggcauuugauccauaugaaucguaugcucgagauauuuugcgaccugguuuucaugaucguuuccuuagucaguuaucaaagccuggggcagcacuuuauuugcagguauaguaauuuuuaaaugaagauguacaaugucugaaaaguaaacuuaaaaaaaaaauuaaaucacuuuuuuuuccagucaauaggcgaagguuucaaagaagcuguucaauauguuuuacccaggcugcuucuggccccuguuuaccacugucuccauuacuuugaacuuuugaagguaagaaaacucuuuauuguuauuuguaacauauucaagugugaauuuuuuuuuuugcuacuucauuuguaaauuauugugugaguacccugcacauuaguguguuucuguuuucuuuuuccagucaagaagcaaauggaaaucagucugcaaaagaguagcauauuuucucgucuuaguagugaauuuuauuuuuguuguuuuuuaauuuuuuuguuuuuuguuuuuucuuuuuuuuauuuuugguuuuuuagugaauguuaaagcaauugucagauauuuuugucuuguaccuuuacuuuuuguuuacauggcugauucuuugaaaacaaccuuggauuuaugcaucgcaguuuccauuuggggaccucagcagacucagggacucagugugaggauaagggagccagugugaggauaaggccaaaguaauggggaagguuaguuuaccugacuuucauagcucaaguuugcaacuaucuguauuaaacuguuuaucauuacuuuagaaacaauaaauuucuguaaucucaguaaaaauugcccauuugaucacaguucaaaauacuaagcacugacugaaaggaaagggguugucucuuuuuucuuuuccuguuauauacugaaauuaaauaaaagucuguauaaauuauaauucaauaguguagcucaaagugauauucucucuaccuuuaauggacuagccuuguaaagacaaaagaagacaugcauuaauagcguuauuauuucuuuagcuuucaaaugaguauuuguuucaucaaagaaaacuucuguuuaguaucaugauucuuucacagagaauauauuacuggaaaucauauuuauaguuugcagaugauaaaaugggcucucuguaaugaaucaaugaaugaauagaaggucugugaauuuauuaacaguaaacuggaggaacucucauccuuacauuuucucaggucucugcacugcauaguagucauuuggaauucaguuugauuucucaauuaggaauguuuacauugagaaaggacuaagggaguuaaaagguauuuuuaaucacuaggcagaaaugacaaagcucuuagcaauagcauaccauuuaaggucuuuggaaauacaggaugaguaucuuaagaggauaaucaagagaggaagcauuuaguauguaaaaucuuuagaaagaauucauuauuacuaacuauaguuauaaugggacauuuacacacuguuuuguuauauagaauuuuucuuuguaaugguuucucuaauaacgggauuuuuuuuuuuuuaaccugagccuguaaugaaauucagaaagauucaaaggccauauaaaaucuuaaggccguuaucaguuuauaaauaaaaacaagaaugccagguguguuggcacacgccuguaguuccagcacuuugggaggcuaagacaggaggauugcuugagcccagguguucaagaccagcuugggcaacauggcaagacccugucucuacaaaaauagaaauaaaauuagccaggaaugguggugcacaccugugguuccagcuacucaaaaggcugggcaggaggaacacuugagcucaggaggucgaggcugcagugagccaugaccacgccucuguacuccagccugagaaacagagcaagccccugucucaaaaauacaaaacaaaacaaccuuccccuccaaaugaacccaagaagcuuugaugaaaguucagaaggcuauaaaacccaaucaucuuaauaauauaaaagaaauuuuuacuccuucaaguguaggcaauuaaaauuucuaaaauuauaacuuacauuaauagaauuuuaauaagugcaucauuuagcaauuuaagauuucuacugauuuaagcauguguaucccuuguucguauuacugccuaaguuauauugcaaaguuagcaguauauugggcaggaaauuuugucuaauuaguccacaagacucucaucacuuuuuuuuuuuuuuuuucugcacaccuauaaucccagauacucaggaagcugaggcaggagaaucaccugaaccugggaggcgaagguugcagugagccaagaucacgccauugcacuucagccugggcaaaaagagcaaaacuccaucucgaaaaaaaaaaaaagaagaaaaagaauuuccuagcagcccuggauaugccaaauguguucaggguuccauggguaucccgguucauauuacugccucuucgcuuguucuuuuuucccauuuaucuggaauuccucuucuacccucuccaggcuggagugcaguggcaugaucucagcucacugcaaccucugccucccagcuucgagcgauucuccugccucagcuucccaagcagcugggauuaauuaaaggugugugccaccacagccgacuaauuuuguauuuuuaguagagacaggguuucaccauguaggccaggcuggucucgaacucuugaccucaggugauccgcccaccucagccucccaaaagugcuaggauuucaggugugagucaucaugcccagagugaguuccuuccuuucuuuacauacaucucuuuagagaacuuguuccauuuuuauugucugccuuaucauucaacuguuugcucugugaagaauggagcccuauuaucuuugaauucucauaccuauuacagugucuggcauuuaggcuuucaauaaaugcuuguuaaaaaaugaguggcaaaaaauauauauacauuuuccuuuaaauucuuaugucuuauauuuuaaagaaaguuuaacuguaaauuuuauauaauuaccuuuauuuuggaaacuuagguagaaugccuuaaacuuuacaaagucaaaagauaaguuuagcuauuaauaguauaagacuguugaacacaaagaaacaauaaaauggugguuaccagaggcuggaggguaggggaguagggagauacuggucaaaugacacaaaauuucaguuaggagguguaaauucaagagaucuaucguacaucaugguaacuacaguuaauaacaauacauugcauauuugaaaacugcuaagaaaguagauauuguguucucaccacgaaaaaaaguauguguuaaugcacauguuuuaaguagcuugauguagccauuccagauuauauacaucuaucaaaagauccuauuauauaccauaaacauaugauuuuuacuuguugauuaaaaaauaaauuaaaaauagugugacuuuaaugcugcugacacugaaaaaauacucuuuccuucagcaguuaaagauagcagucaagucuucacucuuuaacuugaaaaguuaaaguuaauuuuuuuaugaaguaaaaaaacuuccuuugugcccuuuugaaaaccauauugcuucaauaaugugauuuuuguaugugaaguuuaauuuacuucauuaaacaaauuuagauuucuuucuuggggcuaaguaaauauauugaccaguauuuuauuuuauuuuuauuuuauuuugagacagagucucacucugucgcccaggcuugagugcaguggcaagaucuuggcucacugcaaacucugccuugcggucugaagugauucuccugcuucccaaguagcuggaauuacagacgcccgccacuacgccuggcuaauuuuuguauuuuuaguagacaaaggguuuugccauguuggccaggcuggucacgaacuccugaccucaagugaucugcccaccucggccucccaaagugcugggauuauaggugcgagcccccacaccuggccugaccaauauuuuaaagguuagcaaaucaguacauguuugguuccacaaagguauuaacuuuuucuuuguuccuuauacaugggauuuuaucucccucuccccaagaugcacccaaacaaaccuuagaaaaaaccauccaggaugacuuugaauucccuagagaauugccuauucuuuuucuuguaugcuggguccuuguaaccuaggggaaaguaaguuucccucuauuuuaaaauucagguugaagucuauguuguuguguguacaugaguguauuugguuuccuaaggcugccacagcaaaguaccacgaagucagaggcuuauaaacaacagaaauuuauucuuucacaguucuggaggugaggaaucugaaaucagggugugggcagggccacacuuucucuaaaggcucuaaggaagaaucccugcugccucugccuagcuucugguggaccccagcgauucuuggugguccuuggcuuauagaugccaucacucccgucuuugccuccaucugcacaucagcuucuucacagcuucacguucuucucuaugugucugcauccaaaucucgcuuuccuuucucuuacaaagacaccaagucaguggauuuagggcucacccuaauccaagaugaucucaucucaacuugauuacaucugccaagauccuauuuccaaagaagaucacauucauagguaccagggguuaggacuugaauacaucuuucaugggggacacaauucaacccuuaacaauaaguuuuugguacacuauaaaaauuaaauuuuuguuguucugauucuccagcauauacacuggcuacauuggcuuuauacgcuggcuucccccuaacacccccaucccucuuuuuuagagauaggucucgcucugucacccaggcuggagcgcagugguaugaucauagcuugcuacagucuggaacucaugggcucaaacaaucuucucaucucagccucccaaguaacugagacuacaggcaugcacuaccaugcccaacuaauuuuuuuaaauuauuuuuuuguagagacaaggucccauuuuguugcccaggcugaucucaaacuccugggcucaagggaucuucccacauuggccuccgaaagugcugggguuaauggcaugagccaaugcacccagccuuuucuuucccccucuuucgcuuuuuuuuuuuuuuuucuguuuucuuuuuuuguguuaggccaauuaaucauuucauccugaucuuauauuuuuuauuuuuauuuauuuauuuauugagauggagucuuguucugucacccaggcuggauugcaguggugcuaucacagcucacuguaaccucgaccaccugggcucaagugauuccucagccucacaaguagcuaggaccguaggcacaugccaccacgccuggcuaauuuuuuaaaauuuuuauuuguagagaugagacgucgcucuguugcccaggguggucucaaacuucugggcucaagggcuucucccaccuagaccucccaaaguacagggauuauaggcguaagccaccgagucugguggagaaucaauggagguucucucuaguguacauucccuugaaccagcuuucuaaauucagaaauucuuaucuagaaaccaucggcucaaagcuacaugguauuggagcugaccacaaauguugaaugucuaaaguuaaacauaggauagcguaccacaggagccauuguaaacaaacagcuaacuauuguauuacuccaauuuuuaauuuaauuuuuugguuuugguguuugggguuuuguuuuuuguuuuguuuuguuuuugagacagggucucacucugucacccaggcuggagugcagugguacagucacugcucacugcauccucaaccucccaggcucaauuaauccaccuaccucagccuccugaguagcugggacucugguugugcgccaccaugccuggcuaauuuuauuuucugguagagacggcaucuggcuauguuguccaggcuagucuugaacuccuggacucaagugaucugcccaccucagccucccaaaaugcugggauuacaggugugagccacuauaccuggccaauuuuuaauuuuaaauaaacuugacugcugugagguacauuuguaguuagugauguuuucucugauuagaacagagaggugguuuuaaaagauauguuuucauaaaugacauaucguaacauuuuuuaggguugauugccuguuuaauguuuggaauugaaauuucguuuuaauuaagaauuucaucuucuccacccauaccuuuuaggugugcugguaccauaaaauaauaauuuauuugaaugucaugaccuuucuuucccucagcuuuuaguggaauguuuaaaaugaugucauggcaaacaggagcaaaagccuugaauuacacagcaguuaguuaauuaguucuggaauaauuuggauaauauuucauacauuugcuaagagggcuaguaaaucaaguguuacucuuugcauuuucuauguuguaauccacuguggugucucaucaaacgguaugcaaauaacauuccaaaaucgaaaugugaaccuaaucuuugcuuguguucuguuacguugugaugagcucuauguauauaauauuuaaaauaaauggagaucuuuauuuuuauaucccaaauguuagacaauuacaauguauauuucuuggguguauacuuugucauucuugugcauugcaauuuaccuguucuauggaauagguuuuauuuagugaauauugagguuuuucaaagucauuucaguuauuuggguaccuauuauagugaaaagucacgggacugaaagucaagaauuguggaucuaguaccugccuguuagugccuucaaguaaaugguaguuccuucguuguauacaaugccauguuggaggaaauuaauuccaaggaauaaaaacgaauucaagcauuccuuuuuuuaaucaaagggaagccauuauaugauugugagugaauugagcauauaaaaugcacuggguacaacaauuuauuuuuuauguaucaaacacucuugaguuuuagucuccugaauacugcuauauucuuuauauucauuguagcuuuuucuuuugacagcuccuuacauuuaaucccauuuaucucccaggguuuccuuugcauauggaacacaccauauugacuauugccucuuuacuuauuucuaagggaccaaaaaaauucgucacugguaaaagugguuucuuucuugugaaaaguuaaauuuuaucaucucaauagagcauaugaguuuucauucugcuuuaaaauaugauuccuggcugggcacaguggcucaugccuguaaucccaguacuuugggaggccaaggaguucgagaccagccuggccaacauggcaaaacccugucucuacuaaaaauacaaaaauuuucugggugugguaacacgcagcuguaaucccagcuacucuggaggcugagguaggagaaucgcuugaaccugggagguguggagguugcagugagcuaagauugugccacugcacuccagccugggagacagaacaagacuccaucucaaaaaaaaaaaaaaaauaauaauaugauucccuagaugaguuuaaguacaaucucauaugguaauauaaucucaggauuuaguacuuuuuuuaaaacuauucaaauaaacugccuuuguacaaauguaauuguuacuauugcacauuauuauuaaauaggcacucaugaaaagcaugguauugaauaucacugguaacaagaggaugcugcuuuguugagucucauuuacauacuaauugccacugcuuugucucuguagccacaauaagccacccuuuugaugguaguuagcuugaauuauauugcaccagugccaaguuuaaauuagcuauguuaaguaaaagaagcaaaaagugguagaagaaaggucauuuauuacacugaaauuuauuuuagaggcuugccuaaugcuauaaagguaaaaaugacauuuuaaaaguauuucaucaggaaaguuuuauggguuugaaauguacuuuggguuuguggcuuuuaaaauauuaacauuuuugagauaccagaauauucuguauguaaaaugcuacaguuaaauaguagauaaaugauuccaaaacuugaaacauuuuuaggauagaaaaucaaaggauguccaaguggauuuuuucuuuuauaaauauuuuuauguguaugagaauuauauauuuugucuaccauuagguauguuuuccugaauuaaaaauauaaaaaauguauccaggacaaaauaucaaaugcucaauauucugcuaccuguuaguuauuuaagaccgaaaaauugccuuguaucuuacugacuugaauuucucugggcuuugcuuuugagugauuaaauucucaaucaacucagugaacuaauucaucguucaguggugcuuucauuaaauuugccuuaagguauacagcaagcuugucuaacccccggcccaacacaaauuuguaaacuuucuuaaaacauuaugagauuuuuuugcaauuuuuaaaaagcucaucagcucucguuaguguuaguauauuuuauguguggcccaagauaauaauucuuccaguuuggcccagggaagccaaaauauuggauaccccugguauauagcuuucaauguuagauuaucugcugcuuuaaagacuaaacuugauaauguuuaaugguaacauuuuauuugucucccagaauucugccaugugagaggcaaauaguuucaaaugauagggauggaagguacuuugagagauuaccuggauuccagccuucagccuacuaguaauaucuguuaaguaaaaaccuaguaucuuucuuuaugaacccuggccauuggcuuucuuuaaucuagcuggccauauugaagaacaauauuaugaauaaaagauauuugauuuuuguauuaauauguacacuuuuaaagucucuuauccuuuggaaaauaucuuucguuacccuuuuuauguugagaauuguuaggaauaaauuuuucuguuuuuuuuuuuuuuuuuuuugagacggagucucacucuguugcccaggcuggagugcaguggcacgaucacggcucacugcaaccucugaccccugaguucaggcgauucuucugccucagccucccgaguagcugggacuacaggcgugugccaccacacccagcuaauuuuuguauuuuuaguagagacgggguuuuaccauauuggccaggcuggucucaaacuccugaccucgugauccccccgccucagccucccaaagugcugggauuacaggcaugaaccaccgugcccagccuaaauuuuucuuuuacuuaacacaguuaagacugaaaauuuuccuaaaaauguagauuaugccucuaguagaaaguauggugaguuuuuaauaaugaauauaagaaaucuggauaauaaaagcuaaguauuaaacauuacaauaugguauucauuacuucuagaauauuugaccauuaaaguauuuuaaguaaauuuuaauaaaaaugguuuagaauauaaguaagaaaucuguuuacuuuucacaggucaucagugcaugugguaugugcaugcgcaugcauguaacugauuuuuaucaauugaagcagaaaggaauguguuguugaccuuuaaggaauaccugugaaaaacacaaaauccuuaaaguacuaauguacuaaugaauacuuaagcuaauugaaaaguaaacuucuagccaggcaugguggcuuacgccuguaaucccagcacuuugggaggccgaagcaggcagaucacuugaggucaggaguuugagaccagccuggcuaacauggugaaaacuugucucuacuagaaguaaaaaaaaaaaaaaaaaucagucagguguggugacagacacccguaaucgcagcuacucgggaggcugaggcaggagaacuacuugaagcugggaggcagagguugcagugagcugagauugcaccgcugcacccuagccugggguacagagcaagacuccaucuaaaaaaaaaaaagaaaaauaaacuucuuuauaaaucacuuugaauauuucaugauuguguaucucaagucuuuucauucaugguagagaguagguauuccuaaauuguuggaugaaaacucuauugauaaaauguuauuuuauuuuauuuuaauagacgguaucucaaacucguaggcuuaagcgauccucccaccugggccucccaaagugcugagauuauaggcauaggccauugcagccagccaauaugugauuucuuaacuuuuccuuuugguaaccaggaacagguuuaagauguaugagugaauuauugugacucauacaucuguuaagugcuugcuugaaucauagccaccuuacuguauugacaauuaguuacugaugacuuaguucuuguuaaguagagacguucugucugacacagauauuugccaguaauagaaaauaugcuugaguuucaguuucauaaauauguauauuauagcuucacucaaaaucuuaauguggauauggacaaaguucuuuauuauacuaauguuaauucuguaguauaauuacaaagaaaaccauuuacacuuacauuguguguuaccauuuacaaagugcuuugguuuuuaauaacaaccccuaaaaguaggcaggguaggcuuuuuauaagccuuauuuggcaaaugggaaaaguaagacucagagaucaagugacuugccccaaggucacacagaaguagagucaaaauuugauccuagauuuuguaauugagauuccuucuacuauauugcaucguucucuguauauuuaucuuccuuaucaucucaauauuauauaacaauaauauaggggucagaaaccuaagaccaaauuccacacuuaaaaaaaaaaaaaccucgucuacaugcuuagugguaugcuaacucuaugauaauucaguagaucgauuaugcuccccauuucuuuucagugguaugcaccuugaaaaacuacauauuacugccugucacaagauauaacccaucuuaacacugcuaaucuuggucuuuuaauguagaaaacuugguuguguauuaauaguaacacacaagaaaaacacuuuuaaaaagaauauuugaugacacauuuaaaauuuuuauugugacaguugaauaaauguuauuuuuauccuuaaaugaguuuauuauuauuuuauccaaaaauguacuacugguucagauuugucauuuuggcuuuacagcaguuagaagaaaaaagugaagaucaagaagacaaggaauguuuaaaacaagcaauaacagcuuugcuuaauguucagagugguauggaaaaaauauguucuaaaagucuugcaaaacgaagacugaggugaauauuuuuacuuuuuaaaauauccuuuuuucccugaauauugugguguaaauucagggaucccaguucccuccucaaguaaacaaugaagaaaauaguuuuagugacaagccuggucuuuuagaggaagugacaucaaagccaagagaauuguuauuguuugaaaaaccuuucauauuugugcauuuuccuugcauacucccagacaagaccuccugagagucaacugguaagcugaaggagagacagaguaaaauguaucggguagauuuauguuggcaucguuauucugucaaaguaaaauuauuaguguccuuuauuuuagggauuauauaacuugaggcauuaauucagauaacauugcuuccacuuuccugauuauaauaugugcuacauguuuuuagcuuugggucuuguccauuuaaacucuucuaaauaauuuauuuuaaucuuucagauuacuuuuuuuuacuguauugggcuacuuuuuauuaguugucauucuaaauauuuaguagccaagauagaaauaaucauuuuguaguuacauuuaaggagaauuuugucagcaaucauugugcuuuuuagaacacugaaaaaaauuucuagguugcuuuaauuuucaaaauuguguaauuuuguaauucuaaucuauuuggggaauuagugaauaccuucucagugagacuuguaaaaaucuacuuuuacacuuucccuuacuuacaugagcucuagguuuucugucaucuauguacuaauaaugucuuuuucuuuauuccagugaaucugcaugucgguuuuauagucagcaaaugaaggggaaacaacuagcaaucaagaagaugaacgagauucagaagaauauugaugguugggagggaaaagacauuggacaguguuguaaugaauuuauaauggaaggaacucuuacacguguaggagccaaacaugagagacacauauuucucuuugauggcuuaaugauuugcuguaaaucaaaucaugggcagccaagacuuccuggugcuagcaaugcagaauaucgucuuaaagaaaaguuuuuuaugcgaaagguacaaauuaaugauaaagaugacaccaaugaauacaagcaugcuuuugaaauaauuuuaaaagaugaaaauaguguuauauuuucugccaagucagcugaagagaaaaacaauuggauggcagcauugauaucuuuacaguaccggaguacacuggaaaggaugcuugauguaacaaugcuacaggaagagaaagaggagcagaugaggcugccuagugcugauguuuauagauuugcagagccugacucugaagagaauauuauauuugaagagaacaugcagcccaaggcuggaauuccaauuaucaaagcaggaacuguuauuaaacuuauagagaggcuuacguaccauauguacgcagguaagaauuaugcaguugccugucacuuuuguuuuccugcuucaaacugauuuucuuuccugcauggguuuauugugccuaaaauagaaaagaaacuaacaaccaaagaccucuuuucuuugacuaaaaauaccccacuuuauauuucuuuggaauguuuuacuuuuucuacuacacuuaaauacuuuuuuuuaaccuuaccaucaguuauagaugagaaaaugaggucacuuggcuaaauuuauccaguuagaaagugacagaaacaagacuaaaguuaguaguaaaucaucauuauugggaucuaaaaaguuuuuuacuccuuuaucuuuuuuuucuuucuucuuuuuccauuucugagauuauaaauaaaaauuuuaauauaacaaaauugugcugguaguacaaauauacacggcauugcuuucucucaguuuccacuccuaaaccugauuauuuaauaauaaauguugcaauccuggaagccaaggauuccaguuuuauuauaauuuuucaccuagaaaugucuauagucaguguauuuauuuuacugacccaaaaauuuaaaaaaucauaggaaauguaaauaggcugccuagauuuuacaugaaaaacaaauagguuauugucauuuuuuuccauauaaagcuguuuuuugagagguacaauuuuucgguaguaugaccugccgauuuaguugugcuucaccaaccuuuucuauguucuuuaugaucuagacuacaacuauaaaaauguuuuuuauucaguuacccaaaauuugugauugcaaaauacuucuuuucugcuuaagagauuuuuaaggcuauaaaaguucaaauugcccuucuugccacauuuuccugguuuuuaaguccccuuagaggacucauagaauuuuuauaacaugagcauucuaaacuuuaucauuucauccuaaguacuuuuguuugggguuccuagacucauuuggaguaaaauuaaucuuuagauuuuucucuguguuuguaagaaagaaguuuuaauuuuuuuuuuuuuuuuuuuuuuccuguagagcauuguaagaagacuuacuacuaguguuuacugucacaagucagugauacuugggcaggaaaacauuuucaaauuacaaaauuuuuaauuguuucuguaagacuugauugagugauagaaguuuucucuaaauugcuauauuucacaaaguuaauuuaugauuauuaauaagcagcugaagaaugguuacaacuauugucuggggaacugucccuuuuauuuauuuuuuuaaaugaggacacuuuaaagcaaaauuaacuggaacaagcugauacuuguuuuguaguccugaaagucuucuuuccuuaauguguacaauguuagguaaaguccguggacaugguacuuuuguaaugauguuuuauuaguuauuucugucugauacuucuuuucuauaucaauuuuuagcuuugguauagaguaauauuuugagugcuuuuacuuauaaugaauauaaaacacuuaaauuucaagauuuauagaacuuugccaaaguuaaguguauugaaaauuuaaguugaugagauuauuuuacuuaaaaaaaauguuuuuaaaaaauuccuuccaauaauuuuuugagaaauaaaaggccaguguuguggcuaaguuuuuugauauuuuucuuuucugucuucuuuugaagcuuaacugaauauuuuaauuuaugucauaaauauauuacuggugaaacuggagucuacaagcagcuuucgugaguugugguuuacaguacacacacauuaguguuaacuguuagcuuauuugggcuauucuguaaggucuguuacugaaguuauuacuggcaacauagaaugguuuuuaauagaccaucugugaacuuguaaaacugaaauggacuuuuaaggccucacuacaaugguaacagaucaaguuaccauuuguuuuuaagaacuacuggucugcucuucuccucucaucuuucuucagccuccccaaagagaaaagggauuugugauuugguuaguagguauguuuauuggagaacaugcaguacagguuguggcuuacacugaaacaaagcuaacauuuaacuuacacauuuuuauuuuauuauauagaauuguaauaaaagacauuggauauaauacaugagaaaauuuaaugaauacuauaagacacgacuuacagacaucuuuuagauuauuauaguuugguuagacauugucauaaaaacagaagagaaacugguuuaaccuuacuuuauucagacuucacuguggugucagccaacuuuaucccucaaauauuuuaacaguaauguacaaaauggagcuauagaucucuaaugcuagaagagaugcccaagccuucacuuuguagacaaaucccaaggccccugaagauuauaugauuucccagaaguucuauuacgaguuaauuccagaacaagucaagaauuagguuucuugacucuaaauagaguauauuuucuaccauguuacauugacucauauaaggugauuguuuucaugaauagaauauguuguaauuuuuuaauuauauguguuaauaauuaaguaaaaggaucugguacagaugugagcucaaaaaaaauaaauaaauuacuuccuugguuugaacugccaauaauauaaauggcuuguucauuucugggcaaacgugcguacuaugaagauauugucaguaauuuuuuuuucuugaaauaggauauagguaagcucugacuauagauacacuuccauuggaaugcauagauuuuuuauguauagauacuggucauuauuauuauuuuuauuuuuuuacaaaacccaauuauuagucuauugauguaguuugcucacuaaagggaaagcuuuguggaaagaaaaauuuaaauuuaggugaauuagaaagugguuaacuugcuuaaaagauugcaacagggucuuagguggaaucuaauuuauagcuugucucucagauucgguguuucuggauguaucauaauuugcugacuauaucagaacuuugggguuugucccaaaaacuaggggaaaaauuauccaauuggauggaucauucuaaaucuggcaaugguaugaagagacuauuuccuuauccuaaguaagaaagcacaaagcaauaugcacaaauaaaaaguugagaguaggaauuucacgucuguuacagaguuguuguaggcaacaaaguacaaguuaaugagaccuaaaacaacacgaguagauaaaugguagguggugcuguguccaguuugguagucuauuuuagaaaaaugagaugacccugaaguaaggauaauaauucagaauugacauuuuaugggaaauaaaagcuuugcauauugaagugagggaaaagguguuucccuugccugggaauuucucuuuuccagaagaugguauugaaaaaacuuaagccagaagaucguuuucuuuaaaguauuuacugcuauuuuauaccuucauagggaaaagccucaaaaaccugaauuagauuuauuuugaguuuguguccuauauaagcucaguuucgguguuuuaacuuauuuaaaucuuuugaacaauuuuucaucuauagggcagcgcuguucuauuuuuauacucucugauuuuuuaaaaaaguguuugugcgucagcauagcgucuguuuccuuuuuuaaggaauucaagacugauuguuuauaaauccuuguugaggagcuuauuguuucuuguagcuuuuuaaauggcugcauuaaagggagaauuaucacaugaacagacauccugauuauaacaguguuuuacuguggugguugggggugggguggucuuuacauaaauaacuuuuuuauguaauaaauacaaauuucauugaccuugucaaauaaaaugucaugucaaucaaaauaggcacauaaggaaaaaggauuggauuaucacuuccaaucuauauucugaacacuaauguagguauacucugaguuccuaaaauuuugaaguauugugcaguaaaauaucaaauaaugguuuuauagugaggaaaacagagacagaaggucagcagaaaaaaauaacuacagcuucuguuugaaauaaccugguuauuucuguuugaaaauaaccuagcuguuuugauugggggaagcagagcaacuagugaacaugguggaaaccuuagcguagggauuugagagucaaguagcaaaguaauguuaucucuaaugaugagggggaaaaacuguagaaaaaguuuugguuguugaccauauugaaauucaucaggagaucauguuugagaaagaauuuuguggaauuaucuccacaaguaagugauaaacagaaaggagaauauaaaaaugggcuauuuuuaauuuuuuucuaggauuauauguuuuugcuuauguuauaaagccaaacccagacuggcuuuuguauuuuuauguguuuaccuuucaucucucucugcaacaugguuuuagaauauggguagauaacugcugcuccacaacuaacaacggcaguauaaaacuuagcuuuuaccauugccuaaucaauggaacuagguauucuguuuucuuacagaauuauauaaccuguccuuauugaugggcauuuguuuauauuaucuuagcucuuuacaucaucaguaagauaaacgucuccagugguuagcgacaugguguguguuacagucauugaaauggagaaaccaauccaauagaaauaaaaauaaugucuggaauuuuuaugcuuuucuguguaaaauuucaaauauaaguacuuugucgucuuaguauguuuuucauucauuagcaauuuuucauugcuuuagacuaaaaacagaauauaaauuaauacaagccugggacuauaugcagccuuuaagauauuuuuugaaaguacuuaaauuuuugccagauuuucuugguuuguuuuuaguuucugcugcuuuugucuuuuuggcaagacuacucuuaauuccagucaagcuaaaaacaacucuagaaccuaauacaacagucaugauuaugggaguguuuauuucacugccagcugcagaaacccuguacagcauacaggaagguacagcuguuaauuccuaaaaucuagaauaaggcugaucaagaguuacagaaucacaauuagacugcuaauuuuucagugacuuucuggugccuuuaaccaagauuagcaguacagguacauucugaguuaaucauucauguaaauuucuauagugguuauauaacucaagguuuaauucuuuauauuuagaucucacagcuguggaaacuuuaaggguuucuuuaauccagggagguuauacgauaugauagaaaagagcacuaaaucaggaaucacaugaucuagguucuggguccaucucugccacucuacaguaugaccuuagauaagucuaguuacaucucuuccagcccugcucaccucacauaaaucauaugaaauaaguuaugucaaaguucuuugagaauguuacauaauagaccaagaauuggugugaucccauuugacuguggcacugagacacaucauggcuuucccagcauuauaaucaauuacuaaagaacugaaauggccagaaguuuuggcuuaagaagaugaaaagucuguuuagaaauagcuugccuuuaaacauagccacaguuuucuuaaaacauacuuuaagucacuuagaacuuggcuuuuauucuguuuuucaacuuaaaauuccucuugaugucccucaacuuuuuagccugauuuucauggcauuugagaaaauauggaggugaguguugauuuuagauuuuuagacugaaauaaacuuuuccuuuaaaaagggagagggcacccuaaauuuggaacacaggucaaggaugcuuggaguacucuguacugcggguaugggcucucuccagcagugacaacucagcaucucucuaguggccacugcuuuugcuuccuaaacaugcuguuuugaguagccucaccuuacaaauagauuugcagaacaggaagaagauucuugaaagggaagauugugaugaaaccgauaaaaaucucuguauuaaaaucuuguacagccuucuguuuuaauaucuuuucuucuggaugagacauuagucuuuaacuuuugaggaacucuguaacugaagacaaacaauaaaauaccaacagagaggaaauuauuaaaggauuauauguauuuaaauuacuuuuaucaguaacccacucuagccucagaagguauaaagcuaacggagaaggggacauuuaaaaccaauguauuuuuauucuguaaaucuuuaacuuaaaauaguauuuugaauucaagguugucugauauuuaaaucaguuauuaucucgaugaccacauaucaauagauuggaaguauauuucuguuuugugauaaauccaugaauuugcuuuuuggggaaaaagcuauuauaaacauguuauuuuaaggcuaaaccuaggaugggucuuagugagaaucagccuaaaugaaaauuuuccaaacaaauacauucugcuuuugcuaaauccuaugcuaauaaaagacauugugcuucuuauaaaacuuugacccacauuauguagccuaacagaaauaaaggcaucugcuacccucuaugaauuuacuauuggagucuaccagucccuaauacaaauaggaaaagaaugcucccaauaaaagacucaaguuacugaacuuuccccuccuuaaaaaaaaaaaaaaaaaaaaaaaagauuuacaauuaaaugugggccuugauaaaauuugaguuauagaagugagugauuucuccccccuauuaugggagaugucuuucccccucuuuaugcagaagacaacagcccaagucucuugugcuggugagagcagccuuucuccacaacuuaggauaauacuguuaaggagagacgggaguaggucaggccuaggggagugaucacacucagccucuuguuuuacuucauggagaugugaaugaaaaguagguccuuucauggaagggauuggagacuccuauauuuaugauugaccucucauugugacuacuugaaauaaaggcaauuaaagguuggaauaggaccaaaccaacauauucuaucacauuuaauaguuuuaauagcuuauaaguauuuguaagcaucuuuaaguaguugugagauuuuuagcaaauaauuuaaaaacuguauuuaacuuuagcuacuacuuuauaaguuccaauuuccaguugcaugcucuguuaacaugauuuaaagaaagcuagauaagucauccuagauaaacucaucuugauguaaggaaaaguaauggguuauugcuguggccuuucucuuuauaagggggauaaaccaacuggugauacuuugagauccugguagcaggugggaggggagccugguucccugcuuuaccuuugcuuuucuuucuugcucauuccuguggccgaugaguuuaagaucaucuugucagugugcagagggcaagaaauaaguugauguaaaguuuuaauaucaccacuaauuuaggaggcacuaagcuagcagugcauuaccaaguccaaagccuucuacuuggcaaaacauuuuggaacuuuuaaacuugacuauuugaucuauuuugaaaauguacauaacaguuuuaaucauuuugaaucauagaguuuaauaagauauuuuuccuuuuucuucuuagaucccaauuuuguucggacauuucuuacaacauacagauccuuuugcaaaccucaagaacuacugagucuuauaauagaaaggucuguccauuuaaaaaauauuuaaauucauuauuuuuuguuaaaaaagagauugagcuaagauccuuuucagaaauguuagaugagcuuuaaaauauacuucacaagcacuuuuucaauaaauaaaaucucuuagaugaacauuuauuuuauaauaauguuagcuuuuauuauuucaauacaaaaauauucuuuuuuguaugugaaaacucaguauuugaaauuucaaauuuacagaacuaaagaccuauauaaaauuuauagagucaagaaauucaaauucugaugaguuagauguucuaaguaaguuuucaaacauacuucauguugaguaaaauggaacuugucagugaacaaauacugugauggaaggaaaauauuucauguacccaaacaaagagcagucaguuuuucuggaauuacccuuaacagugauuaugucaccugauuuagaguaauuccacagaccaaaaaugaauaucagucccguaacuuuauagucacauuuauuuuuagaauuugcauguauucuuuauuuuguuuguaguuaguuuuaucuauauuggcaaguacuaauuucuuuuaaaaauuuuaaaauaauuuuauuagccuuuaauacuauaggagucucacuuguuuacacugauaugcauaucuucaguaauuuuuuacaguauucucuugauuuugcugacuggugaaaacguuugugguuuucuauuuguauaacucgauauaauuagucuuuucauuaauuuguucuauuuuauguuagguuugaaauuccagagccugagccaacagaagcugaucgcauagcuauagagaauggagaucaacccuugagugcagaacugaaaagauuuagaaaagaauauauacagccugugcaacugcgguaagcauuaaauaaaugaaguaaauaagucuuuaucaaacuuucguuucaauguugaaguauauaaggaccuuucccaaacaaggagaggggugacaauaaaauuaguaaauuaaauuuacuaauuagagcaguuaucagaaauuauaguauaagccuuaacauagaauuuuggaaguguuaagcacacugauaagauuaauuugguaagaguuacugcauuuucauuuguauuguacugugcauugugauaaacauuuauguuugauucccauguaauucaauucuguguuaaugccauagaguauuaaauguaugucggcacuggguagagcaccacuucuaugauuuugaaagagaugcauaucuuuugcaacgaauggaagaauuuauuggaacaguaagagguauguuuuuuuuuuuaggugccuaguuuuauauguaauaaaaguaccaacacggugacuaucaauugaugucauuggggcucaguaauguaagauguuuauaauaguaccagcauaaccauuucaaaaaguuaaaaauuuucaucaaauagcauuuagaccugcaaauggcucaagucacccuguugauccaauguauuuucauuuagugacucaacuuacugauuauuuuagaguugauuaagccaagucuucauauauaucccaaaguaugagggcauuugggaauuacguugugccauuauaacaccacugauggaggucgagugggccacaggcaaauagaaucagagaggaagcagaguggauuaaauugagacucuaugucuaacacugccacuaaucagauacgugacuuugggcaaaaucacuuagauucuuuagacuucaguuuucuuaucaauaacauaaggagcuagguuugucgaucucuaagguuuuccuucuaguuuuaaagauuacgugaguguauggcucuaaggauaucuuagacaaacuuauuuuuauuuccuuuguaugcucuaaaugauaaucagaaaauaguuaaauaauaguacuuucauguacaauauaaaacagagccacaucaaaacucacacuaaggaaucaguccucuggcacugauauuuauugguuuauaaaaugcaguguuaauuagaugaauauuguguauaaucuauccuuauaaaucuugugauuuacauaagauauaccuuuucuuggaggauuauaaaauaauacauuaaacugaagaucagaacaaugggauggacagucucuacaaauuaaguacuuucuaauuuuauuuggaaaggaucuggaagaauacauaccaggcuauuaacagugguuacccaaaugaagaagaauaagauuaggauuggggaccgggaaauggaaaaggagaacuugcauuuuucauuuugaucauuugaacuuuuuauagcaaagauacauucaggugucauccgugugacuuuaaaccauuuuuaaaauauaaaauauuaaauaaagaauauuuaaauguuauuuaaaauauaauguauugcagguaaagcaaugaaaaaauggguugaauccaucacuaaaauaauccaaaggaaaaaaauugcaagagacaauggaccaggucauaauauuacauuucagaguucaccucccacaguugaguggcauauaagcagaccugggcacauagagacuuuugaccugcucaccuuacacccaauagaaauugcucgacaacucacuuuacuugaaucagaucuauaccgguauguaauuuaacauucaaguugaaaagucauuucaaaagaguuaacuuuuaaaaugaaauacugauuucugccuuauaggguuuucauaagacuuaacugaaauauuacaugaagugucuaguaauaaggccaggcaggcaguuccuguucuuuuacuccccuggucccucuagcugaauuuacaccuucugucuuucuguguucaccccuaguugguaaggcuagguucaaauccuggcuuuaccaauugcuggcccugggcaacuuuaaccuccuugugugacuuuauccuucugccccuuauuuuccucaagaguaaaauggggcuacugauaguaccuacuccuggggcuguuuugagguuugcaagucaauauauguacauuaccuagcacaaaguaagggcucaauaaauguuagcuacugcuuuauugugaacuuacagccauuauagucuuuuuuaaucauacuacauugauguaauuaucucaaaaauguccuucugauuuuaaauggagacuacuuagaaucuuaaauuauucacuuuuuaauaacuaaaugagaaaaugagauaaauuuauagaucucccacugaaaaucguauuucugaaaauuacaguguuagaaucuauuuuauuuccuaggacccuuuugugguagguuuuuuuccucuccuccuuuagaccaaaagaaaaaaaaaagaugugugaaugcauugauuacuguacccucuuugaacugauuauaacagauaucauuacuuaaaugucuacuuugucacccuaauuuauuaauaauguuuauaagugcugggaaagauauuauggaggagucucaaccuugcccaaagcaaaaugcuacuauaaaggaacgcuaaaaguacacagguauuuccauaaaaauaguuuuuaaaaacaguuuuuaaaggcugggcauuguggcucacuccuguaaucccagcauuuugggaggccaaggcggguggaucauccgaggucaggaguucgagaccagccuggccaacauggugaaaccuugucucuacuaaaaacacaaaaaauuagccaggcaugaugacgggcgccuguaaucccagcuacccaagaggcucaggcaggagaaucacuugaaccugggaggcggagguugcagugagccaagaucaugccauuguacuccagccugcacaacaagaguggaacuccaucucaaaaaaaaaaaaaaaaguuuaaaaaaaauccauaaggaaauaugcauaauuacacuuuuuuguuauaccuuguuuucacagaccuuucuguugguauaagaggaaaguucauaugagaguuuaguuuuuauuugucuccuuuacuuaauaaaacaaugucuauauuagagaaaaaagugucauguagaauuauguauugaugauuuuagagcuguacagccaucagaauuaguuggaaguguguggacaaaagaagacaaagaaauuaacucuccuaaucuucugaaaaugauucgacauaccaccaaccucacucugugguuugagaaguaaguauuccuagcauucuuauauuuuauagcugucagcuauguuaugaauuucaaugcaauuuuuuuguuuguuuuuuuugagacggaguuuugcucugucacauaggcuggagugcaguggcacaucggcccacugaaaccuccaccucccaggcucaagcgauccucccaccucagccuccagaguaaccaggauuacaagugugugauaucacacucaccuaauuuuaauuuucuuucuuucuuuuucuuuuuuuuuuuuuuugagacagagucuggcucuguugcccaggcuggagugcaguggugugaucucagcucacugcaaccuccaccuuccggguucaagcaauucucaggccucagccuccugaguagcugcaacuacagacgcacaccaccacacccagcuaauuuuaguauuuuuaguagagaugggguuucaucacauuggccaggcuggucuugaacuccugaccucaagugauccaccccucuuggccucccaaagugcugggauuacaggcgugagccaucgcuccugaccaaugcaauuuuauuucuauaugucucaugucuuuuuccucuauuccuccuuucuuuugcauugaguguugaugaaaaugauaauauuugucauuagaaaauauugaauguuuuucuaauguagcauuaauuuuuuucauuaacuuuuuuugagguccuuuuagugguugccugguugccuuacaguuuacccuacacaucuuaucagaaucagcuucagacuuauaguagcuuaauaccagugacauaugaaauauuacuccuauguagcucuauucccuuucucccuuuuuuuugugguacuguaauacauauuacaucuuauuaaugaugcaaaucaaacaauacauuguuaacaguuauuacuuuaccauuugucaucauccucuuagcccauuaaagcuuugcucucacccaccuucuuuguguauuauuggcaacauauuacaaauauauuacauuucuaugucaauaaauucaacaauguuuauauuauuuuauacaguuguuuaagucaguuaugagaagaaaugagaaaaaaauacgcauuuacaaaaugucuuuaauaauuacacaauuaccuuuacugauggucuuuguguggauucgaauuaccaucugggaucacuugcuuuucagccugaagaacuuccuuuaguauuucuucuggagggugggcuagcaacaaauucucucaguuuuuguuuaucugggaaaaucuuuauuuuaccuucguuuuugaacaauggcucuaucuucaaguuaauauuuuuuuuuucaguucaaauauacuauugagcuuauccaguaaguuuuuuauuucaguuauuguacuuuuuaauuccagaauuucccuuugguuccuuuuuauaguuucuaucucuuuaaugauauccucucuucgaugcacauugucaucaauaccuuccuuuccuucuuuuucaugcuuuccuuuaauuccgugaccguauucauaauggcuacuuagaaaucuuuuuuguuacuguuguuaaaucugacauuugguugcucucacaggcaguuucuguuccuuccacccccuccgccccacccccaccccuuguaagagucauacuuuccuauugguuugcauaccucaucuguuuuugcuggaaaccugacauuucagauaauauaguguagcaacucugaguacugcuccuccuuccccagcccccuuuccagggcuucuuauugcauggcagugguacuggaaagacucauccacuccuuaccugaccacacacacccagcuaugaaacuccacaauuugccagcugauugcucugauguuuucaacaauuuucugguggcauaaaugcuauacaaaauaaugcaaucaaauuguggcuccuuugaaggaaugguuucugagauuucuguuugauacuuguucugaccccaggagggcuccucucagccgucuuauuuccuaguugucuccugcaaacuacucugccuacagucuaggguguaucuucauuagauccacaaaucucuuccccauugccuuucaccacaauuuccacuguuccuaagggcaccauuaaauuuaaacuacuuuauacuuuguugcaaaugacaagaaauuaggagcuaucuguuugaaacagggcucuggggcugggcaacaauggcaagcuuuucucugagugacacuucugcccuaggagcuaagugcuugguugagcagguagaguggcagacggaugcuacugcagccugaggucuucuuacccgccucuucuggcauggaaccacgcccucaggaaccagaggaagggcucuuuucucaguaugcucaaaacaucacacccaagguagcgucuccauuccauaaguggaaguugggcaaaaaaggguauuccuacuucucagcugcacucaacugggacuuggccucagcaacaggcagcagggacaggaugagaaaacugaaguccugcuccugcaccucaccgggagcuagguguucuugacugcaggaaucuggaguagaugcucaguucacccucacugagcugggagaaagaagggagggaccagucuugguucaaauaccacagacucucuccccucucuuaccaaauuuuuguagauuuuccugaauagauguuucuuuugccauuugcucucagggccauuacuagagacuuuaaaugugugugugugcgugugcauguguguguuuguguguauguguguuuuaauaauuuuuaccaguuucacucagugaagcuccucauacuaucauaccacaaguccagaaucucaaugcaauuauauauuagguuggugcaaaaguaauugcaguuuuugccauuacauuuaaugcuguucguagaaauguaggaaacauaggaacagagcuguuccuagaaauguauguagccaauaauauaugaaagaaagaaauugagcauuaaucacuaaaaucuugcaauuagaugaagaauagaacacaacagaauucuugaauucuacuagaauacacccacaucacaaagaccucacaaagaccuccauacauuccacaagauaguggccucaccaguuaauucugaugcuaauagaggaugcaccaaauauaguaggaaaaugauuguuugacuguaccagucuagaagacgggaaagagcaguaugccugacuggaggcacugccuuccuucuaucagucacccugaaugugucuucucuauaguaguuauacuaucgccaccccccuacucucuacauuauuuuauuuacuaaauucuuuaagcuauaacuuuauuggaaaaacucuaaaaccuuuaguucacuuuuuuuuuauucccagauguauuguagaaacugaaaauuuagaagaaagaguagcuguggugagucgaauuauugagauucuacaagucuuucaagaguugaacaacuuuaaugguguccuugagguugucagugcuaugaauucaucaccuguuuacagacuagaccacacauuugagguagguuucuacauguguuuuuaaaaugaacuuucauucccuauuagaaaaauuagauuuuuaacaauuauuaucuuuaauuuuuaaaugucucauuugucuuuucaguaguagauuaaaagacugaauuaucuaaguuuuguaaugaauugguugcuuuuuaaaauuuaagcauuccuauuaaaauguauucacaggucccagccuaagcuagaagaaaaaacuuucggcacuuaauuuguaagauaauguacaguuaaauguucacauaauuguguaaggaaugacaugauaaacuagaucucucucacacacacacauacuuuaaguuuauacugaggucuaugaagauaauuuauuugaagcaauauuugaagcaauguuacagucauaaaaucaaauugauacuguuguauuugggcguuucuguuagccuaguauuuuuuuugacaagaccuuugauuccuuuuguaaacuuacgccuauuuuuuuuccuuauagcaaauaccaagucgccagaagaaaauuuuagaagaagcucaugaauugagugaagaucacuauaagaaauauuuggcaaaacucaggucuauuaauccaccaugugugccuuucuuugguaaguauuucuuucugaauuuuuauugcauuucuggauaaaacaaaacacucauuucauuaaaugacugaauaauuacauguguaauaugccagcagaaaauacuuguuugaucaauauuuagcaccugaagcccuuuagaauuuuucucauuaagacuuaaggugaagucuaauauacauuucauuuucuauuuucaucuuaggcagccauuagauauuauuuaauacuuguguuuuuauauuuauaaaagccuuuuuaauugcauuuuaauaaacuaaauacagcagaggcauagccaaacucaacuauauuuauaaucauuuuuguaaacaguuucacauggcuaaaaaucauagugugccugcugugccuuugggcccacaccucuggcacaucaaaauuuuauucucuucauccucuccuauuuuuccccuucugcaucagaggaaggaaguaccuuuuccuuccuuuuuaggacugaaucuaccaccugaaucucccuuucuguagguuccucuaucuuuuuccguucuuuauuuccuuuauuuucauguauucaauaucucuuuccuacucucaucuuuucucugccugaguauaugcucugaugauccuucuuuugaaugcuuauagaaauuaugaucucucuauagucucuuuaguaugugcuauaguuucuucuagccuuuuccucaucuauauuuuuuauauaguuuuaaaucccacugcauauaacaauguuauguccugauacuuuuaauauauuuucccacauuuuauuguuugggcuuuauagcaaccauuuuuguauuuacuucuaaucuuuuugcugugcacauuguauauaauuguaauuguaugaugugcauauuaagguuauucacuuaucauaucuuauauuuuuguauuuuauuaaauaaucuuaauuauuuauaauggcugcauaauauuccauaaaguuggacaauuuguuuuaaccauuacccugugauuggacacauuguuuccagcuuuuuugcuuuccacaugauuuucugauucacauuuucauuuauacuauuuuucuguauuugaaaauaucuucuugagacaaauaaccagaggaggaauuacaguagugcucccaucuccacgguuucacuuuccacgguuucaguuauccauggucagcuuugguccaaaaacaugagauauuuugggagagaaagaccacauucauguaacuuuuagcuauuuuuaaucuuacugugccuaauuuauaaauuaagcucauacguauguauguauguguauauguauguauaggguuuaguacuaccuauaguuucagguauccacuggggauccuggaacauaucaccuuuggauaagggagggacuacuauacauagguuaaaagguguccauuuuuaaacuguugauaugugauuuuaaguugcuuucugaaaggcugccaugagaaguguaugacaauuaugcugccaucaaguguaugacaaagcaaauuucaucccaugguuuccaauuuuggauacuuuuuuuuuucauuucuauuauuacaacuacuaagcuauuuguugcaauaauuuccauucuuugauuacuguggagauuuuuuucauacauucuuuaauauuuguauuuccucuuguccaugucauuuuucguaucuccugcaaacaaucugccuuguacuuuuuauucauugacauguauuaguuuuaaauucuaccaucuguccuuucucauucugguuucuauuguuucuaaccuuagaaaguucauauaaucuaguaauaaucauauuuucuucuagcuuuuuuuaugacuuucaaaauuauauuuaacucuaauaucaaacugaaguaucuuuaauaucuuaugaaauacucaaauuuauuuccccacccaaauuauuuauuuguuaaucuagguuuacugaaugauucuacuuuuucccuguuuacauaugggacuuccuuuuuuuuuuuuuuuuuuuuuugacacagagucuugcucugucacccaggcuggaaugcaguagcugccaucucggcucacugcaagguucacgccauucuccugccucagccucccaaguagcugggacuacaggcgcccaccaccacacccagcuaauuucuuuuuuguauuuuuaguagagacaggguuucaccguguuagccaagauggucuugaucuccugacuucaugauccgcccaccuuggccucccaaagugcugggauuacaggcuugagccaccgcacccggccagggaccuccuucuuuaauauguauuguaucucacugacuuccuauaccccugccacaguuuuaaggauugucacuuuauaaucagugauucucagcagggggcaguuuuugccccccuagggagcauuuagcaaugccuggagacaauuuuuuuuuaauuguccuaauugggauggugcuacaggcaucuaguggguagaggauagagauauuguuaacauccugcaaugcauaggacacuuccccacagccaauaaguaaguauccaguccaaaaagucagcagugcugagacagagaaacccugcuuuauauaguguuuucacagaugauaaaguugguucuucaggguuucuucaguccuuuuuuuuuggccaauuuugccuguuuauuuuuccaaaugaacuuuauaaguuugaguggggggggaugcccccaaauguaacuggaacaaucugucaauuaauuuguaaagaacauuuauuauauuuagcauuuccccuuauuauuuuuccuggguauuuuugguuugaaugguauucauuaaguuaccuuuaauuccaagaauuuuuaauuuccuuggguuuucuaaauauuuaaucauguuuacaaaauaugauacagugucucuuccuuugaccuuauuucuauguuacgccuuacauaauuggucauuaacuucccaaacaaagcuuuaaaaauaauggcagaaauaagcagcuuguuugaaacucaguuuuagcggggauaaaguauaauuuuacuacuugcuugauuagaugguuuuuauccuuuuaagaaagcauccuucuugcuacagaauugcuucauuucauuauuuuaaaaauacuagccuucaauuuauaucuacaaacuuuuuuuaauuaccgcuauuuguaauauaucuuucucauuucuguuuucacuuacuugcuuuaauuuacuuuuucuccaaaaagauaaggucucuaauuaucugcugaucuuaugagguuuaaaaaaaaucauuauuaauuccuaguuuuccugaggacuuuuccccuaccccuacguucuuuuuuuuuuuugauacaaggucucacuuuaucacccaggcuagagaguacaguggcaccaucuuggcucacugcauccuccaccucaugggcucaagcagucaucccgccucaaucccccaaguaggaggaacuacaggcacaaaccacuaugccuggcuaauuuuuuuauuuuuuguagauacaggguuucaccagguugcccaggcuggucucgaacuccugagcucaagagauccaccugccuuggccucccaaaguucuaggauuacaggugugagccaccguacccagccugacccucuacauucuugauaaaaauauugaguucauugauuuucucuuccuggaaaaauauuaaagccuauauguuuuugcuuaaagauauuaccaguucguuuaagaggaacuggaaaggcucuggauauaucugacgguaugucauucaaucugucaacguauauuucuugaauaccuacuaaguaccaggacuacgucaggugcuuagaaaagugaaaaauacacagucagucugcucaccuagcuuauagucaugcuacucaugauaucccauggucuccgguacacagacaugaaaagaaaccucaggacccauucacugacucacuauuuggccccugcuccuguaacauccuaaugguugguauuuauuuauacaaacugaaacuguccaaaguccucucucagaucuuuauaaacuuaacugaucuucauaacauguucucuuuuuuuuuaagacaguuucacuuuuguugcccaggcuggaguguaauggcacgaucucggcucacugcaaccucugccucccggguucagcaguucuccugccucagccucccaaguagcugguauuacaggcacccaccaccacacccggcuaauuuuuguauuuuuacuagagacaagguuucaccauguuggccaggcuggccaggcuggucucaaacuccugaccucaggugauccaccugccucagccucccaaagugcugggauuacaggcgugagccacugcgccuggccauaacauguucuuaagugaaaggaggaaguuucagacccacuuuagaguaugauuucauaagguguuuuaaggugagcugugugauuuauugagugaauacaaacauguagguaguuugauaggcacacaaaguuuaauaggugcagcccaucugccaaccuucguaccccuuucuucuugcccaucuuccuaguuacugagccucugcuccuuuaagguaguuuaucuacaacugacccuggucaguuuuggugcccuaucugugcuauucuuaagcuaaaaguuaccagucucuggaguuagacagccuuucauacaguucugauccgguggguaaagccagauguuauugcugcuucugaauuccauccugucuauaugguaguuuauagaaacuccuuccagauucuuuuccuaaauucuggauacugguuuucaaaccccuucuuugggggagggucagggauaguagcugauacuuccucuauuauuuuaccagcguuagucccaucuuuugcuggcacaaccaccauuuaaagaauaaaaguagggcagucacuccuuccaaagcucugccagauguuucaggucuauaacacaguuuuucuccauaaacuaaaauauucuacugauaggagaauggauaggugggcuaagaaaugaauuuuuucagcugggcgcaguggcucaagccuguaaucccagcacuuugagagguugaggugagcgaauugcuuagggccaggaguucaagaccagccuggccaacauggcaaaaccccaucccuacuaaaaauacaaaaguuagccaggcaugguggugcauuccuguagucccagcuuacucgggaggcagaggcacaagaauugcuugaaccugccaggaggcagagguuguaguaagccaagaucgcaccacuauacucccgccugggugacaaggcgagacucuguuucaaaaauagaauuuuuucuaagguaaaaggaggauguaccuuaaucagguuugucaucaaacauccaagccuuuagcauuggcuuugcccuuugcuuuuacacagcucugaucuuguguccuccuucuguuauguguaaauuugccuugucuccauucuugcuuuccagcuauuuuagaauugauucucauauccuggccugucuuuuaaaugucucucuucuauuuugaaacaauauacuucuuucauucaaucgaaaaccuuugcugaaugccucuauguguuaugcccagggcuacaugcuaagaauagacagauaagauacaguuccguaguuucuguucccuugaaagagcagagaaauaagucacagcacuguguaguaagcauaacacuguauuguagaaaaguguagacugaaguguggacaaaugccagagaagccuagaauccuaagcagcuacuuuauccugggaaggaugggaaagacaucagcaaaaaaggugaaaccucagcccucuucuuugucauaaugcucuguuuucucuuucccuagaagagcugccuccagagguaggguauguuaaaugauauauugaaguacaggaguaacuagacuuucuauuuauauauuuuuuaaaacaugaaaaaaaaaccuaagcuuuacuaauauauaauucucagguuuauguuauacauacacacauauacgcuauguuuuuauuaaacuauauauguguauauagggagaaagcgaggauaugugcuuaaauauuuuuuacugaugcaguguaagaucaaaguuuggacaccacugcugugaucauuuguucuuuuagcuagccaucaguuaggcacaaaauaauuuccaaauuucaucccaaacuguaccaaagugcuacuuauaagcauuuucacaacuucauucaagugugcuuucaagaacaaagcugugagucuucauucccacugcccccauuuccuccccaaaccaguuaaucaguucuuggggagucuaccucuuaaauauuuauccacuccccauuauccccacagacacuagggcagcccucaucaucucaccaggacuauuguuagccuacuaacugcucuucauguuacuggucuuaacuccuuccaacccaccuggcuucauaguacaccuagaguaauccuuccagaaugcaaacaaaauccuucuaauucccuaauuaucuccuagauaaaaguuaagcuauuugacaaaaggcacacuucaugacccaguccaagugcuaauacccacaaacucuucacagaugggccaucaguuugugaccacuauggaagguugauuugggcugccauugagcaugcauacucuuauggacguguuugucagacugaacacugagcugaguggaucaugcaacuuguguagaggacaguauaaauggcugaaaauaaaagccaaaugacaggcagaugugaaaauaaaaaagccugugcuuacuagaacacacagucacuuugucuuaugaauguaucaucaggcauagcccaggugcugagaaauaaccaaguaacuaaugcacuuaauaacuggauccuuuuaaaaaccaaacaggcauugaugucagauuucauuauugcugaucuguucaauauugauuuggauccuuuuaucuuuccaaggauguggccaaagauuucugugguguaugccucuaccacaaaagcauuuagaaguacaaacccagcccuugccuaugucuauccucauauccugccacucuuccucuaccccacacaccaaaccccuauggucuagccauacuaaagagcaaauuaucucuaaguaugccuuucaagcaagcuucaucaucaugaaucaaugccuuuauacacacugcugcuuugcuuagacugcucuucuacuuuauucuacucauuacacuucucauuuuuugggacuuauucuaagcauuaucucaucugugaugcuuuuucuaguccucccagcucaagacagaguuuggaauaccuccuuuuugcucucauagcauguuaugcauuccuacuaauauagcaccuccuaguauguagcgcuuagcaaauuauacuguaguagccaacaguucaaagcucuggaucccugaggucaggaacgccuuaagcacuggacugcuggaggucuuucucaucuuuguaccugcaguaccuaaugcaggacuuggcuuacagcagagaauccguacacauguggggagugaacgaacucaggaucuuuuuucuccucaaagcauuguaaucaguacuuuagggaaaaagguagaagcauaagaauauuagggcaagaugcaacaacagcaucaacaaucacaaccacggcuaauuaauacuuaacguucgucaggcucuauucuaagcucauacauauauucacucauuuguuucucacagcaacccuccuguccucauuuuacagaugagaaaaacugaggcacagagagacuaauuaagcaauuugcacaagaucacacacacaggcugcucgcggugacucacgcuuguaaucccagcacuuugggaggccaagguggguggaucaccugaggucaggaguuugagaccagccuggccaacauggugaaaccccgucucuacuaaaaaauacaaaaauuagcugggugugguggcauaugccuguaaucccagcuacucaggaggcugagacaggagaaucgcuugaacccaggaagaggagguugcagugagccaagaucgugccauugcacucuagccugggagacagagugagacuccaucucaaaaaauauaaaauauaaaauauaaaaaaaaaaauaagaucacacacagagaaggcagcagaacugguuccagagccuuuaugcuagaauagaaagugccuguuauuuuguucauucuccuccucguccaguguacagcuguagugauggggaaacaggaaaucaauuacuagguugccacuaagucuacaaacuauugaagaccagaauuuacauaaaucguaugcagucccacauuugacaggcuugcaaaaccuuccacauuuccaugaguaagccuauccaaauaguacuacuucucaauugcaaaucauaacaaccucuuguguggccgucagagcugacuaagcagaaacuaugauccucugaauuuaguauuuuuccuguuugccaaaaaugaugugucauuagugacgaaguuauucuuaaaguuccuuuaacaaaacugugauuuauaucaaauaacaauggcuuggaggggguauggaaaauugauuauucuuccuaacaaaucuauuaauuuuauuaaacuuggucucccucccuuuuucuuggauguuuauaaaauuuaagucuuucuaaaaaaaauaaaaaaauaaaaaauauguaucccacugccuucuggccuccauggauucugaugaggaaaaaaaaaaaaaaauuuaagucuuucacagauacuuucucuuaagcugcuguuuucauaucauggaaaucugagccuugguucuuuuguuuuggcaacugagaugguacaguguaauauacccacaauuaaugaaacagaaaaaaacuugcauuuuccuucuuuauccuugaaaucauuccauuauaucuucuaggaauuuaucucacuaauaucuugaaaacagaagaaggcaacccugagguccuaaaaagacauggaaaagagcuuauaaacuuuagcaaaaggaggaaaguagcagaaauaacaggagagauccagcaguaccaaaaucagccuuacuguuuacgaguagaaucagauaucaaaguaaguugaauuauuuaaagauucauacuucugauuaaguuucuaaacuacuuaauaaaaggcagguuuauuuuauaggggagaaaaaguaaaauaaaccuuaaaagaaauaauucaaauuuacuuguauuaaauguuuucuuaacuuuccaugaauuucaaacugaauuuauaauuuugaauauuaauaauuuuuucuuugcauuuauuuuagagguucuuugaaaacuugaauccgaugggaaauagcauggagaaggaauuuacagauuaucuuuucaacaaaucccuagaaauagaaccacgaaacccuaagccucucccaagauuuguaagcauuuguauauuugucuggugaugucauuacuaccauauguguuauauaguuuuccauaaagguauucagggaugaaguauacaugugauaguuaaaaguaaugaaaaaguacuuaauaauuauguccaggaauaucccacuuccuuccaaauaaaugaauguuaguauuaauuugaguaaauccugauaucaaagaugaugaaauugagcaaauauuauguaaguuuuuaauuuuuuuuaccccaaaaaauguuaagauuuuaaagacaggaauuuuaaugaauuuauacuaauucacuuguaauaaaauaucuacuuaugacauuuuaaaaguaaugacuuauuagaacuuucaaccaugaaucaugagccauaaaauaccaaguuuugcuaacaauacuuucuugggaaaauaaaguuuccauuguuuuuuguuacuugucagugcccagccaaauuuaugaauagaaucaccaacucacugauuugacuauguacucucuuguucauaaaaaagucaaaagucugccaggugcgguggcucgugccuguaaucccaacacuuugggaagcugaggcggguggaucaucugaggucaggaguuugagaccagccuggccaacauggugaaaacccugucucuaaugaaauacaaaacuuagccagacaugguggcgggagccuguagucccagccacuugggaggcugaggcagaagaaucacuugaacccgggaggcggagguuacagugagccaagaucgugccauggcuauccagcuccagccugggagacagagcaagacucgucucaaaaaaaaaaagucaagaauccugaauuaaacauagauggcuucuaagugaccaagauaaaucacauaaugucuuuuaauuaaaguguaugcaauugccugacagcaaaauuucucaagcccuuguucaguuuuuaauaagauggauuaaaaauagaaaauuauaaauagguauauaaucugauccaaugaagcacucacugagaaaugaucauuuugcaaggaaaaugcaauaaaaccaacauacauacacaaaugaaaauugggcaauuuaauguauucguaaauaucucaaaugguccugauggcaucacuguauuacagaauagaaagguauuguaauucacagugaugauccuggcuuuucaacaagguuaaauuugcucaaaauagucuguuuuaaaaaccagggaaauauacaauacauuuuagaaaaacuucuacccaaauguauuaaaauaacaaauacucuaguauuuauaggacuaaaacuuaguuauuuaaagaaaugcauucuuuaacaauuuagauaccagggcuuuagcaaaauagaauguuaaugcuuuaaauguucuacuuuuauuugaauaauuauguccuuauuagugauuuaugauuuuccuguauauuagcugaauuuuaccaggcacauauagaaaaacuuuccuuucuacuacaguguuuaaaguauuguguuucuuuugauaugucuacagccaaaaaaauauagcuauccccuaaaaucuccugguguucguccaucaaacccaagaccagguaccaugaggcaucccacaccucugcagcaggagccaaggaaaauuaguuauaguaggaucccugaaagugaaacagaaaguacagcaucugcaccaaauucuccaagaacaccguuaacaccuccgccugcuucuggugcuuccaguaccacagauguuugcaguguauuugauuccgaucauucgagcccuuuucacucaaguaggugcaaaaauucuaagugcauuaagguauuuguuaguacuauacaugcuagagguaaaaaagaaucucuguuauuuuuuuguaugugugaacuuguaguuaagucaaaugccauuucaaaagauaauauuauaaaaauauaagacaaauucuaaacuccaccaacuugaaauuucuaaaaaaucugcuggaacagcccucuuuaaauuuauuauacguuaaugaaaggccuagugguaaaauuggcagcuuaaauuucauuugagcuuuucaaaugcauuccucuuauccagaggagacaaagaucagucuuaaaaucugcaaguaauuuuagucccauguuucaaaugcugccuggcuccaaaauuauuauacaggcugaauaucccucauccaaaaacccaaaauccaaaauguucuaaaacccaaaacuuuuugagugucaacauaaugcucaaaggaaaugcucauuggaaguuuugagauuuuucaguuagggaugcuaaaccaguaaguaugauguaauauucugaaguccagaacacuuuuggucccaagcauuucagauaaaggauacuuaacauguauuugaauacuagucaggguacaccaucuacucuccaccaaauucuuuaguagcuuuuaauuuugcaauguaucagauuuaagcccuuuucgucuacccagugguccccugaugguauauaauggcugcuaauacacuaucugugcuuuucagugcagcgaaacaaaucucacagacugcacacuacugcuuauccaucucuuauuucuagaccagcacuguccuauagaaauaugugagccacauguauaacuucaauugucuaguuagccucauuaggaaaagcaaaaauaacuuuaauacauuuuauuuaacccaguauaucagaaauauugucauuucaacaugaaaucaauauaaaaauuuaugauugagauauuuuacauuccuuuuguucuaaaucuuuaaaauccagcgugcauuuuacacuuacagcacaucucaguucagacaagccacagucagaugcucaauaaucacauguggcuagugguugccggacuguacagcucaccuuuugaaaggcuaccuuuucaaucuagaucaccaauaauuuuuuaaauuaauuucaugugaaacuuuaaagcucuucuaagaacccuuuuucauuuguucguuauuaaaucaaaacuucaauccagucaccuuuaacucuuucaugaccauuuccacaugcccuuaccguuggcuaucuuagcucgaugugcuaaucaaguucccccuaauuugacauacuagaaucuaauacuagaggcagcaugacauuauuaugggggaggagguugagaagcacuaaccucgaaguuagaauuucugguuugucaucccagucugcuaauuagcuuucugauuuaagacaaaauacuuuuucugugccuucugggggucaaauucgauuuuuaagauucucucaguuggaagaaaucuaacuaaaaauauacuuaaaauaauucuuugguaguauauuauuuugaaauuugguccagaauccuauuuguuuauuccuguaguauacauacgucuguaguuacccaguagucuuuguugucuuugggccaucuaaaguauauuugggcugggcauggugucucacaccuguaauuucaacacuuuggaaggccaaggugggaaaaucacuugaggccaggacuuugagaccagccugggcaacacagcgagaccccaucucuccuaaaaaauaaaaaaauuagcugagaggagaggugugcaccuguagucccagcuacuugggaggcugaagugggaggauugcuugagcucaggagugugaggcugcaaugagcugugaucaugccacugcacuccagccugggcaacagagugagacccugucucaaaauaaauaaaguguauuugucuugagaauacuaugacuuggcauuauuuggugacugaaggucauggagucuuuuuuuuuuuuuuaauuuuauaaaauuuuugguagagauagggucucgcuguguugccaaggcugaucucaaacuucuggccucaaacaaaccuccugccuuaaccuuccaaagugcugggguuauagaugagccacugugccccgccauggagucaugugauacacauaguaagcugucagauauuuuugauaaguucaaauagacaccaaguaaaaaaagauucccauuuauucuccccagcuugccaacccccuaaauuaaguaaugaaaugaaaccagcaccuuuucaguauaucugacuuaaaaucauuauuuauucugacccauuuaacuguuugcaggauuuuuucccuagagcagacagcuauaggccuguaucauuaaggauucucaaauaagugaacuauugaaaccacauaaaagccaucaguugcaaauucuacuucucuuuguuuaaguagcuaaaaaugaaagugguggaaaaaacaggagauaagcauauuaaguucucuacuagugcugaaucuuuaaaugacuagcuaagcagcgaagaagaaaucauucuagaaugcagugcucuggauccugcuuuguuauaaacaguuauaauagcauuaaguuaacaguauuucacuuaaacagcuggacagguggagaaaacauuguuucaggaguuaggcuuuguaaucuuagacuugaggguuuucucaauuucucuuuguuuaugauaaagaaaaacccuauuacuacucccuuuguuuuugguuaaaaacugaaaauaacugauuuugaaaucaaauaaaccaguguaauauaaagccauccauguguucugcuaaucccuuaaaaccuaucaguugcuuuuguguauuaaaggucuucuccacaugcuuuugucuucacuuuugccuaacuaacagaugugcgagugccagaggaucacccagagccuccaacuugcuacccacuguuuugccaccagagugaauaccuauuuccuuguuucccucagggccuggcagaaaagaacugccuugacugcagucauaugucaucccaacauauuccacucaaagcaguacaaaguuccauuguuuaaguuuuucaaaaggcagaguuugacuagaauuuuuuuuuaucaguuauaauacuauacuauucuuuuuuuacucuuacgguuuuuucccaaaauaaucuacuuuuaaaaaccuauaauuaauuauuucagccaguaucugcugcauaucuuauuccuugcuaaacacuuacacgucuucacugggaaagcuugcagucuuacugagagauuaaaaauaaucauagugcaaagagauucacaguuaaacgcuaaaaauagugguaaagacauaaauacuggagaagcuuauagaaagaugaccucagaaugagcaagaguggucauggaaagcguuguggcaaagacagggcagagaaguggccacguacuuagugcugccacacauacauucaaagcccugcuccacaccuugcccuggccagguccaccuuugaggugaugacgacaguugcugagaaaagagaaaagaccacuggcucacuacuuguuucugcugcuauaauagagaggagaaaaugaugaaaugcucuuuuuaccuuccuguuugaagauugccuggucauaaaagggagucagaggucugacuucuccauuuccaucccuuaggggacucuuuaacaacaaaaagaauguauuacaaguaugucaagcugauaacgcaaggcuuuuccuccuggaagauugcuguaggugaugaguuucuaaucccaaauauauuugcauuuaccaggcuuuugugaguuuaagaaguuaucuaucauaucuuuuuuuuuuuuucuauagaaaaaugcuuguuucuaucaagaaugacuccuuuauaaacuggggaguaucuuuaagagugguuucaacccugacuguauaguaucaucuguugaggagcuuaaaaaaaauauguaggcccagcccacacuagacuggcauugguaccugguaucaguauuuuuuaaaaacuucccauaggauucuaauguacagccaagauugaggaccauuugucugucaucugggauuaugcuuaauaaauuaauacuguuuuuuaaauuaauuagauuucacuucuaagucauuaucaguaaauuuacucaguaucuaacugacaagaauuucuagcauauauuucuugauuagugcauguaaaauucuaaaagaauuucuauaguauuuuccaggcaauaagacaacuagugccccaaauuuaccaaaugcaugagucuaagccugugcuauauauaaauauacucaaagccaaguuuacaucuguguacacaagugugcaugcauauguacaauuaaagacuauaguuguaacagucaugagcuuguguuuugauuuuacuccuauuccuguauuguauuaaguguacuaucauguucuugaggcauaucuccaggagauauguuuauuucuuuuccaggaaaagugggacauauauaaguaggguaaacgcuagagcuagauacuccuuuaaucucuauuacgucagaucucuggcucccuuuuacaaccaggcaaucuucaauuauagguggcuaauagggaagaaaaucaucggcagagcaacagcuucauguaauuucagaguagaaaaaugaauuuuaaucuucugaaagguaauauuagaauuagcuggauugcuacacuuaggaaucauagguuccaaauaaauaucaguacauacggaaaucagauaaugggacagauuauuugaaauuagggcugccuagaaaucuggaaugugagaucacccuccuucugaccaaauaugcuugaauaaacuuaauauuccaaauuaugugagggauugccuauugugcaaaaaaaaaaaaacgaaaucugaauuuaaaaaaaauuaccacagucuaguauuauuuuagucucuuggauguuauaacguuaucuguuccaucuguuguuaauaugagacacuguacaaacaaacaacuauauugauuuagaaucaguauagaucaccuagcuuuuugucucaauuuuccuacuuuaaugcucuuggggcuuucgcuuuugauuuucaguuuuuuccuuaaaauaauuaauauuguugaaauuagacuuucuaaauuuaaauuuaucagaauuuccuauguaaaaugagucuaggcaccaaauguuuaaugacuuuaaaaaaaauguuuaugacuauaaaaggaaaaacccuguaucaauuucaagcuuguuuuauauccaaagugcuaguuauuuugugaugagaauauaugccccaagaacauuuuugaaagacauauaauuaguaacuuuuuuauuuuucaacuuacauaaaauaaacuuauuacuuguuucacaaguuugaguuuucaaaauaauauuuacuaaauggcauauuuauauacauccagcugaacuuuuugcuugaauuggguuucuacauuuuaaaaagucuuucaguaauauacgauuuuuuuaugaauguuuuucauuuaauaauuaugaaaucaaguaaagcuaaaaggaaucuuaaauucccaauaugauaucauuuuuuucuucucaaaaguaaguaguaaugagguuuuacuauaaacuguuacagcauucuuuaaaacgacaaugacaauaacauuuucaucauaauacaaauuuuugcagaugaguugaauauaucaaugaaagaaaaaaaucuacuuuuucuuguuuccuuucacaggcaaugauaccgucuuuauccaaguuacucugccccauggcccaaguuaguauauuugguuuaagacucauaauucuugcuuuggcuuuaaaaaucaaaccaaguguaaccuuuccugcuaaaacucuucuugggucuggcagcauugguaccuugcuugcaacauccuagaagugaggccuucacuugugcuaucuuuagaucauaagugauuugcuuaaauuuauauauuucucaugcuuuuuauaaaaccuuguuucucucuuaaaagaacauauuaaauaaguggcuuccacauuuaaccauuucuuuuuuccaacuauagaguucuaaguauauuuuaaugcucaacuuugaaaaaaaaaaaaaggcaagagcaugcaugcgcauaugggaaugcuggcagcuacaugcaguuucuaaaucacaaaauauacuuagccugauggcaggauagauuauagacaacugcuuuugacuuuagaagaacuuucuuauaauuguaauuauucaaaguauagccuaaauacugauaaacaaaauaaaguuccauuuuaauuguaagguaaacuaacaagucacuaaauuccauuauuuuaauuauuuaagcuaauauuuuuuugcuguccuuucauacaauuucaaaauauguacaauggaaaauacuaguuacaagcugaauuaacuauauucuuaagaaaaaagguaggugaucaaaauguugaucauuuaaauaauaucaguacacaaaguacucuuuuuaaguucuauauuuuauaacaugugacaaaauaaaaagcuuaaugcuuaaagggaaaaaaaacugccaacuauaauuuugaaugaugguuuaaguauuuuuuucacaucuuuuuuuauaguagguauaaacaacuaacuuaaguguuguuuuccaaaguguauuuauaugccuaccuuauguucuuguuaccauaaaugucuguaagagagguucuaauuaguagcuuuacuuacuuuuuuugugccaguccaccaacuuauucuuaaaucagauucacuagauuuuaguguaauuucuguuuucauggucagggcugccuccguugucuugaauagugccaucaccguuaaaauuuuuggauuuagaguauaaugagccucuuuuugcuuacaggcaaaggggagccuauaacuaaacaaaaugaggagaggccccucaccuagacacuaugauucuuucccuugcauccuuugagagaaaugcuagggagagacauuggagagagugguuaagagcacacacucuacucccagggacuauccaguaagguggggaaguucuauaaauucuaauaaagucaaagaaaaaaaugaacccauuauagaaucuaaaaauuaccauuccaaagauuuucaguagcucacugucucccagacaucugagaaucagacucaauuaaaaauuucaauaauagaguaaccaugggaauguuauuuuguucaggcaaaauaacagaauaccuuaggcagcuuuuuucuaaauauucugcuaaaaaaugucugcaugcuuuuauggcaguuugcuuuaaugaaauacuauucgguauugguuuauugaacagcuuuugguauuucuacacauuacuuuuaauuauaagcaauuuccagcuaagacuuuucaagguaaauaaaugaaauaaaauuccuguggacuuuuucuuaaaaauuuaacaucccacaggaucugcuucuguaucaucuauaaguuuaaccaaaggcacugaugaagugccugucccuccuccuguuccuccacgaagacgaccagaaucugccccagcagaaucuucaccaucuaagguaaaguaagaaaucuuguuguguagaaauuggaaucauuacaguucauuauaauaaacggcugucuaguuuaguucucacuaggauaaguuaacauuucagaguauacaggcuuaauaguuuaaacaaggauuacauauagauuuagcaugcaguaauguuucuuucuucugaagguaguuuuuugguaugcauucaagacccuuguaaaccuaaggcuaugguuauuuucagaaaaaaacaaaaguuuuaaucuguaaaguaagaggaauuugguuucaagcaguucuuuaaaagcauacagagaaaguccugaagcuuuguaugaaggcacauuauaagucaaacuguauuuugacauaugcuaaaauuuacuuaucugagcccuuaauaguaaaucugacauacuuuuaaauggaguuuucaugaaaauucuggguuuggaagagaccccaaaggcucaaaauagcuauuauuucuacuuauuuaauuuuguuuuuuucuuuuuggccagcuguuaaacuuaauucauuaguucuuaagcuguccagagugcagagcaccaggauaagucaagacaagacacucuuuguagaacuucaugaauguuaacauaguuaacuuaaaauuauaaaauagguacuuuaugcuaaauuagaaaugaucuuagauugagugauaagcuaagcaagcaguagcaaacaaaauuuugaggaaaaaaauuuaaguaaaaacuacggcaaacuuuuuuuuucuaugaauugacagaaccucccauuuaaaacauaugccagccuuggcaacagagcaagaccuugacucuacaaaaaaugaaaaaaauuagccaggcauggugguacaugccagugguccuugcugcuugggaugcugaggucgggggaucacuugagcccaggaaguugaggcuacagugagccaugauugcaccacugcacuccagucugggcaauagagcaaggcauugucucaaaaaaaaaaauuuuuuuuuaauuaaaaagaaaacauauggcaaaacucccuguuccacacuuagcauccugccaauagcauguuugaaaaccccaacuuaauucuuauagucaugauacuucauaaauuuauuaauaaauguguauuuuauucuuuucauuuguuagauuaugucuaagcauuuggacagucccccagccauuccuccuaggcaacccacaucaaaagccuauucaccacgauauucaauaucagaccggaccucuaucucagacccuccugaaagcccucccuuauuaccaccacgagaaccugugaggacaccugauguuuucucaagcucaccacuacaucuccaaccucccccuuugggcaaaaaaagugaccauggcaaugccuucuucccaaacagcccuucccccuuuacaccaccuccuccucaaacaccuucuccucacggcacaagaaggcaucugccaucaccaccauugacacaagaaguggaccuucauuccauugcugggccgccuguuccuccacgacaaagcacuucucaacauaucccuaaacucccuccaaaaacuuacaaaagggagcacacacacccauccaugcacagagauggaccaccacuguuggagaaugcccauucuuccugaguuccucuguacugggauguauauuuuccuagccccaaauccauugcuggcaauggaugcacugaaugugccagcacugaggaguuaaaaugagaacuccaaacacuaacgacucuucuucaagaugcaguauaagacaaugaauuuuaaccuagauguaauuauacaauggaaaugguauuccaguuuagaauauggaaagaccgaccuagaggaauuggacaacugauugcaccugaaaaucauaaagggacuuuuucuggccaauaggcaggaguccucuuuuugugaagugaucuuuugugaagugaucauuaaagggauggaaaacacagucuaguguccagcaggcccacaugacaguuuuuguaauucaaauuaugcacuuuuaaaaaaaaaaacuuaaacagggaucuuaauaucuuccuuuguuuuccuuugcuuuacucuucuacuuuagaauauuuucuuaaaaaucacucaaaggacugugaggaaaggcugugguaccugaccuuguugaaaucaaggcccggcacuguacuacaggccuguuuacagauuauuacggugaacugaauggguaccgaggcuucaccaaagagguacuuuuuuguuguuguuguuguuuuaggaauaauuguaccaauuuuaagagcauuccccccaccuguccccacacacccaaacaaaauguggugguguugccuucaaaaaagagaaguuuugugucauuaacaugacagaagaacuuuuuaaaaaaaaauaacugucaacuauucuauuugcauuuaggagacuguucaucuaugcuagauugucauuuucccuccuucucccacagaaguuuacugguaguccaugucauggcucguagcuaucccucuaaccauaccauggaaaugcaggcacccaaugugaaaaggagcacuugcugggcaucacugacaccgcucauguuuuacacauaguugaguaaucagcauaucuagaauuaucuugcauugccuaaaucauauguauauagugaauguuauauaauauaccuggcaggucuguuuuaauuuaauugaauaaagauacaaauacuuuguuuggcuggcauauauuaaauuauuauaugaagaaaaugguugauucuuauuucuuuuaguugaaaaacacacaaaaacacuaaacauaaaagcacguuuugugguacgccuugguuucuaguucuggauauauguauuaaucuuaaagaaugaucuaaagucacagcuuggcauauaggaagauacuugguuagaauaggauggguaucuuuuaagcagaacuuuguaaguaaguuuuaaguuccuaagcaacaaguauacaguuuguuaagguuuauauugaacauucuaccuugcuugagguuuucugcuuuaucaaaacuauucauaauagaacaucuaccugcaucauuacuaucauaauauggauuauucauaaagcguauguacuguucuucugagucuaacaaauacugugacugaaaugcaugcaccuuguugaagagaaaacauuuuauuaaucuccacuauaaugucugugaaaugugcaguauuccauccuuagagaguuuaucugguucaucagcaucugcauguauccucugaauaaugaagcaacauuucagcaauucuguuaaccacaccauuagagacauuuuuagaagugcugcaacauggugggaaccuaguacuuuaauaauuuccuaugauauuuauuagagcauaaaauguacaucacgauaguacaguauguaguccuuuaagaccagaagguauguuaacugcaccaucauuaagcagucuauccuauuuucuuauuuauuuguuagaauugaauccuuucucaauaucuguaccauuccuaugaugguagccauucuucucuuuauaaaauauuuccucuuugaaaagcguccuaaaacauuaauuucaaauccccucuuggaugcaaagugucccuaagaccauccauucaacaguauuuaugugagccaacuuacuagagccgcuacaacuaaucaugauagacaguccagaaucucccuggacuuuauacugggccagccucauugucccuaagauuucucuuuuuaugucucauggauuacuucucuuuuuaauugccccaggcacauuccaaaugagaaccugguaaaagucacauuggacccccuucaguaugucuucggcuaauguguuagccuucaauaaggugauaaccccuuuucaaccuaucuagucuauaaagaggaaaaauucagauuuggaguucuaauccuauuucucccaaagggaacuauucuucuaccccaugguucuaggagaccacuucacugugcaacaguuuuacaugcauuguggauggaggauauuuuuauucugaacuguuacauuuagguaaaaauauuuucugcagugguaacugauuagaaaaaugccaauuggaugcccuuagguggaggugagaaaauggcauccuugccuucuucucaauaugaaacauuaacuaguugacaaauuuauccuuguaguaaugaaaaucuauuuaaucagggaccagaaauggcugaggagauaaaugcaucauuacaaaauucugcuuuugaauccuggacauuacaaggggguaaaugcagcaugacuuuuuguuaaccacauuccaaaauguggaacauuucuuuuagaaaugaaaauauuucaaggcugauguauuuuaagacuacacauuaucaggaaacauacauugagaguucgcuuaauuaaagguuguugggcaucaaauuauguuuaguagguuacuauucucuaacaacucaaggaugcuuuaauggaucugaauuugacaaagagcaugccacacuaauacuacagucaacaacagcccagagaacaauuacuaugucagcuggaggcuauauuaugauucuaaauucuuaaagguuuuuuucccuccauaaaucaaaaauuaccuuauguaaaccaaaaauuaguugguauuuauggucaugaucuuaauucucaaguuuagcuuaaucuuguauuucauuguuugucuucuaauaugacagcuuaaauucagauuuuuaagugacucagcaaaauaggaggagugucccaauuuauuaguguuguacauauugaagaaaaccuuuuuguuccuucagauuuagaaagaaacaguuuaaccauuuauuucuugguauucugcugcugugaauagguuuacuuauucuuuuaacauauauugugugacuacgcaaguauagguccuguuguauugcauuaaucuuuaccaguaacuaaacaucacaagguuaauauugguuuggcugaaagaauuaugcaguaaaguuauuuauaagggaacaugaugacuuuauucaauauuuuucuucuuugaaacaucucauuacuaacuuuuaagauuauuucauaaucccuuauacaugagccaaugaaauauuuugagcucuacuuaagaagcaugaagucuauauuauaaaucuaaacaacaaaagcacuuguaacuuguuuaguaaauuccaugccuuauuuuccauuuuugacaccguaaagugcauuuucugucgacugugagcaaauuucccuuuugccuuuaaugaaaauagugcauuaaguagccaauugcugcagaauuauaaagcaaauuagcuaacagugggucacauuggacuaccacucaaagaaacaagaugcauaacagaugauggaagguacaugugguguggcuuagggagagcgcaccugugccagaugcaugccacuuucaguagcugccaaaugugccuuuaauuaagaacaucucuaauuuuuuucuucagaucaagucagcauuuggggucgggauuugggcagggaacuuuggggugcaaauaucuggugaaaccaccagagaauuuguuugucaaagugacauguauaauuuuaguugagacguguuuguguauauauguguauuugccuuuguuuaguagcacgguuauuugcuaaaauaauugucaaaaaauugcucugucggucggucuuugauguaagaacaaaguguggucuauacaucuaauauggccuuuguaccuaaccauguucauagguaaucuuuguacucugugugcagcaguauuugguuugcauuuaaagugaaaauaacggcuguuauuuuucuggcauuacuaagauaaacugaaaaauaauaaagaaaaaugccuuacauagcccacaaguguauuauuuuugcauguauuuauuuuagagggcaguauuuuugaaaucauuagugauucucauuuagcucauauaugccauauagaaauauuuugcauuuuuauuguggucuuucuuuggaggcac

SEQ ID NO: 21319 - RNA, 33499 nt, Homo sapiens
cugacugcauuaaugcuguuaguuuaauguggacagagacaucccacggcgugacuguuaguuaggaugagucagcuugggggaguuugugcuuccugcuugguguggccagccacaugccaagguccccugccuucuagcccagaaugacgggacugggcagaacacccccaacuuuuagcugccacuuggcucauuacagcaguaccaguaugggggugggaggggugaggcuguggagugaaggcggcguauagggcagagacuaagagguccugugagauucuuagaggagccauccugcuccaaggggccugagcugaguguggucugugagcaucugcugcuccucucagagagggagaucucacucucugccagucugucuagccccaaagagccugguuuucucaguaucaguguagcuccuggggacuucauaggcauaaagucaguccauuuccaugaagauaaggggauuaggaaagaagguucuacuaguuggcauagcaaacacgaggccaacaccaugagaacaguaggggaggggggggugagggcucagcccccagccccugacuggcagugauggcccaugcucaggaagugggauccucugaccuccccugaaucccucaccuucccaaguuucagagcugggccgagcuguugagugaaaugaccgaaggcagaguuuguauguucuccccgugucgccccauccauggaggaguugaaguuugugggaggggagagugguacucccugucgucaacuccucagcagaacugauaguuguugggcugcagcaagggcugggcgauauccccuugcucgcagcaggucaggugcucacuagagcucuccuccuccagcucacugcugcugcugccgcugccaccgcuucugcugcugcucggcagauugguauaguccugagggugggagggaccagaaacugucaguccagauccaucaggcccagcccaacgugcuuuaccggccacccaccccaagccucaccccacucacccgcucucuccuguccucuugggccugcuccugaaggaaggagcagaucugcuggaaggugggucugugggugggcuccaaggcccagcaggccugcaugaugcuguaucugggagauaggacagaggaugcccaugggcagcucccuaggguccaggggccauuaacacacaccccuagagagaccuacccagcagagguccccaaacccagucaaaguaaguuuaguauaaaaccuaugccaaguccuuggcaugcuuuaccauuuaauccucacaguaacccuugcagaaggguacucucaucacccucauucugacagaugaggccauuuugguauccucaggguaacuguaauaacgaucucuuaaaagucuguuuagggacaggugcaguggcucauuccuguaaucccaacacuuugggagguugaugcaggaggauugcauaaggccaggaguuccagaccagccuggacaacauagugagaucccaucucuacuaaaaaauuuuuuaaaaauagcugggcuugguggugcacaccuguagucccagcuguuugggaggcugaggccaaaggauugcuugagcccugaagauugaggcugcagugagcuaugauugcacacaucacugcgcuccagcccgggcuacagagcaagaugcugucucaaaaaaaaaaaaaaaaaaaaaggaaaaguggucgguuaggaccagcccuagugaacagcugcuucucugagaacaucccccauagcuugaacucaaaaggggcuuguuguguccacuaugggagagauaaagucugacccuggaacauuuuggacagggaaagaucagggccacacggccuuccaucccuuuccagcgaaagccugggguguccuuuucccucccugggaucccuucgcuuacauauucuuuggggcaaaugcaggcugggccauuugguauccauccuucaccaguuuauagaacuugcuguucaccaggaugccaggguagggauucagcccugcaaaggccaagaucagguaagaggccaugcccauugucuucuccccauucccgcacacccacacacaucuuagacuggguuuaaagggucccacuugacaacacugcaacagcagcuacucuuacccggugcuuccugugugccagccaguguguggcaggcuuaggcuuuaggaaggugugagccucuauccaggccuuaucacaccaaacauucuugcacaggcuuuggaaucagaccaaagcuucagcuguguaucguuaaaguguggacagucaggugguuaugaggguauaggagcagcguauuuaagaacugaguacaaguccuugugccuaguccucgggaaauagcaguucuuucuacuagagccuaguaguagagagcugcaucuucaagggucuguagauuucagacaaaggagggaaacagugacaaaggaggguaacagguaacagcaacugagcagagacaaacgagggaagagccagaaaggagcgccugucaggggcagagggucugccgagucccgcaggagccacgaugcuggguuucgagagcccuugcccauuccugcacucucaccaacccucgcuguguccugggcaccaaacagcuuuguccaccaguggggcaaccagaggagccagccccaggcucugccuggagugggcccaguggcucaccaagugagaagaucucccagaggaggaugccauaggaccagacgucgcucugaaccguguagacacagucaaagaugcucucuggggccauccacuucacaggcaggcgggccugggaugacaguccccaguuauuuugggccccgacucuucacccccuccccagccuggcccaagcccucccagcacuuacauugcccuugacaauguaguuggagucauucaugaugucccuagccagcccgaaguccccaaucuuggccacaugaccauuggucaacagcacguuacgcgcugccacgucccgguggaugcacugagggaaagcacugcaggguuagucuugggccuucuccuaccugagccugaggugaggaggauggcagggagggccccacauggcuuuggagucccugcuggagugaacaacaguuuugguccuuuaccacaaacccuugucuauaccuucuaccagggcccaggaucugagaauguguaucgugaucugaucauuuaaugcuuagaaacccccauuacccugagcagccauggcccuucucacccuuuguccucugacuggucugcucaggccccagaagcgaagggcuuccgugcagagagcagucuccaaacccuaccguuacuucugaucauagcagcugcuaucugccaggcccuucccuaaacucugcacacauugaacccuuuuucuuuucaacaaucguuaugcccauuuuuauagguguagaaacugaggcacagaauuuaaauaguugcuuaaagucacggagcagguggcagagccaacaaucaaaccacugacucccgaaucuguucuaaggaagauggcaagagcucccauucccuggcacuucuuccuaggccgagcgcacuuuauacguuaucuaauauccccaaaauucugaggaagcuuccguuaucauccccaccagaccgcgugcuuuaugagcagagacaacuguugucucucauacacuauuuaguaaaaacgaaugaagaaagccugguacccuuccucaucuucacgcuggggacacaggugcccagccccagagcuccagcccugggcacagcuuucucccacucauccuugcagcugcugcccaaaugacucucucauacucugucuccuccccuacccccucacaggcucccguuuccuccuccccaucgucacucauccagccuccccggagcacagaccuggguggcuaugagccagggccagguuccuacucacauucuuggaagcgaggaaggccaugcccugggcuacuuggcuggagaagugaagcaggucccggagcuccaggggccguccauccuccuuguccaggucuagggugggaagaggcgucagggcagcccugccacacuccccaccccucaccccagcagccccuucuccuuuucccuuguuaucaagcaaauggggccuggcccugggaccuccucaccuugcucagagaaggagucauuugaagaaguggagacaggccucaucuccacauagguguccacacccuggcuggagaagccacugucccuacauaggagagaggguuggggggcagaggucacucaucaucacugcacugcucagcucaggccuugaccacccaccaccccauggucaacuggaaccucccuuucugauaagaaacccuccugccacacuccaucugagugagcauuggucucugcucggcuguccccggugagggagcuuacaacccauucugguuuugggcagcucugccugugagaaaguucuucacuguuccuaaugccaaucuaccccugagauuuuccuccuagccccugcucuacccucaagggccacagagaaguuggaguccucuuccccauaacagcccuacuagaauuggggcauauucuagggccccuugugcccucucuucucuggacagugccucacaccccuggcuucacauuaaaaucacuucgggagcuuuuaggaucaggcuaauuacuaauacuucagaaacucuagggacaaaacagucauucacagauuuaaaucuccccaggugaucacaaaguacagccuaagcugaggcccacuggucuagagcagugcugcuuacgcugcaacucaugugcagauaaaucaccccgggaaucucugcaaugcagauuuugaaucagcaggccuggguggaugggccugagguggugcacuuccaacaguccucaagagaugccuaugagagcacacuugggguagagaauuugagaagcacuacuguagacugaagcacuacugcuccuaacguuccagccagauaggauuucucucucccuccuguccccucugcgcuagagauguguaccuugacaauguccauauucuaguguucccagaaggagaaaccgaaaaaaccuuccgcucccuuguagaaacuaugcuuccguuaacagccuggaauccuuugacagaguugguuuacaggccauuugcccucgaaauuacccacucugggaauacuuuccccaucugcguauuugaagauggaagcuaauacuuuccuuuggugcucauuuugaucugaucuucagaggccuagugugugccacccucauagaagugucagggaaucagaagaggaagugaugcugccaggcccccauuuuuaaggcccugggugaagagauggccuccuucucuuuugccuccccaggcguggcagcugacaguaucuaggaugagggcgcaguguacacccuucuuguucugauccuguccugaccccacaagccccugagacagagaccuccaggacagcaguguggcuugggugacuccuggacuggaagucaagagagcaggauucuaguccaggcuccaccucuaacccugacucaugugugacaugaaucuccccacuuccucucuuugguuccccauguggcucugucuguuggauggcucuguucuggauggcuuccaggaaucacagcaacaggacaacagagccaucucucuuuuuuuuugagacggaguuucauucuuguugcccaggcuggagugcaauggugugaucucagcucacagcaaccucugccuccuggguucaagcaauucucccgccucagccucccgaguagcugggauuauaggcaugcgccaccacgcccggcuaauuuuguauauuuaauagagacgggguuucaccuuguugguaaggcuggucucgaacucccauccucaggugaucugcccgccucagccucccaaagugcugggauuacaggcaugagccacugcacccggccacaucugcccaucucuuacuagggcuccaggcacagaucuugguugaucuuuuacacacacuggguggugauuucauugaugcauaucuccaccagauuaugagcugcccaucuuugcccuccacacucccagaacacgguagguguucaaauauuuguugaaugaaggggaaaaggaguagagaaacaagagauggccauaaaaccugugguggcuacuucccaugacacagguggcaggugagggcugcauagccacccauucaugagccauccaacccugagcuggcuuugaagacagacucggauccugccucccagaccuggccuuuuucuuguccuuugccaggggcuaccugcggacauauuucuucucgagguggauguucuuauagucgacgccucccucgggguccuggccggggcucaggcugggucccagcauggccucagccuuccuucgcagaaaguugagcaggucgccauagcaacaguacuccgugaugaccaguacagggccuagagcagccaaggguguggggugagggaggugcugagugcuccccuccaugaacaggagcaugagacugggggcagugaggccacuggacuuggacucagcauagcugaguucuaaccucggcucugugagcaaguuuccuugugccucaguaguuccauuuguuuaaaacagauggcuuuggcggggcacgguggcucaugccuguaaucucagcacuuugggaggccaagguggguggaucacgaggucaggagaucgagaccauccuggcuaacauggugaaaccccaucucuacaaaaauacaaaaaaaucagccgggcaugguggcaugugccuguaguuccaacuacucaggagguugaggcaggagaauugcuugaaccugggaggcagagguugcagugagccgagaucgcaccacugcacuccagccugggugacagagugaggcuccgucucaagaaaaaaaaaacaaaaaaugaaaaaaaaaagacaaccuuaaaaaaaauguagcccaagaauuauuucuucaaaggaaagcuauggcggcucacuguaggucagagcugcuaucagugaagaggauguggggcacuuggagucccagcaaagcccggggcaccuuugggggcccuggggagaguguccaagcauccuugaauggaagcuucauaagagguaggcggggggcuucacuccagacccagaggauccggcucccuggaagcagggccuaggagcuugcacauucaucuccuccuccaagggcuccgaugcucccuaucagucucucuuuauaccucaagcugcccgugcagcuccugacuauuccaggagaugggcccaggaguuuaagggaugcugugaccgggaucccccugacacuuggagcaguaggauccugagaaggagaagacggaacaagguagcccuggggcccugagauuccccagaggccccaagaccuuggccccaggaaccccaaggcccuuaccuccauggguacaggcucccagaagguugacgauguucucgugcuggcccagguggcucaugaucuucagcucggacaugagggccuccuucucaucagcaugggccguggcugggaggaagaaccacagucccaaagacagggagagggcaggacagagagcaccacacagauacauggggaccaaaugcagagacccaggggagaaagcagggcauaccccaagacccggagugaccagaagccaaaagaaggagaaggaaaaaugcagacacacagauggcagagagagagagaggagggaugagccugucacugagcuggucuucaggugacaggaagccaaacuguggccaggccauggccauagguggccuuucugcacccccagacuuuuuggagcucagucaggagccccuucacaacuaaagggugaccuagaccuucuuggagccgggagucagagggugccuggagcucacaagaaaacccaaguccucaccccugagcucugucccccaggcuucaacagguugaaaugugugugaugccucuugugacaccagggccagcccacccccagcaucuaccaccccccaucccuucccucauccccuccccucacucacacuucagcaucuucacagccaccuucaggacagcauccuccuugcccagaccaaaggccguggccuccaccaccuucccaaaggcuccagcuccgagggucuuaccugccacgcacacaggucccuuaagucccugggcaccaaagggccucuguccaagggcccaugggcucccugcaacccccacaggcccugugauaggaagcuguggagugaugagcugccaucucaccaaacugcagguuguuccgggggaacucccacuucucguuguaaggcagcugcguggggucgaugaaaguauaacuguugcccucauagcucucgaugaucuuccagcggaccugguacuugggcuucugcagaagaggaagggagcacguggcagucggggcuggcaggcaguuccuggaccuuguuucugacccccaagagcaggggugugggcagucccaaggcgcccagugggagaaggcagggcaaggccugcucugggcugagagaggucgucucaugaacauagcacugagagcauguuccugcuugacucugccuuguugugugaccuucccuucuccaagccuguuucacuauuuguguauugaagaccuuggacaagacaaccucugagggcccugauaucucugauaaucugguaauuccugagccaggagggaggguggaacuugagaucuuauccauccguucaucuguccauccaucuacccauccauccacccacccaaccucccauccaaauauauauauauauuuuaauugugauaaaacauacaugaaauuuaccauuucaaccauuuuuaaguguaugguucaguaguauuaaguaaauuacauucuaccuugugcaaccaguuuccagagcucuuuucaucuugcaaaacugaaauucuguuccuguuaaaaagcaacuccccuuucccuccuccagccccuggcaaccaugauucugcugucucugugaauugcacugcucuaggcacugcaccucaguggacucacacagcaugugucuauugagauugccuuauuucacccagcauaaugucuucaagguucauucaugcugcagcacaggucagaauucccuuccuuuuuaaggcugaauaauaguagcccauccacauacuuucuugaacaucuauuugugucaggcaccgcugauucagaguugaacaggacaaagucccugccccuccauggaguuugcauucuaguggcugagagaggcauuaaacgcaaauaaacauguaucuaggagauucucaaguggugcuaugaagaaaauaaaguaagauaagucagggaaggccccuaaagagcccaccaugugaccaucagaggaagaauuuuccaggaacagugcauggaaaugcuguaugcuugacaugggaaugauccuggcaaguuugagcuauaggaaggcagccaucauggcuugagggaaguggggggcagauuccagaaacaggaaggccuugagggcuaugauaaggugaguggguucccuuuugggauuuuuuuuuuuccaagacaggaucucugucccccagacuggcaugcagugggggcagucuuggcucacuacagccucgacccccgagguucaagcaauccucccaccucagucucccaagcagccgggacuacaagcauguggcaccacaccuggcuaauuuuuguagagacggggcuuugucgcagccuaggcuggucuugaacucgugagcucaagcaguuugccugccucggucucucaaagugcugggauuacaggcaugagcuaccaugccuggccgggcagugagagacccugagaguuugacacaggugagucgccaucugacuuuuuuuuuuugagacagagucuugcuccuucacucaugccggagugcaguggcacgaucauagcucacuaggcucaaacuccugggcucaagcaauccuucugccuuggccucucaaagugcugggauuauaggcgugagccaucgcacccagccuugacuuuaccuuuuugagagagaaagagagacgcugcccacuagauagauucuggaggaccagcaccuuuggaaagaccugauuuccuuccuuaggcucuccaugcuguuaccacccagccaggggaggcaagcccugggauguggggaggaggaauggcugccccuguuucuugcccaggggucagcugcugagggggaguaccaugcuaaggguugcccacaagaaaugcugauggaagaccaaguugagggggaaaguggaagcugggcuggggcgguggaggacacugaggcccugggucagcagagcaacucuuuccggccaggccuuggggaugggacaagcuuggcugugccugcagcugggcuccuucccugggcacccgagcuagaaacuuaaaggaaguguggaccggugcuagggaggaggcuggccuuuagcugcaaguccugguugagagagaagauuccagucauguccuuugcagcaacguggugcagcugaaggccauuauccuaagcaaauuaacaccgaaacagaaaaccuacauaccgcauguucucacuuauaagugggagcuaaauauugagugugcaugggcauaaagauggcaccaacagacacugggggcuacuagagcagggaggguggaagcgggcgaggguugaaaaacuaugggagcuaugcucaguagcaggugaugggauccauauuccaaagcucagcaucacgaaacauacgcaugcaacaaaccuguacgucuauccccugaaucaaaaauaaaauguggacauuuuuaaagagagagacagggagaaagcuuccagcuaaccaucaggaagaacuucuagcugguaguuagagagaaaagacugcaauuagaaaugagaaggaacuaacuuccaggcucugauucggaagggcggacugcaggugaacuucagagccucugcguuauagcuugggagagagucugaaacgggacccagggagaagaacuucccaagccucugaggauccaaauccugcccgugggugccuucccagcccaaaagacagcaacaaggcaaggaggggauucuucagccucuccuggccacuuccaucucuaggagccucuguggcuaagacuguuuuuucuuaccacuucuuguuccucugucccucugcagcugggcugagucagccccucccugcccccagcugggcagggggcacuguugaaagggaggggaucaaggaggauggagguuuggcuggauucucagauuucugaauccuaggcuccuaauuucuggaagcggaccaagcugccuucugccugccucaggaacccuccccugccccugcugggcauguaaaccucccagggcaccugugccaucccuggaaagggcucaugggcgucuacccagaggcagccucucuuccaaagaacuaugagugagagaucaagagguggggaugggcgaggcucccugagaaggguggacguaauugucaugauggcagcggguucuuccugagcucuuccugggaguggggcgcugggcuagaugcuugaagcacaucaccccauucauuccuugcaaugggccuaagccccaggcccacccccugacuucuucccuuccucccauccuccccaccaaagggggcauggagacaaagucccgguccccuccccaucuaggccugcugguucugggugaguggauguucuccaucccaggaagguggagaucugaacaauucccaguggaaucuuuggggacccuccuguugcuccucagagcucaguuccagcccccagaaucguagucuuuccagcagccucccuggacccucccuucccugcugccucagccauuucccugugcgccuccuccuccaggggagccugcugacuccugcccuuuucucuucccccacggccccccuuguggucacucugggggacagaaaggugaugauucagcccugaggcagaacaaacacuccccacagacaggccacuucuuuccccaggccugggcaaugaggagaggcugggcugaguccccagugaaggggcaaggcuccgaaccucauggggcaaggcagaggaggaugggagggcaggcacuuagcacgggcaugaccauccugcccccuccgcucccauggguggacaccucggccuggagcuaaagggucugugaauggguguaggggaggaggguagcugcaagucuucucgcagccuugcaugggcuccaggggcagcugaauuuccuggacaggaaguguggaggugacauguuccaaaaauggucccguggagaggggauacagaguuccuaaaccacagccaagggggcuggccagcccaaggcagaaagggccgcagggggcccuaggcucuucucuggaaucucugcaugacuguccuggcagcucugugggcacugcgaggcaguuuucaguuccauguaaggaagaacuuugcaaacauuggagcugcucagagaaggaacagguggccccgagagugaguaagguccugucccuggaggugggugggcugggccaaacaaccgcuuuggguguguagucaaggagaugaugcccgaccucagaccucccccuccuuccaccaucccaagaggcaugagcuaacucugguuccccaacgaacuuccuccugggacaagagugugcagcucccaucacagagacugucucguccagcaccccgcucaguccucuaugugcguugugguacggaaucccucacaacaggcuguuaaugaucccauuuuacaaauggagaagagacucagacacaccaacuuucucaucaucccauagccagagcuuggcagaggcaggauuuggacccagauucacugaaguccaaguuucuggugcuuaaacuagaccaccagugggcucuuggcaugucagaggaggaggggcuguuagagaacacccagacccaugguauaagaggggaaacuaaggcccagagaggacagcgagucagcugagguuacauggcaaaacagugucagagcuggaccuagauccggagguauugaccggggcugcccucagagcagccuucucaugcugagugcuggcaggaguagagaucccgauccaugugccccuggggcucccccaacauccuucccacccugcccacuucaagcccucuucucacaaaagccccaaggggguguggggaagaaaagguagccaaggggacacaagaugggucauucaguccuugaucacaccacucccuuguucaaacccacugauggccuuggaccgacagggugggguccaacccuucagacccccaaccccacccugguccuucccucaccugcaccucugcacacucugcccucucccccagagguacccuuucccuuagugucaucuccccugcugcauccucauccuccaaagcccgucccaccaaugccaagccaccuccuccaggcagucucccuuacccaccagccugaaaaguccguccaccucugaacucccacagcccucuggccugguccucucagcuucugaucacauugcacauggucuuugugugggcaggcaggcaguggaggccaugggcucuagggacagaagccccuggggcccagugccaacccuaucccucagccccuugggguuuuuuuuuuuaaccuugcugagccucagcuuccugauggguaagauacugacuaguauacuuccugccuccagcuucuugugaggguaaaauaagaugagucaauguuucacauaaugauugggacaugcuuuggagugaguccuccuucaggguuaaaaaccagacucugccuuugaccagcuguagacaagggcaacugucccaaccucucagaaccucaguuuacaacucuguaaaacagacuaaugcuagcugcauacagugguugcugagggcauuaaaugagaugauguagguaacaugcuauagaaaaaugccccucaaaucacugucauauacugagcagacagugacaggaagcacacuauacgcaacaugcacuaaauuguggcuuuggcuaauaggacaguaacaugaaauaaugaagaggaugauggucacaggcccucgucuucacuagaccaugugcuucuuagggcagggcucaggccuggcccaggggacaccacgcuuguauauccauuuccucugccccgugcugggugccaggacaccccugggcugagacaggaucccagggcugcgcugccucagaaugccauuccucuccucauagccucucacucuauaauccaugcucuugcuuucacggcuuuuuguuuguuuuuugagcugggaucuggcuguaucacccaggcuggucccuaacuccuggccucaagcaaucccccugccucaaccucccaaguagcugggauuacaggugugcccuugcuuuaauggcuauuugauuagcaccugucucucgcacuagacaguaaacgcuauuagggcagagccucagaggccacccagcagcugacucauguuggcauacaguaggcacccacuaaagagcuguuagcugauggacugacugaggaggaggaagggugaauccaugcagccuggggguaccauccaaaucuggcucacucaggcaccuggcagccccacuccgcuccggcucaccugcuuauacuuguacaauagcagcaggagcagcagcagcagcaaggccaugauggacaugcaggcgaccaccacuggugugaagaggaacucauccgggggaugcgugugggcuccuggaaggcaugaagcaaagcagugagcaggcaggggugccuccgagcccccugaggucaggccugcacacugccuggaacacagugggugcucaauaaaugcuuguugacugaaugaagcauccuccacuggaagccucuggagccucuccugcacacccuccccgagaaaggcagagaggacggccucuucagcucugcucaugcccagccccaaacccuguccagagucacagccuccuguggcuggggguagggagccucuggggucaugcagucucacccucugccagugcaagaaaccucucugcagcggccuggccuggugcccagccauggcuugcaugcacuacaccuccaggaagcucguucagaaaggccuucuggaggucacacugcaaccuuccucuccugcauuuccccugcagcuucuccacaugccuuuggaaucauacagcccuucugagggucuagcaagccaggcuuguggccccugagucuccucuucccagaaucuauacuacuaguucuagugauguuuuggagaacauaauuuccacuuccuugcucagaucaguaacuuagaucugcagucaaguuucaccugugccacuugggagcugugugacauugagccuagggaaaauucuauuuauuuccuagguuuguaggaguuaaucgagauaauccccacaaagagcuuaacacagugccuggcgcagcagaagccuucaacaaaauguuggcuuuauuauaauauacaaccuccagcagugaggcccagcgcggccgcaggcuccugcuugcagcuggacccugguagcaguugcuccaaggccagcagcuggggacgugagugaccaccccugagccaggcagaugccagggucuggcacacagugggugccagagccugguugucaaaagccugaggaugcugugggccucugagaaucacagaacuagcugguaaggagccuuuguguaaagcagagaggcagccuguguugugcacagggccgggcaucaucccccggggcagccucuugcacagcaaccucaaauggauagacugugucuggagcaagaggggagaguuggagaaggccguccuuagcuggccccgagcuggagauggacuguuuccuugcucauugccugccucccucaucagccucugagcucuggggaggcacugcuucccugcauagggcacgucccuggcacacggugcauaaugccugcacauacuugugaauagaugcaugaguuagagugcagggacaagagugggggccaguuucuucaggcugcuuucucucugcuuucucagagacuaccccguccuacugcuucgggggaccugccaggcaggaggggcuuggacuggcccagagagguggaccuugguacugcuaggaucugcuccaaagguggagccaaccccagcucccucgguggggggugggggaggagccgccuaaaggagcaggggcggggggcgggcgggggggcggugcgggugcgaaggcucccucucaccugcagagauggguaugaaggcccaggagccacuccccacgcuguugugggcccugcacucguagguuugguugugcucuaaggucucaacagucagcaggcucugcaccgucaccuuguggaagggcuccuggcucaggaccucaggguaugggucaucccagaccugcagcacuugggccucaucacaccuggcaaaagcagaauguggcucagagcuucaggguucccagcgccagcaugucccucccacucacagggugcccagccccugagcccaggugagggaggugaguggagcccacuuaccuaucaguguggccacugcacugcagccaugucacguugggcuggggguacccagaggcagcacacaaaagggugccagagccguugaugaauguccauaugacgcuuaccucuggggggucugaggaagaaaggaggaggccccaagucacacuuuccccgccaccucccaaucucccaguaccuacuucccugugcccugccccagucaaccccaucccuccaggcagucccagggccuccgccccagguggcgcucggccccagcacucacaucgaagggugagcucaaacgucagagcucuccagccuccuggguuucuggccaggaaggaguagcggccagccucagagggcuucaggcggggcagagagagggugaaggugugccugcaggagagaaucaggugguguuggugagccccagccuaguauggccccugccaggauugcagucagauaacagccuuaaagggguuuauuuuauuuuugguaaaauauucagggcccaacggccuuggguaagccagauacucagacagggugccauugagacaugcaaaaaccaccaaucccauuuccuuaguugguuuucuuaucugaaaguguuuuuuucccgagguuuaauagaggugaugucuucaaggugcugggaggccuaucacaggucgccuacguugaccacugucacuggacuaagcuuucaugaaagcugcaaucccugcuacaaaucccugaagugccaaccuugccaagagggacugagaaagagacaagaggcaggauguagggcccuggguucugagccauguugcugcagagacugggguucaaguccuggugcugcuguuucuuggcugugugaucuuagacaaguacuuaaccucucugaucccucacuuccuuugcugugagagugauaucgaugguuauuaauucacaggcuuggcuugaggauuaaaggaccuuuuuagggugcuugacacagaaguugaaucuuugugggcacucaauucaaugguacccuuuauuacagaaaaggcccuggagcaaaaacuaacaauaaaaaucaucuuuggcugauucugggaaauuuuuuguuuuauucuuucuuuaaucucuauuuuacaauuuguccauaaugaacauguguuguuuagguaauaaauacauuuuuuaaaaagucccccaguucacugucaaaauaaauaaaauuuuaaaaauuauagcaaauggccaguucuugcuugggaaaugucugcagcuacuacuagacuaaaaucuaugguauucagagagcagucucauccagccagacccugggcauauacaaggccucugcccaggucacuucuugagauaacuaaccccuuuaacuaaaaauaauuugacuuuuuuggauaauugaaagucaccauuaugaacaacccaucacaugaacuaaaauucuguggcuguuugguguccaggcuugucugccuugugcugaaugggcccagacuacuguguuuuaggggaucucguguuccuuuccucaaugucucuguggcuuauggacccauuaaaccgauccauggaccagcccccuccaaagggccuacacauuccagauucagaacuucugcuuuaaaugagaggaagacagagaccuggccagaaaggaccagaagggaacugagaggaggaagaugaggacaagaaaacauccuuguugcuucugacaauugacaagcaagauugugggaaucaaugagguuugggcuuccagagcuagaacgagaaucccaaagaguuuugaaguugucuaagggauccacacagggaugacaaacagaucucucaugagccaacuaugcuggaaauacugccugggaccuguguugaggaggacucugaggccgcaucuacacucugcagaacagaguugcagaaacaagaaugagagugaguguggcaugcacaccacguauucgcugcccuuaagcuguacugucucccucugaaagggcaggguaugaaugauuauuucaggccaggcacgauggcucacaccuguaauccuagcaccuugggaggccgaggcaggcagaucaccugaggucaggaguucgagaccagccuggccaacauggugaaacucugucucuacuaaaaauacaaaaauuagcugggugugguggugggcaucuguaaucccagcuacucgggaggcugaggcaggagaaucacuugaacccgggaggccgaguuugcagugagccgagauugugccauugcacuccagcaacaagagcaaaacuccaucuaaaaaaaauaauaaaaagaaagaaaagaaggaacuauuuuaauaccugaguuaauaccugauauaccugguaugaguguuccucuuaggcacaaagcuuucuuauuuagaaccuaccugcuuaagccacuuuggaugagaaagcaagaccccaagaacacaguucacaagcagacaggaaaaagauuucuaaaauguguguggaauacacaggauugugggaguggagagacggaagaagagggguguggaguuauuauagauugcacuucaugggaagaguuuugagcuuacagagaagagcagccagugagaaauucuuggggcugggugaucacaauccuuuaaagaacauuucauguaucugugauugugugaucuuaauucccucuuccccucccuccaagcuuuuguauguagcagauaacuugugcagucauuaucaggagugugucuaugaguggggcuguuuucugcauuuggauuggccccaagagaggaaaaugaaugaggcugaggguucuugagggaccaaugagaaugcacacucccaagaaaugguagaauccuuggguggggcauugacuaucccaaggaugugggauggagagguaggucaauuucaucuagaucucaaacacagaugaccaauauugggauuccaugaagucagggaaagcgaagcccagaaaggggcagggacuugcucaaggucauacaccaagguugggacaugagccaagcguccugaugcuugcugaagcauaccccaucugguugucgggcuguguagacgggagcugauaagugguaccuguauguguccuuggugguagcauuagcaagcuugggcucaggcugguggucagaaaagggucccagguagguccaguuaaaaccuugcaggccuggguaggccuccaccaugacuuugagguugagccccucccccacggucaccuccuggaugagguucugcucagagcucaaguucaaguaggcacucucuggaaagcagaacacacaagcaucuggcauuagugggaagauguccuuguuuauuuguccauuuugucauccacccauugauccagucccugagcagcuaugucacagguacauaguccccaccacccaagacagguccucugacaccccucuucucaccacccccuucagaaucccuggaucaaaacuuuucucacugaagcccuaggagaaccugggcaaaucccuauccccauuugugccuccaucuccuuauuuguguaaugaagagauugaauauaucugugauuuuccaaguuuuugaaaaauuuuuggcagcaagaaaacacacacacacauacacacacaauuucacguguccucauccauuucccuuucuucuggucauaaauuagucaaugcggcuuccaaauauagcucuggaguagguguguaacccaggccaaccagugaggguacucuguccccucuggcccggugauugguuuggguuaccaugaauccaugaguccauaacacucaauuccaugauuuuuguuaagacucugggaaaagagaagcccucauuuuacugguguugcuggaucagauacuacaaggcggauagucggaguccuacaaggggaaagccuuccuggcagggcugagaguuggggagucauagauucuuuccagcaucagcugaacaccuggauccaaguguuccugaagcugauauccaugagcuuuuuagcuauaaggaaaaaaauccuuuuaauuaggccaguuugaguugguuucuauuacuuguaucugaaagaguccugacuaguuuuuuuuuuuuuuuuuuuugaaacagagucuugcucugucauccaggcuggagugcaguggcacagucucugcucacugcaaccuccgccucccagguucaagcgauucuccggccucagccucccgaguagcugggacaacaguugcaugccaccacgcccagcuacuaacuaguuucuccuaaugacauuuugcacagauuguaauacagcugcucuuguugaaucucaggcaagggaauuguggcaagaaccccaauucacucagccucuccgugccugucaugguagccccugacaugccuucuuaaaaccucagggcucugccacaagcccuggacuagaugauuucuaagagcuccucuccuuacucuauucugucuaaaaaucugaaauucacccuucuacacugauauaugucuacucaaaagcccucuauggagucccauugccuccauuauucagcguggcguucaaggcucucaaucaaaucaggucucacugugcucauccagccaccuccccucuuccuuccuacacacacacacucaacgcuccacccaucugggucuccuaacaucccugaacacaccauagucauuccaaccuuggagguuuugcucaagcaauuuccucuaccagaaaucccauccuccuccuuuucauuauagaggccccuuuauccuuuaagauucacccccaugagggagucucuacucagugcuccaggacacaggaaccucucacuccacucgacuuuugcugcccuuccagacuacacacucauuaggcaccacaucugcacugcuucaugcaucugguucucccuccagguagcuuucuucucucuccaaguagucugugagcuuuugggggcaaggcuuuucucuucucugucucucucaacaauccaucuaucuauuauucauccauccauuaguccauucauccauccaaacaccaacaacuuccugcugccuucaccauuaccacucuaguccacccaccaucagcuccagccuggaccacugcgguagccuccuuucaucucaccuucccacuuuagcucucugaccucaucugagaccacuuuuuuucucacucucuccccgcagccacacuggcccacuuguccccugaacauggcaagcacagucccgcugcaggauggagcucccuucuccaaaauggccgcauggcuugcuccuucagcaauuuaagccuuugcucaaauaucagcuuucuagugagaucuuccuuggugaacacccuaucugaagcugcaaaugcuauauaauuuguuuuuuuaauaauuuacuuggcucauugcuugcccacucccagcuagagcacacacuucaugagucggggguuguuguaucuguuucacuugcagcuguauccucgaugucuagaacagugucuggcccaaagugugaaugaacauaaacauuucuugagugaugacuguaugccuguacuagaaagcagacaggauuagaagccguaacugaauucuugugcuuuugcucuucuuccccuuuacccugccaaagcucccagugcagauugggguccacagcagagcucacaaucugcugcaaguccagugccuugcacauacucuaggggcagugaugcucaugauucucaugcuccucgccaccuccaucucccauaacauucaacacaugaggcacggccagaccuaaaugucucagagccugcucccacuccgaugagcugcugccuugcuucagggucugaguccagugacugccacugccugcacccaaucaccauagccagagaccuggaggucauccuuaucuccuuucucuuccucaucccugcaucucagacucuuccacacaccacuggccaucuucagcccauucuccagccuccagguucccacccaacccacauggugccagacugagccuucucagauacuaucuccuggugcacacuuggacagcauuuccugugucagacccuguucuaaguacuuccuaucuaucuaucuaucuaucuaucuaucuaucuaucuaucuaucuaucuaucuaaucuaucuaucuucuaucuaugaaggcaguuacuguuaauaucuucauuuuacagguaggaaaacugagacacagggugguuagcaaccugcuaguccuuggcagacucagguuggaacacugcccuggagugugugcuccugaccaccacgaagugccuccucuguacaaucugaccccaucacucuccucuuuacaaugaccucccaauagguuaagaugcaguuauucuuucucacuuuaagacaccuuuaccuccggcuucugccaccuccucugcuccccuguggccacuccucacaccacuccacaucccagcuguugucaaguucuuucaguguuccaaaugaucuauguucucuuugccuuugagccuugcauauguuccucccucugccagaagcgcuguuccccuuccuuucccacccuucugcccggccaacucaccuucauucuucccaucccaguuuagaggccaccuucucgaagccuggguuggggggacucuucaguguucccaggacaccuugugcuucccccauaaucacugggugaucauugucuuuucauguuuccauaaaggaaugcaugaaagaaugaacaaaugaaguccaguagggagcuacuggaccccaauccccaaauaaacaaaaaauggcacuaaggugcacccaaugcagccaugcacuguaagagcuccaagaugggagagagaucccaggagaggguaagggaaagcuccuggagaguggcuccuuagccaggccuuggauaaacaaacuccagcagagauauccucagcaggucuccuucccugacaucagcuuccuccucaaaacccuucugcucacacuccugcaggaucccuaccgacuguccaccaccacccugaugcuuaccuaccacccggaagaacauggagguggagugcuugcccugcacguugcuggccacgcaggaguaguugccggcauguuggaaaucuacuugaucgagguugagggucaggacuuuuugguaacgguuauuaugaaagucagauuguugagggauugcgagcugcagccagaaggaauggagauguuauaccaagguaguuuagggauuagaaagaucuggguuccaauccucagccuuuaaggauuacuaucugccuuuccucugagccuguugcuucacuuguaaaauggggcuaauacuggcucccugccccaagacuguagugaggaguaaaugagauaugcaugcaaguggcuuagggcugugucuggaacacggcaggugcagugggaagggagggggcucuuagaggcagcccaacgugagucccuccuggaauccucccuccuccucccucucucccaaugucuuucugaaauagcuguuauauuccugggcuucaaugguggccuaggaaacccuugcuaaaucagaagugagcucaccucuggcuuuugucuaaaggcuggggcaaaggccaugugucaaggugacagagaaccaccuccccccacccacccccacaaaguucagcggcacaagcaugaguccugauucugugucagcuacugacugggagugagaucucgggugagucugcaccccucucuggagucugagcugugccuucagcuaagacagccaguuuggaguugggggcccaggacuccaccaugggaaaccuggugugcugggaggauggccagacuucaccuugugaucugcagggacugaccuugguguuguuguguuggaggaagacaucaaaguuaacaucaacgcugcuggcugagcacacgaucugggcagccuccccucgaauccgcaccagcucugcaggcaccagugucaaggcugggggcccugggaugacugagaccgggggagagaccccugaacacccaggcucccugaacaugauagagauauugcucuccucccugccaugggccaggacacacaggccaggguccccaucacugccccaucccaaauccugggaggcagccuugaugcucccaguccccccacugcaaggccuguccuaaagagaccuuggaaagucuacuuucuccaucaccucuaccccuccccagucccgucaccauucuccacucuggacuucugcaccagccuccucagagaccucccugccucccuccaagccccccacaccuagauucuucacuaaagugaccucuuacaaauauaaaugggaccaugccucucuccucuguaaacauuuggggcuucccauuacucucagaaaagaagucaaaguccuuccacagcccaaccuguuucugaccgcccugauaaccccaccccuuguucacugcacugcagcccgcuggaccucuuuccuaccacagggccuuugcacccaccuuucccuccuggaaugccuuuccucccacacuucaaaugggaggcuguucucauccuucagaucuuuagcucaaaaauuccucagcaaggcuucugugaccagcugauaugaauuagccuccccagcaccuccaugcccgccacuccccagcuugguuucuugcucaucacauuuguauuuacuuucuauuuaauaguuagacucuagucgaaugucaaauccgugacaggaauauuccagcagccagcaagaugccugaugcacaguaggccuugaauucauauuuaugcccauugcugcuguugaaagauaaucuaauccagauuccuaaggcccagggacaugaaaggacucacccaaggucccugagggggugucaaggcagaacuagggcccaggaccuuuggcucuuggccagcccagggcucugcaggaugaaaugccaggaaagagcccuaauggccuccucugcccacacagcugggguccuuugacccccugggcagguuuaguggcuucagaucccaguggcauugggcuagcugcuucacucugacccuggcccuuguuacagggacugauugcugucucaagcccagguccucaggcugggguccugcuugcucucaccaguccucccagaaaccagaauccugccugccaucccagcagggugagacuccaccuccacuguuaccuggccaccgcgagagccaucacacgcacccaccaucuccucccugccucuuggcucagcaucccuccuacacaugcccagcacuuggccuuaggcaggcccccagugggaaauccaugucugaggcugagcuuccguccucuuuccauaccuagaacauucagagccuguccccaccucaccacuugguacucacugucccccugcugaagcagaucuuugcacagccaccuucuucaugucauucagauuuccgcucuaauaaaguguuuccuucucagugaggcuccccgcccuacacacuccuuauucagcuaccauguugaauguuuauuuuuguagcauguccaaugacuugagaugaccuugcccacugaguuauuugcucacaugugguuugucucccugccccgacaccuugucaguccugccccauagaugaucguggaaccauugaggggaagaagugaaagaaagaggacaucccacugccccccaucacacccaguccccagucaccacccauguggccgccggcucucuguccccacucuucaggccuggcugccgguccccaugccccacgcaccuuucugcacuuucagccggaugcugauggacaucaccuuccugccacccaucagggcacugcauugauaguccuggcucugaaugaacuuggcccuguggauggugaagccaugccagggcgagaaggaguaguugguguggcgcaugaggggccggccacgcacacgcaccagcgagacgccugcuuccagcaccgggucugugagcagacagggcaguagugcguccugguccucgaacacgaccaccuccugugcuagcacguuccagggccgggcagggucuagaguagaggagggcacaggguuacaacugcccucccuccacugggccaaggaguaccuggacauaggugacaaggaagcucagagaggcugaucauucaucugaggucacaccacgccaggacaguucagcggaugcuucagcgugguggcuccagagucaggcgcaccugggcuccagucuagucccacuaugugaggcugugugaccuuggauaaccucccugcacuucuagaaaaugcaucaucauagacccgacuugcaggguuguugugaggacugcauuacauuagcagcucuuccagguccuugcucauagccagcacucaguaaaugcagagcugaauuguuacgauuguuaauuuuagggcccauuguaguggggccugccgggucaggccucuugggaggaggcucagacuccucaccuuugacauagagguggauggcggcgcugccucccagggggucuccaggcucagugcagcgauagguccccguguuuuggaagguagcguuguuggugcugaggaugcugcuggagccaucagaguacaggguccagugaggugauggggggccaucccauuccacgcugccauugcccacacaucgcaaggucaccguugcuccuggcuucacgaccagcucagggacacugggcucuaucacugggauucccugaccuggugggagagagggacagcagacagaagugaggucuaggaugcgccccuugggccguccugacucugagaugggugguagcuuggcagggauggugcugugccaucaagggaccaccuugaacgagccccugcccccuggucauuugcucagcuccuaacccucaaccugcucagggacagacugaugucucugauguccaggaggucccuccucugagaaagggggcuugcagcuugcucagccucucacccaggccucugucccccugggguccucagccuccugccucagucuucccugcugugaugccaucuuucuacuccccaggaauggacucuuuuaacccuguguacaaaguggacguauuucuaccaccgaaugaagaaacaaaugaauggaauguucacggccaaguccucagcuuaauucauaugggaaagaaaaaaaaagagauguaggaucuuagcccagcagaguuagagaggucccaagaaucuccuggugugcccgcucccaccaauggacaucuggucugcagcacagugggauggggaggugccaugccucaguuuccccaccuauaaaacagggacaaucaucguacccacucauugguauguuaggcauuuuaaaugcaugggaagacuuuagaacaucaccugucaccaaauaaauggcucaguaagaguuagucacuauguuuauuaccuagucuacacccagcagcucaccccggcacccccacacaucuguguuuacugggaagccaaucucuuuuaaggaaaauuuucuugaaggagaaaagagaacuugaaaccccuaucaggcuguccgggaagaaggcccguugccucugcagcgucagcauuuuuccagggccuaaaauaggggcaaaggagggaagugagagcugauucaagccuccgaggggcugccaggcgccccccagccugugugggcggaaacacauuguuggcgucaggcucagcccccgguuuccgcucagccuguggcccuucuacagggauguucucacuucugcuuccccagccuccuagccacucuccucucuccaggcagggagagggagugccacuugcggggcagcugugaggcugggcucugacgcugacccacuggcugacccuggccauccaacuccucagcucuggcccuuccucuucccagugaugggggcacaaugacaggccagccccgagggcuuucggugaauucaggguaucuccauuguucucugcaaacccccuugaaauggaaauucccccugccccaccauagagcccagaauuggaaagguuuccucucucaaguccuuucaggauggcuuaauucacguuuugauuuuguauucaucagaaugugcaucccuucuccccaagacucugaucagcaaacgagauugagugaauugugaauacugccaagccugccaccugggguuguagcccuccuaugcagugcaacugccaggaagagggacaagugucauuucuagcagccuuuuuagcaaaucucaacagagcuggggcugcccuaucacugcugcagcaaucuagggcccccaggccgggguuuuauagcaggaaacagcuuggagugugggcucacaccaacuuggguuuggaucuugguucuucccuuaccagcuggguuaguuucuuaaccucuuugagccucaggcuauucuucugucugaugggaauaaucccagcucccaccccaaaaacuucagcugaagguugagugagaugauguauagaacuacuccugcccugggcaccugcuuuaauugcuacauuucuaaugucccuucugggccaacucugaucgcucaagauuuuaaccuuggauucugugauuccauuuguuccuuuuuuacaccugccucacaccuuacagugggcuucucccaucccuucccccagccugucucucuagacccugccuuggccuccaggaaauguggucagggagcggugucugcccuauuuuguccuauccuauugucccagguauucacgcaggauaaggcugauacccgcaacuuccgcagccaacuuccccugcuggcuuggcuagcagggaaggaagccggcuuggcccccauccuccucggggugggggcaugggcuuaugaacauuaacugagguccccuucugugccuguccauucuuccccccucucaucuccacuccccaauucuccccaugccccacaccucuccacuagcucccacuugccuggaagccccucccucaucacuuccagaaugugccccaaucucuacucuucucucccaacacacacacacacacacacacacacacacacacacacacacacacacacacugcacacuaaggcuggacacagccccucuucagcccaggaucucaucgcaguaaugaagagagagccccccucucucucuaggguccuccaauaccauccccagucuccucacaguggccccucauccacucaucauuggucuguugggcugaaaacuuagguuuccagccuccccaucucuucuuucucuugggacuggacccuggaaaaccaucuggccccccucccacacaccaugccccugugaagggaaaauaaaaacuugggacccuaauucacucugccaaaaggaaaaaucaagcuggaaacugagucaugcaagaagcugccuugccuuuuauuccuaagcagauagcgacagauaaaagguaaaauaucccacaggcagcuccucuauguucacuuucccuauguaaagagccaauuuacugaaccgagauaauugacuguuccccuaccugcugcuuuucuuuugcaacauguggauuaccacaaccuccccuuuuccccuccagcccacuuuccccuuuaaauauuaaagcccucgaauucauccagaauggcacagaccacagaauguuuuugugacuccauguuuuuuucucgccagcauguccuuaaccuuggcaaaauaaacuucuaaauugauugaagccaggcacaguggcucaugccuguaaucccagcacuuugggacgccaaggcagggggaucgcuugaguucaggaguucgagaccagcauggccagcaugauaaaacccugucucuaccaaaaauaaaaaaauuagcugggugugguggcaggcaccaguaaucacagcuacucaggaguggcagaauugcuugaaccccggaggcggagguugcagugagccgagauccaugccauugcacuccagccugggcaacagagcaagacucggucucaaaaagauagaaaaaagaaagaaagaaagaaagaaagaaagaaagaaagaaagaaagaaagaaggaaggaaggaaggaaggaaggaaggaaggaaggaaggaaggaaggaaggaaggaaggaaggaagaaagaaaggaaggagauggagucuugcucugucgccuaggcuggagugcaguggcaugaucucagcucacugcaaccucugccucccggguucaagugauucucccaccucagccuccugaguagcuggaacuacaggaacccaccaccacacccggcuaauuuuuguauuuuuuaguagagagggggcuucaccauauuggcgaggcuggucugaaacuccugaucuugugauccacccgccucggccucccagagugcugggauuacaggugugagccaccaugccuggccacaagacuccaucucaauaaaaaaaauaaaauuaaauugagaccuggcucagauacuuuuccguuuuugccccacaggcagguuguggguguaaggauaggacaaggcagugaaaucaaaccugugggacucucugagaugaaggggguggcggguacacugugugugcauuugucagaccucauugaacuuaagaaccugugcuuucuacugcauguaaguuacauugcaaaauaagaaguccaggccgggcgccgugacucacaccaguaaucccaacacuuugggaggccaaggcagguggaucaccugaggucaggaguucgagaccagcuuggccaacauggugaaaucccaucucuacuaaaaauacaaaaauuagccagucaugaugguguaugccuguaaucccagcuugggaggcugagacaggagaaacacuugaacccgggagguggagguugcagugagccgagauugugccacuguacuccagccuggugacagagagagacucugucucaggaaaaaaaaaaaaaaaacccaaauacucaagcucagugugauugccugggccagagaaggauggucagugggccaucuccuccucaucagggaccagaagcgccacggccuuaggguccuucugugaagaggccaguaugaggcuguccuuucuccccuucaauccccauccucccccaaggucccuuugaauaagcaggcaauagaaauguguuuguugggccaacaagccaagcacagcagccccucaccucuagucauguucccucccagauggaaauucugcagaacugcuacagccuggggaccuccugagacuuggcagccugugucugggagggcucugguccaggagacccucacuggccucuucccaaucccuccucuagcccuauaccuauuucaccccgaauuccccucuccugagcccugggccagagaggccaaccucuugucucuccccucugaccccuuacacaagccacccaaggaagaaccaccaccccuaucaggcccuuccaaaucagaucuugcauagaaucaucgaaucacaggcuggcagagcugccagagccaucaggagcucuccagguccucccaacucaguguaggucuggaccagcagugccggcaucucacaucucccaggaguguguuggauauacagaaucucaggucgcaccugagaccgacugagucugaaucugcauuguaacaaaauccucagguaacuuguaugcacaggaaaguaugaaaagcacugcucuggucuagucuaucacugucccccugcccccaacaccugcaauugaauagaaguggacacugaagccucaagaguaucagaggcuugcucaggacacacagugagucgcuggcagagcugggacagauccacagcaccagguggaccaguuccaccacacccaucucuuuucaccccacuaccucuccaaagcagauacccacaagccugcaguccaguguuggggagacuaaaacagccugaggacacccagugaggggcaaggacugaauccuuucacaggggucuucuccaucacaccccaacaaagucccccaccccccguucugcucuuaccaugccaagcuguggccaccagcaggagcagcagaacuccugggcccauggccucgguggggaaguggcaggcaggugcagggcugcaaggugcccagggcacagagcucucagcuacuagcuccgcagggaucgggacacuggacacacguuccucuccucugcacuggcuguuugucuuguuuuccucuuccuccuccuugggcugauccucuucuuccccuuuuagcuaggcaaggcaaccacagaguuuggaaaucuugggucuuuaagaagaaaacaaagccuugaacccaagagggaggggucgcagucuggggcagggccagccugagcuuggggggagcuagcuaaguuuggggcccuucuaaagccaucuucaaggggucuugggagaagagacaugucca

SEQ ID NO: 21320 - RNA, 8351 nt, Homo sapiens
ccggugaaaaggcugcagccggacuuggggaggcgucgccaaguucgggaccgacgggccaaggcggcgcgucucggggguggagccuggaggugaccgcgccgcugcaacgcccccaccccccgcggucgcagugguucagcccgagaacuuuucauucauaaaaagaaaagacuccgcacggcgcgggugagucagaacccagcagccguguaccccgcagagccgccagccccgggcauguuccgagacuucggggaacccggcccgagcuccgggaacggcggcggguacggcggccccgcgcagcccccggccgcagcgcaggcagcccagcaggugaguggggcccgacgccgguggucccacgggaggaccgcgcgugggaggccggggucaacucccgcacgcuccgggacuggagcggggaaccggagucggggccgggcugggggcuggggcgaggauccugccccucgccguccggggccaguugcccccaccgcgcagcgggcagcagagacccgcgaacuccccuucucccagccgcccccuucucccucgccguccgcguccgucccuccgucuccgugcccgcuuucucuccuccugcccaccucugacuucugcguccacccugcuucagaaggggcgugggcgccuaggguggucgccucgaaggcuaggagggucucuccgcuucgggcugaauuccugggaucuggagucugggcuggggugaggguccccacacgggagggaggcgggauccgucgggagagcagcugggccagggugggagucccggcccggucugcgacccuccgcguguccguccgucugucuguccuucgccccuccgucgccaagucccuaucguuucucggccuggggaguccagggggguccgggcaguggaaccugccagguccccggagaccggcccucgaucccuuugccgaaugcggcgaauagagaccucgagguuccgggacgugcgcggggucaggcugcgggcgacucucgcgaccccacucucagccccuaacggcgcccgcugcccgccggggggcacccgggaggcugcaggugcccauuuccugucgaggggcugcgagcacgugucgacaggggagggaaggaggggcguccguuccgccgagucacggcggccgagucacggcggcugagucacccggggcgucccucccuuccuggccuggagcggcccgggcccgggagugggagaugccgccggcggugccucggacccggaacuggggucacugggacgccgggcccgcagcgcuugggcucgggcuaccgcugucgggacuugccugggcuugugggcgcuucccggacgauugggcgcccacacccagggcccagcggcagagcuagaacccacuucucccagaacacugagccccaucccaacccacuccucagauagcuggcugauagaaugggaacagggacguugugcugggcgcuugcuacaucauuuaccauauuucacggaaucgaagaccucaucgauugaaaaaaaaacccacuauaacuuuaugccacuaauuuucuuuccuucucuuucuuuucuuuuuuuuuuuuuuucugagacagggucucccucuguugcccagacuauagagcaguggugcaaucacagcucacugcagccucagccuccugggcucaagcaauccuacugagauccuagcugggaagcgaccuggccacaggcacgcaccaccacacccaacuaauuuuuuaauuuuuuuguagaaaugaagucucacuguguugcccggugugaccucaaacuccugagcucaagugauccuucuaccucagccucccaaagugcuggguaugagccaccaugccuaguccacuaaaauuuuuuaaauugccaauuaaacuaugauuucagagcuauuaaaggguacuucuuaacaucagugaaauccuguaauccucaccuguaacaauauuaaaaaugaggaaacugaggcacauggagguuaaauaacuugcccauggucacacagccaguaaguagcugagagcugagauuagaauugggacagccugccaugccagguggcuaaagccugucaucucaacacuuugggaggcugagguggguggacugcuucagcucaggaauuugagaccacccugggcaaccuagugagacccugucucuacaaaaaaauuuaaaaaaaauuagccaggccgugcgcggugccucaugccuauaaucccagcacugugggaggccaaggcggguggaucaccagaggucaggaguucaagaccagccuggccaacauagugaaacccugucucuacuaaaaauacaaaaauuagccgggcacaguugugggcgccuguagucccagcuacucgggaggcugaggcaggagaauugcuugaauccaggagguggagguugcagugaggcgagaucgggcuacugcacuccaaccugggugacaaagcaagacugugucucaaaaaaaaaaaaacagaaaagaaaaaaaaaauuagccaaaugugguggugcacgucgguagucccagcuacuugggaggcugaggugggaggauugcuugagcccgcaggucacugcacuccaaccugggugaaagagugagacccugucucaagaaaaaaaaaaaaaaaagcaauggaauggccugaacccagagcagugacucuuuccugccucagccccucugcacugggcaccugccacuuaccagacugucgcacacauucucucaccugauucucacagccuccccuugagcugggagcuguaauuauccucuucgugcaaacgggugcaggaguggguaagagcccagcugcugggcucauuggcucugugucugcggacaacuguucucccgucugaaaaugaagauacuaggcugggcgcugugguucacgccuguaaucccagcacuuugggaggccgaggcggguggaucaccugagguugggagcuggagaccagccuggcaaacauggugaaacccugucucuaccacaaauacaaaaauuagccgggcaugguggugcacgccuauaaucccagcuacucaggaggcuggggcaggaggaucacucgaaccugggaggcgcagguugcagugagcugagaucgugccacuacacuccagccugggcaacagagugagacuccaucugaaaaaaaaaaaagaaaaaaaagaaagaaaagaaaaugaagauauuacugugccaaugauaugagucaguauuuguaaagugguuagaacaguuccuggcaguuugugcuuuauaaauguuaguucuaauggggaaaugggggcacagagagguuaugugaccugccccaaagccacacagcuuaugagcagggauuugccaccaggucagucucugacugccaagcugugcucuuucuguucccagagcuagccuguacauugaagguagacagcaguguagccucugcccaguggaagccccucaauccacacggaccucaucuguggccuuccauuucuuauuccuuagaaguuccaccuggugccaagcaucaacaccaugaguggcagucaggagcugcaguggaugguacagccucauuuccuggggcccagcaguuaccccaggccucugaccuacccucaguacagccccccacaaccccggccaggagucauccgggcccuggggccgccuccagggguacgucgaaggccuugugaacagguaaggcacagaggcauugcagugguuccgaccccgcccaggagugcuagggugcagagaagcuccugccagaaaggagagcacaggcuuaggaggggguaagguaggcuacaggugacuacugcccaaggcugaaagugauaggagccccacgggaggcccagaggguacaacagucacuuccagaucagggaaagcuuccuggaaaagguggcauauuagccuagaaggauggguaggacuggcagaggcagagaggaaggaaaggacauuccagguagcggggguggcaggagcaaggauggaggcggaggcaagaacauguaaggugcgcacacggaauggugagggggucuccaccugcugacaugcauagagggggcgcuuauguugucugggagagaacaggaacaagaggguucccuucagcuacucccucagucucaguuucccugucucauuuaauccucacaaaaucucucuggggaauguacucugguuuuccccaucuuccaccaaagaaaugaaggcacagaaggguagucacuugcccaagaucacacaaguagugaguaaugacacaggacuggccuuggccccaggucuauacaacucuaaagucagauccuaaccaccaaaccagggccaggugcaguagcucaugccuguaaucccagcacuuugagagaccuaggcaggaggaucacuugaggccaggaguucaagacuagguugggcaacauagagagacccugucucuaccgaaaaaacaaaauaaaauaaaacccccaaaacuaaucaccaagccacgcugucucacuggaagcuaacagaaggcucaaaguagagggaacugacaauucuuggcuccccaaagcccuuaccaaaauaagugaguaagagauggcgagucuuuaaaggaguggcucaucuuuccucucccuggggcauuuuggugugggagacuacaggggaugagguuaaaaagcuuggucggcagguagaggauggggagagagguuagggcccugggaaaggugagagaucagccagagacagguuucccagaacagaaugucuggccuuuguggugaggagggacugugguaugagccgcagaagcgggccagggguaaacccuccugugcguccuuccuucagccugguccugagggugacccuuugauccuggguucuccagguagggcugugagcugugaguuggauccuuuuggugaaauggucucucucaucuggccugucacucaauguggaauagagugagugaguucuauggguucuaaguccugcucuggaaccauaaguaaguuauccucucugggcuucaguuuuucauggaaaguugcguuaagaaucuaguuuaaggccaggcaugguggcucacgccuguaaucccagcacuuugggaggccaaggaagguggaucaugaggucaggagaucgagaccauccuggcuaacaugaugaaaccgugucucuacuaaaaaauacaaaaaauuagcugggcgugguggaaggcaccuguagucgcagcuacucgggaggcugaggcaggagaauggcgugaaccccggaggcggagcuugcagugagccgagauggcaccacugcacuccagccugggcaacagagugagacuccgucucaaaaaaaaaaaaaaaaaagaaucuauguuuuuuuaaaaaagaggccagcuguggugacucccccugguaauccaaacauucuaggaggccagugcaggaggaucccuugagcccaugaguuccagaccagccugggcaacacagugagaccccgucacuacacaaaaaaaaaaaagaaaaaaaaaggccgagcacaguggcucaugccuguaaucccagcacuuugggaggcugaggaggguggaucaccugagguuaagaguucaagaccagccuggccaacauggugaaaccucgucucuacuaaaaauacaaaaauuagccagguguggugguacaugccuguaaucccagcuacuugggaggcugaggcacgagaaucacuugaacccaguagguggagguugcagugagccaagauugggccaaugcacuccagccugggaaagagugagacucugucuaaaaaaaauaaaauaaaauaaaauaaaaucuuugcauguucucagugaaaaacaagaaucuacguaaaguacuuggcuggcacauaguaguuuuccaauaaauugcaacuuaaucagcagcacucauuagccccuccuagugcuuacagcucauggaagaggagacuugguuguccacagauccagaaggaugaggguccugcaaagagggugcugagaaggaaaggucacuucuggcuggggaauaagacggcuuccuggaggcaggagcaucuuaguugaguccugggagaugaggaggguuaggguuugcggagggggagggcauuaugggagaggaaugugcacuaaagcuaggugcgaggaggaaauuuuaccaaucaaagcagacagcgccucagugcagggaacugguugggugcagugaucccuaaaucaccggcugagggggcccugccaugaccucugccaggguccuaccacugggccaccaugaggggcgaguuccaggcagccaguagcccaggguccuccucacugcgggucucacccccagaucagcccggaggaagaggagcgccgccgaguaaggcgcgagcggaacaagcuggcugcggccaagugcaggaaccggaggaaggaacugaccgacuuccugcaggcggugagcaccagcccugguccaccgagcucagagggacccugucucccagagcccccagagccccaguauauguagcccccuccucaccauccuagcuccuugucugaggggcaguccuucugggaaaaugaugaggaaaaauugauuagaaacuggcugcagcaugucucacucacagcagagcugaagcucagccagcaaucuccuuuuuuuuuugagacagagucucgcucugucacccaggcuggagugcagugaugagaucucggcucauggcucacugugacaucugucucccaggcuccagcaauucuuaugccucagccugcugaguaccuggggcuacaggcgccugccucccuacccgacuaauuuuuguauuuuuaguagagacgggguuucgccaaguuagccaggcuggucucaaacuccuggucucaagugauccgcccgccucagccucccaaagugcugggauuacaggccggagucacugccuggugccagcaaucuccuaaaacgucugggccugaugggaguugugcccauuuucucccaggggcuuaugggaguuguaguccagacuugcuggggacucuccacugcccccccucuccccccgcccaaccccagcuccucagaacccugaguccaaacgucugcggcucugggguauucagcccucaccuuucugacuccucuccugaucuucuacaggagacugacaaacuggaagaugagaaaucugggcugcagcgagagauugaggagcugcagaagcagaaggagcgccuagagcuggugcuggaagcccaccgacccaucugcaaaaucccggaaggagccaaggagggggacacaggcaguaccaguggcaccagcagcccaccagcccccugccgcccuguaccuuguaucucccuuuccccagggccugugcuugaaccugaggcacugcacacccccacacucaugaccacacccucccuaacuccuuucacccccagccuggucuucaccuaccccagcacuccugagccuugugccucagcucaucgcaagaguagcagcagcagcggagacccauccucugacccccuuggcucuccaacccuccucgcuuugugaggcgccugagcccuacucccugcagaugccacccuagccaaugucuccuccccuucccccaccgguccagcuggccuggacaguaucccacauccaacuccagcaacuucuucuccaucccucuaaugagacugaccauauugugcuucacaguagagccagcuuggggccaccaaagcugcccacuguuucucuugagcuggccucucuagcacaauuugcacuaaaucagagacaaaauauuucccauuugugccagaggaauccuggcagcccagagacuuuguagauccuuagagguccucuggagcccuaaccccuuccagaucacugccacacucuccaucacccucuuccugugauccacccaacccuaucuccugacagaaggugccacuuuacccaccuagaacacuaacucaccagccccacugccagcagcagcaggugauuggaccaggccauucugccgcccccuccugaaccgcacagcucaggaggcgcccuuggcuucugugaugagcugaucugcggaucucagcuuugagaagccuucagcuccagggaauccaagccuccacagcgagggcagcugcuauuuauuuuccuaaagagaguauuuuuauacaaaccuaccaaaauggaauaaaaggcuug

SEQ ID NO: 21321 - RNA, 9541 nt, Homo sapiens
ggcggggccgggacccgggagcuagccgagccaccgggcacgccagccucuucguccucggcgaggcgcgcacuuggccccgacccccggcagcggcugugcgugcagccucuucguccuccgcgcggcgugcacuugcucccggccccugcgccgggcggcggcggggcagcgcgcaggcgcggccggauuccgggcagugacgcgacggcgggccgcgcggcgcauuuccgccucuggcgaauggcucgucuguagugcacgccgcgggcccagcugcgaccccggccccgcccccgggaccccggccauggacggugaggucgcccucugaccccgcgggguggcaucgccggggccgccgcggcuguggcgggagcccccgcgccgcuuuccgccccuuccugcgccgacgggcgcugcgcagggagcggucggccugccggaugguggcgcggggcggggcaggcggggaggggucugacucaguuuccccucuggguggaggggguggcccuugacucagcauccucccugggugggggagcagagggaaccuugacucaguuucccuccacaccguccaugggggcagcucuggcuucguuucccuauuaggggagaacgcaucugauucaguuuccucucuggagggagguggggcgugcccucccucaauuuuccuuaagaaaguacaacaggcccugauucagcuucccucuggagaagaaggauuccuuaccccguuuucccucaagaagcagguguuucugguuccuuuccuccaccccuuaguuucaccgcagguucuagggagcagguccugacucaguuccccugggagggagccuggcuucuccucuccguggagagcagauuccuccuugugagaaugggcauugggugugugcugacccugaucucccuccccuuucagaacuguucccccucaucuucccggcagguaaguggcccccgcggcggucggggaggugcucccugggguagggcagugggggcagccgccuaauggggcugcgguguccccuggcagagccagcccaggccucuggccccuauguggagaucauugagcagcccaagcagcggggcaugcgcuuccgcuacaagugcgaggggcgcuccgcgggcagcaucccaggcgagaggagcacagauaccaccaagacccaccccaccaucaaggucagcacugcgccagggugugcggggaagggacuguggaaccccagcccucuguguuugggagucagguuuggaugucugggccucuguacuuuggacagaucaauggcuacacaggaccagggacagugcgcaucucccuggucaccaaggacccuccucaccggccucacccccacgagcuuguaggaaaggacugccgggauggcuucuaugaggcugagcucugcccggaccgcugcauccacaggugaggucccugcaggcuaggaggcccagcaugaggggacaggaggcgggcuaugaaguagccgcuacaguguuacuccuuucuggacccagggcagaauuccucacuccuugcccugacucagcucugcaaguaaacugccuuugucuugaaauuaucuauuuguacguuuacucuagcagaugaguuccaggggauacggaugggucccuaaucacuucugaauuccugaccccuguagcuggaaggacaagucccucagagucacgucucuuguuugaggaagaaaaccauugaaccagcacucuccccuggaguugacauugcaguugacagagacaggcuguaaaaaaauauacaggccgggcauaguggcucaugcuuauaauccuagcacuucgggaggccaaggcaggaagaucucuugagccuaggaauucaagacuagccaaggcaacauagugagaccccaugucuacaaaaaauaagaaauuagcuggguaugguggcaugcgccuauagucccagggaggcugaggugggaggaucgccugagcccaggaggucacugcugcggcaagcuaugauugcaccacugcacuuggguggcagggcgauaccuugucuuuuuuuuuuuuuuuuuuuuuuuaagaaagagucuugcucuguccccagacuggagugcaguggcgcgaucucagcucacugcaaccuccaccuuccggguucaugccauucuccugccucagcuucccgaauagcugggacuacaggugccugccaccacgccuggcuaauuuuuuguauuuuuuaguagagacaggguuucaccguguuagccaggauggucucaaucuccugaccuugugaucugccugucuuggccucccaaagugcugggauuacaggcuugagccaccgcacccggcccgacacugugucucuuaaaaauaaauaaauacacagauaaauaaacaaggugcugucagaguaacaguuucaguccugaaaauaaaacgaggucauaggauagaaggauaaccuggggugggggaguuaggggagcuggugugugaugacuuuagauugggaggucagggaaggccucccucagcuaagacuugaauggugagaaggaggagagaaguaggaaaagaacauuccaagccgaccaaacaagugcaaaggccuugaggugggaaugaguguccuguguuuagagaguggaaaaggagccccgguggcuguaagcagggagcccacagggaggcuggcaggggcaggggcacggaggugcuugucagcugagugaagggacaggguucguugcagcacaguaggaagccacuggagaggguuaggcauggagcgaugaucuaggggugggcagaguaggaaggagcaggcugggcaaggcaggaaggucugggcucugugagagacagugggacagacgacugggggcgcucaguuuccagaaccugggaauccagugugugaagaagcgggaccuggagcaggcuaucagucagcgcauccagaccaacaacaaccccuuccaaggugagggcaaaccugccugccacacccgcacccucugucacccuccccagcccgccuuuccugcaucucccucacuggccaagacacaguaaagcuggaaucuuggugcccauucaguacucucccacuuuaccacugggaaacugagucccaggaggggacaugacauucaggccacaguggagucagugcuggguucugccuccucuaggacuuguguuucacacacgcaccagcggcccucccagcgcagagcucccugcccccacugauagcaccuauauccccacuuccccugcucuccugaucgccuguuuucuuggcaguuccuauagaagagcagcguggggacuacgaccugaaugcugugcggcucugcuuccaggugacagugcgggacccaucaggcaggccccuccgccugccgccuguccuuucucaucccaucuuugacaaucgugaguagcgagggagacgcaggaaggggagagggugggccugaauaggaggaaggggguuggggugaguguggccugcaagaggcgcucuggcuucauucaaucaucuugcguauuugucuacucuucucugcccagcucuuuguuggcuggggagagagggcaaagaagacccagagcuguccuugagguguagcucuggccuggcaggaagucuagcagagagucugaugggagaugggcauuuucaguauugugugaugagaagguggugugcccacaacugcgauaaugacucuaggaaaugaacucccaggaacaagauaguguucgagaaugaugauucagugauggaagcccacagaugaauugggcugacugaucagcugcagucuuuaguuaaguaaccagcaggaugaauggaaauaaaacgaaucuggagccccaaggaugggaaaccaggauaaacugggggucaggagggaagggcucauugccaagguggguauggacuggccuuaaagauugcuuuggucagguggagaaagagugugaucagauuggcacccacuggacuauaagcuccgggagagcagagagguuuggguuuuguguguggucguauucuugcuuagaucaguguugagugcacaguaggcaaauacuuguugaaucgguuggggugaggagcuaauaagaaggucugacuuuggcuacaaagguguagguggcaagcucugggcaaccuugacucugggcugggcagggaaguugcaucuccugcaggccacccuggggaccucucguggcucaggucauccucccuuguuuucacugccucaggugcccccaacacugccgagcucaagaucugccgagugaaccgaaacucuggcagcugccucgguggggaugagaucuuccuacugugugacaaggugcagaaagguauacaucaggaggcaggggugggcucuugggagcaaggggugaagcugagcagagaaguggagugucagguaacuggcuuuggauacuuccuccugugccucgggggccucaggugggccgaagggugauguaucagaagacaagcaucagaaguugagggggagaccauggaggguuagacacacugacccacacugccaccgcaucuccugcagaggacauugagguguauuucacgggaccaggcugggaggcccgaggcuccuuuucgcaagcugaugugcaccgacaaguggccauuguguuccggaccccucccuacgcagaccccagccugcaggcuccugugcgugucuccaugcagcugcggcggccuuccgaccgggagcucagugagcccauggaauuccaguaccugccagauacagguacacagcugggguggcagcaucagggcagcugggcucugugccgugagagagaggccaagacugcaugucuggggcugugguugagggccagaagcuggagucagagcuugggauccaagaaacuggaauccauuucuugccucauuuaauaauaaugauaccucagacauugagcuaguacuacacaucugccccuauuccaggcacuucacuggauuaccugauuuuaaucucaugacccuuuugaaguaggagauaguguccaacuugccuggguucacguggcuaguaaguagcagagucuagcagagucagcguuggaacccaggccaucuggcuucaggauccuuuugccacacugguugucuugucacuaccauacagcccagccacauuuuggucgagguuugaguguccacuugguaccagggccugugccagguauugugaauacaaaaaaugaguaagacaugcucccugcccuucagagucucagucacuugaggaagacaaaugugcaaaacagauccuuaagucacggaaugacaugugaaauggaggugugcgcagagaagcacgggggcacaguggccuccggggagcuggagacagcugcauggagaagguggcauugaagcuggagaaagacacagaaguguguucuccaggcagguggcccagcaccuggaagggaagggguguuggcaacugcacggccuauucagggccaccuucgugguuugagcugauguugggcagugagcaggcucagagauuggagggccugguuaagcugaaggccucuaagcagagaggugacaggagcagauuuggaaguugacucaggaggccacguguagaagaucagagacagacagacucaaagcagggaggccauucuggaaauguugcuguaguccaggaagagaagaugcggcacaaaccuuacagaaggaauagcagagcaagaucacaucuccaccacuguccucaguuacccuucagcccugcagccguuuugcgucuuacagaccaagcucagucucaccucaggaccugugucuagcuguugccucugcuuggaaugcccaagguuuuaaugcaaguggcucaugccaguccuucccugaccucuaaauuagcccuucccucuacauuuagacuguccugaccucacuuccaguauuguuacaucaccauaucgucccuggaccaccgucacuugagauuuucugguuugguuuuguuuguuuguuugagacagagucucacucuugucgcccaggcuggagugcaguggugcaaucucggcucacugcaaccuccaccucccggguucaagugauucucccugccucagccucccgaguagcugggacuacaggcgcccgccaccacauccggcuaauuuuuuguauuuuuaguagagacgggguuuucaccauguuggccaggguggucucgaucucuugaccucgugauccacccgccucgaccucccaaagugcugggauuacaggcgugagccaccacgccuggccgagauuuucugguuuguauauaugauugugucccucucacuuuuucacuaggaugccaacuuuuugggagcagacaccuugugugcauacucacggccacauccccagugucuagaagggaggcuggcacauaguaggugcuugauaaauauaugucaaguuacuggcggggagugagagaaaagaagauaaucauuccaagguuucuagcuuuggugacagggcagauggcggauggucagggaaugcaggagaaagaaccuaguuuuugagggaugaugagguugucuuugaauugauggaauugaagugcuuuggagcuacugaaauaccacuguaauuagaaagacaguucugaaagcucugacuaaaauaugaaaccauuagagauaagaauaagagucucugcugaagucuuaaggcaguugugccucagcugccccagagugccaagaaauucucgccaggccuggguggaggcugacaaugagccaggaugugagcagugcaggaaggugugagcuggaggcuggggccccccaggucuccucuuugcccagagcauggccccuguacucggccucaccauguggucuuagaggggcagauucagccaacagaggccuccaaaagcugugggauucucagaacugcugagugucacacaucccuucucauuggcagagaagguugggagaaugggucuugggaaagccuggcuccuccccuuccuccugagggaccuuugagagcgucggggacccaccugaggagagcaagucccacuucucccccuuacuuucccagacgaucgucaccggauugaggagaaacguaaaaggacauaugagaccuucaagagcaucaugaagaagaguccuuucagcggugagauggggacugggaaagccagagaggaaggcagcgggcagggaggggacacccuggggcugagaacugaccuagcccuugcccuacaggacccaccgacccccggccuccaccucgacgcauugcugugccuucccgcagcucagcuucuguccccaagccagguaaggauuuccuuuugucccacuggaacgacagguucagcucuguucagcugaggagcaguggagaugaagacuccugggccccauuacagaccuacugaaucagaggcuuugaaaggauggcgcaggaaccagcgacuuccugggaugcuaaugcacacugaagccugggaaccaccgugccacuuaaauucuauauuggguaucuugggaaucagaaguuaaaaaugcagaaucucugcucucaucucucacuugaauugggggaacaaaaaucaccucuaaauuagcaagaugugugugccugugcgaggcucaaaaacugacaagcucugcacuucaggccgcugcucacuuggugcuccaugggcucauugccucucaggacuuaguuuuucagcuguaaacugaggaguccagcuuaucucuccaagugucccuuccucuaaaaggcuggaagaguuucgugggcuugaguagucagggaggacuccaagguggagguguggcuagaacuggacccuacaggcugggucagaugggguaagaggaaggagauaggguguuggcagugacucccuagagagggauugagccugagcaccaugaagaggggcugggguacagaggacgggguggaucucuagggcuuucucugaccccugccucucugucucucuccuccagcaccccagcccuaucccuuuacgucaucccugagcaccaucaacuaugaugaguuucccaccaugguguuuccuucugggcagaucagccaggccucggccuuggccccggccccuccccaaguccugccccaggcuccagccccugccccugcuccagccaugguaucagcucuggcccaggccccagccccugucccaguccuagccccaggcccuccucaggcuguggccccaccugcccccaagcccacccaggcuggggaaggaacgcugucagaggcccugcugcagcugcaguuugaugaugaagaccugggggccuugcuuggcaacagcacagacccagcuguguucacagaccuggcauccgucgacaacuccgaguuucagcagcugcugaaccagggcauaccuguggccccccacacaacugagcccaugcugauggaguacccugaggcuauaacucgccuagugacaggggcccagaggccccccgacccagcuccugcuccacugggggccccggggcuccccaauggccuccuuucaggagaugaagacuucuccuccauugcggacauggacuucucagcccugcugagucagaucagcuccuaagggggugacgccugcccuccccagagcacuggguugcaggggauugaagcccuccaaaagcacuuacggauucuggugggguguguuccaacugcccccaacuuuguggaugucuuccuuggaggggggagccauauuuuauucuuuuauugucaguaucuguaucucucucucuuuuuggaggugcuuaagcagaagcauuaacuucucuggaaaggggggagcuggggaaacucaaacuuuuccccuguccugauggucagcucccuucucuguagggaacucuggggucccccauccccauccuccagcuucugguacucuccuagagacagaagcaggcuggagguaaggccuuugagcccacaaagccuuaucaagugucuuccaucauggauucauuacagcuuaaucaaaauaacgccccagauaccagccccuguauggcacuggcauugucccugugccuaacaccagcguuugaggggcuggccuuccugcccuacagaggucucugccggcucuuuccuugcucaaccauggcugaaggaaaccagugcaacagcacuggcucucuccaggauccagaagggguuuggucugggacuuccuugcucucccucuucucaagugccuuaauaguaggguaaguuguuaagagugggggagagcaggcuggcagcucuccagucaggaggcauaguuuuuacugaacaaucaaagcacuuggacucuugcucuuucuacucugaacuaauaaaucuguugccaagcug

SEQ ID NO: 21322 - RNA, 81360 nt, Homo sapiens
cauggauaugcacugcaaagcagaccccuucuccgcgaugcaccgugaguaccggcgcccggcuccugucccggcucggggcucuccgucccaacccuguccagucccagcguggccccggccccucgcgcucaggucccaucuuggaggccucccuggcuucuggucccucuuuucguucuuucucucccucgcccgguguuucuaaugccuccaguuucucuccugccuucugucacccauucuuaccucucugucugccugccuuccuaccuucccugaucccuaucaccugccuuugcucuuucuauccgcuccuucuuaggucaugggauccacggccucggagcccugguuccagccacccucucccuagucagccucuugcccugggcuggggggcaaauuagcaggcaguuuucaggguguuguuuuguuguuuucucugucuuuucucucuuucucucuuccucuguuugccucccucuccugucuccccacaucuuuaucuuucucaaacuuaagagucgugggguccaggagacuccaagaguauucagccucagugucaggacaauugggcagaagaguguggggguggggugcccccuucugacccucaucucucagcaucuccaggcccuuccagcccagcauaggcuucuuguggguugguuugaaauauuuucuuccucuuccuuucuuucccaccccccuucccuugccuucccuucccuucacauugggaaucccagguugucaagacacgauggucaucuuucccugccucugccugggggaugcucuaaaaacaaagaggggcuccgagaagaaaucgaagucagggagagagccagcagcgcagccuuccaggugggcccccggcagagugcagcucugcucucagcucuggaggcuccuugccuagacugccgacuccccauugaggaucacgcagccagcaaccuggccagggggucagcaaagagcaaaaaaugagggggaaagaacaaaaggaaagcaaaugccaaagcugaggagaaaggaaaagagaaauccaaacacgggaaaggaaauuaaagaaagaaaguugacaugauguuacagaagaaaagggagaagggagaaaaaaauagagaaaagagggaauuauuuuaauaaaauuugaauuuaugccaugucuuuagcuugaaaaacuauucugagauuuuuuuugcaggcuuuuuuuuuuaaaagcuaaaauucuaaauagaaaacuccucccuaucugcagauuaauaauuaaggauaauuuguaacuuuucacaaggaaacuuuagacccggcuuggaccuguguuuaggacaagagagccgaggagggagagcuguguuuuucgcuaaucauauauuuagcguugcggggguuggggggggcguuuaaaaauacuucugggauaaaauauauuuuucuaaguaauuuccaagcgcaggaaagccgcgccgagggcaucaggccuccgcgggucucggcgagcgggccggaaagccucgguccuuuucgggaggaguggaaccggguccacacgccguuuucgcccagccagccugccucgcggcccgcugccacagcucucguucuccuuuuuugcggauuccgccggggguccgccgaguccuggcugcccgcgggcagccacuuugaaacccaaagguuucugcacggccaagcagaggucggagggagagagccgcagcgcgggcccgcgggccgguggacuggugggugagacaccgcagcccgagucggugcuggcggccguggcgcauuccaggcccgacucagcgccgacucgcugcagucccccagcccuggacucccgccguguccccuucccauccccaccccuuagacuggggcugaggggccgggcccugagcccggggaggcugaauuauucaucuuuaaucugcccgcagcugccgccuuuucauaccgguaacgcgaguucucccggggccuaaauuauugauggucgggguuuggagggaggggagggugagaaguggggcuagagauagggagauuaacggggugggcaaggggguaaaagaaggggcuucagucucucccagcaacgcgaucagaggucuuuccccaggguuucaccgagcuugcucuagguaccccccgagaaagggaggggagagaaaugaggggggcacagauguccccgcuuucuccgaaacucgcgugaggcuagcggggcaggggcugcagcuugccaguccgggccgacccgacucggccgcuagaagucucugcgcuuggauugcucaguaccugcggcuacggguugaucgcucugggugcaggauuucuagacugcuguaggccagggagaauggggcacaggaagcacccucaggccuggcacccaguggccgccucgguuccgagaucgggagcccgcgcuggagccggguuggaaaccccgugcccuucucuuggccgaaagagcaaaagcccgagccgcucgguuuccugggggggcugccgaggucugaggggucaaagggacucgagucggguuugggucggcuacacagggcgccccgagaguuauuaacucgccagcgaggccuaugccgugccaccugggcgagacggugggccccaaccaggcucugcgaggcgcggcaggcaggcgagcccaagcagccggcauucucugccugcugccuggagccgcucugccucccugucucugagcgcagcagaccccgggccccugccucauccgccuuccuugcucuacuucagauacuaaggaggugaaagagagauacggucccccuacagauaaauaacauuagaaaaacuucccaucaaaaacaaacaacacaggaaagagguagaaaaauuccgauuacaauuuaauacuuuuuaaagaagaggcagagagcaaaggggggugugugugucaggcacuuauccccugucugugcuaggagcucggauaaacagucagccgagccucgacgcccccaaaucguccgccuccaagccccgcacgcgcggacagcucccggguugccugcggcgcaggcgggaugcugcuucgcacuaguccaguccucugccaggcccuuccucuccucgcuuucuuacgcccuuuccgcuggcaugaauuccccuuuggcauuuucuccccucuccccucuuuucugucaucugguuucucuccaguccccccuuugcuuucuaccuugcgucgcaaggccugagucgcccucucgcccagcccccagucuucagcccagcgucugugcuuccaguccccacuccuccgcguggucguggagguccaccaccuuucuucucaagcucgggaacaugcccuuccgcccugccugcuuccuucgcccgucccgggccgcggacccugacuaauggccggucccugcugugugugggguguuguguuuuuuucuugucucuccccagcagggcacgggggugugaaccagcucggggggguguuugugaacggccggccccuacccgacguggugaggcagcgcaucguggagcuggcccaccagggugugcggcccugugacaucucccggcagcugcgggucagccacggcugugucagcaaaauccugggcaggugagggcuucgcagcugucccgggagacgccuugccuacuuccccggccagcccugggucuccagcuggaggacguggcuaaaaguccagcgugccaagccagagagggagauccccaaaggggucuggagaggugcuccuuuuggagagaguguucagaugguggcugaagacccaggagcgaggguggcgcagugucacccagugcuugcccugccccuggucccuggugagaaggcagcccguuucuggcuucagaaagggaaggaugacuuuccuaauggaguuaaggcagauacggggugggagacauuagaggaauggggggggagugaaaauggguccccgagaggagaagcagcagcauuugggaggcagaaggaggguccugguucccacagaugcucugugcccaguaggaaagggcucgagguggugccucaacccuggccucccagagaccuugcagcgcuguucguuuugcucuucccaagugaaaggcugggcuuucacucccacgggugccuauuugggcuggugcgaacccagccccugguguggccgucucccuggagggaugguaccccuuguccuccuacuccgcggcgcuccuccuagccaggcacccucaggaagucagcucagccacacugggccuuuucccuccacuccgcugccucggccgggcaggagaguggcucagcagcucuggaaccugcagccccccugccccgccacaguccgcuucuggcugaccccgccggcuuucccggcgcagguacuacgagaccggcagcaucaagccgggugugaucgguggcuccaagcccaaaguggcgacgcccaaagugguggacaagauugcugaauacaaacgacagaacccgacuauguucgccugggagauucgagaccggcuccuggccgagggcaucugugacaaugacacagugcccagcgucucuuccaucaacaggugagcaagccacccggguuuucagggcuggacuccagcuccuggcuccugccugcaggggugucccacgcccagucucugcucuuuguccagccucugcccuuucucccugcuuccagccccaaauccuucugucagagaaagggaaccugugaggcagagaguuagacagacagacagggcugucugcaguucagggcuggguauucccugccaggcuucucccgccggcguccuggaaaugaauccaaguguuugugguaauuaagacuccaagauuacgagcauccagccuugggaucuugagacaaucacagccugcagccggagccuuuaaaaugaccagugucuauucaucccuccaaacagacuggccuuucuaaaggcugcuccuuccccaggggccgccgcuuguccuggcucccucacccucccugccaacucccacaaagcucaccucccaggagucuggucuugcuagccagcuccacacaaauuucuggccuguaggcacugggauccgggcuugcagaacaaaugccaaccaccagccagcaacuggcagggaguagaggagcuggacaaggagggagugccaagcagggagggagaacuccagacuuugagacugaaccuugggugauacccucaaccaccuaaggugccugucuccaggcugaagucuuugcacugaugacaggcucacacacgugaggacagcacagggcugagucagcuugacguguaggauauuuaggucuccuggucuccaaaccccuccagugugcucucggggagaacacaugugcacacuccaugcauguccacccuagccagugugccaauaugccuaucugugguagcuacagaacauacaagcagcacugggcucaggaacccaggcugguuucaagaucacagaacuguacaaacugacaguuguucacagagucccugcacaagucacacaccagccuuggccccccauuuugagacaccccaaaaugaaaagagggcuaagcaguucauaccuuuguuauuuuuugcauucuucauaagcucauuaucagggcaacuaauaauucacauggugccuuauucugaaauuggcaucacauauaaaggauuuuuuaaauauuuugcaaaugauauggaauuaucccaaaucauccugaaaacagcagguaaaauuagcugguagaauguaccuuggcuaaagaagauucccucugccacacucgugcuguaauguacugcgaggcgaccccagaaauuaucccagugugugccaucuguauuaaaaugguuauucaguuaugaacaggguaacauaauacugaucagcuaauuauacacccuccgaaaacccuccagcucccucggccuggcucagccagguauugaaagcauagcgauuugacauucagauaccuuccaaaggagcuggagaaagacgcugggugguuugggagaggaauaagcccuuugcuuuaaaagccaggagaggaggcuggggcagcuuugggcugaggcaagaguggcacuucgggaggggaaggggacaaagcauuguuuuaugagccauguagagacucagucucuuggcugauugcugguccugggcaugaguuggaacugagaucucaagagaagaacagccaagggccaagaguggcccugcugugugcaguguugcugggacuggguaguggucuucugcagaacauuuaagagaaaugcuuguugucaguaacagaauuuucaagccuuuggagaaacccaagucauguaggauuuagguaauuuguuucucuugaaugggguagaggaguggcgcaacaagucaggugugguggccccguccaacacccccugccccuccccucaacaacaugcacuccucauuggcugagaugauuuuggaagcuggcuuaggcauaaguuuggaaauacuucuauccugaaaagccauggagaacaagggccaggugacccuaggaucaagcuccagaggucuugaggugcacccaccagaauuaggacaaaguagacaagugagccacaagugagaugaggguggggaaagaguagccucagcuugacagcugugacagcugcagaaccugcccagcacagagcccuaucaccugaggggcacacaggcuuccuuuggguguggagaaauagccaucugugggcagauguugcuggagauggagagggaguaggaggagaggaacagguaagccaccaacaacacgggcagccuacccuggguccguaguuaggcuucauggcuggcuuugucuacaaggagcaggaaaacuauucccaauuuugcuuuuguccagaauccucucaugguucauauuuuggaaagaauucugggggcuucccugugugcugcugaguuggggcuggagaaauccaccuggggaaccacgcucucaucuucaucccuguaggugcuuuuugcucugaagagggaagguuuaucugagauguauuguuucacccaaaagccugauaaaaacaggauguuucugcuagugcugguuauaucagaaacuuugccuuuuaucaguucugggaauucucacucacuguaggaagagcccggagauuuuccugugugcacaaaguguggugcaccggggaacgggugguucuugaguuuagagcuuuguugguagugaccugcccacuuguguuggguacuuuauaacaguuaugaguaagguugugcaugagcuggugguuggcaagaaaagaaguccacacaugcucacccaccugagcuagugguuuuucaucuucuccuucccaaaacagaugcugucgccacacuugaaauaugcuguuaugguuauaaacuaaauugcuuuuuucacucuuuaaaaaugguuuuggcauucucugauucuguugugauaaaggccuggccauccagccuguauucuccacuagcaaauccucagaaaugccucucugaaccagaggacugggucaggaaggccuccccacugccacaaaccacguucaaaaaucccaaggcuugacugggcuccuuagcauguggaauuuaucugaaucuuucuaaacauuggguuaccaauggcugagcauggaguugccagcuuuuugguuuguacaccgcugcuguaaagggcagguguuuauaaacaggggacuuuagauugaaaccuggugugggacauggccuggagaggggagagguggagggagauccaugcuacugaaaaaggaaaaagucgucuaguuacauagcugagcaauugucuaagcaggagggauuuuccugauuauaugccaaaaucuucugguuuggcuguuacucugggcagagaauacaccuccuuugaaagaacaggcacagaccccaaauagagucugggguuacugacaaucccccgagggugcucuuuugggaagagcugacaauaagggugucaccuucuaacuuuuuuagcuugccuaacacucuuuggagucagggcacucucugccccuagaucuuuggaguggacccuggcagaaucaacuucucacggaucucccacuauccacacucucucuuagccuguuaggcucuaggugaguacauucauucuccuagcaguggcaacccagggcuguguuaaggaauuccauccuguaucauuugggugucccucuucugucauucucaggucuuugagucauucucaggucauuguuccccuugggucaggcaguggggugacaauggucuacuaguuguucguucaaagaccuuuccaaauaagcugggagcuauuaauccuagccccgugaauguugaagauauguuccgggcuagggucuguuucucccucucugaaacucagguuccagaacauugccuauucuacucuuggaccuggcuuggcaugaagcuuggccagaggggugguacugccuaccacaucuccauaucuuuguagcuguuugguggucagggcuguuggucucauggcaaagagacagggcaaguuggagaguucagaaaaagacuucuauccacagaggaauggcagaaacaaggacagggaacucaccuucuguggccugagccuagcagauugggcccacaaauagcagaccaacaugccaauuucugucagagaagccucgcucaccuguccuuucccagagacaguccccuacugugagguuacccaucauuggaauaacauuugaaacaggcaugaugguugaaauucucauuccuuaaaaugagcuggaguuguccuccugaaaagccucuuuuuguuuuuguaguuguuuuagccugggcuuccuggcccacaguccuguuggucugacugucucccuguuggcugguucuguggguguucaggcuacaaaagggguuucuggugagagcaauugcugcuugcccugccuuccuaccucagcuggcaacucucgagaagaggcagacaggaggcacugggccugacaacagcuccaggugcauuucagaaggugacgcaaagaagaaaagagagggaaaacccaaaaugaauaaauaaauagugucccaacuguucugagaacucaauaaaacaaucacaucaaauaugaagaggcauaaaucuugugucugcacagguaaccuacucaauugcuuuuauuaucgcucaggcugccuccauuuauuaccguucauggccugggcaaaggaggcugcguggaggguggucuccagugcaauccuacacccugagaggcaacaaucagcccauacagccagagauuucgaugggagcccaggaagggcccaucugucugcaugaaaaccaaucaauaacucuguaaccagagcccuugucacagggaaauggacaacacaacaguucaauagaggggccacagggggaauuagccaaguggagauggggccaaacaggagcagccccuagagaagggaaacaggggugccuggaguaggggagauuagggaagggguggagauguggcaggggagagcaauagcuucauaugcauguugguauuagauggggaguauugugcaaaauagacccagggaaugacaggcaauguuggaaguugaggugguagggaacauguguuuuggacagcauuugggaaaugggcuuguucuggugcacaugggagagugugacuaugcaugauggcaugugcuugcggacuagaauguuacagcuucuacagaaagaggaacaauaguaguaacugguguggaagauuaaucacacuccauacccccuaaaaccccucugaaaaggggguuccuaugagcccacaugggauagggguccugcuucccagucuucuuagcaggacugaugaaagagccccauuguccgcucccagcuucuuagguguccaacaauagcuacucugcagguugccucuuaauacucaagucuaucuucacccccuccuugugucuaccuggaauuggaguuuuuauauuaagaagagaacaaugguguaaaagugacaagcauccaguagaaaucauacuucaaguacccaaacaaccauucuguuucucacuuucaauacaguauucaauaaauugcaugagauauccaacacuuugguauaaaauagucuuuguguuagaugacuuuggccaacuguaaauguuuugagcauguuuaagguaggcuaggcugaccuaugauguuccauagauuagcuguauucaaugcauuuucagcuuacaauauuuucaacuuaucgagccauuacccuguugugaguuaaggagcaucuguacacugaaaauaauuuauuuuucacuuccuguccuuuaaaagaaugcucauccgaccugccaguucucugcaucccugcuguuucuucucacacuucccccgccccuccaagccagguguccagagcucagauucuugcaggggaagcagcuucaggugcagcuauccccagugcagcuccccagccaugcaguugaguccagagaaggggaaagggcuccugaaacugagaugugggaaauagagucucacaaccaaugcccaaauagcaagugaaauauuagacagcugaaacauuaaaucacguuugguuuuucuaucuaccacugaacuacuagguugagaugguuuucucuuguggaacaggcuauuuguuuuggggcuagcaaggcauggcuugaauauauucaugaugguuugcaguguagaaguugauaucuucugugcguguggauuuguguguguuuguggguaccuaccuaugucugcuuuuaggugaaaaggcccugaggccaagaggagaaaagggaggaaggcucacaggacaugaccugcagucacaggcaaggcuggacaccuuguacuugggccaucagaucaauuggcaaguagucauugggccacugggcgaaguggcagcagcaauaaggcuaggcugaagauuccucauuucacagucuaggcaaauuggagccacauuuuccuucaguuauuugcauuguaacacucuauaguccaguuaacccuggauaagaggggcuuugcuacaaugaugccacaagagcugugcgaccagcuguccauccuuacuuugauacuuggguccaagcccuguuggcaggauuaguuagggaccaauugcauaagcagccaagaaggcgcucuucccaacacaauccuuccuccaaagcuguggucccgcagugggaggcaugguagcagcccugggacacaacggugggcagagcucaccccagggccagccugcaagucuuuccucaaucauccaggugugaggggcauagggaagaggcuuacuguuugugagaaaugcagagcuggccacugcagaaggcuugggguguagaugaggcgugauggcagaggcagccucaggucuccugaggaaggcugggcacaggggagcuguugaggguaugggaagcuaaagaagaauggucuggcgcuguaggagagggagcagccucuuguaggcugggaacucucagguaagagaggaagugugcaggaaagagguagacaggcgaggccguagagccaggguccccucauggcacauccgcaaucaaccaugggagaaaugaggcccuuucuuuuguuuucugagagauaauguaaugagaacagauuuuguguuuuccaagggagaaggaaagagauagaaagagagcagggcagggggagcgagucaggugccauucuuuuuuuuuuuuuuugagacggagucuugcucuguugcccaggcuggagugcaauggcacgaucucagcucacugcaagcuccgccucccggguucacgccauucuccugccucaaccucccgaguagcugggacuauaggcgcccaccaccacgcccggcuaauuuuuuguauuuuuaguagagaugggguuucaccauguuagccgggauggucucgaucuccugaccucgugauccgcccgccucggccucccagauugcugggauuacaggcgugagccaccgcgcccggccgucaggugccauucuauucuagaaacguucagguuuguuguagggauguugggggaaggaaagcagugcccagaaguccagacugggguuugccaaaagcaaugauggagaugcgcuguggcugcaggagucaugagcacaaaagacucccaggccccagcaggaagaggcuccagaauaugagaugaaaaguggugagaacuggacaaacagccggagcacaugggcccugccugcaggcagugaugcaggaagaccggauuuuaaaaaacucucugcugaccgaauaaaacucaacuuugggccugauuccauccauuggccagcauucagcagccuuugguugaccugacuggauggacuuaucucucugccuuagaccagggcaguaacauccacgcaaguggaaggggaugggacauuuccugggucccuugguccagaagcuccuggggaaggcaguggaggagagauuaugacucccuauagccggaggaggagaggugggguguggguagggagaggcagaaagugaggaugaggacugggagagugaggcaggaagcgaugaagcugagagguggaaggaagggcgcugccuugggcuggacaggguuguucgggauuggagcacauggcugagcaggaaauggcacggcagagcccgcaaggggagcuuggauuugcucauccgagcuggggccuucaguggcccugcaaggucuuggggguggugggaggaaaccugagcuccaggcaucugguaguacaggcugaugggcccugaggaggggcccagaggugaugaaggagaaaggggaagaggaagguaagcagguuucugagaagaguauggagcgaaggaaauggcaugggaggaauagcggccuggcuggagcuaugcagcccuuucugagaggaaaccucaugagugugccgcaauggucuggcuguggccccucucggcaggcugugaggcaggccagcaguggcuccagccuagucccuggcaggcuggagagggagaguaggagagcagccaaaagggagggaggcaggccccugccugcuggggguugcagauucgagagccaucuccacccagagccuuugaccagguugcuguggacuuccuccucugccugcccucaguccugccugaaccacagauuucucucugcugccaccugggaacagaacaagccagggacaggaccgguggcuccuggcagggcugaggcagggcagcaggcugggaggagaacuguguucacccugcaggcacaguagaaucaagaaaucagagaggaaggauuggagaggacugggagagaggggagcaggcagaaagggagaacaaaaguggccccugagcaugagcaaaugggagugagcacugggggcugcucucccuggucuuggugcucccucuuggccugggggucuuugcugggcccaacugcccagcccauaccuggcaggcagaugauagaagcugaagggcaugaggagucugcaggcagcuucuggccugcaggacauggaggcggucaggaaggagacacucauucagccucuuaguccagaagcuuugauccugauuuuggagggcaagcaguggugccugccuuagugcguuuucccaagagaaguuggugauguguugggagccucugugcauggcucugcuuuggaaagacuaugugugcuggugguaucuagcuaggccuggcuucuaugcccugggaagcugucuaaauggcccuggcucccagggaacucucgaaaggagucagucuugucaaacugggaguuggugguuugcuauucagaaggcuuccggcuaaagggauuguuuggucccagaaugaaagucccuguuaucacuuugauggccugccuguuugggauguuaguuaauguucccuggagagcacgugguugaauggacaguagacauccugaugggucaaugaacggggguucugaaagguacacacagggucccgacacaucuagucugugugcaugcacaaguuuggggaugugaacgcuuaugaguagugugcauuugcucugcuggaugagugaaccaagccaugugugauggccaggguggaggguguguguaguaucgcacuaggagaacuggaagcaguuguuucuugugugucugcugacguccucaaagggagcauguauuuagguagagacaaaggucaagauagucaccuccuuuuaucauuugcaaaguggauaccacuaucccuucccccagucccuuacuuuucuuccucuuucuccuccuccuccucguuccucagguuagcugguuuggguuagggggccaaucucagaagacucuaauuaaagagugaggagaaucugauaagauaaggaaggccauccuuccucuagggaccaauggagguuucauguuccucacuccccgcugcuucucugaggagcugacacuagggcaggcagccugccgacugugacugucuggagucugggagagccagagagaaggaggugugacugggguugggacucggguuccuacccauuugcaaugguccuggaagggaaaaccuagcagacuccagaugagagcgaggggaggguagaagagagagugcagaagucaggaagagagaagugggagccagaugugaucaacacagauaugccucgcuaaguccuaguuuuuggccacagaaauggacuguacgggguggggugugguaccuuuuuuuuuuuaauuagggaaggggcuaugaagccauuuaacccaucuuuggggcugagcacuuagcuccugcagagaguacagcccugguuaggguucagcuccuccuagaaacaaugcucaccugcgcucucgacccuccgcccucccaccuagcacauacacuuuucuuuuuccccacccucguuuccucugaacuuggcucuguggaucaggucacuccuggccccauggagacagccaggaaggccaugcagacucccuuaggagaugaccucccaggguggguacaaaaaaaguugagagaaauucauuucauggccaguggcugcuuagaaaaggcgauuccagcauccgaaugugauaaaugcuaacugagcauuaaucgcauuaaagagggcccuauaaacuuuucacuucuaauuaaauuuguccaguggugcugcccaagcgaguacucugggccuuuguuuauguggaaaauuaaaaugcaaauacaaugagauuuauuuccaggaguggagugaugggcuggccccucuggcuacuggucuccaggccugucaggucaggugacugcuucuuuggaggugcuaucccccuugugacagauucuugugugaagggagaggccagaguucaaggucaaauagaguuaguaaauggggagaagauguagaaagaauugaagagaaggagaaaaaggcaauagauuaccaggaauauagggagacauuauucugguuucccacccuccuuccccaccaacucacaucucuagggguauagacccccaaaaucuuacuuguuaauaucaccacaagccuccucugaagcuaugagaugaaggaguacaugggagagagaauuuggaggaagcagcccugccaggcucggcauggcggcucacaccuguaauccuagcacuuugggaggcugaagcaggaggaucacuugagaccaggaguuugagaccagacuaggcaacagagugaggcccaucucuauuaaaaaaaaaaaaacaaaacuaaguggccaucaggaagggucaagggccuggauuucucuccagcaguuugagggucaucugcuguccacaccgggguuucacugggcucuuccugccaguuccaaguggcauugacauggggcagugaagcauagaggcacaaaccaaggaggacauugugcaugcacgccugcacgcacgcagccuucuugcacauaaggagagccgguuucucauaagaauaaacaaaugucccuugcaaggagucauuuagugccgugaucccuugauaaaagugguaauccuaaaugcuacugaauggaacaaucuaaauuuccuauuuacugagaacauaaauuaagucgaggggagagaaaaccugcauaagaaaaauuaguaggguauaucaguuagagacacugaaagauagcuaugcugcucucuggauaaggaaguuguaaauagcauuaaaaagucaagcaggaaaggaaauggagguaggagaaaugauaaaagacagagcacuaaaucacaaauagggguacauguacgaagucacaaaccggcuuuaugccaagcuuugcagaauccacagcuuggacugacaauacauagagaugcuaaacacacaggcaugcagacuuccagagagugucaguaugcagaggguggauuggucgcaccaugggcaagcuguugucugugcuggacucugggauugauccaucaguuccuccuugcagggaucugauuggguacaguucgguaggcagucgaggauacagcuguaugagguuuuuaaaggucuuuaaacacaugagucucuugugagcuggauccaccuucuaauggaucuccaagguagcaacccauucccagaacacugccugcuugacugguuuugucaaauagcugcuaccccuguccuccuuuuucuguuuuauucugggcuacucuuuuccuuuuuaguguucacuuaugccucuuggaaauucaugagcacuugcugacaaacagguuaaugacuguggcaacucccaaacaucuggauggaaaccaaaacuucagucaaucaucuauaaagguugucgauaugaugccaaagaucuggcgauuuagaaauguccacauaauugauugaauuucucaguuuuuuauccaggcucagaaucaacacauugggaaacaccuauuuucagagaaaaauauuccaggaaacaaaguguucucauuagaaagcaucuuugauguguucgagucugauuucuggcuugaaaggaggcugggcugggcucuaagucagauggagaucuggugguuagaguaguuaguauuggaacgagcacagcuggugagagguuuccuucccccgaaaguuggccaggaggguagaucacuuuguccaaauaagcuuaggcugccuguuaggccugguuucucuaagggaguccauuuugccauuuuaagggagacugucagguucuuaagacauguggcuuuuucuucauuuaucuuuucauucauccauucagaagcaaguaggugcuugcuaagcaccuacuaugugcuaggcaauucacauaaagcuauguggcauaguguuagaaagcaggcucuggggagaaacugccagaguuugaagcuggcuucccuacucacuggcuagaggguacuggguccaccuuauauccucugugggccccaguuucuucacucauaaaaugugggggauaauuguguaggucucucauaaguuuucaugaggguuaaaugagugaguccacauaaaccagcuuagaauugcaccuggcagguauuaagugcucaauaaaugcuaguuauuauuauugcaguaguaauaaucaagucuguauuucuuguuaugcgucuauuucaguguguaugcauucugcuuuguguaugcacaaacauugaauuuuuuuuuuuuuuuuuuuuuuuuugagaaagagucucgcucugucgcccaggcuggagugcaguggcaccaucucggcucacugcaaccuccgccucccggguucaugccauucuucugccucagccuccugaguaccugggaccacaggcgcccgccaccacgccuggcuaauuuuuuguauuuuuaguagagacaggguuucaccuguuagccaggauggucucgaucuccugaccuugugauccacccaccuuggccucccaaagugcugggauuacaggcgucagccaccguggccggccugaaauauuuuuaaauaaaaaaguuugaagagccaaaaggauauucugugaacagaauuguguaucaugaaugccagugagaaucauggucccucgugagcccagauggauuuaggaaggggacccacucaguguauuuccagaaaaaaagacccucuaugauucaguaaucugaccauugagcagaauuagucagauaauugccccuuugucaacuuugagagcccagaccuuguggcuguguguguguguguguguacuuuguauaacugcacauuccuucucuuggaagccugcuauugcuugaggaauucaagguuggcauuuucuaggcuucauggcauuuucguagguuguggugcuuugcauuuuguaguuuuuuuaaaagauaaaaugaaaugguaguggggaaaaaguccuuauuugaugcauuugaaggguuccacugauucuuaaaugucauacaggggagaggaaagggagguaaacaggaagaggaggggaagagaggagagaaaauggagauaagacaaaggaagaagaaagaggaaagggagaagugagcaaauacuuaacaaauucaaaugaaaucugucuauucuugucuggcaugucuggauauucuaaggaaguaugggaguuugacaaucauugcaguuauuuccauugcuaaggaguaaaaguuuuuaagaaaaaaauuucaggaaaaaauuacuuugggcuuaaucuauuugaugaauggcuccaacuaacuggacaacugcaaauucuauuuauucuuugccugacaagagcaaauaugaaacccaguuucccaaacucaugacaauguguuucucaucuuuaugggaacuuccauggaacaagacugaggugcaaucccauucuugccucaaguucucccugccccuuuggcuuaguuaggugaccaaguucagcucaauggauggcuguaagacccacacccaaauacuuacagagucacuuaucugauaccuuuuauaccuuuugcaucauucucaaauuccuagauuucauuauucgucauuuaugccuauuagcugguaaagguucugauuuucaaauuagaaaguaaauguuuuuaaugagcaaaauuagaauccugaaagcucaaucauccuuacauuuuucuuguaguacgaaacaagucaagggcugccuauucauuaccagaugcagggccagaugcugcccucuguguggacauaggcaguggugagcucugucaauccccagccccugccacugcccagauggcagggagagaacuacccucugccccugugcuaccuggcugcaauuuuugcacuucucugcuuaaaacacacacacacacacacauacaccucuuaauuugucuuaggauuuuauguacacuagcacacauguguacauguuuauacacauacacaggccaaucuuauggcugcuuuacucagaaagccuuuauauuuaucaucaucaucaucaucaucaucaucaucauagugguuaacaagugcuuacuacaguaggaaccguuacaagcauguuucaugcauuaauugauuuaagcauccuaaacaaccccauagggcuuuauaggauuguuauagaugagguagcuggaguacagagaaguuaaauaacuugcucaaggucacagacuaaguagcagaaguaggauuugaacccaugcaguccuggcucuaaaacccacaugcuuauccccuaugccauacuucauaucuacuuuggaucaagggaagugcaggcacaggcaaucuccuggggaacucuguauauuuugcagucucuuacaagcucaaaacaggaaaccugcacccuagcagauggucacaccucuguguaucucuguacucuuccaugguguguguuccucagugcaggccacugcugagccacaucaucuagagauacugggaaggaagaagauacuaauagccagagccacagaguagaguggaauggggauucuuggaacuagaguuuauauugcuguucccauugggauuggcaaguuuacucccguccauccuccuccagcuccaacagggaucuagacucucaauuggcauaagguuuggacuaggggcuuaacucuccaaaucaggcagaccuguucucguuugguaaagucguaacuguucagcagagcagggacauuugcuuccaagaagaauagaaucguauuuuugguuaucaagaagagauuuguccugcaucucuagaaucuuccuucugaaaagcagcagugcaaaugaccaggccagaguaagcuaaaaaagcuaaaggauggauccucucacccacaaccacaccaagaaggcaauuaaagcaauuaccgaaucauacaccaucacccagauccagcaucauuacucaacccacaucaccaaggagacacccauuaaccuaaucucugagacauacauuagggaaaaaagaugcugauaugaucaaugaacacaauaauucaaagcagaaacacagacacugccaccaaacaauacucaaauuccuccaacucaguguuacacaaagugcagccaccucaauacaauaccacaaaacaccaaguaacaaacauuaagcuagcugccggaaugcgucaacacaaugcaauaauacacgguaaugcacaacacaguucaaacucuguaucccauaggcacacccauacccacaggcugaaaucauguggccacuugagccacaugggcagacacacacagagacagagccaauagcgcagcacccaauucuccugcacacccagcagaaaacgaucacagcugcaguccucccaagcacgaugcagccugccagaaagcagcagcaccaugccguuucuccagcagguggacguguccagaccaucaccucuaauaaggccucugggcucucauugcuaguaagagaguaaacuguccccugagccugcuucccgagacaggacaauucaguucuauccugguugggguuuaauaagacuucgcuguuagugaaaaugacagagcuccagggauaaagggaaaggugguggugggaggggagcucacuaagcugggugcaggaauuccccuuccucuacccagcccuaccuucuguggccauuccagagccaaagcccucaugcuggguguucacggaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacucgcacgagucaggaggucaaacaacuguuauggagcgaaguuaaaaauccaaauaaaauauugacacuuuuuuggggagggggaggugggaagcaaagguauuuaaaauagguuuuuguugcaaugcccccaggauaaagaauggaaggagacugaagacaaguuggaguuuauaaaaucaauggaauuuauugcacagcuacuuggcauuuaauaauucucucauuuccacaucccccucccccaccccauccuggccauagacagagagauacacagguauacaaaugcacauuuauguacgucaauacuggugcauggaccaauauaaaaacacgauugugaugugaaaaucucaaacaccccaggaagggaacaaugaugguguagagucucgcuguaguuuacauauuugacagaaaugggcauaacuuggcagauacucaugaagcagguuuugauaaauauauccacuauuauaaaucuuagaucaaugcauuggagcagaccugaauauaaagauaaacuaaucauagaaauagauccucaaaacagaaauugagaaacacaucuauauguaguaucauccugcaaucauguacaugauuuggaaacuagauagaugaaaauaauuuggaaaauuugccccccaaaccuaccagugcauauaaaauucaccgaagccuauagcagcuuaaucuaaaauugugauuuguuaguaacacagacaugaugcuuaucaaauacagcuauggcacaugcaugggagaggauaagcguguuuaaaaucacagcuaccugugcucucuguuaauugucuacauauauaauugcucaauuuuccaaaaucauggauaugaaaaggcugaaggaaaaauuuguucauguccaaauaguuaauaaauaaauauauauauaaauuucccaaaaagaucaacugauucagccuacagacauugaagucacaagccuggauccaaugucgggcucuuacccgaugcauauguauaauuauaugucaauugaaaaaaauaaacaccaaccaaacaaacaauuucuggcuccaaugcuauuaagcaugugacuuugggcaaguugcuuggccuuucuguuguuucuuaggcaaaauagagaggauggcuauuugauagaguuauaguugaauucgaaugagaaaacacauucauuauaaugccuuucauacagugaauaugaaauaaacgauaguuauugcuuuuacuauuauuagauucagcucuucuauucaggccuagccucucauagauucuaccaucgguucuugauaugacugacucauucuacucaaugguuagccgcauaaguucuagagugagacacucagguuuaaauucuggcucuguuacuuaacagcugugugaccuuccguaaguuaccuaaccucucugagucucagcuuccacaucuguagauuauggacaauaaucuucauagguacuugugagaauuaaguuaaauaauccauauaaagugcuuugcacagugccugguacauaguaaguguauauuggcccacugugucccuuaagauuaugucauuguuauuauuggccagguacaguggcucaugccuguaaucccagcacuuugggaggcugaggugggaggauuacuugaggucaggaguuugagaccagccuggccaacaugguaaaacccugucucuacuaaaaauacaaaaaugagcugggcgugguggugugcaccuauaauccuagcuacucaggaggcugagguugcagugaaccugggaggcagagguugcagugagcugagauugugccauuguacuccagccugggcaacagugugagacuccaucucaaaaagaauaaaauaaaauaaaauaaaauaaaauaaaauaaaauaaaauaaaaaaauaaaaaacaaaaaacaagaguauauuauuguuauuauuauuaauaauaauauucauuuguuauugaacaaauagcuaucaaguacuuacauuauaccagacaccauugcuaggugcuggggaaagacagucgugagaaaaauagcagacaucugccuucucagagcuuggagggguggacucuaugugaacugaguaagcaagaaaacaagguuucagcucuguguuagacccugagaggaagagggaaacagagagaaauagauuggaaagcuaggauagagccagauaagggaagauuuugaaggccgggcugaagaauucugaauuuauccuauaggugauaggaagugauuguaggguuuagccagaucacauucuuucaggagacagagaaagacugacggacuguuuuugaaugccugaguaggcgaaagguaggaaaggcuagagguagggaggccaggcagucacuagcgggcccuacaucugcugcugcucaugugacugcagagggaggugagcaugccuguggugggacaggguugggggauggacaggugcagagugggagacuuuaucccagcaaugaaucuauagcaguaccuuguucaccuuauaucaagcagucuucaagccucuggagcuucccaaacaggaucauggggguggacagcugguagauuccagcucuagccagaagcucugacagaugagggcagggccaguggugagaggcgcuagucugucacgcucugggcuuggcaugcaccacagacugguuuccaaaugguuaguuaaacacauugccccuuaauuuuuaaaccuaugcauaucuugaaguuaaaucaauccauaugcuuagcauucaucauauaaaccaucacuauugcccccuugggccagccccauggcccaucuagccugguaaauugucucuggccugggcucucaggggcacguggcggaaagauuaucgcccucaaugccagucuuggaaggcuaaguugaugcagaauauaugccugguaucuaaguaacccacugggaauuuaucauccuggaauguaccaaaaaccauuuugaaauuauuucaauuuuuaaccuaugguuuuguuuccacagagcaacugauagcuuauugaauuuuggugacuaugucagcuggagucaggguuaauagauggagagaaauguggaucgauagaguaugagaaaggaacuuucuuaacucacuaagacuuauucccagcucuuccaaggauccccuugagaaaccaaccagaaggaugguuucuucaccuccuggcuuaagcuagucuucucaaauagaguucagaaacucuaauucaggucuaagaugggacccggugauuugcauuuuagcaagcaccccaggggauucuaaugcagguaguucaagggcaguaguuugaggaaacccuucugccagcuuuuugguaggacuuucauuucuuggagcucagcuaugacuucugagagucaacaagaguugacacauuugggaagaacccugguaaccuggaaccuguguauuccagcaacauccugccacagccagaauggaagguccugcccacagcucugaagaauggccuggcccuuaucaguggccauguucagaacccugccugacauauggucaguuauccagacugaaaccugcagggcauaugagugagcaugggcaaaaaaaccucuaaacucagcccaaacugcagccagaggcuacaaaaacaguguguuaagugauucaggccugccuuaaaggaagccacgugcaggagagaugcuguuuccuuuguguuucuguggagaggaggaaguaaauuucaauuuuucaguuccugggguauacaaagggggagacucuaguuccuuagaguucucaggaguagggaccauuuccaggagagguaaacauuuccugggugaucuaugacaucucacucaagguucugcugugaaaagucucccgcuguuaguguugcugacuugccucggggccaagccauggauacgugccugauauaggcagcucucaaagacuuguguugaagcaauaaccaccugcauuagcugggcaaaauauccuuugcugaagcaaauaucuucuuuuuuuuuuuucuaagacacagucucgcucuguugccgaggcuggagugcaguggcgcgaucucugcucacugcaacuuucaccucccgcguucaagcaauucucugccucagccuccccaguagcagggauuacaggcauccgccaccaugcccggcuaauuuuuguauuuuuaguagaggcgagguuucaccaucuuggccaggcuggucuugaacuuccgaccucaugauucacuugccucggccucccaaaguguugugauuacaggcgugagccacugugcccggccacaaauauccuuuuuaauaucuuuuuugugugugugacagagucucacucugcagcccaggcuggagugcaauggcaccaucucagcucacugcaaccuccaccgacuccagucguggguuccacuucaccacugcaaucguggguuugagagauucucccaccucagccucccgaguagcuggaaccacaagcaugugacacccugcccggcuaauuuuuguauuuucaguagagauggguuuucaccauguuggccaggcuggucucgaacuccugaccucaagugauccaccugccucagccucccaaagugcugggauuauaggcauaagccaccaugccuggcugcaaauaucauuuuguucucuaggaugauugaguuuauaaugcccaggcagucugagaccacuggcagaggcccccaugaccauucgucuggcuuagugggcaauggggccagcuagucuggcacauuuucuacccuggagugccuuugauuuacugaaucaggaaagacccuccccauaccagggauuaaauauuuucugcaaagacucuaaaguggacaguuuacuccaggacaauuuaaacugauuuauacauguauauaacacauauauccagauacuugacaucuugcuccuaagagcagccugccucaagccuggucaugucacugguuuguucaagcucugcuaggaaguaauuuuguuccucuagggaauaauucuaaaauugggaaggaagucuguucuagacagcaggaaaggauuucauggugacauacuuggagauccaauguacagggguugucagcaauuggguccagcagguguuaauacucccauuuucuagugaggacaacugagguucagggaaaccucucacccuucauuucucagaagggacugaaaauagaaguuucaauuuggugccuuugggugucucuccccuggaggcaguauaauuuagcagguaagggauuagucccugggauuagucuaugugaauucaaaucccagauuuacuguuuauuaaaugggugacuuugagcaaguuguaauaagccuuaugugcaaaaugcguuguuguaaggauugagugaacuauuuauuugaaguacauagaacauugccuagcacauaguagauacucaguagacaguuuuuuguuuuuguuuuuaaacuggagccucuccugaggaagcauugcuccuagaaagccugcccagccuaguccaguaaaugcugccaccucacuccucccaaggugagcugucugaggucaccucaaugcuaauaggaccucuucuugucuccaccucagggaguuuuugcacaccauguauuaucauauaauauaaugcaauauaauaucauacauaacauaacauaauaugauggguagguuaacuuggaaacccugaggcggacgguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuggagaauugauauaccugcucucaguggcuuguucugcucccaggcugccccggccccccagguguaugauuccagcagacacuuaaccuuuuuuacagugucaucaggcuaaaaggaaucuaauagugacacaggacuugugcucagcacucugccacuauugcuuuccugucacaaauaauuuauagccuucuauuuccaccccugagccugcaccccagccuugccuccugcuucccccagcucccaggaaucaauaaacucacauagccacggugggacuucagggugcaaggagacagacagacagacaaagagaggggaaguggagagaggagcagagaaggagaagaagagagggacagagagugaaacacagagaaaagaauggggaaggaggaggaagagagagagcugaacuagaagaugaguaagaaugccuggugcucucuuaaaagguggagcgcuucucucuuucuucuugaguuuaacacaguguuaauaggaguuucaugcagggcuuucauucuuacucacagagccugagacuguguugauauccaaguuggugagaggugggggucuuccgggaauuuaaccaguaagggaguggccuccccaccugcccugucauccuuugcucugaaguccugccacgacccccugccaucccuugggucuccuguggauccuugccagugacccuaguggggcuugguccagcccccagucugucugcuugagagucugacgcaaccuccuuuugggucagaugucgccgccgccacugcugcuguuucuugucuucucaaugcucuucccagggucucaguggcaccugcauugaccagucuggggcauacuggguagggaggucuccugccugcaucggccuaaauugaaagcacccgggccuaggggucacccauaggaauaauaauacuggucaucauuguuauuauagguagcauuuauagaaccaaccaucauaguaaucacauuacauggagugucccuauuuaguccuugccacaguccuaugaaguguaugguaguauuaucuuauuuuacagagaagggaauaagaaacugccagggguuucacaggaaacaaguaacaaagccgggauuccgacuaaggcaggcugagcccagaacccauguccuucuuccuuuugcugcucucacucccuuggaagugugggagacucuaagugccuggaaguccccaugcggggcccaggccaaagcccuggagguccccaggaaagggcgagcucucaucggaaaugguggaggagaaagagcaucuugugaaggaaagagaaguggggagcaggcacccuggcagggcagucucucaguggaaauggaaaaaugacaccucccagcuucugagcagagcuguguccuccagggucccagcugcacccuccagggaucuauauccagaacuugaccuuccaggucaaaccugccuggggccguggagguuugaugugugucuggcugucuugugaggccaaguaugaaaaagaauuggagaaagaggaggaggaacauggggaaacgguaucaggccgucaucaucaacaacugcuuuacuucauucauccuuuagccccgagugaaauugccaugaguuguuggguuguuguaugggagacaggaggacaauggaugaccaucagauuuccaugaucccaguucuuaaauucuccgagaucagcucuagggacuggcaagugcccacugccugaggucauggauggacaccaagagcauuaguaacucacagcaggcacccugcccagcuccucccccaugcaccaccaagccgcugucagggaguagugauuuuccaucacucgcugccucagcuaaauuugcgccagugcccuaggggucagaggcucuggguaacaaagacagaaacuccucaagcccguccaguucucucucucagccagccccaccccugggguucccuuagucaagagcccaucagcccucaagccagagccacccacaggcccagugagcucacagaagcuguugcugcaguaaacuaggagcagcugcucugagcugcucagcaucuuucuagacuuuucuuguagaugauuguacacugccucucagcuacuauccaaucuuuuccauugugaucaaacuccaaaucuucccuccaacucuugggagaugaccuugccuucugcuuugcugagagauaaaagccguaaaagcuccuuuucaaagcuuuggccaccugaaaauaugccauuucuggcuaacaccucccuggagucugcacuccauuuuuccuuguucucccuugcucuguuaaucauccacagucccuuaggcaacuucagucucuuccucuucacugguucuuccuccucagucuacaagcuuauccaggucuuuccuacccaagaaggccuucccuccacuuagcugcccguuccauccuccaccuuccauacuuuccucuccuuucguuuuccaaaaacuucugaggcaauagucuccguuuacugcccugccuccuuuuacucccuaugcauucccuaaccuuguucugucuggcuccugcuccagucgcuuugcugagacuccuccucaaggucacuaauggcuaccagaaucccaaaucugugcuucuucuuguuccuaauucccuucgguccccauguugcuguuggcacugcagguuguguuuuucuugaaacauucuucuccacugacuuaggugaaacugaccuaucuugguucugccauuuccucugcaauuaauucucugaauccuuugcaaggucaguuucuuuucccagucccuggaaauaaauguccuccaguauccacuccuuaggccucuugucuuuuaaacacuccuuuccccggucccugacagucuccuaaauccauaccucugugugccugcugaugcaggggcauugccccuggacgcuccucuuucaccucaaaugcugcacaucuaggaccaacaucaccacuucccuccaaaaccagucaccucccuauagccuuauuccugaccugcugauguaaacuccaccaagcuuccaguuacacaaaucugaguuuguaaaaccaugguugacuccaguugguugccaaacucugaccauucugccuuccucuugucuugcaaauucuucccuuucuuuccugagaccagcucccuaucgccucaugccucauguauauguauguugcuuuacugggaucuguuuguagagauccccccuaguuuagaaaucacucauggcuuaaggcccucuaaaccugguuccuacauguugggggcaggaugacaaaguaacaaaaagcauagauuuuagaggcugcauucugagucuucccuaauugguacugugauuuuuuuuuuuuuuuuuuuuuugagacggagucuuacucugucgccuaggcuggagugcagaggcacaaucucagcucacugcaaccuccgccuccuggguucaagcgauucuccugccucagccuccugaguagcugggauuacaggugcauaccaccacaccuggcuaauuuuguauuuuuaguagaguugggguuucaccauguuggucagguuggucucaaacuccugaccucgugaucugccugcgucggccucccaaagugcugagauuacaggcaugagccaccgcaucuggccuuuuuuuuuuuuuugagauggagucucacucuauugcccagacuggaguacaguggcuugaucuuggcucacugcaaccuccgccucccggguucaagcaauucuccugccucagcugccugaauagcuaagauuacagguaucugccaccaugccuggcuaauuuuuguacuuuuaguagagucgagauuucaccguguuggccaggcuggucucaaacuccugaccucaggugguccacccgccuuggccucccaaagugcugggauuacaggcgugagccacugcacccagccaguagugugaucuugagugagcuacuuaaacuugucucagcuuugguuuucaauuugcaaaaugaggauaauagucucuacuuuggaggugguugugcgaauuaacaguaauauauaugucauauaaauuguguauaauauuggcacauaguagauguucaguaaguggaaaauggugaugguucucaucacauccaaguuuucauucuuguuuccucuuagucccuugccugucuccacucauucuggcugaccacucugggcauuaacccagaaggcagcaggcucgcguggcuuccgcuuccaccagcuugugaugcccuccccucuacuucuuuguucaucuuaggaucaaguuauuuuuuacuggggaaagagacaguggagauccuguaguccaaccccuucauuuaaagcugaagaaacugaggcccagagaaguugagaggugagaccaaggcuauguggcuucuuaaaugcaaaaucagaagcaggacucagggccccugccaugcagcccaguguccuuuccgccauccucugugccucugauuucagcccuacuuggcuuugaagaucuacaucaauuucccucuguucagcgacuucuuccgcaguucccucuccugcaaggggaaugguuccucuccuccaaguuuccagcacuaacuaccugauucccucggguaacugagcuuuuuuggggauuaagucuccccuccccaccuucauauccagcacugugagcuaggggccuuaucccaacugccugcaaguguucaggaaaagcuuuuagagcugacuugcucauggcuugugacucaccuggcugguugaggugagcuuggcucacaugccucucuguggggacaaggaacgcuaucagaaaaguggcuuccaaaggccccucauuugaccaguggguagggggagcauuccuccgucuuggcccugggacuggucuuuggcaucauugagcccucgguuuuucagaucccugaaaagcaggcuccuggaauguuugauuuggccccuucuccccaggauguacagggagggcaccagaccuuucaaccaggcuggcaaagacgcugcaauccaaguaagaaccucagaaaaggaggccagcaaaccagccagccauauaggaacagggcucugacuuguuugagggcaguaagugggcucaagaagagauuguucagccugacaucuggcaaagggacugugugcuguguuggaguccuggggacaaaagaaagggucaccugugacccagccccucccuggcuacuucucauucuuucaggauauggggaaaucucauccucucaacucugaaggacugugacacagucccaaguaggaaagccagcuccaaaaugaucucaaaacccaggagguccugguaccaggaagagaugcgugugugguugaggagagaaagguggacaacaagccacuagggcaguccucacccugcagaaaaagaaaggaugcugugcucacugggucucugcccugaucuuugcuaccaaaaaucaaacaauaauuugggugaugcacauagcaggacauaaggcaggcugcauucacccagagcugcauuacguuggaucugcggagccaacagaaggaaaacccugugccuugcagcagucagugagggcagggacacagggagcagauggaugaggaaaucgcugaggaacuugggagagagccccuuugcagggcugggcuggaauuggccgggauaggagugggcauuugaugugugaugcuguugugacgcuguugcagaaucauccggaccaaaguucagcagccuuuccacccaacgccggauggggcugggacaggagugaccgccccuggccacaccauugguaagagggcucagggaaggggaggaaaccagaucccaccuagagaaaggcaggaaacgcagcuccaccccugggaacugccugcccgcuugagguccagagcccaaccuauuugccaacuccucucaccugagcuccuguccacauagggucuuccugagagauacugguucucuaggacuguucucugccucccacuugugucaccucccucugcccugcuuuagucagucccuauccucuccccuccucuccucucucuuaaguguuuuucuucuagcauuucuucuucuuuuucuucuucuccuccuccugcuucccucucccucauucuccaacaucuuuuguuuuuaucugauucugucucccuaccugugcccucuuucuuuuauaucaacuuucuuauuccaucuuuguuuaacauuccaucuuguucuuaacauuguccucugucuucuccccuuggcuccucuucuuuucucccucugcccuucccucucuucucucuucuucuuagguguagcucuggcucuguucugucuuccuccuuccucauggccucuuuccucuuggccuuucucucuugauugcucagccucugucucacccacucuguaucucucauccuuucuccauccuccucauucuuugagccaugcuuagggccucucaaagacgugacccaggccuacuagaacaccugcuaacacuccuccucuguccccaacgcacacagacuagcuucccucuggcccaaggagaaacuuggugcuacuguagccauagaugaggcccgggguuugaggggcugggaugugguuacauuuuuccugcugcuccucuuggcaguugucuccuucugucuugaccagcagguaauagaaaugacuaguuccagcccuccaggaguuggcaggagcuguuguuuacuaggccaguguuacagugugugcugggagggaggguugggccaggcuguaccugaguugaucaccauagagcgaauggguucacuaaucuugcccuaagggggaaauuaggaguuucucaagugauuucaagaccaaaagcagcugagagagagaaaugcacacuccuggggaacaucaggaccagucuugugucuccuggagaaucagagacagaucuuagaaagccacagacucuaaaucaggauugguaaagacucagcccaggagacugagaacaaugagcuggggcuucauuagaaggguuugcccagccccagggauuggaugagcugugcaaggggguauccaaggagcugugcucucuagaggaccauggaggugcugccuagaaggagacagguuugcuguuuccugggccuguacuccauccgucuuuaggagagugaguuugagaaccccagugaaauccacaggucugcagagaaggccugggguuaaacugggcaccacuuaccucagggcuggacagaagugaauaauagccuguauauggcaaugcaguccccucuuaaauagaccccagaggaaguagaggaaugagaggaacgugggcuccucaucccuccuuauguccucugcuucucucugccccccagccuuggggcuuuggccuacgaucacaacugcuaaacugcuauccugaugccauuuccuccuuccucucauccaguucccagcacggccuccccuccuguuuccagcgccuccaaugacccagugggauccuacuccaucaaugggauccuggggauuccucgcuccaauggugagaagaggaaacgugaugaagguagggaggagggaagagguguggcuuccccuucacaugcuuuguccuuggacuccaagcuccgguuucggccuggccucgcagcugcucugcugugagaucaauuuuaguagcaaagcccagguccccccacugcccugcuggcuccuggagagagggaggguggcugcuaguggggccaucagcuucaccaucugcucagcagccccggcugccucaccugccacuagggcucacccuaucgaucccugugggaugucaggaggagaagcaagaaccguuuaccuugggaagguuuuggaguugggggaacagcuggucucuggccugaggaugaaaggccaaccuaccuuguccuuaccugaucccaaucugucuggaggugagguagugaugucaugugcagccuagccugguguccuuucucuuuaacaccugcacaccgcccccaguucaaaccucacagggagcuggacaugggaccccucucuccucuucuucuccaugaguagaaaugccacuccaaauccccuggcccucucccucaccucccugaaaugccucaaggugcagccaggcuguuaggaagggugucaaagggaagggggaaggaagaggaggaggagagaagaaaagaaauaagggggagagugguagggaugauccugggacaaaguguuuuucaaaugucgugacauugggggucccuuggugaccaucugguucucuucugaugcgugaagcuggggcacagggcuggcagacccugaacaacagagacaccagugucuccggccugcguccugcccccauuuucucaugguucccgcuggagaagugguaaccuccuggccuucagaggauuuuaaagacaucucccaggaaagaggcagaauccucaaacaaugagcauaaaggggugaccaucuaucccauuagcccagaacagucccaauuuaugccuguugucucugcaucuuggccagucagcaucucagcaucucccuuuucucucaaaaaugucguguuuggacaauaaauuauguggucauuccacacauagacaaacccucgguaggggaagccuaauggagugaggagcagagaaaagggacaacacugagcuugccugggcccacaguccaagaucccccagccuaggcugagggaagagagugggagaggccaggcccccagcggaagggacagcguggaggggaggccuaggccugacaagacagugaugaccuggcgcuggccuccuuccagaagcccuaauggccucguuucacagggaaacagcuugucuggcucuauuucuccuucuuccaaaauauccaaaccgauuuggccgccacggccuuugccauucacuaaauuucauugugguuguuuuggcggcggccccugaugggcagggggagguugugggaaaggcccuaagucccaguucucccugaggcucccugugcucaggccuuggccaagcuccuuggcaccccaagugcuuugguagaaucugccucaaacccuaaaggucucucccuuaaccagcagccccuguguuuuuuaggggugagaggcccagcagcccaugggaggccacagauaccccucuguacucucccuuuucagucugaggcuguggccaaguaugccaaccucguggccaaguaugcccucugcugcaugggcuccuguggggcaagaaaggcuggggguagggaggcacuggcaugagguuguggucacccagggcugcgccuggcuggcccagaacagggcgcucuccugagugguugaucgccuucauuguuucuaaucaauucaguucagugaaccuuuccuggacaucaguuucaagaaaggcuugguacuauaggaucccaaagcagaacaagauaugauucuuguccuuaaggagcuuacauucuaguggggcauguuaaacaugugagcucaaagagcagauaggcccaucagauauccuguugcgauggaggucugguggcgggccacaggaacugggcuggggagggaguacauggccaggaagggcugcucuuugaggaggggccugagggaugaagaggagaauguucagagacaaugguagccugaaauucuaucugauagacugagccuugugaccagaaggcccuuuggccagccacugcagggcagcuuuagcagggauagaaggcacaaagagaugugguggacaguaaggcugaggagacagguuagggccacaggauagcaggccaggucuagaccauagaaggaguuugggcuuuuuuuuuuuuuuuuuuucugaaagcaggaguagucugagcaggaagggacaggagcagggcuggguuugggaagcucaugcuccagcagugugacagugaugcaccagggccauguugcaggaagcagugaaagccuucaaagcaagagauuacggugcccccaaguuuccucugaaacauuuaccugcugggccuauccggguggcaagacauaucagaggccucacucuuuuuugagagacgguucuccuccucuuaccaacuccucuugaccaaccccaggccaaauggagauguauuuucccugguggaggccuggccuaugagggagaccaguucucccugaccucccccuccaauccugauccaccagccccuggugggaagggagaggagagagcaaagguagagcuguggcagccccuccuccccuuucccccacucuggaugcuucuaaggagccaggcccaguuugcauuagggagcagcucagaugauuaagaauaagggagauaauuaugugucaagaugauguagcccaacucugcagucaggccaagguagcaaagcagcuggcaggccagucacagaaggcagccucgggcaugggcugcagacacccagguguguccuucagugacugggccgggacugcagcaaaagagaauacugaccaggggacuaagggguguugggaugggacugagcacgcacauuaaagggcuagacccuagagggaauggaggggcucaucucccuccaggaggacccuuaaagacccugccagacuggcccuccuuuggccccaagcacuguggcaucuuccuaggagugucauaccccaagggcaagcugugaaucucuuuguccuccaggaagcugcuccucuuuugcucuggguacaguucggccuauucuucagcucuaacaaugucacggugaugggcauuagugaggacaaucacugcagugagugcuggcauuauuggagacaaucucagcaguaguuauugguguucacagugauaaugcccagaacauuauuggcacuggcacucggaauauggacaguguuauuaguaucugcagcaaucauuucccuggggauauuaggaaaggacugaucagcugugacucuggggaaaaacuggcagugacugugagccuguuugagaccccuucccaugccuuggccuuugagaguauggaaaacacccccugacuuucccuugagaaaugugcuggucaagaggcuuugacccucaucccaagagcccaggagcucccagaaugagacagguagacaguccagauagaugaggaaguuauguucugaagcacccagaagacaggcuguccaucaguccgagaagguagaauccccauucauaucauucaaaaauccucacuucuuagcuguaauuaugggugggcauguuagugcuggauucccugggcccuuugaagggaugccaauucccugaacacugugugagcugguuuauguggcuggaggagagagauucuuguauuucccuaucuacaaucaggcugaaaacuggaaguccuucgccuuuacccaguugcuuucggcuggggcccaaaacauugcuguucaucggugaugguauugaagcgcagggcaguuacacaacuuguccaagaauccaaaugaagucauauggugagaaucugcuggucugugugagggagguguguugggaucauccuuugaggugugagauugcagggggccaugauuuugcauuccauucauuagguguacaaugaauugugccauugaguggugccaagcuggugcaguugugcguuugcaggcagggcagguugcauggcugcagauggccgaguccugucacugccuuuaauagcucccuucugcuuuggaugaagccauaaauggaagaagcaguuuauuuccuuaguuagcuaccauccuagagguccccaagaguguugcucagguuagacuuggagcaaaugaggggauuaagccguggaaaugagaagcaccugcccuugucuacgagccuggcuugaggcagcagaagguugcaaagacucccaccaggaaggaaggcacaggguaggagugagcaugccaucccuagagcagggcauggaugggcaguggggcucagugggaaugaauguggccucuggagugagcacagcagggucugaauccuggugccccucacuaguugggcaagucaccuaaccuucaucagcucaaucuucuccucuguaaaaugaagaugguaauggcacuuccuuccugggggcuguggagaggauuccaugaggucgugaauuuaguguugagcugacuucaucuuggagacgcauccuuguguaucugggaaagaaagccuaauuggcagguuuauguuucaugaggaaaugaaguuguguuagaaagaaauuuauuugggcauaggcgcccuaaccuuggugcagcuccuuguaacuagggcagccuuuaguggaugcugggauuagcuaacccggaugggaccagcgcaguggaggaaagcugucguccucacacccgggauugggagaacguuuguccauuucuaucuguucauuuacucugugguuacccacuugggccacaugucaucuuucagccuccacaggcauuuuagguguguauaaauaaauaaacauaagauccucuucuuuuucuaacaugugggcaucucucccucuauucaucuguggacauuacugcucccacaugcaaguuuauuucuuuaccuuggaaaauguauguuuguuuuauaaacccaaauguaauuuuuuacacaguuuaugcaagugugaguaugcauguguucuaccgcucugaggucuuuggguauaaggggaugggaaugucaugcacugggaaggugugcaguuaccuggguagugugcgugcuuggagagagugccgggugugacugugugagcggggagagcucuaagccaggccucaguguguugagcgcccaugguccugggcacaggcaucacccuaccuucugcugauaaagggaggggcuguccugagccugccuccagggguggccuagggcccaagacuagggagacuaaggcccuuacagccaggcugugagggaauugcagcucagaacccuuguagcccuuagaaggggagucuggucucccgaucuugggauccugcccccaaucuucugccugccugucuuucgggaucucucaguguuugucugucucuuauuugcucuaguugagguauacacugauccugcccacauuagaggagguggagguuugcaucuggucuggacuuuaagagguaugagggccagagggaacauggcgugggggucaagggaaauagcuuggggguggcgguuagagaacauucagagaguggguuccuaagggccagagcauggaaaaggaggaguuggcucaggcuuccacugggagaccuggaggcuaacagagucucagggccuggauuacuuccgccaugggccacugaugggguuugggagcugaggccccgguggccuggagggucaggcacucaguggauggggggucacuuuuucuagcccuuggaaaaacaaagagcagaucggguaguaaaacaaaagcaaaggagaccuggaagcaccugacagcccuaauucaucacagcccaaguuuuuuccuguguucccauuauauuuguuuguaaaaguggaaaucaauuuugaagguaauuuucuggaaagaauggaagggaggugggagggccggauaaggcagagaugguaaaaggaaaaauuuaggccaggcacagcccaggggcagcucuuggcaaggugaaagaaaauugcauauucaaucuccauccaugaaucuuccucacugcugcccgccuccugcuugaaaacaaugaaggcuuuuucccaacgcugggcagggccucgguaucagccucacuuuaacuucagggucauuaauucccugauuauugaaggagaagagaggguugcagcaucgucaauuccaaaggcacccccucaugugaucgggcacuggcugggguuggguggggggcacccagggcaaagugagguguuguuugagaaaggugugaggagcgaggaaaugggggagccacuggacuaugggggaaggaagccaggaggguggaagaaggcagucauuacugcauaccucuguuguguuguuauugcaaauuaaaaguagcauguuccacuccacagcuaucuuuggggagggaggggcaccgagggaggugggggaucuuaucauugcuucuucagcagaccagccguggugucaccgugugaggugacauuugaauuuacaauuccgcugagaaaagccauuaauucacaaauuaacauuucucccucucccucucucuuuaacacucucucccucucucacauggaugugcaagcaauugaaaagacaaaggaaauagccuuaaggaagagacuuuacugcuagucugugcugagauugcucccccugcuuccagauagauaaaccaauuaccugagcagcucugcuccuggccgcccgcgaucgccuccuuuuguaggcugccuccauggcuggauuacacucgguguaucucauuaauguaaaccaggcgugcccuggucaccaagcucucuucccggcucuccuucuggaggggcagugggaggagggcuggggucaguaaaggcaggcaaggaggaccccgaggaagaccagaggcugccacugccuggcuucccaggcccugggcacucgggugcagccugccauguuggcugaggcugaugggggaagucggugggugagcgcuccuuggugggcuugcucugaacugagugagggcuggguauggcugggggcagaggaaggagacagggccugagucucucagcggcauuuugguccagaugcagggggcuggcagaaccagagagggaucugagugcucccugcuugggaagagcuuggagaaguuuugcugaguacacacuauuuuagugggaugggauucagccugaaggagcuuggagagaggcugaggagggcccaggagacuuggcgagguugcaccauauuggguaaacaaaaacccagcacuuggauacaauuaugucuguuuaccaccuaauucuugcaugcacacacaccccccccgacacacauacaugcacaccgacacacacacaugcacacccagccauccgacucuuuugcuagagaagacggggagaaggagugugcucccagguuucuaaagugagcuuacaucguggguagggaauugcagggccucucucugcuuuugcucuccucccagacccugguucagcacuguaagaaggcauuuauguugguagggggcagcugagcagaguuuuugcuucucucucucucuuuuuuuuggaugaaguuucacucuuguugcccaagcuggagagcaauggcaagaucucagcucacugcaaccucugccucccaguucaagcgauucuccugucucagccuccugaguaguugagguuacaggcaccugccaccauaccuggcugauuuuuguauucuuaguagagacaggguuucaccauguuggccaggcuggucuugaacuucugaccucaggugauccacccaccucagccucccaaagugcugggauuacaggcaugagcgacugugcccagccugaguuugugcuucucuaaggagaggugcucuguggauuauuggugggauucuaugauuucacacacuguacuaucuagcacaucacagacucuccccucccuaggagacaggcccuaugaaaguccagaaaccaaaucuauaugaugguaaccaucugucuagacaaguuucugacuuuaacugcauuggcucaaccuauguucauuuuccaacucauacccaaaaccuggcuaagguccacuuaguccaagaaagagcugagguucaaaggucagcacucaccaaaacacagggggaaaaaaaacucauuuaugaacacacauucauugcuaugauuauaucucccuaguaaccaaggaaauuaaacuguucauaccugaggggggagguuuucugucuuaguuggaucacauauuuuagccaaacucucuggguagaguuggccgugagccuguugaauacugacuaugucauuauccagagguagguguagguucugucgauguuuuagaaggaccuuuaucuugggcccugugcauaggugauuuguacuuuuuuuguggggaaguacagggguuuagcccuggcuguguggaucaacauaggugcaugcaucugcauauaaguccuugccuuuauaucagagacagcagccaaaucaccaacuaccuuugcuucccaacuaguuaaugcuguuguggaugaagaauuccaucugguuguuuggggaaguauuuugggauuuagcacaaaagaguauauauuuuuucauacaaugccagaaauucagaauagagaggucaauuccacccuaccaggagagaauauacagaauugcccuagaggagacuguauguguccauccaccgcuggaaauuggggugggcggguguagguauaccacugucucagcaaaggcugucugguacuccugcccagcuccauguuugcacccucguggacgagcacccaucuugucagaauacaucuucaacuuccuagucuuucacuuggcaacuaccuuccagcccugcagguaggcauuguucuccuuucccacccagcaagggcaccaagcaggaaaucugcugccucagcucugcccuucuuccccaagcacaggcuauggaagcaggaaggaggagaugagcgccgaagcuauccccgggcccugcuacuccugaguucaccucccugggcgccucuuccucugcagacaagcaggaagcugagaagcgcaggccacuggaaaaaggguuuggagaggauguaggcuagggagaccccagaucccugccugccagcggaaugguccuggcagccuccuugaccauugcugcccgcccuggagcccagaaaaggaccccuccugcccugccuuccucagagccaugguggccuuagggcugucugggacccucuccauuuugccccauugggguggaaaggcauagagggcugggggagggcugggccuggcucaggggcugcgagacagaucacgagccucagagccaaguugcagccucagagccgaguugcagcggagccaguaauucaaaccauccugacccuucggugaaccugaaccugcugaccuugacagcacuagacaacagaggccucacaaaccucaaccugcacggaggccuggccuucccucccucccauucuuggagcccuguggcccauccuccagguggcuccuaauuuggcugcccccaugaaaugucagcauccccucccucccugaggcuccgccugccugcuucaaagcacccuuugugcucaucucuacuggagacaagugugugggcaucuccugggggccuuuccaggacuggggcuggggcuuuauccugcaggcagagcuuuuacaccuugcccuucucuuucugccccaggcuucaccuuuuucaggaggacuggcuagagugugugugcauguguauguguguacauguguaugugugugcauguguguaagguugggguacacacaggggcagcaguagaaugugauccagacagcagacaaggggagggaagagaagccagaggaaagcagcuccaggaaccugcauuaaaguaaaugcaguuuaugaaguuuaugcuuuccuccuagggagagcuggauuccauccaacagccucccagagccugccaaacagcuccugaagcagaaagugugagcaggagagcaagcgagccagugacagagggagagaugcgcggacacacucacacacccuugcuggcucacacagaucucccucggcccaggcagccugggaagccugggauggagggauggggacaguagguuugguaggagugacuccaggagccguucuuuccuccuuucuucccuccucaccugccaucuccaucucuuuaggcagagugcccagcaugagcccuugggcagugugggcaccuggguggacuggugguguggggagccgagggcacugugggccaccuggggcagccagcuuguaggagccgccugggugagggacaguguggguggucuugggcaguggguaugugguccaggcagcaaaagggaccagaaugcuauacaaaggaaccucuagggacuugcuuuuucuucggaugcuggggauccauuuuucucuggcauuuuggucugaaccaugugggugccuuacagccacugaagauaauuauuggagucuuuuaaggagaaauagagaccguauuuuuuuuccugguaauucaaaggaaauaagugguugacaauguuaaaguaugaaagcucacagagggacuuaaaagcaaguuggaauauuggaguaucuguucuucuggacucuucuucacgugcacaagcacauggguucgugcgugugugcacuaauaauguguaagugggccaggacccuugacuuuagaugaaaggggagugugggggagaaaaugccuggagaggaaguccgcagcauaggccuuugcucuggccugugggcuuggcaccaucauguugcuugccccuauggcuucugcgacauaccucagcuggggacagacagugagaagucuaucucccuucucuuucugggaacuccaugucugcucuauucaaauucuaccaggaacugagacagaagaggaugacagagguagaaccauccagaagcagaggauggggagaagagggcaaaaggauagcgaaggaugcucagaaauugcugacuguggaggacgccuugggaagccaggaggugcuaggcacaggaggcagaaacuggccaaggauggcguugguccuuucuccccccugcucucucccucccccucccuccccucuucccuccacacaucuuuauugguucugguaauagcguugauuugcaugucaggcaaagccuugcuacacacacaaaaagaaaaccccagcccuggcgguguggcagugucagcucucgcuguuguucgacaguguaaaauuaaauuaauaaagcccccaacacaggaaaacauaacaggaaauuaauggccuuuacugucgcucugaugcagucauuugcaacccugcuuuccgcaccaaagacuucauaaaugcaagcaguuucucuaaacaagcauacuuagggcggccugguauguaauuuuucgccuugcuuguguccuuugagcuaacaaagcccccuuuccucuugguuccagagauuucuaacugguucuggccccugcuggagccaaacggggacagcaccaggcagagggccccacccgcucccugagagcccagagaaggcugggaaagggcuagggucccaggagcuagacgcucagugagcccuccuuccccaccagccccugcagcaggccagcaggacugcauaccagugcucccaggcaggaaaguugaucuccucggggaauuccccuaaacccacucaaggcucaccccucuccuuccuccccgggucuguccucccucucccacaacuuguguguucccuuccugaggccucuggccuucaccucccuccuugucgguacccacucuccaccguuccacuucuuaauacauggaucgcacacaucuaggcuggcugugacuuggcaguggggugccacgcucuucuucuccacagguaaccugggggcucuuuuucgggggagcuaaguuauucaaagugaggaaaguaaaugugcugguacaauuccccgggguucuagguuuccuccauaucucccucuucucuaccgguugguuaggaaaugccagggcccuaaggggccccucagacaaucccucuguccucggcaguuuucagugagcuaagaguccuugacugcuuugguguguaaaucgguaggauacugaggaaacugacaccuuccucucuggccucucuggggaucuuuguaucaaugugggcccaggugcccaguguguugggagguaugagaggagcagagaaccgggaugugacucucaggagcuuagagccugcuggggaaggcaaggcuguugcacucagacaauuggcuguucauuaaaugcccagacacauggcuguguguuccauaggaaucuggggaaauggacuagaagggcaagcaggaaauggggcuucagccugggagccugggaguggcugagauugagagaggccuuggcugggcuggauggugacaaggcagagugucagauucuuaagggucauccugucuuaucugccacucaccauagaacucuuuccuccaacaguucugccugaaaggccacagcccugccuggacauaugucagagauggacaguggccauuguuuguuugcagcaucacuuuauaccaagucaugcggguugagggaagaccacgggacgugggauccaaauguccagauguggguccaucuccacucccuacuugcucugggaacuuugacucauuacauaauaucucugaaucucaguuuccucaucuuuaaaauagagguaauggcauuugccacagagaauggugguggugguaaagcucuccauuugacacccucccuucccuauccucccucccucccuuucauccacuccaccuuauuuacugagcucuuggcaaaugcugggcuggguccuggguggauuucagauucucacaugauaugguuccugcccuuggaguucccucaccauccugguuacccaucucagaauucauuauugaagguuaaaguuccucugaaaugaacacugaacuccagagacagucuaaccaaugccaggcacaguagagccuugccacucucccaucuggagacucuacauccauaauauagccuaagauuacauuugauuuuuuagcagccaugucagacucaagcucauauugaguucguggucaacuaaaaccucgagaucuuuuucacaucaauugcuaucaagccaggucuaccccauucugcacuuguguaauugauuuuuuuuuuagccuaaacauagggcauuccauuuaucccugcugaauuucaccuuguugguuuggguucuuaauucuacccgauuaaggucauaaggaugucuucuauaucaucauccaacuaguuuuuugcaaaagaguuauuuuccuugaaaacacaggaaagccacauggcccaccaauggggaccuccuccuggcugcuguaagugaaugaaugcuuugggaacuacugagcccaacagccaucaaucauuuuacuuguuuucaucuuguccauuaugcuaggaaggagauucuugguuaaauguuaacacucacuacuuccacauaauuuccuuaauaaauuauuuuuaaaaaucugguuuacaucgaugagcaaauugagugccugcuauguacaaaguauggcaggacugauuuacaaagguaaauaggacacaguccuugaccucaagaaacuuacaaucuagcagggagguagacauacacaucauuauauaaucagaaugugaugaaugccgugaucaaggcaugaagucauaugaugaacgaaaaaaacaaaggagcaguugcuuccacucagggcaacuagggaaguguuuaugagggagguauuugaucuaagcguugauauggaguaaauaugccacaacuuauuuuugugagugcgugcaagcucugggauaucaccauuuucuuuucuguugcccauaaauuaacuguauaauaauuucauuuaaaggauuuccagagccugauccugaauuuaugauuuugagugucauuugcauauguguaccucuucccccuuuucugacaggcaggauggccuugggcuugucacugccucacccuuucuuugugacaucucagggaucaucaacagcaguuuuaggguccuguguggaccugggaaaguucacugaaauggccagagguuaccugccuggccccucccugaccagggcacuagugcccuccuacugggcucaguuugaagauucuuucauuuggagaagacaaaagcaagcuaagguugagaaguucugccuucucucucaauauuacauccucuucccuaggacugagccaaaaccugccuuucuuuucuuucuuucuccaaggcccuuuuuuguugucucagcuuguucugagcuuuugucuuccugacaggcucaugccacccucauauccauccuugguuaugguccccgcuuccaucugucauguauccugcauaagaggaaaaaaagugacuucuaugauccuaagugcaauacaugcucauugggaaauaccuggaagagauaguaaauuuuuaaaaauucacucacaaugucgucaccaggagauaaccacuguugaauuugguauauuuucccauucucuuucuuuuuuguguauauauaauuuuuuaaucaaaaauugaacaauaccauauaaacagcuucaugucuugccauuuucaccuaacauuacuuaauauaggaccauuuucacauaucauuaaauauucuuugaaaacacgauuuuuuaauggcugcauaaucuuccacuguucgauguacauguccuuuuaaaaucugggaucaucauauuuuaaagcuuaucugugugcaacaacagugauuuuccugaaauguccuucucuuuucaccccucccccacucccacucccuuuaugcugucagguugauuauuugagcuuauagaagcagaauuucauuuuuagagcaucccauccucguggaauuauggucucuuuuagaaucucuugccauggaaucccuggccaugucuuucccccagcauggagcauuuugcuuucuucaguucagauucugcccugcacccccuuccugagcuacugccaacucuagacaugcuugcuuucucccugcauccccaucauuucccuuucaucaguuuuucuuucuuggucagaauuaaguggccugcaauaguggaaagggaucugagcuaggaaccucaguucccauucuuaugacgacuagcuaugugacaugggaaaauuaccuaacuucucugagccuggcuuuugguuuuugucuuaauuuuaaauaucuaagagggaauccaauuaaauucucuucauauuuuccagcuguagaacaugagugacacugaauucagaguagcagccuccuuuguugcuucuuuuuccuucuaaaagguaaaauguugagcauaacaaguuaagaacugaccaaucuuugcuuuuggaauucuugucaacaaaucagccaacauucaugaucacuuucucuacaugaaguuuauaaaguugaaaacuaugggaccccugccuucaaaauucacaguucagaggagaaaacaaacauuaaauaauaacugugauacgaagagauucuaaauuuggcucugccacuuauuggcuaucauaaguuguucuggguaaauuaccuaaucucucuaucccucaguuuccccagguuaggagcuuagcugccagaggcauguugccaggguugaguucuggcuccucugccaucugugaggcguguaaccuugggaaaguuccuuaaucucugcacuuucauuuccccaucuacaaaauggggacaauaauguuuaaguucuugugaaaauuaagugaguuaauauauguaagauuaucagaggagugccugauauauacuaagcacuuaauaaauguuaguugcuguuauuguaaggauuacaucagugcaugcauguuaagcauagugucugguauccaaguagaaacuggaucuguuuuaguuauuauuaguacuauuucuacaauagagguuuggauagauggcuguuagaaugcagagaaaggagaaauuaauggugagggaggagcuaacagcccucuuguauaugucugaggaaacucaauccagaaaagcucaggagauuuauagcaagugagcaacaaaacuaggauuucaauccaggagauguuacuucugguccagcauuguguuagggucacuaguacaguuagugucccuagaggccggugggugugaauggguacagcaagccugaggucagacaggcccacagccaccccagccucucccuauucaugaacucacugaguguuuagaagcuaggcuuggucaaguacagcagguaguuucccagggcuagaaggcugggcagaaccuggucuugccccgagccaagguuugggccagauuuccaaagccuucuucauguccaccucuuuuuuuuuuuuuuuuuuuuuuuuagacagggucagggucucacucugucucccaggcuggagugcaguggcaugaucucaacucacugcagccuccauccccagggcucaagugauccuccaaucucagccucccaaguagccuggaccacagacacaugcuaccacacccagcuaauuuuuauauuuuugguagagacgggguuucaccauguuggccaggcuggucuugaccuccugagcucaagcaaucugcccaccucggccucccaaagugcugggauuacaggagugagccacugcacccggcccacuuuaugcccaccucuugagcuuggcuugggaacuguggccaggccagacucacugaauguccaguuuaaagaugggaggcaauggggcauaucauccaucucccuggacaagcagugucaccauagcuccuuucccagcccggcccucuggagccccuucccuccucucuccuuuuuccuaucuauuccucccucacucccggaaucccacuuuccccucauccucucuucuucccucccuucuccuaucucccuuaccucucucuucauuccugaacacuccuuccuuuucuauccuccuccacucucccuugugacucccccacccaauccaucaauccucccuccucucccagucuggacagcaccugaccucuggggagccaccccauuccucagcucccaaaccucacucccuguucccaguuggaccuccaccucccugguccugcugugccgccguggggguggggcugggccugcacaggcaggcugcccugaaugacaagcggggauauugaucgcguucugaacucagcccagccgauagaagguaauuaaugacuccauuugccucacuaccgaggagaacaauugaguuugaaacugcaacaacuggcagcugggaagacuggggggcagccugggggugaaccccucagaggcggaaguaauguguggaguagcuaggcagagagagcaccuucugagcagaggccaccaucagaacgggcagagcccccauccccagcacagcuggccccugagccccacugcucccccagcccuugaggcccaaggcccaucacccacugguccccccaccuccacgcuuuucucuuuucuucccauaucacuuuuugaggucauuuucugccugcggaugaagacucaguuuucccaagacugcuucuugccagcugugcaaucuugcacauauuuugaacucucccugagccuguuuccucguuuguaaaauugaacuaacaguaucacuuuugcaagcauucugugaagacuguggauaauguguauaaaguaccuugagccugcccagaacacaguaagugcucaguaaaugaugauggguccuugacagagaaggcaaacaugguagaguggagagagcuucagaguccgacaucccugaguucacauccaggcucugcugcuuccuagcugugcaguguugaacaaauaauuuugccucucuaagacuauuuccuuuucuagaaaaugagaguaguaauaaguaccucguaaaguuugaagagguugaugaguguaggugaaagcccuaauaucauuacuuucuccauagacagauagauguuuguauuugagcuuagaaaacugaaguuaguguaauucuuuuuuuuuuuuuuuuuuuuucugagacagagucucacucugucacccaggcuggcaugaucucaacucacugcaaccuccgccuccuggguucaagcgauucuccugccucaggccucccaaguaacugggauuacaggcgcccaccacuacacccagcuaauuuuuuguauuuuuaguagagaugggguuuuaccauguuggccaggcuggucucgaauucaugaccuugugauucaccugccucaagccucccaaggugcugggauuauaggagugagccaccgcgcccggccaaaguuaguguaauucuuugcuauacuuaaauucuucucaaauaccucaucuugcuuccugggauuugaugggcaaccccguucaucccacccugauuuuguagacuuugaugagccuuggugcuuucugcccaagcaaaugacaucauuucauuuucauuuucuuuauuuuucuuuucuuuucuuucuuuuuuuuuuuuuuuuuuuuuuuugagacagggucucacucuguuguccaggcugaaugcaguggcacuaucuuagcucacugcagccuugaccucccaggcuuaagcaauacucccgccucagccuccugaguagcugagccacaggugcauacaacuaugcccagcuaauuuuuuauuuuuguaaagaugagucucgcuauguugcccaggcuggucucacacuccuggacacaagcaauccuccagccucagccucccaaaguguugggauuacaggcaugagccacuaugccuggcccauuauuucauuuuaucuauuaccaccacccccaacugucucuugucccuugcagugacccuucugucccuagcccuguucccaagacaggguucagggggugucucccuccccaagcugcugagaacccacuggacaacuccauucaugacuggccagugccagggcccugaccuggggugagaggugugagauagggcccagcuccagggccacccaggaauagauggggagugagugcagggcugaaugaaugaggagaugagauauuuugguugaggaguaaagacauuuuuaauagugauuuuagaaguagcacauacuaauugcacaaagccuggaugguauggaaaaacuuagaugaaaagaaaauaaaaauugcuugugauugggaaguaaccacugucaccaugccggcagcucuccuuccagucaaguugaucuuugguuuuggaguucucuucguuugccuggagacuaggguccugcugucaguagccccacacucugggcucuggcugggcaggcagccacucuguccgucuauuuaguccacagcugucagggcaccugcccugugccaggauccccagcaaauguccccuugagccagucacuugcccucgcuucaccugcaccucauuuacucugagccucaguuuccuccccaguaaaaagggauuaaaaucccuaccuaccuuggagagugguugggaagcccauauaaccuaagaucuaugaagaccuuuuguuaaaugcuaagcaaauaggaaacagucagauaagaagacaauaugagcuuuguuauccucgaaagaauaaucuaugucaaaguuuugacucagcaguuuguuuaaucgaauuaauuuauuuacauacuaucuguguuccaaaaagaccuguaguagcucacccccuugagagugcucaugccacaguggacagagcaccuggaauggcccaguccugggagucccauuccccaguugugugaccuuggaaaagucacugcccaccccugcuaguuaugguaacaugaaaaauuuggaccagacauccucuaaucaucugggcacagucugcacucagccagcaccugugccacaggcuguagccuccauuuggggagggugccaggcaaagaacgagggaugccgagaggaaggcugugcccuggauggagccaaguggccuucaacugggcccacuguguuuggcacccaggcugcagagugaaaugauuuagagggcaagcucuguacuccgacagaccuggauucaaaucuggcugucauuuacuagcuucauggccuuugacaagcuacuuaaccucucuuugcuucagcuuccuuaucuuuaaaaugguuaucauaguaguucccucacaggguugucggaaggauuaaaugagcucuguaaauaacagcaauggcauguaaugaguucuugauacuugugagcugcuacagaaugggagcugggcagggggcagacggagaaugaggcugaacccucccucuauggggacugacuagcacacggucccuuccuugcucuguuuggucuuauuaaacccacagccaccauauuuuccagccccaaucuaaaaauguggccagagaauggggaagaauacuggaaaucagaauuccuccugaaagcccaggacacaugaccagcagccuccagcccucuuggugcagggaguucaaauguagauguguucuccaggccccagucuuaagcagccucugccaccugcuuuggauggcagcucagcagccccgggguuaaguucugcugcucaccaggaacacaguguucucugucuauugguagaggcaccagagaugggcaggaugguguugcugagaguggaaaaggccugugcgucagagcugaugcuguuagaggcuaacaagcaguggggauagcacaucuuuugcuagccagggauguguggggcuuaccugaugagagacuggguguccuugggugccaggccagucagauggccagucccaaaaccuucugccagagguauggcuuugaaugccacccgggagagucugaguaccuacucggggccauuccugaugcuggagcugcagaaaugcauuagucacggucccugccacaaggugcucuuugacuggcugcugggccugggggcaaaggggcuguuggauaggggaucuucuuugaaauggauggugucuaaucacucacgcgcucuccuucccugcucacuagauuaagaucugcuuuuacauccuagaaaccuagauuaagaucggcuucugcuuccaccucuguuucagcccagcucugccagacagcccuucaacagcugggccuaacaguggucucuuucuuccuccuugccgucccgucugagacuuugcccuuggaaagucccaugccgagcucgcuccccaucuucccgggagaacccucuagguggucagcacugacagcugucuuccuucuuuccuuuuugacucuuccuccuuuacucucuucuucuuuuccuccuccucuccuuccccugcaaagccacccucauccaggcccugggcagagaagguaucaggacacccagucuucagcgaaaguagagccagcugguuuuauuccugcaguaaguguccucaccccagccagcacuuccagcuucuggugcggaaggcuucuucccuuucuuccccuccuucuuucugcccuuccacgccucugggcuuccuccuucccugagcuuauccuccuuggaccuucugauccagggcuucucccaaccuccuuuccucauucccuuccugcccucucuccuugccuucauuccucccuuccuucccuagcugauggaaggaugccacccccuccucuggaaagagcccuugagagccuaugguacgugugguguauuuggagggcuggcuggcugucccccaccaguaaugccacugcccucuccugggcccugcggcucaccucccugcaccccauaaguuucuuugugcuccuucgccauucaucaugacugcugccuuccuucuccuacaggaguucccgcaagccuccuccagccucucugggggguggggguucuccgcaugcuuucaucacaccacuuuguuuuccuucuccucuaacgccuccuuucuccuccccacuucccucuccucugcuuccccgccucccacugccaccucuuccaguagcaggcuuccuuagccuuugccuccuuucccucccccuuccccuccuuugcugccucuguaaccugucuuaccaccagggccugaguauacaaaaaaauaaauaaauaaauaaaaaggucagugaguggagggagcagcaauaaccccuaaaacaguacuaucaguggaacaugauugaucaauugaauuccauagcggcugaaaaaugugggauuaaguaguguauuauacgcacaaugaguugaggcaugauguucauuucaaguucauuucgccggccucugccaccagaucaggcaaucaauaggggcagcagauaucauauaucaccucucugcgggccggggagagagcaccauaaucucucgcaaauuuagagugacagauuugucaagaucugaagggccccugaauaaaugaaggcaaagagacuccuccagccagugaccugaggacaaagcuucaguucagccccuacacacacacacacacacacacacagacacagugagccaagccacacacagacaggcauauacacaaaucuacacagaggcaugaggagaguccugccacacaugcacacacauaaugugugaacacacgcucacaaauacacccucucugccccuacaauaaccauauaugaagauauuugaugcuuuccucagcccugagaguccggcuuccccaaaagguaggagggcuccaggaagggagaaucaaacacaauaggacacgcaaauagcuacagggagugaaaugaggaugauggcacauccugaaaaaagaaguaggcacaggagaaacggggcauguggccucacaguccucaugcaaucacacacagacacacacauucuuucaggaagcuucucauucuauuuccacacacgcagacccuuguuuaucuggacguuuauauauguacaagcgcguagacacgcaauacucacacaaaagggaaaaauaaauuuaccacacuucaacuuucaacucauauguugaugcauacaucccguaagacugaaaugauuccagagccuuaugcagaagaaaccacaaccaccaaguuuuguguucaugggaacaaauaccauugaagcugcuucugucugucuucuucagaugugguccuggucuugaucucugucucucucucccucucuuucucucucuccuucucucucucucucucucuccuucucucucucucucucucucacauacacacacacacacacacacacacacacacacacacacacacacacacacacuuucuuugcuuucccacccccuccagaauagauauggagggaagaugggaggucacauuaggaaagcaaaccccaugcucggucugggaggccagcaagggaggauggcugcagguugaguuaaucaauauguaauauuuucuauggucuccugaaugauacuguaugguguuacuguauauaaugcaauauugauuauaucauaucguauaaucaccuauaaacugauauauauaacauucccagaggaacacccuggggccuccggcaugggcuggccccaggcccaaggcuccucagcuggucuugggcugagggaagccuggagugaccaagcugguaugggguuugggggggaaaccccacuuuggggggcugcaagguguggguucagagagaggccacagagcaggcacauugccuacuguacaccuugaaaacuccaaggaaccgacgcugggaggcaaggauaggggagggcugagaacgccugaggaaaggggacauggagacaggauuggccuguagacucaggggagcaggcaccggugugauaagacucugcucccucuggagacuugcaggaggaaccaggugaccaagaaacuggcuccuguaggaggcuugagccugggucuagguuggagacagaggccgagaaggcggccagggcauagaggcauccacaggggcccuucugugggcucugcccaagcgggagcuuugcugcucuagcgacaccucuuuccucccgcuugguuucccucuggccucaguccuggcccaacccaagcagagugccucagcucugccucagagccccuccucccucagggcgaaguugauuacuucacccagucuccagguuacacucggccucggaaauuugaugguuuucaacccuuggaauuaguggaacugaaauucaucucggagccgaguucaauucuccacaggcucaguaaugccagucugagacacccagcuucuuucuuccccaggcuggcccuggcuugggggcagggggugguucagggagacaugccccagggagcuggcuccugggagcccccuggcuccaccucugccuaauccuuccugaccccacagugugaccgcuccaucucuuaccagguccucagguccuucucuuccuugggcuuccucagccagaucucugaggcagggccacccucuggugucagccccacuggcccaggggcugagaguaaggggucccauaggggugcagagcuccugggcccggaaccagaugcccaccucuuugcccugcacuguuccugugccucugcuggccuggcgcuaacgccccgaguguccauguguucuccagaugugucugagggcucaguccccaauggagauucccagagugguguggacaguuugcggaagcacuugcgagcugacaccuucacccagcagcagcuggaagcuuuggaucgggucuuugagcguccuuccuacccugacgucuuccaggcaucagagcacaucaaaucagaacaggugaggagggagcuuucugcuugcagaaguagaaaggagccggcagagcaaggccucucaaaaacuuguucacuaaacaccacaugcauagccagcauuguauguguuacacacguguguucugugugugugcagugugaacaggcucacaugagacaguaugguaucguuaagacaaaucauuauggucuguauaugguaauuagaaaugaguucugggugcaagaguauggccuuggguaaaucaucucuguucagagccucgguuuccccaucuauagaaugaagggcuuggauguaggguuugucaagucccuucuagcuccgcuuuucugugguucuugcauggaguacucaggaacauccucuugcugugucccuugcccacacccccucaggguccuacagaaagucuacgcuagacuggggagcucuccuugcccagugucaggagagccugccugugccugccuccugcuccccaagccagcaauucaauggaacccuagguaggcuggcagcuucccacuuacacccaacacuuucugcagacacugagcagcccaggacacauagcauggggcacagcauguaacacaccagcaaaacgcacaacgcagaaaccaucuccgaacuuuucuaugugcuggugugcaugugcucacacuccaccauccaccugcuccccucacccacagcccaugguacugugcucacacaccacuguccaccugcucccccacccacagcccacgguacugugcucacacaccaccgcccaccugcucccucacccacagcccacgguacugugcucacacaccaccgcccaccuguucccucacccacagcccacgguacugugcucacacaccacuguccaccugcucccccgaccacagcccacgguacugugcucacacaccaccgcccaccugcucccucacccacagcccacgguacucacagcuagccccggcagccgcauggagccagugggugugugcugcccccagaucaccagcucagcauaccccuagcauaugccuccacccacauacgcuggguggagcccccagcacacccgcucccacacaggggcacacucccaucccugcuacacaugcagcccaggccaggcccacagucacagcacaagacagcauugcugugcuugcaugcaugcacacacgcacccacacaugcacgucagugcagccccacagcguugaacgcuguaguuccacucuuaagacuccaacagcucccagccacucgccuuucuccccgcccguccuuuuaucccauaagcuguuugucuucauaaaacaaaaaucaaaagucuuuuuaaggugcccugagccauaaaccaacaaaggaggagcuggccgaggcgggcggcucagugcacccucccugaguccccgccuguauuacaaugaauaaccuuuauuuacuuucauuagacuauuaaacaccagcacagucauuuuucccccugaaacucggagcagggcccauaaagcaaauccgaagccuaauugaguucauuuuaauuucucuccgaucacagcgaauuacucuggugauaaaucagggggcagcuucacccccaguagaaggccuaauuugcagcuaauuacaaaacugauuucuacaggaagaucaauacgagaaggaauuggaaaugacgaggcaaucccguccagccauggaggggaggggguacucuaggggggccaggaagcggaagggaaaaaaacagacccgaaagagcaggaaaucaguuuuaauuuaacguaauauuaaucagagcaacuuuuccugcuuugugcaggcucccggucugcccagcucuggggucuggcuuggccguggcugcaauaaaaaggcaauuacccgaguguuucaggcaggacacccuuucagagucaaugacuggcccccuccuacccuucuguuagccauguggacucucccccuccccaauuucauaccccagugcacaggcagacagcgaggggcccauggggcugucauuguuuguuuuuaaaaaaggggcgcccauacccgaucagccagcagugccaggcugaaggccccacuaggcccuucucccagcuacuggcucugccagucaugucaugguucccccuccuccccaaggcuccucgacaucccaugccucucaacaaggguauccccacuacuacacccuacccgcaggggugcuuaggcaggagaugcuacagaaacauaaagggugcuggcauuaagugcccaaaauguguaaagggugcugugccuccgguuucaccaagucaggucuacuacccgcacaaaacuugccaucauccaccaagcccccgcaucuccccucugccccaccaucucuuucuaccccaucugggcgggcuccccuguuccuccuccccaucugcacaccgagcccuuucucugugcgugcaucaauagagagcugucacuuuucucucuccucccaggggaacgaguacucccucccagcccugaccccugggcuugaugaagucaagucgagucuaucugcauccaccaacccugagcugggcagcaacgugucaggcacacagacauacccaguugugacugguaagggggcuuccaggagggugggggcacugcguucaguggagggugccucagcccaugccaucugaggcccagugugaggagcaggucccccaccgugauauuuacagagagaacgaggcuucuaaaaccagggugcuuccugaacaggggugugcagauguggggagaaaaaaacuggggucagggcaucugugggcuucaaccuggaaaggcugaugcuaggaggggcuguugccaguucuuccuccuguccuucgccucucccuuugucuauuucucuucccucucccaaguugcccagaaucaugagccucuuguuaggaugucugcagaaagcaaauaagccaggcuggugagaguggagcauggguacccaguguccagccuccacacuugggucuccaaggcuccugggggacccgcuuaccgcucccuccaggcagcaugggugaucauggcuuugggcuugagggcauggcacccagcucuguggaguuugagaugaguacaauuauuccagccuuccuccugcuucccagagaggucagugacaccaaggcuugauuucaaggccagguaggaucaggcuuggcccacaaucaaaugcagagcuaggggcgccauggccaggagccccuacaaaugaagagcagcagggccaguuaguuuggaaggggagguggaguccagggaaggccgcagagcuccaggcuguggaaugcacgugccacugcagaaggguuuccaggccaggagacugcccaaaugggagagacacgcauugagguguuauuaaaauucaccuaauuauucuggagacacuaaagccaaugugccguuuguuccuugggagacaggaugauugagaagggucucgguggggauugggagacacugaggcguuaccugcagagcgaggcaagcggagguggccugcggacccagcagcagggcugcagagccagcggcaaaggcagggaacaggcaccgcccacucuaggacugggcccugguucugccugugagcuggucugagugcggcugcauuugagccugagcugggcucaguggccacccagccuccaccugggggcuuaggagagcccugucaguuuucccagccucucccuaaggggcuguacugguacaacuguuuccagccuagaucuuuggcuagggagucagagguugaauucuagaaguguuggagaccuggacugggcuuucgggagugacgaccuuagcuggguuagcugggccaggacacagcccaugaccaaauggcccucagcaugagccauccuucgcccagcugggaagcucucugaccugcuagguauucugacccaaggcagagagacggcccaggccaggccaccuuucuccugaccugcucagaaguacaguggucacuucccaaagauggccacuccaggcacuguucaaagagaacccgggagacuucucuaaccccaucugcugcccagcgcucaggccauagucuagaaggcaagggcuuccuaggguggagcuauggaucuucaggguagggcuccugccacaggagacccaggggcugguacagagaagugccuccaccuugagcagcccccacccgccucccccccauggcccuggaacagucccagcucagccugggaacaucuccggcugauccaucuggauccaagugugagaaaaguucauuucagacccagcuugacauucccagguggcaaguuagcacuaacaucucaaucuguaugcgacauuucaaucaagcgaggaguaacaaaagcagaaccauuaacauucggagcuguucaccagugguaaugacggggaaacucgcucagaaacuggaaauuaccaaaaagagacaaguguguggagaggugggggagggaagauggggauagggguagggaaugauuuuuccacacuuaggccaagauccacuguuuggauuaauagugccauuacccaagaaagagcugcagauuaugcucauucuuaaaauguuuuugcuggcaauuaaacugcugcaguuauugaucuuuguugauuuuauguccuccuaauuugcauaaucuauuaaagaugaaugauuuaugauguguuuauuauggggacaaacagaauuugcuagagguacugucaaggugagccauggggcauugcucagagacuccauaugccaucucagcaguggguccagcauguuggccuucaggccaggauauuguggguaguagugagcagugaugcaaggagaacagaaacaggagaguggacuuugggugaguucuucuagaaagauacuggcaucugugagaacugggcuccaggcagagcuggagugcgggagaggcccuuaguguauuuguggacacugaccucaaagagucuuuaaaagcuuauuuucuuggcaaauauuaagggcuuuggugggagaagagaaaaggaggcucuuuuagguggguaggugauucuggggaggugugugcuaaagguaagggagcuguuaggucacccagugcccauagccuggcuuaggagugccgagguguucaaggagcccucuuuauccuccacgucucaggcacccugcucaucuucuuccccaggacugacagcugcggcugcaaaccuuaggggaugagggaaugcccuagcccaaccugaaaagccagaccuuauugagauuccugccaccuccuggcccuggaggcugauuucaaacuucaccagccacuugaugcagcuauuccacaaggucaggacugagaggagagaggaaccuagacuauuguguggaggggagaguggggcccagugggccaggacacagcuaaucacauugcaagcaaggguggcugccggaggcuagggcucagccccauagccuccccuccccaccuuccaucagggaaccgaggagagagacugauuuugcuggguaguguuugcaaguucugccgagauuuuaauuucacugcaucacaacucagcaagcugccaagucaagcugguuauuuaaauuuaucacccacuuucccuuccgccgcugggcugcucuagcucagcggcaucucuucucuccagcccacggcucuaggcugcuggucuggaacggagccucgucucuccuaagugauaaagaaagagggaccagcuacaugagagaaugggucacgggcauucuggccccaggcuuuuucagguuggcuggcuguggcugguaccucucaucaccuucuugacccuccaaaggagcccagaggggcugccauccaccucucaguagucccagggcccuccgggucagggcaucugcagugaggacucgcuccaacugcaugcaggaggcuucauuccuuaaagucucccaucccuggaagaaaagauagucccuguucuccauagcauucucaccuugacccccccuccccaugucuggccggggcuccagugacaaaggagcaugcagagacacuggcagugauguugaucugggaggagaagaugagaacuuacuccaggauucccaaagucacuggggauguuucugagcauuagagagucccuugacacagugcaaguccaccccgaaggagagagcccagaugcaaggaacagugcuggagaagucagagacugugcaguuccaugcucucuagaaaaggguuggccaaucuuuuggcuucccugggccacuuuggaaggagaagaaauuacuuaagucacacauaaaauacacuaacacuaagauagcugaugagcuaaaaacaaaaacaaaaauaaaauaccucauaauguuugaugaaaguuuacgaauuugcacuggaccacauucaaagcuguccugagcagcacguggccugugggcuguggauuggacaggcucgcucuagaagcuagggaaagcaccagucccuggagccacugcacccacaggcuucacuggccucuagugggcauugcugccgcgcacuggcagagccuugagcaagugcagcucucaccgcccuuguuuuagucacagagagguaaaggaggaaugagauugaugucugggacccaggcaggcuaccucaccaaaacauaacugaauaaaauauaacaacaaaaauguuaauacgcagcaaaucucacucuuuggugccagaaauagaggggaacucaaagccagaucaguauuggagaggccgcuggcaucacacuggagggagaugcugacugggagaggaugggguuguaacacaccagucagggaaugugacuuugggaaucaggaagccagaacugaguaucauccugcauaaagcaaggaacagaacagggaccacacuguccgugaaaggcaaacacauacacucgucugaguagcccagggaaacaaggaagggggcagaauggaaggucaccaugagacauggagacgccaagccugaugccagaucagaguccaaauuuauaccaugaguauguugcaggaaacccaagccaggaacuuacauaaaaauuuguacaggauaguaacccauucugaaaccucaccaggagcaaugacaaaccuucuuuguagagacauucuaaaauccagggcacaugggacucccacagggggaagaaaaaaccccaccacuaaugaugagcuuacuguaaaaaaaaguacacaucucaugugaauacaaacuuucaaaagggaaaguuaguagaagcaauaaacagaacaguuaacauccccccaagaccugggaacaauagaauaauccaaaagugcuauaaacucagcauguuuaauauucuaaaaaagaucaaaggggccgggcgcgguggcucacgccuguaaucccagcacuuugggaggccgaggcaggcggaucacgaggucaggagaucaagaccauccuggcuaacauggugaaaccccgucuccacuaaaaaaauauacaaaaaauuagccgggcgugguggcaggcgccuguagucccagcuacuucggaggcugaggcaggaauaucacuugaacccagaaggcagagcuugcagugagcugagaucgugccacugcacucuagccugggcgacacagcgagacuccaucucaaaaaaaaaaaaaaaaaaaaaaagaucaaaggaaguaucagcuguaucuuuaccacagauccagaucccccagucccuucccaccacugcucaccaaauugucagauaauggagaucaaaaagggcaaagaaugaggaccauaccuauagauuauugcuuugggguccaggaggcauggaaagagcugagccucaggcaacucugaaaguagagccuguuccaggcuuguccaggcucccagacugcuaagccucagcagaaaaucuuauauuuucuuugagaaaaugucugaacauuagagagcuagagaugggcacaguaccuuucuccccaguggggugggggcaggugggaagccuccguagcuuccccauccugguugggggaaggugguuuuauucaagagcuugggagaaaugucucuuaauugcugaagacugcaguuuugaaggaagcuguaauuaagauccaggaagagauguggaugcugcccaagagggaagugcccaaggcaggaagagggagcagaagaggcuggucucccagaagcuggcugauuugagcagagguaggggaggccagagaggcaaaguucacagcuggacagcagcagggaccagugugagcaguguggauguagcuucugaaaaggguugccaacucagaagcucggccuccuggcccacaucugagauggucagcaaaguggccuuuuagcagauagagguguggacccugggaaaccuccuccuccuacucagggcauccugaggaccuccaggaacugccucuuuccuguaguuaacaacccccuuccaaugcaacugcauuucccuccauaaaacaaacagcuuagcccuuggccagcccccgggggaggagagggcaauaaagacugagaaauguuucucaaggaggcugggagucuccuagucuugucugucagcucaaagccccugauuagcuagaggaauuuagggcacagacaucauaguuccucuccuugaaaggagagggcuaagacaacuucagacguguggcaagucagagaucccuuuacuguggaggccaaagcaagccagagggcuguuccucagugcucacaugcccuagacccuuccuuuaggcugugagggucccaagaaaagaggcuagccuccuucaaacaucccugagucugcuggccacauccccaaggaccuccagcccccaaccucagcucugauuuaauuaugggggcauuuccauagcaaugagacauugacagauaugcggcugcucucggccugcagccuagggagucauuggaucaggccucuuucccuuccuccuuuauccaguccacugauagagguaaaggauauggaaaagaagaggcccuaauccacugucgggaucagagucaggccauauuugaccagaauaaaagcugugccaccucaaucucaggucccaaucccauguccuugucugugccuaccggccacccugugcugcugggcugcccuucccaggagggugccauggcagaaguacccuggcugagaauggggcugcagagggaggagcaucguagggagggugacaaagguaggaaggguuuggggugucuuagcaaagacguaguucugguguuuucuacgcugagcucaaauuuggcccuuaaccuugggccuuucuucuuaccuccucccuucaucucuucccucuguccgugaggcccaaaaaccugaacaugccaaauggagugcuuauuccuccaaggauggccucacuuguucaucagagaucagagagagagagaaaggggccagucugaauuugaaucaaaauauuuucuaagaaaucaaugaucuugcuaucaagugcauaacaauagccaacucaggccaauaaaggauugcccaguugagaauacuggccacugcuuucaugauucgucagguuacgggacccuuuugguuucuguagaugucauuuagauacuugaugugucccacaggggaauucuccaaaaaagagaucucccagcacuaagcuuuuuaguccguuauuugguacuuuuuaagaagaaaauguuggcuaaguaaaaguaaggucagucaacccaacauuuuuugaaugaccggaaauccuaaagacugcugucccaaugaaacagguauguauugguaccaagggcucagaaaugucucaguggccucaaagccaccuaggcaagaccugaaaaccuguuucccccagagggccggccaccuccaaggugacaggaagaccccccacuuuuuucccaggguagccagaaucccuuccaccuccacaauuagcuguagccucaggacaaacaagcuagugcuuuugcaacccugagcuuugggagacaagcuccgccacuauugucacuucugagagggcuuugcaugccuucagccugaauccuccccucuucuccccaguggugguggcggcugggcuggcaggcagggaaggaggaaauccugcagggcucggagaacagccuaaugcugcagaggcuuaaguggccguuuuccuugggauuaggguuucacuuacacagagcgccugaaaaacacugcgcuuuuggaaggauuagagcugacaauucagugcucucagagaacaaaauaaagccagagaggaacugggaggccuggaguaucagaagacucugcaaacaggcuuaaccucugcccacccagcaugagggucucucaugcucugagcccaucuuugagccugggcccaaccucuugagugccaguaccugcccaacuccaaucuucauuugugauuugcucauggagccagagaaggcaacacagggacguugccuucuggaaagaggacugggaaguugccaacugggaagaggacuggaaaugucuuccccucucucugagccucaguuuccuccuccguaaaacaagggaguuggacuagaagauauccaaguuccuucucagcccuuugaaaaugugauucuccccaacauucccugguguuauccuaggaugcugaagcugcauuuccauccaugguccagcugaauuagaaggaaaccaccuccugugaggcccugagccaacaggcuacacagcccagaggagggcggggugcugggagaagggauggaaacagcaugacugguuguguccggccgguuggcugucaagguguagaccucacuaagccccugcagaucuggguaacaucccugccuaggacacaccagggauucaagguggcagugggagcugagaucaacuggaagagcagccacccugaguuggaggcacagcccccucugcuggaaccuggagcaggcaagccucaggugggguauggggcugaggccagagccuggggcugugggcugucccauagucccuucugcccuagaggacaacucaaauccugggaggauuuggaagcuugggaaauaagaaaugaaaggaaauauguagauaguuauuuuccucuccuuuuaaaacaucuuguguggauuuaaaguuuguuacuuuaguguaauagauauacguugaauuggucauaaggugcucguaauuguuauaguaaauaccaauuaugcauuuauauauuuaggcagcaauuacaaauuuaauaacuguguauuuuuguaaguauuauaaaugccuaugucaaaugcaggcauagacugccagccuugaagaaaucuaaugucuucauuuucgcuaccuuaugagaagcagacagaacuugaggauagggcaguaaaacaagaguuauguuuucuggccuuaggguccuccgcagugucaaguggguagcaaaagugcucauuuucagagaaagaugcugaggaaaagcaucucugaacuccucgauagaacuuuugcuauauaaaucuaugucuaauaagucucaucugagccaucaugagcagcaguuucugcuucuuucguggcuuccuuuuuauuuccuugaucuucugaaugcugacauuuuccuugacuugagaugcaacucccugcuacuucacauguuauuuugcugugcuuuguaucauccuguuuauugauacaauucaaguaguugcaaacaaaucagugucuuaugccaaagaacggggcucuuucacuuuuuuauaaacagugcuuauuaaucuuuaagccauauuuuuugagaauaugauaaaagucauguaccaucuacacagaaagauacagauauacaauguccauaacauuuuauguauagauuuauauagaccccuugaagugaucuauggguucuugagggaucaguuaaccccaauuuaaaacccccacuguaaaaaaguggaagaaacugaaacacauaagaaacaagaagugacaagauguucuguuauaggaaggauucacuuagcaugaucccauauuacuuuccuggaccaaacaccuaucuauuuucugggucugcacuauuugagaacaauaucauuccaggaucauuucccaaguauacagccuguucuguaauccaguuucugccaucuacuagcagugaaaucucagacguaauauuuggccccucugaguuuauuucucaucuauagaauggggauuaaaggccgggcgucguggcucacccuguuaucccagcacuuugggaggccgagguggguggaucaccucaggucaggaguucgagaccagccuggucaacauggcaaaacccugucucuacuaaaaaauacaaaaguuagcugggugcaguggcaggcgcuuguaaucccagcuacucgugaggcugaggcaggagaaucacuugaaccugggaggcagagguugcagugaguggagauugcaccacugcacuccagccugggagacagagcaagacucugucucaaaaaaaaaaaaggggggggaguuuaaaaacauaucaauggcuggucccaguggcucacgccuguaaucccagcacuuugggaggcuaagacaggcagagcaccugaggucaggaguuggagaccagccuggccaacauagugaaaccccgucucuacuaaaaaauauaaaaauuagccaggcauggugacaggugccuguaaucccugcuacuugggaggcugaggcaagauaaucacuugaacccaggaagcagagguugcagugagccgagaucgugccacugcucuccagccugggugacgagagcgagacuccgucuuaauaaaaauaaaaauaaaaauaaaaacaucaacaucauaggguugauaugaagauuaaaugagauaauacaucauauaaaauguuaaggacaccgcccagcauauagaaggugcucaaugaaugcuagguaguccuggcccaaguagaaacacagcucugaccuugaaucuuagaccugauggugaaaguagcacaaauuaccugaugacuacaauuuuucaacuuucuuaauaaagucuuucacuuugcuuuucucuguacuuguaaggggagcugcacuuagauucuccaaagcaguugauuugaucuggcccauuugguaaggaaugucugacgaaagugcacugucugaugcaguuguagugauugcuguagaaauuggcuuuagaaucuucagggacuucugcaguugaacugagaagacauccucaucaaguacagugcuuugaacacuucuggggacuuuaagauucuccacuaccacuguuucuugaagacccucuuuguuuuucagaaaacucucacaggagauuaauacuccaccccauggaguuuuauuauagacuuuuggcaucgggauuuuauucucugaguccuuuuuauccacagccaugacgauaugagacuuuguuugucagaugacuucuuuuccuuuucuuuggcucuuuuggggaguaucuggcuucguguuauuaaaaggcagugugguauaaacauggcuucaaauuuuggcuguaucauuuacuagcuguguagucaugggaaaacugugaugcaucuuugugccuucauugucucacccuugaaacaaggaaguuaccucaucaucuggaaggcuauucaucuuuaaaaacuuuguaaccuuggccaggcgcgguggcuuaugccuguaaucccagcacuuuuggaggccaaggcaggcagaucacuugaggucaggaguuugagaccagccuggccaacauggugaaacccugucucuacuaaaaauacaaaaauuagacgggcaugguggcacacaacuauagucccagcuacaggcuaaggcaugagaaucacuugaacccaggaggcggagguugcagugagccgagaucgcaccacugcauuccagccugggcgauagagcgagacuucaucucaaaaaacgaaaaacaaaaaacaacuuuguaaccuuggaaagcaaguguccaacaugaaaugcccaucuucuuguaauaauaugugggguuuuguccauuuguaauuucugaugcuguuuuuauguuacuggccauugucauugagcaacaaaaauccucuacugcuuucuguuggguggcacauauuuuauaacugauguauucugccacauaacuguuuucuccuuuuucugugcuuuugcuuguuuguauaaaggaggugcugugcuguuguacaguuuuagagucugucugcacucauguuuuuccauccaucuauaguacagcaaggcccagugcucugucgauucuugcuugcacagauuccauuacccauucauauucuuucacuaaaagaggcuugcucaaagaaugcugcugggcaaaugguaugacagucuuaguaauuugaaaacuuccugcaguauguguuuuccauuauugacaaugguguuccagaagaauauauggcaagaguuuggucaauuuuuucugcucuuuaagugucaccugugugcuaaugaagcaauugagagugcuuuguaugcaguggccagcaccuuugcuggcucagggguccugaacaggguacuccuuuguggagauacugguguuauagacuccgcagcagcaggugcacagcuguaugcagaacacgaggaagcuugcgugcuuuuuccuugucuugggacucuucuuucacguuuuaaaaauuucuacauggcacugcccaacuucaguuuucuaaauagaauuuggcaaugugccuuucaaucagcuguucagugggugacuuucagcaugcaaaaguuccuaccugagggaaguugccauuuugcaagacagaaaggcaguagaaauaaaacuuuccaauaggacugcauccagguuagcuggaaacaucuuucuaguuauccagccugucuuccuuccuccugaagugagguaggagauuccgugacaaaaccuuagauuauaaggaauucauggugacagauugugggaaucauaaaacugaaaaccagaauucagaugcauuuaaauuccuguuuauuaagaaagaggcacaccccuuuuccugcugcuuugcagacuuuaugaugacagggaaggaggaauuagguuucuauaucuguucagcuucaaaacuucugcgucuucccuaacucgauccuguccugggccuuucucuuuuuuuugaccaauaaaugccauauuauuaaucucucuaggaauugauuuugauauugcugucauugucuacuucagguccacuccacugagagacagucaggaggaguguagcuuucaaugacaacagaagucaauaaaagaaaacccacaucaaagcaaacacaaauccuuuauucugucucucuaggagucaaaagugaucucuuguuuggcaguucuacucugcuuguucucgaguuuuaggaaaugaaagauauuggcuauauuagacagguauagaggaaagucauucuauugcauaauaaagucacaauauaugagucccucacuguaaaccucuuaucagccuauaaaaaaucauaaucuauuguuuaaauuguuuuuuaaagaaaaagcauauucuaauauuuacauuuuauccaagccuuuacuucuuuaaugagaccaauauacaugaaacaauaaaaaaaaugauaacccaucaggaauuggcuguuaagugcaauagauugauggacgauuaaucaacaaguguuuauugagcaucuaccacguucucaacuaugcaggauaaagcagaagacaggguccugcccucagguugcuuaugaucuguuugaagaagcaagcuaugauaugaaacaucagggcucauauauuaugaaauauaauggcaugguaaaccaugcagcacagaugcuguagaaguuuggaagagagaaacuucccugauggguagaaugguagggauuuuaaggcuucaguggggaaggagaggaaaaccguaaggaagaagaaaaggucauggcaaaagcauaggggguucacaucacacaagccaugaaaacagucaaacuaaaccaggagaggugauaaucuuaaguuggauggagagaguaccuuagcagcuuuaaaagccacagaguuucauuucaaacuauagacuacagggaaucaguaauaguuuuuacaagggaaguggugugaugaaagcaaaguuucaugaggacuagccaagcagccacauuuaggacagacaggaggggaagaauguggagucagggaaugcaagcaaaaauauucuguggcaaaaagaaggugcuuagaagcugagcuaggaagguaguggaagaaauggaaauugagcagauguaacagacauugccaaggagaauugacaauacuuggugacugacuucaucuagaaugggaggaagaaggcuaugucaagaaggacuccaaaguuuuuggucuuaugauauucaagaucauaagaaccgacagagggaagaugaaucuguuuuuauuccaguuagguuugagguaacagagggacagccaaggaaaauguucagcaggguacuagaaaugcaaaaaccugagcuguagcucuguauagcuagggaaggauaaaucacucagacgugucaagguagggaugaggaaacucauacagcucuggaaugcagggaggugaggccaucuucaaagggagaguagcaaagagagagagagaugcuuuggaauagccauugggagaauaaugacuauggcccagcugaugaaaagaaagugaacgggcccagguaugcauaguucuguuacuuucuccagccaugccuugccuucccaaggauagacagaggcauuagaguaauagaguggcauuggcuagugaggagaauaaggggaaucuggagggguuaaggggguuccaggagguccaggagaggauaaagagauuauggcagaggggagaaagcaaauuauuauuagagaucagagcaugcuaaauugcaaagggaggugguggccccuucauagccauggaggaugcaggcaagguagggagcccagucaugugcagcugugucccagaggacaugucgguggaccagggguagcacccucaucuugacucgcuuugucucccacccuccaggcuuuagcugauagagcccuccagggacagaaguccagcagcuggugggggagcagauuuugcucauuggaacuuuaucugguccacuugcacuuuuggcucaaagcuccugauucacuucagggugguuuucuaucauguaaaugccauaaacacuaacagcaaaauagcccacuggcugccccccugcucuccacaccugccaggaccaggaccugcagcuccacuuggagaggacaaggaauagccaucagucccuguaggggugauggugggguguccuccaagccugaaggaaagaugggguguuagggagaggaaagauaagcaagaugauagagguccauuuggcugcuggagagaccacagcugaauaucuugcugagaaggaggaguaaaaccaggucaucucccucccaucuccaucuggguuuggaaugcacagagacacaggcaaaggcagauacacacacacacacacacacacacacacacacacacacacacaaauacacagagacacaaagagcuacacaaaacagagaugcguacacacagcugaucauagacauuuagcuuagacacaugcaaaggcacacucagauggcgcauucaggugcacaguggcacacauaccccugcacgucugcacagagcucuuuccucuccaagaguuuccucuccgugcaguacccuggugugaguagaggcaggccccuuucuuccaggccucaccccuuccccuuuguguuuuuccaggucgugacauggcgagcaccacucugccugguuaccccccucacgugccccccacuggccagggaagcuaccccaccuccacccuggcaggaauggugccugguaggugacaaugcugcagcugccuaaucuagguggggggaacuaaauugugggugagcugcugaauggucuguagucugaggcugggguggggggagacacaacguccccucccugcaaaccacugcuauucugucccucucucuccuuagaggcugcaguuggucccucauccucccucaugagcaagccggggaggaagcuugcagaagugcccccuugugugcaacccacuguaugucauggccccuccacagcgcccacccacccaagucugugcccgaggagcacucagccucagcuccacccucagugcccagcccaccccagccagcugacacugcuuggaagagccugcccugguuuccauggaaacuuggagccaagaaccauuuccaggggcaugucagucacucagacaaagccacccugguccacaccaagacacaagggaagaccaauguugagaaccaaccccaaccccaacccagagacaguagggagcuagucccuaagaggaauggaggucaggcugcggcgggaagcagggagagucgcugcagugagacaggcuagaacaccccuauaccucuucagaggcacccagccuuccauugcuucccuggggcucugacccaucccuaaucagaggaguuggguuuggguuguuugaaucagagagacagaggcuguauuuaaggucuggugacugcagcuggagguuguacuauaccuaaccccuaaccccagauugggagcagggucuugaagccaaagagaguugaaguuccuaugugcacaaacaccaaaacacucuugucuuaaggaggguuagacucacucagccagcaacucacucccucuggccgcccucuauguggccuuucccugaaguucaacucucauugguauggggaauggggaggauagaagagagugguuggccccauccauccagggacauuuagguauaacccuggguaagcagagcuugggguaggggcagcggcaaagagggagauugcugcugggucuuauggacuaggggcugaagggaguuagagguguggguaaagggauuccugcccagauuuaggggaaggaaaguagaagccuuguugggaggcaaggagauuuuagggagaaacucccagcagugagcaggugggggcuggaggagguuuuaaagagguggggugagggaagaguggggaggugggggcagggagucugcagggagguggggaagaggggagccgcagagagcucguggugucgaggggggagucguuaaacagaaucuagugcugaugaggaaauuacacuuguuucauuagcgauggggaaggagauagcucaguuccucuuggucacaguugagcucagaagcucauuauccugcugcacgcaugcuuucccuccucgucaauaaacaggcuuuccaguggcugcaucccccacccccaccccagcucccucucagagaggggccccuucuccucuacuuaacccgcgguuagggaucacuguaaacagucuggggucaucacacaggagaaagggcgagggggaaaccuggaggccuggccuuucucccgcagagggagggagguagcuuccgacgacggcucccaacccacgggcccuccgcucaccgcuagcggaccagcgggcaguccaccugcgccgccuccauccccugccgcguagcccacgcauccaaccucuugagggaaaggcgggagggcggugucucccaaaagagcucccaccucuuguguuggcacugcacauugaugccauucuuaggacuuucugggagaaaaaugucccgaaggccuuucuucgccaccgccccccacucccauuuccacccauuaggggccaugccuccuagaaccggaguggcaucuauaaaggcccuggcccccagcgcgacaggguggacgcgccccaauacaaacccuucguggguggccgcgagcgccuccgcugggaagcccugggcgggcaccggcccacaggucccgcccgugggugugcgagcgcgucggugccucccgccuccccgggcucucuccacgcggacgcggugaucgccccaccuccgcccggcccgcccgccacggccauuacccugcccgcgacaccugcgccugagacccggcgggaggagcgggcggagaagccaccggccggacucgugggguccgcccuggcuugcaggcgucugauccccacuccccgacccucccgcagggagcgaguucuccggcaacccguacagccacccccaguacacggccuacaacgaggcuuggagauucagcaaccccgccuuacuaagugaguacgccaccuggcuggccggcggcucagcgcggccgcgcggcuucugggcacggucccacucccggcgacccgaccucuggggacccggccgggccagggggacaggcuuguuagugcagcacugaggcccggggaccccucgaggacgcccgcaccuccugcccucccgugcccucccuggucgcucgaaggcucugcgccgcccucgcccucggauccccuggagggugcgcagccgggcgucaccagaucgggucccucucaugccccgugaacgcaacuauucuccggggcaacuggcuccacugcccagccaaggucucccaguccggaucccgcuggaccccagccaggggaggucuuuucugugcuuuucuuuccuuuuuuguucuccuguuuguccucucacccagcccauucuucuccuguguuaacuuccagguuccccuuauuauuauagugccgccccccggggcuccgccccugccgcugcugccgcugccuaugaccgccacuag

SEQ ID NO: 21323 - RNA, 7028 nt, Homo sapiens
ggccucccgccccucccgucgcgagggcggggccaguggcgucauuuccaggcccgcccccuccggccccgccuccccuugguauuuucgggacuuuccuaagcugcucuaacuuuccugccccuuccccggccaagcccaacuccggaucucgcucuccaccggaucucacccgccacacccggacaggcggcuggaggaggucggacccucccccaaaucugggcccccaucucccgcccacccccauuuagaucugacccccucccccacgccacuccucccaacuuuaggcgggcgucuaaaauucugggaagcagaaccuggccggagccacuagacagagccgggccuagcccagagacauggagaguugcuacaacccagugagucaugccgccugccccugacccggccggcugccccucgugucuguccaccugucugcccgagcccccucugcugccuuacaccuguaugcucgcagaugcucucagccugccagucuguccaucugucugcaacucugccuccaaaaggagcuuucucuugggucugaggaggaggggggagugaccacugaagacuuggagaugggagguggggcuguggggggugcugagagucggaugccacccccagucugucuccaaaccagggucuggaugguauuauugaauaugaugauuucaaauugaacuccuccauuguggaacccaaggagccagccccagaaacaggucagcaaguucacuaaccuccccuaguccuaaagcgggggagggagagcaugugcccucucucugggggaggggcugggagaucguggcucagcaaggucucucuguccccagcugauggccccuaccuggugaucguggaacagccuaagcaggugagugagcaaaagggaggguguggaauggcuucagcuuuggggacaaaugggguagugguagcuggcuggccauggaggagccauugccgaaggaggccacaggggauuggauggucacugcugcugaucagagugcuguaguuugguucagggcuacuaccaggcacugcggucacugcuggccuggguggucuucccugaucacaaugcuacuaugcccuuggaccuucagagaggcuuccgauuucgauauggcugugaaggccccucccauggaggacugcccggugccuccagugagaagggccgaaagaccuaucccacugucaaggugagccaggauggugcuggagggugggcuaaguggacagcaugcccaaggcccugacugacagucccugccucuccuagaucuguaacuacgagggaccagccaagaucgagguggaccugguaacacacagugacccaccucgugcucaugcccacagucuggugggcaagcaaugcucggagcuggggaucugcgccguuucuguggggcccaaggacaugacugcccaguaggugcccucuacgccuggcccccacugguaugcccgucugccagucccaggccccagcccaccuccaugagcuuagcaucugaccaaggggaaagauguagguuggccccaaacccaagggccuaaguagaaacuccaauggcuuccuugaggaaguaaggcugagcugagcccuggcaaugggaaaggugccucaggaagaaagaacugcauggccaaaggccuccgauucucucuucucagauuuaacaaccuggguguccugcaugugacuaagaagaacaugauggggacuaugauacaaaaacuucagaggcagcggcuccgcucuaggccccagggccuuacggguaugggugcagggggugggucggguaugggugcagggggugggugggucaugggaggugcucauggaaggagcagggagggagaagcccaggggucacacauguaccuacugcccagaggccgagcagcgggagcuggagcaagaggccaaagaacugaagaaggugauggaucugaguauagugcggcugcgcuucucugccuuccuuagagccagugauggcuccuucucccugccccugaagccagucaucucccagcccauccaugacagcagugaguauccugauugccuggggugccaggccugguggcagagguggcaugaggggugaccucaagcugugcagucaaacagacccagguuucagaaccuggcccugccacauaugagcugagugauccugagcaagucauuucccccccgaagcuucugucuuuaguaaauguguauauuggguguuuccugcagcuccagggguugcugagauaaggaauacaaagcccccagcuucuuaaauguggccuuggcuauugcaucaucucaacuaauccauaucccacuccauagaaucuccgggggcaucaaaccugaagauuucucgaauggacaagacagcaggcucugugcgggguggagaugaaguuuaucugcuuugugacaaggugcagaaaggugagacuggagcccacuuugggcaccaaggacaucgaguauaagacuggggccagggaagcucuaggguaaauggccccagagauuccaccgggagcuguggccaagcuuccguuuuccuuguagaugacauugagguucgguucuaugaggaugaugagaauggauggcaggccuuuggggacuucucucccacagaugugcauaaacagguacccagggcuagggcccgggcccgggcugggggcuaaauuaggcuaaggacucacugacacccugugucucccugcaccccccaguaugccauuguguuccggacaccccccuaucacaagaugaagauugagcggccuguaacaguguuucugcaacugaaacgcaagcgaggaggggacgugucugauuccaaacaguucaccuauuacccucugguggaagguggagcugggcugaggaccucagggugcuggcggggggccaggcugggcuagaagaaggucccaagagcuagauguggggaugcaugagccaagucagaagugcgagggucccaggaggugcuuccuaggagccggcccugagggcucuucugggaagggccccugaggcaugacacaauaacugggcucaaucucauuuuccucugcccccagacaaggaagaggugcagcggaagcggaggaaggccuugcccaccuucucccagcccuucggggguggcucccacauggguggaggcucugggggugcagccgggggcuacggaggagcuggaggaggugaggggguacugauggagggagggguaaagguaagagaagcuguggaggaaaaaaaucugggggaggccgggcgugguggcucacgccuguaauccagcccuuugggaggccaaggcaggcagauuaccugagaucaggaguucaagaccagcuuggccaacagcgugaaaccucgucucuacuaaaaauacaaacauuagcugggcaugguggcaggcgccuguaaucccagcuacucgggaggcugaggcaggagaaucgcuugaacccugggagacaagagguugcaguaagcugagaucacaccacugcacuccaggcugggcaauaagagcgaaacuccgucucaaaaaaaaaaaaaaaaaaucugggagagucauggcuggugcccgcuucccacagcccugccuguauccacagguggcagccucgguuucuuccccuccucccuggccuacagccccuaccaguccggcgcgggccccaugggcugcuacccgggaggcgggggcggggcgcagauggccgccacggugcccagcagggacuccggggaggaagccgcggagccaagcgcccccuccaggaccccccagugcgagccgcaggccccggagaugcugcagcgagguauggacuccggggcacgggcggucggggcgccggggcugaggaccuagcccugacccacgcccucuguggcccguagcucgagaguacaacgcgcgccuguucggccuggcgcagcgcagcgcccgagcccuacucgacuacggcgucaccgcggacgcgcgcgcgcugcuggcgggacagcgccaccugcugacggcgcaggacgagaacggagacacguaggcaacagagggccuggcggacgaggcgcggggugggggcaggaaagggaccggcacggaggcgggcucugcaguuuucggacacgccaggcuucaaguccggccucgguguucacaagcucuguucaagcugcuuggucucuccaaacuucaguuuggucgaccgugcaagggguacagucauagcacuuaccuaccucaaaaggugcugcgaaacguuaagugcaggcacagcgaugcccugggccacgugcuggguuccaugggccccagcgagggagacuaugagggcgguggggccuugaaagcgaaggaugcucugaguggcugggccagacucucgcuccccaacccccagaccacugcaccuagccaucauccacgggcagaccagugucauugagcagauagucuaugucauccaccacgcccaggaccucggcguugucaaccucaccaaccaccugcaccaggugcgggggcgccuacuggggaggugggagggguuggaaggcaagugggucucgggccuggcucacccugcuuucauccccagacgccccugcaccuggcggugaucacggggcagacgaguguggugagcuuucugcugcggguaggugcagacccagcucugcuggaucggcauggagacucagccaugcaucuggcgcugcgggcaggcgcuggugcuccugagcugcugcgugcacugcuucagaguggagcuccugcugugccccagcuguugcauaugccugacuuugagggugagcuccccaucucaccugacuaagggggcaggcggggaccagggaggguaucuggccagugcccagaauggacuaugaggugucgagauugaauggucagggcugguccaggggcugccuuaagggucacagcugcagguugagcauccugcauccuuaggacuguauccaguacaccuggcaguccgagcccgaagcccugagugccuggaucugcugguggacaguggggcugaaguggaggccacagagcggcaggggggacgaacagccuugcaucuagccacagagauggaggagcugggguuggucacccaucuggucaccaaggugggacugaggauuguggaaggaguggggccaagggugguggaggggccaaagauggugaaggggggggcuggccaaggggaccaugcuguggugucaacucucgcugcucgcacccccagcuccgggccaacgugaacgcucgcaccuuugcgggaaacacaccccugcaccuggcagcuggacugggguacccgacccucacccgccuccuucugaaggcuggucagucucacccucaggggcacuugaacaggguggggggaagggagagaggugccucccagucccccgacuuugcaguccuuaauguaggcccccaccauaccgccccaugacggccucccucucccaggugcugacauccaugcugaaaacgaggagccccugugcccacugccuucacccccuaccucugauagcgacucggacucugaagggccugagaaggacacccgaagcagcuuccggggccacacgccucuugaccucacuugcagcaccaaggugaggccagcccgggacuagaagugcucugagugacgggguccagaguaucuggacuuaaagacacaggcuuaaggacgaggugggagguagucagaacugcggcugucuccccaggugaagaccuugcugcuaaaugcugcucagaacaccauggagccaccccugaccccgcccagcccagcaggugagaagcaucaggcauccccagcccgacuccucugacuccucacagaggucucuucuccuucaggaccucugaaggaggccucccuuucucuacccucagccccguccaucaccccucaugguccugucugucgcuuaccuugggagaaaggcaguguucagguguccauguccccacccaacucuggagguaaaugacaugucuguaugugugucccccuaagggccgggacugucacuuggugauacagcucugcagaaccuggagcagcugcuagacgggccagaagcccagggcagcugggcagagcuggcagagcgucuggggcugcgcagccugguagacacguaccgacagacaaccucacccaguggcagccuccugcgcagcuacgagguggguuggccugugcccugcccccuccccagccuccuuucccgaucugaguccaggugccuccuuggccccagggcucccgagcacaugcccuaaccaugacucagaccucauuccucugucuucucagcuggcuggcggggaccuggcaggucuacuggaggcccugucugacaugggccuagaggagggagugaggcugcugagggguccagaaacccgagacaagcugcccagcacagguaaaggggccucccuggaagguggaucuggaccuggagggccggaggccugaggcuuugacuaucccauuccuguccccauuuacccccagcagaggugaaggaagacagugcguacgggagccagucaguggagcaggaggcagagaagcugggcccacccccugagccaccaggagggcucugccacgggcacccccagccucaggugcacugaccugcugccugcccccagcccccuucccggacccccuguacagcguccccaccuauuucaaaucuuauuuaacaccccacacccaccccucaguugggacaaauaaaggauucucaugggaaggggaggaccccuccuucccaacuuauggcagccccugaugugacucuugucccuggaaccagcuacccacccugcccacaugccaggcauggugagaagagaaggaggaggcccagccagcaa

SEQ ID NO: 21324 - RNA, 7028 nt, Homo sapiens
uugcuggcugggccuccuccuucucuucucaccaugccuggcaugugggcaggguggguagcugguuccagggacaagagucacaucaggggcugccauaaguugggaaggagggguccuccccuucccaugagaauccuuuauuugucccaacugaggggugggugugggguguuaaauaagauuugaaauagguggggacgcuguacaggggguccgggaagggggcugggggcaggcagcaggucagugcaccugaggcugggggugcccguggcagagcccuccugguggcucagggggugggcccagcuucucugccuccugcuccacugacuggcucccguacgcacugucuuccuucaccucugcuggggguaaauggggacaggaaugggauagucaaagccucaggccuccggcccuccagguccagauccaccuuccagggaggccccuuuaccugugcugggcagcuugucucggguuucuggaccccucagcagccucacucccuccucuaggcccaugucagacagggccuccaguagaccugccagguccccgccagccagcugagaagacagaggaaugaggucugagucaugguuagggcaugugcucgggagcccuggggccaaggaggcaccuggacucagaucgggaaaggaggcuggggagggggcagggcacaggccaacccaccucguagcugcgcaggaggcugccacugggugagguugucugucgguacgugucuaccaggcugcgcagccccagacgcucugccagcucugcccagcugcccugggcuucuggcccgucuagcagcugcuccagguucugcagagcuguaucaccaagugacagucccggcccuuagggggacacacauacagacaugucauuuaccuccagaguuggguggggacauggacaccugaacacugccuuucucccaagguaagcgacagacaggaccaugaggggugauggacggggcugaggguagagaaagggaggccuccuucagagguccugaaggagaagagaccucugugaggagucagaggagucgggcuggggaugccugaugcuucucaccugcugggcugggcggggucagggguggcuccaugguguucugagcagcauuuagcagcaaggucuucaccuggggagacagccgcaguucugacuaccucccaccucguccuuaagccugugucuuuaaguccagauacucuggaccccgucacucagagcacuucuagucccgggcuggccucaccuuggugcugcaagugaggucaagaggcguguggccccggaagcugcuucggguguccuucucaggcccuucagaguccgagucgcuaucagagguagggggugaaggcagugggcacaggggcuccucguuuucagcauggaugucagcaccugggagagggaggccgucauggggcgguauggugggggccuacauuaaggacugcaaagucgggggacugggaggcaccucucucccuuccccccacccuguucaagugccccugagggugagacugaccagccuucagaaggaggcgggugagggucggguaccccaguccagcugccaggugcagggguguguuucccgcaaaggugcgagcguucacguuggcccggagcugggggugcgagcagcgagaguugacaccacagcaugguccccuuggccagccccccccuucaccaucuuuggccccuccaccacccuuggccccacuccuuccacaauccucagucccaccuuggugaccagaugggugaccaaccccagcuccuccaucucuguggcuagaugcaaggcuguucguccccccugccgcucuguggccuccacuucagccccacuguccaccagcagauccaggcacucagggcuucgggcucggacugccagguguacuggauacaguccuaaggaugcaggaugcucaaccugcagcugugacccuuaaggcagccccuggaccagcccugaccauucaaucucgacaccucauaguccauucugggcacuggccagauacccucccugguccccgccugcccccuuagucaggugagauggggagcucacccucaaagucaggcauaugcaacagcuggggcacagcaggagcuccacucugaagcagugcacgcagcagcucaggagcaccagcgccugcccgcagcgccagaugcauggcugagucuccaugccgauccagcagagcugggucugcaccuacccgcagcagaaagcucaccacacucgucugccccgugaucaccgccaggugcaggggcgucuggggaugaaagcagggugagccaggcccgagacccacuugccuuccaaccccucccaccuccccaguaggcgcccccgcaccuggugcaggugguuggugagguugacaacgccgagguccugggcgugguggaugacauagacuaucugcucaaugacacuggucugcccguggaugauggcuaggugcaguggucuggggguuggggagcgagagucuggcccagccacucagagcauccuucgcuuucaaggccccaccgcccucauagucucccucgcuggggcccauggaacccagcacguggcccagggcaucgcugugccugcacuuaacguuucgcagcaccuuuugagguagguaagugcuaugacuguaccccuugcacggucgaccaaacugaaguuuggagagaccaagcagcuugaacagagcuugugaacaccgaggccggacuugaagccuggcguguccgaaaacugcagagcccgccuccgugccggucccuuuccugcccccaccccgcgccucguccgccaggcccucuguugccuacgugucuccguucucguccugcgccgucagcagguggcgcugucccgccagcagcgcgcgcgcguccgcggugacgccguagucgaguagggcucgggcgcugcgcugcgccaggccgaacaggcgcgcguuguacucucgagcuacgggccacagagggcgugggucagggcuagguccucagccccggcgccccgaccgcccgugccccggaguccauaccucgcugcagcaucuccggggccugcggcucgcacugggggguccuggagggggcgcuuggcuccgcggcuuccuccccggagucccugcugggcaccguggcggccaucugcgccccgcccccgccucccggguagcagcccauggggcccgcgccggacugguaggggcuguaggccagggaggaggggaagaaaccgaggcugccaccuguggauacaggcagggcugugggaagcgggcaccagccaugacucucccagauuuuuuuuuuuuuuuuuugagacggaguuucgcucuuauugcccagccuggagugcaguggugugaucucagcuuacugcaaccucuugucucccaggguucaagcgauucuccugccucagccucccgaguagcugggauuacaggcgccugccaccaugcccagcuaauguuuguauuuuuaguagagacgagguuucacgcuguuggccaagcuggucuugaacuccugaucucagguaaucugccugccuuggccucccaaagggcuggauuacaggcgugagccaccacgcccggccucccccagauuuuuuuccuccacagcuucucuuaccuuuaccccucccuccaucaguacccccucaccuccuccagcuccuccguagcccccggcugcacccccagagccuccacccaugugggagccacccccgaagggcugggagaaggugggcaaggccuuccuccgcuuccgcugcaccucuuccuugucugggggcagaggaaaaugagauugagcccaguuauugugucaugccucaggggcccuucccagaagagcccucagggccggcuccuaggaagcaccuccugggacccucgcacuucugacuuggcucaugcauccccacaucuagcucuugggaccuucuucuagcccagccuggccccccgccagcacccugagguccucagcccagcuccaccuuccaccagaggguaauaggugaacuguuuggaaucagacacguccccuccucgcuugcguuucaguugcagaaacacuguuacaggccgcucaaucuucaucuugugauagggggguguccggaacacaauggcauacuggggggugcagggagacacagggugucagugaguccuuagccuaauuuagcccccagcccgggcccgggcccuagcccuggguaccuguuuaugcacaucugugggagagaaguccccaaaggccugccauccauucucaucauccucauagaaccgaaccucaaugucaucuacaaggaaaacggaagcuuggccacagcucccgguggaaucucuggggccauuuacccuagagcuucccuggccccagucuuauacucgauguccuuggugcccaaagugggcuccagucucaccuuucugcaccuugucacaaagcagauaaacuucaucuccaccccgcacagagccugcugucuuguccauucgagaaaucuucagguuugaugcccccggagauucuauggagugggauauggauuaguugagaugaugcaauagccaaggccacauuuaagaagcugggggcuuuguauuccuuaucucagcaaccccuggagcugcaggaaacacccaauauacacauuuacuaaagacagaagcuucgggggggaaaugacuugcucaggaucacucagcucauauguggcagggccagguucugaaaccugggucuguuugacugcacagcuugaggucaccccucaugccaccucugccaccaggccuggcaccccaggcaaucaggauacucacugcugucauggaugggcugggagaugacuggcuucaggggcagggagaaggagccaucacuggcucuaaggaaggcagagaagcgcagccgcacuauacucagauccaucaccuucuucaguucuuuggccucuugcuccagcucccgcugcucggccucugggcaguagguacaugugugaccccugggcuucucccucccugcuccuuccaugagcaccucccaugacccacccacccccugcacccauacccgacccacccccugcacccauacccguaaggcccuggggccuagagcggagccgcugccucugaaguuuuuguaucauaguccccaucauguucuucuuagucacaugcaggacacccagguuguuaaaucugagaagagagaaucggaggccuuuggccaugcaguucuuucuuccugaggcaccuuucccauugccagggcucagcucagccuuacuuccucaaggaagccauuggaguuucuacuuaggcccuuggguuuggggccaaccuacaucuuuccccuuggucagaugcuaagcucauggaggugggcuggggccugggacuggcagacgggcauaccagugggggccaggcguagagggcaccuacugggcagucauguccuugggccccacagaaacggcgcagauccccagcuccgagcauugcuugcccaccagacugugggcaugagcacgaggugggucacuguguguuaccagguccaccucgaucuuggcuggucccucguaguuacagaucuaggagaggcagggacugucagucagggccuugggcaugcuguccacuuagcccacccuccagcaccauccuggcucaccuugacagugggauaggucuuucggcccuucucacuggaggcaccgggcaguccuccaugggaggggccuucacagccauaucgaaaucggaagccucucugaagguccaagggcauaguagcauugugaucagggaagaccacccaggccagcagugaccgcagugccugguaguagcccugaaccaaacuacagcacucugaucagcagcagugaccauccaauccccuguggccuccuucggcaauggcuccuccauggccagccagcuaccacuaccccauuuguccccaaagcugaagccauuccacacccucccuuuugcucacucaccugcuuaggcuguuccacgaucaccagguaggggccaucagcuggggacagagagaccuugcugagccacgaucucccagccccucccccagagagagggcacaugcucucccucccccgcuuuaggacuaggggagguuagugaacuugcugaccuguuucuggggcuggcuccuuggguuccacaauggaggaguucaauuugaaaucaucauauucaauaauaccauccagacccugguuuggagacagacuggggguggcauccgacucucagcaccccccacagccccaccucccaucuccaagucuucaguggucacuccccccuccuccucagacccaagagaaagcuccuuuuggaggcagaguugcagacagauggacagacuggcaggcugagagcaucugcgagcauacagguguaaggcagcagagggggcucgggcagacagguggacagacacgaggggcagccggccgggucaggggcaggcggcaugacucacuggguuguagcaacucuccaugucucugggcuaggcccggcucugucuaguggcuccggccagguucugcuucccagaauuuuagacgcccgccuaaaguugggaggaguggcgugggggagggggucagaucuaaaugggggugggcgggagaugggggcccagauuugggggaggguccgaccuccuccagccgccuguccggguguggcgggugagauccgguggagagcgagauccggaguugggcuuggccggggaaggggcaggaaaguuagagcagcuuaggaaagucccgaaaauaccaaggggaggcggggccggagggggcgggccuggaaaugacgccacuggccccgcccucgcgacgggaggggcgggaggcc

SEQ ID NO: 21325 - RNA, 39352 nt, Homo sapiens
gggugcauuuggagcuccauggcuggagaagcuguuuaugaacucugcccauccaaggccuggcagcacagcuaccccagcugggucuuuucacagaaggccugucgggcagguccuagaacaucacacagagccuuuguccagaaggcaugguguuuuccagugagaaguuugcauugccuacacuggcaggaggcaagggaaguggagaccaccagccuuuugccagcaggagucugcucccagagggaaaaggggaggagagggagcucaggccaagaaggacccaaguggaaacucgagagggaaauggccucggcaguauuuagggcaguagauugggaacuccuuaagagcuggaauugaguuuuguguugaaacagcucaggcuaauuucaaaucucaagccugcccuuuacugcuugugaggccuugggcgauuuuuuugaccuuucugaaccuuaauuuccucauuuguugugugagggggauaauagcaguaucuugcuggaugugaugaggaucagagaccaaggaguacgcaggcacacagcagucacucaauaaaugguggaguccacauacauuuuuguaagcauuccuucuguuucuggauuuaugaacugauaaaaggccagggcugcagaggacacccaggcaauggugucacaugacuguuaacugagaaaaggaaacgaaauuaccaggaguaaacccacauuuagaggaacuuuggcccagaaacagcuggggguaaggcaaucuguuucuaguuaggaagcagccaauggaagaacugugaaauucuucaguuguugcuagagcuguugcuucauaaauguucuaaacuuagcauguguauggggguguguguguaucuaugugguguguauggggguguaugugugugguguauggcauguauguaugugugugguguauggcauguauguauaugugugugugauguauguguauuauguguauauauauauaugugguguacaugcuucucuacgguaagauuguggaagccuugucuuucucaccuucaacagugcucaauaguacaggaaggaaagacacauauuuauuuuagaaaugcuugauccuuuaguauauguuuuuucuauaauucucccaguggcucucagacaaggaaagugaggcucagagaggcuucuuguuuaaacucaaccugcugguuagugccagagguccacccugggcuuagaucugcuugacaacaguaggcauuguuggcuugacuccuaaaagaagaaggccacaaaugcaaauacagucgggguuuuguucuauggucugcucuucaggcaacuuuucuugugguaugucaccuagguaccuguguucuguucuggcucucagacuugcaacuuccugcacagcacguugucacucugguuuuauuuuugucagcucuuccucugaaccaggccucaccccagagaagcagacucagggagggcaggaacagcucuggggcuauugggccuagccccugggcugauguagaagcaucaguucugccucaggcugggacagcuggagugucagccugcgcguucugccugggauccagcauggcugcggucccuggagggcuucagcuucccgccauuccugggaggccucuacagauggccacaguucaccuucuggcaaauucacagcaaacucaagcaugagcugcaagugcugaggacagcuuauugcaguucauucuccugaguaacuccacacacaccuagcaaaugacagguaggcaucugccgggcuaaaccaggaaguaaaacucugugggcagccucagacaggcucuuguacagaaaauagaaaucuuauuaguuccuuuagucuuucaccaaacauuuauugacaaccaccugccuacaauaagccugaugcaggggcaagguuuuugccuuucagaaggccacaguccaguggggaacugaugucaaaacaaacagcugagcuuggggagcagcaugauaacagauaggcauaucauggcaggaauggaggaagagucucuucacucugcccuggccuggggaaaacuucucaugggaagcauuacuuuaccuaagccugaaggaucaguuagauuucaauaaguaaaaauaauaucgaaagcuauuaaaguauuauuauuauuuauuagauacuugcaauaugucaagcauccuacuaaguacuuuacaaacauuauuucauuuaauuugaauaacaucccuaauucaacgauacuguaauuauccccauuuuacaggugaggaaacugaggaucagaaaaugugaaauaacucacucaaaacuaggaaauagaagaacaaauagucaaaccaacuucugcagauuccagagcccaggcuuuuaugcuuuuuaauauguucaaaaaauauaauaauauaaauagguaaaugucuuguuccccuccuggcaucuccugcuggucucuguauaucccauacacaccaacugccugcugcccuuauagauguaaacaguuacauugguuuuuuauauguuauucaguguuuaugucaauauaaaugagucugaguaaauauucuuauuuaccccucuuucuuauucaaaaguggcauauauuaacacugauuuguacuuaauguagucuuggagagcuuuuuauuggaguauauagcaaucuuccucauucuuuugcacaguuguauaguacucauuugcugagcccaggcuuucaaacacaaggcaaaguucagcuggaaacauauagguaggcuuugcuaaacugucuaaauuucaugaggcaccaaggagcaaagggguaaugauauggauuuauuuuuagaagauuccuuauauuagguaggaagaugcacacagcacagccugccuaaacauguagccccaccucaguacaaagacaugauguacugccacagugguggcuggagaaaagcccuuccauggaacaaguucugacuuaucucuggcccuguugccugcagcccugcggccucugcuuuuuaagaugucuuccccaugaucugccuguggaaauuuuacggaacuuccugugccuaggaugcagaaaccacguguagucuuaaugugucacccugggcuacugcucugggugacgcauuaagacaacuuauaauaauugugcaagagcucgagacgcuucacaggugguacuuaaaguauucccaggccucuaguauucccugggaaagcuugcugucagggcuguuacugacucaaaugccuuugaagguaagcuggagucagcacuccuuuucucugagagaggggguucucccacagaguaacaauaccugugguaauaacuuugguucuuugaaaagaggaguuuucucuuuaagguuaugugaucacaguugcuaaaaccuugguggcuucaaagagguuguguaguuuccaaaaauacagccccaucaaaugcacauggccaccagucagcugccuuuguguuugcugaguucuauggcuauggaccuaccacauauauucaucacagugaauaaagcugaccaagcuuuacagcacugguuacauuuuguucuggugccucgacguuugccuuaucuuuccaaagaguucuuaagagaagguagcuuauaagugaaaucauugcaccacacagucuccuggaagaaaacaugcauaaucgugggcaauggcuauaagcagaaucuuagaccagaucucagccaacucacagaucauauuggauagauuacagccccagaaagaaucugggaaacguuuuaaguucuacacccuuggagccaucaaauuacucaaggucauacuuccaauuaguagcacaacuaggauuggaauccaaaccucuugccuucucguccagaucccaguccauuaaauguguuuuccaauauguauuccauaagacguuaauagacacuauguacaaaaggguguuauggucagauaagaacagcaaacaugggguuaaagaaaauugaauggguuacuuaugacagaacuucucagagccuuuaaaacaccauuauuuauugugauuuucuaagaggggagaugauuagcaguuucccuaaacuuacuucauccuaaaacccuuuugugguggaacaucuguggagcauauuuugagagacaccauguaaugcuuccucucuuaaauaaguucaagaguuuuuuaaagauacacucauggguaauggggcugacuuuuguuuaggaaauguugggagguuuggcuuauauuuuuggcccauugaagucaucauaaugggagguaggugccaggccugacuggaaugacuaugggguguuccaagauggcaauucaucucuuuuuaggaccacugcugucuuaaaaaccaauuuuguuuuguuuuccuauuguuacuuugaaguacuuugacugcgccugguuugacauacagaggaaagguaagucugguggccucucuugaugaaauacuguugugucaaaccccuaucuacuccaauggggauagcgccaggaucaagaggcagaagaagagacccagagccagcaaaugagacaugggguuuggcugggggcuuacauacaggagacagaguccagugauggugggcuggacaagauaacugcaaagugcagugguggccggcuggacagaagaaccacaacugauugcaaaaggcaugcaguuuacauaucuuuuucacuuagcauccuuucccuaauaaccuccaccuggcaaccuucacucaacccaaaacucagggccucaagcugcuguacagcccauguuucacaggauggucugggggcucagauguuccugacagacaaggaacgaaucuccugguuggccacuuccagauucccuagcucagaacacacauucaggugcauuugucauacaaguucauucucaggguaugcuuuaguuauugcuaucagaugcauuuaccauacaaacacccagucugaaaaugggcccaaauguaauaacauguaauaacauaaauguagaaacauauuccagauguucuugaucuuuucugggacaugauucuuuugggggccuuaugggaaaaaguuauugacccauuguggcaucaaaugcauauucauaauaaaacuugcauaaaauuuuaggguguucuugcacccucugaagccaaccaguaaaucacugggcuagauuuacuguccucaaagagagcucucugaaaacaaaacauaucauagaccuauguaacacaagaaacgauaguaagacucucaguuguccccugagcaguuauuuuuuuucuuucuuuugaacucuugguucuuggaggguggccuguugcuugcuaguuccuguuuugauguuggcuuugucaauugcgcugaaugacugucaaucauguuacuucaacugcgguacuuggggacuuccuggagcuguuguuuacaaaugccaguccuaguuucucuuucugaaugcuguccuccuagcuuuuuggaaagaaaaaaaaaacagggcagaaggacaagacacaugcagagaaccauauggaaaaggaaggcagcuguuggccguggaaugagguccuauggcucugucugugucuugccaggagccgcaccacuucugucugggccuugguuugcucauuuguuaucugagcaaguuguccucaccaggucaucuccugggacuuuauucuuuucucugaacuucuacggggcuagcuucauuuuuauuauaaacauuuaauaacaaaaagcaacaucuuucuuggguuucccuuguucuucucuugccacuacuuuuauuuauuuauuuuugcucaaaauaaauagagguucgauuaguuccauuaauuaacuucuacccagcauuugucucuucagccaucccccuuccucagcccugccuuaccccugcccuucucuagccuucucuguuuguacuuccuuauagauuuggcugucuuaaucacaacccaagaucauucauuucauuuauuuuccagaaugaaaaguuccucauuucuauaccaggcuuucugggcccuaccuccuugucugggaagcaagccgacacugcagacauagaggggaggggggcauaauggcagcuaugugcacucagggcagcuggagaaaagaggauuaauucugagacaugugaagccuagcccaggauccaguguuccagaagaaugcgaauaaagccccgagagauacaacuggaggagcacuucucuacccugacucaacacuauuaaaugcagggcguggcaguuauaauaaaugcugaaaagcaucggguggaauggucuguguuugcaaaagucuaaugaacuggaguuugcaaaggcuuagaacuuaggccaaguauaggagaugugguaaaauuuguguuuuggcgggggauauggugcgggaaagauuucuugcuggaguuccucaauguuaauugagcuuuuuuucuaaaucucuaaggugguaggagugauuugagggggggaaaccccauaaaagacaaauguacuaagaaaaccuuucgaaaccugaauugaggaaauaaaaucuuaguagucuuucaauuuuucuugguacauaccacaguaaaauauugcaucuauuuuuugaacuaugcuucacauuacucugugcuugcuuuuuaccccaggaaagacaugcaagaaaugccccuugaaggguuucuaaacguuguacaaugcuuacuacccuuucccucuuccccacuuucaggccccugagauggauucaucugauaccaggagccucuaggacccagaaauuuaacugucaaucaagaggcaugugagggaaaguccagcccagccugggugccagaaggucuggauuccuggucugcacauucccuacaacucugggcagagaucucauauguacuucuggcucagcuacuaacuuagcuguguggcuuuaggugacccacuuaacuucucugaaucuguuucuccauuuguaaaauaaaagguuuggacuagggaauccccaaauuuccuuucaguauaaaaguuccaugauuaccagugaccugcucaagguucauuauuucccucauguuuaaagcacagaaucuuguccacuucauagggagguggugaaagucuaugcacaugugcucaguaaaucuuaggccaacacaaaugucagcuaucaucauuauuauaagaauucuuuaugcagcucuuucuucagaacauguuuuauaucuuuuaccauuugugcuaaagugcaauuuuugccuuagagaaauucucaaaauucaggcuuugguuugacaaaaggagacaaggcgucaguucagguagaugaaguugcugcaaaugacagcagcaucuaaaauuucuuaggaaggaagugggcuaagaccuacccuuagcccccagaaagacaaauucuccucaauuucauuuaggggcaugaccauuucuuauuaagaaacagaacucucaaaugaggcuuuacccuaagaaugaaaaggccuuggagaguuccaaaggcauuaauaguaaaucuaggugcuuaucuuuugccuucaacugugcuuuuucaaguacuuuacccaaauuaauuaauuagugcuccuaaacccacaccagccaucacuuugccuuugggauggagggaggugauauuaucugagcuuugcauuaggagaaagccccuggguugacagucccucuguccauacccgguggaauccucuccugccaacaguggcaaacuccuuuguuuguuuguuuugagguggagucugucucugucacccaggcuggagugcaguggcgggaucucagcucacugcaaccuucgccuccuagguucaagagauucuccugccucagucuccugaauagcugggacuacaggcaugcaccaccacgcccagcuaauuuuuuuguauuuuuaguagagaugggguuucaccauguuggucaggcuggucucaaacuccuggccucaagugauccgcccaccuuggccuccuaaagugcugggauuacaggcaugagcuaccacacccggccagcaaacuuucuuaucucuuguucuccauucccaggacucccaugguaccaacucaguaccuugcucagcaucccaggguguuagaacugaauggcugcuuauggacucccugcaaugggcaccuccuucuuuuacagcacagaaaauugaagcauucaauucacucagggagaggaagugaaacacccaaagcaacacagcuaguuagggacagggucacuaccuugucuuaagaggcgaaaaauaggaacuaucucccacccucuccccugacaaaaccaaacacucuuugcgccccuccaaguaucucaauacugcuuaagccugaggaguacggggaagaugaaguauguaacguuuaucuacucacaaagcacagaguuucuguugccaccucugagcagcugucuuguucugggcaacugugaucucccuuccucuccuaagcucuuggaaugaaucuuucuuaagggaaauggaaguugcaauuccauuauucuguauagagugaguuaaggggaaggccucucuccuuuucugucaucuaauagcuaaauuaacauaagcccauaggcacagggauucagguaacagaaaccuaguuugugacaauuacaacgugaaaugaaaacauacauuguggcccagaagcccgggcagcccuaggcuucagauauuaccuacccuaaaguaguauaaugccuuuuaccaagaacacagcugaaucaacugugcuuuucauagaacaggcacacacuaaaauauuuguggauugauuugguaggcaaaaauucuuggcacuuggauacuucuccauuuucagcuuauucuuaaaaaaauuuuuuuuguuaaauguucagcugcaaaggcacaggugacuaaguguucaacacagcuggaaggaauguuggugacaguggcugucaucuauauuucccaaguugguuucuaaauaacacugcuucugggguaucuugagaaaaaaagguucuguguuuaaacaagguaggaaacauuacuaaucuuccuaccuuggucucccaagacacuaaaggcacauagcuuauuaaaaacacugagaaggcugggcacgguggcucaugccuguaaccccagcacuuugggaggccgaggagggcagaucacuugagaucagggguucgagaccagccuggccaacauggugaaaccucaacucuacuacaaauauaaauauuagccaggcgugguggcaggcgccuauaaucccaguuacuggggaggcugaggcaggagaaucacuugaauccaggaggcacagguugcagugagucaaaauagugccauuacacuccaaacugggcgacaagagcaaaacuucaucucaaaaaacaaacaaacaaacaaaaaaccacugagaagaguuguggguaaagaaacaguuuuauuuuuguuuaaacgaguuauuuccaagaccauuugaccauggaacaaucccucccacauuuuuuuuugcaugauaucuauuaaaguuccacaaaauucauguucuuuggaaaauaacuugggaauuacugauugagcccaauuucugaauuuuauugguaaagaaaaagguccugagaggggcugaaguucuuacaggaaguuagugggggagguaggacgacaacccuauuuccugagugucuggcccaaccuugucaaccacacgcaaauacggcagcauucucaaagguggguucugggaucccagccaucauggguacugcuugagaugauacgcaaaaaggacaugaacguuuuccucccuaauggguccuuugggggcaauuugcuaaaacauaacagguuguuuuagaugcuucuuaaaauugguaaucauaucccauucuuucuuuaucucauagaacucgggaugccuacccaacacagccugauuaugcuauaugugcuuaguaaguacauucaaugaaugacuaaaugaaagacagggaggaagaaggaaacaguccagaacugaaagggaugagaagagaaaaaauguggagaaagagaaggauggguaacaaaggagccagcagucacugaucaguagaguauaggugagagaggggaaaggagacagcugcagauaauggaaaauaacaaaacaaaacugaggucugggaagcuccgauuuuaaaaagugaacaugaguuaugagacuaauucagauacuggccacaccaggaggcccccgcccaggagaugaggaugaccaccaacugcugagaaucuuuguaaacucaaaucaagguguauuuauugcacaggcacaauaaaugaacaaggcaucuuaaguacuacaaugacaggugagugggucaggcacaguggcucacgccuguaaucccagcacuuugggaggccgaggcaggcagaucccuugagcucaggaguucaagagaagccugggcaacauggcaaaaccccaucucuacuaaaaauacaaaaaacuagcugggugugguggcacaggccuguagucucagcuacuuggaaagcugaggugggaggauggcuugaccccaacagguugaggcugcagugagccaagauugcaccacugcucuccagccugggcaacagggcaagacccugucucaaaacaacaacaacaacaaaaucacagaugaguaagacacaggucuuucccuaaacaagguuacagucuaaugggcagaagggcuaggacagggacucagaugaaauaaugccagguagaaugugaucagugccccuggagguguggcaagccaacacugugaggaaucagcggcaggaagaucauaucaaaucacgaggcuccagaaaaacuacgaggguccaggaaugguggcucacgcuuguaaucucaacgcuuugggaggcagaggugggcugauugcuugagcccaggaguucaagaccagccuggacaacaugaugaaacccuguguguacagaaaauacaaaaauuagcugggcauagugagcugugccuguagucccaguuacucaggaggcugaggugagaggaucguugagcuagggaggcugacggaggucgaggcagcagugagcugugaucaugccacugcauucuccugggcuaaagggcaagccccugccucaauuaaauaaaacaacaacaacaacaaaauaaaaaacuaccaggaagggccaugaggcacagaaggauugcaucaggcggagauaggagaugagaagagagacauuucaaggugauauauaaagaacuaccagggggugaggaagcauauggggagauguguggagacacagccugaaagucuugaagucacaucacggagccuugaaugaccgaccgaggcgcugacacucaagagaggcaaugggaagccagugaagguuugugugugugugugugcgugugugugcagagaaauaguagcauuagagaugauucccaggcagggugacugggcagccaagggaaagcgcuggccugugcgggaugaggcaguuggguucuggagagcacaagcaaucauucggugcugcccaucagacaacugaaaaaucugaucagaggcaguggcuaaguccccgccugggaacacaaaggaagccuaagguucugguuaucacccucaggggaccgugaccuugaaagaguaaggauaguaccagccaaaaccaaugcagccaagaggaaaagucacagagaacagcgaggggagguggaaguuucaauacagaaauuguagccauggcugagaaccccagcacuggaggccggaauuugugcguuugaacgccagaggcuuggcuagucaugauuagcaaaggaacuucaaagaguuuuggagccugcuuuauaucugugaaaugggaauuauuuccaucucaaagguuugaggggauucgcugagagaaacuucuuagcaugggaucuccagaaacuggaagccacagagaaagcagcggccagagggaggaggaaucggacaggcugaucacuuggaguguucgccuaagcaguuucuagaaauggaggcagggaccaucaggaagcucaaaaccuuugcuucagccgaguuugcagaacgcccugugaggagaaugggugagcugggucgaggaagcuucauccucguccccaucccccagcacugcccuuuucccaacgcucccaucccgccacgccucccaacauacccccaccccgacuucccgcucaacucccgcuccagccagucccaggagccacaugcgcaugcgcccucccgcgccccuccccaacuuuccacguuucacuccucucccuuuuccuccucagcuccggcuccgccgccacgauuggccagccgaccacccggccucggccaauaagcgccgcccucucgcccccguguuacuggguagaagaaaacaaaaacaaacagagcgagaagggccagagacucuccgaggcggcggcagagacagaagagcggggucggggccggcugaccaggaaccugggcgagcagcggcgggggcccgaggggucaguaccaguaggcgcggcucacacgcucgggaagacugcgcccucucccccaucccuccucggaggcagccgcaagaugggagggggcgggggcggaggcgugggggucgcgguccugucagguccgggccugcggugcggggguccggcugccuucuuguagccccgcagguccagccgcgcccuccccaacgccccggacugcgggcauccggccugguucccucuuucugagcccagccuggagcgugucggcgcgggcccgcccccucccggagccaucuccccacugagaggggcgcgcgaggcgcucgcccuugaaggucccccucagcccuccucccccucuggcggagguugaauucgggggccgggauuggaaggcguguuuccggcuggacugaaauccugugaggaagauucgcgcccuccccgcccccugcccucccugggaauccucugaagaugcggcccccuguccuucgugaacccggagccccggccucggccccggcccagccccuuccgggggccgacccgggcugggacuucggggguccuagccugagcccgcugcgggagaacaggcccggccgcuguggggaggggccgcgcgcuauccucgccgggggcgcugggaggcgaacacgugcccgccgccccaucccugcgcgaacuucgucgcgcccgucuuccggcaaagggucucuuuuuuuuaguuuagguaaaauaaaaucucccagagaaaacaaagccgggaagggagcccccuuucugugaaacgcaugccaucuucuccauuugucaguuugaugcuguaacguacaugggguuuugcaagagcuucaaaacugucugcagacgucaauuucgccccccucccccuugugagaacucgcuacguagccagcaacuguguagugucuacaaaugaugaaaacgaucagaaaugcgauuaggugucggggaaaaaaggguuuccccuguuuuuaacuuguauuuuuacuuuaauuguuacaaucuugauauucuuaacgugacuuuuuugggaaaccaccaagugcuuuuuaagcaaggaguuacugguauuuaugcccuuaauauuccuucauuauaggcuuauugaauacguuaauaucucaguaaguguauuugaauuauaauugacuggcuuuuucugugguacuaaugugaaaggaaaaaauauuaggacugcaaaaauaaaugccgcuugaauauuaucuguagugcuugcuuuugcauuacuguaguagaaugcuuuuagcugguuuuaagcugcuaauuagccguucguagccgaagaaugaauacaaguaauccuaguuaauaaauggccaaagcuugacuccccaaaaugccagagcaauuuaugagguauauuucaggaaauacauauguauauauuucgugggggaguggagggucugucucuuagggaaugucuuggcaguugaauacuucugauuguauauuucguguaacacacuggagaaaagaacaguguuuaaugucagccuucauuuucuucuaacuuguauguauaguuuucucaucgaaaauucauuuuuguagguuaguaugaaggaaauagcguuuggauuuuuugcuuuauauuuucuuguuugggccaauuaaggguuguuaaauaaauuggaaaaaauccuacuacuuuaaagagcguaaaaacguggaacaugucuuaucuaaacucuuaaaacguguuuguugcugucaaauaugacuugaguuccugaucggguuaucauugccuaaagacacaggacuauuuuuuuuauuaagauaacuuuguuuuuaucuuaauaaaagagaugauagucauuuccugacaguuuugucugacggaaugccuucuguauaauaguuuaaaauaauuauuuuuaguguuuggaaaacagcauuuaaaaguuugaacagcagaagucuguuuuaagaagcuucuguuaacccuugaaaagaaucuuccugugggauauuaaaauuuuggauugaacuugugcaaacaguacuggauuuggaaggucuggauucucauccuggcuguuccacuaagcagcugucuguccuuggacauaucaccuacccucucugaaucuguuuaguuguguguaagguggaauaccuacccgaagguuuuucuguaagguacauuaaauaauacauguacaauucuuuuugaauuguaaagggcuuuaugaacaucaauuauaaucauuucgcuuauuagguucugcagaaaguauucucucaaaaguuauacuuucaucaagaaugaaaaagacuuuguaauggaacucuaaaaaacugaaacacguaucauaugacauuauuccuuuccuauauguauuucaugcauggaauuaaaacagaauguagccuuuucagccaugaaggaugcugaguguuuagauuugcaaaccauuuuuguucauauauuuauaugaaucucuacauauuuuuaagauuuuuuuuucauaucuaaaguuggcgggaguuauagugaaaagugauuauaaagauucacauauauuaauuuauucuuaacagaauuagagaaugaucucaccauuuucuuaaguucccaagcaauaugauagcauauuagucugaggauuauaccauaguaagaagccuauaauuuuaacauaagguccauuuguuuuuguuucacaaaauaauaccguuuucugaagaaaagggcuauaaacuuauguuagcaaauaguaguacauaaugaggaauuuaaaagucaguuucaccuuugagucccaggaggcucuguauauaucauuguuauccuaaaaugacaucuaacaguagguuaaguuauauaggaaaaaaugugcuuuucuguaauuaauuuauuaggcauuuucacuaauuugugcauuuuauaucucugaagagcacacugcuagcaaccugauuguaaaugaccagaaggacuuauauccaaccuaugugacuuaaacauacacuuaaguacucuaaaccacuauuuaaaaaauacuucuagagagauucugaaaucuuaauuugguugcacuuucugguaauauauuuuuugaaaacuauuuugauauuucuuucauauaacauuauuggaucuguaucacuaaguuaauugucuaaaagguaacugauuucaucaaaccuuccaguauuaauaauuuuuaagccauuuugaaacugaggccuaaaauacugaaaugcuuaugucguuguacuuacuccuuucugaaaugaucagauuuuuaaaaaauggauuucucauauaaauaauauuaucaaaaaaggauuucucauauaaauaauauuaucaaaaaagcugauuuuaaaaguuucucccaaagucuuauucuaguaauuauagagaccuagguaaugaguggcagauauaucugccuuucagauaugccguaaugugaaaaauaacacagucaugugauauucuuuauuaacuaaaacuguguuguuuuuauuuuggaguaguucucauaauucauugguagggaacuauccaguauuuauauuccuauguauguauaucagauuaauuuugaggcuugguauuccuaaaagauuuggauguguguauuucuuuaacuugacguaaacauguaucacaaacauaucuuuuaauuccaauuaaaggggugcuuuggcacaugcugaaaucugggauuuuuuuuuuugacuuugauaaauuuaucaaaaagauuggaaccaaauguuaauuaggguaaguugucuuugaaaguaaagugaacuguuuuauuuaauggaauuguguguuuuuuguuguugucguuuguuuuuacagugugcuuaaguaaguuuaauucagcuuaauuacaucaguuuaaaagaucuugaagcuuucuuuuuuucuuuuaaaaaaacagauucugaaggaagauuuccauuagguaauuuguuuaaucagugcaagcgaaauuaagggaaaauggauguagaaaaugagcagauacugaauguaaacccugcagguaaguaaggauauccuuuuuucuuuuuuucuucguuuugagacaggaucuugcucugucacccaggcuggagugcaguggugugaucauggcucacugcaguuuugacuuuccugggcuuaagagauccuccccuaucucagccuccucagcagcugggacaacaggugugugccaccacaccaggcuaauuuuuuauuuuuuguagagauaggauuucacuauguugccuaggcugaaauaucuugaagcuugacuauguugugaggaagcuucagaccauuccauauuuuauaaaaacaugauagaaaaacuaucuuuaaauacucuuuuauucaugcuguaagaaaacaggcuauauuauuuuuaaagucaaguuugugauuuuuauuuucauggaaauucauuacauguccuauuuuucugccuauccuuucacauuccacauauuccuauucucuguuauauaguacagaauagagaagaauagugagccugcuuauuuucacaugggcuaguuagugauuucuguaauauaaacuuacugguaucuuugguaucuuuccuaacaaauaauuuuuauauucuaaauuaccuaggguauuuucccuaauucuccauggugcuucaauagcauguuauuaucauaaaaaugaacaguuuuguggaauagaugaccaaaugugaguaacucaagauaauuuaaaauguauuuauaguuuuaaaaauaaucucccaaaaaguuaauuagaauuguguaauaucugaauagugagaacaguucauauugguauacuuuggauaauucuuugucuuauaauuuuauuaauauugaaagcuauuuucugucauuuuaaguguauuucguaacuaaauacuacaucuuucuuuccucagugacuuaacucacuauuguuuacaauguacauaguuuucuuugaucugaacaaacauguugaauuugaagcuucuuuaccauuguuuauuuacagaucuuuuuaaaguaugguaaaaaauugaaaaaaauuuauguaauuaaugaucauuucugugcugcuguauacaauagcuguaugaguaugcuuuaggguuauaaauggauaauauguaccuacuuaauugagauggggaugguaauacaguuuagaauauauuuuacauauagguaauugcuucuuuucugcacuguccaguauggugaccacuagcuacaugugguuauuacuccugggcucaagugauccucccucuucagccuccucaguagcuggauuacaggcgugugcaccacugugcuuagccacauguguuuguugaguacuugaaauguggcuacucugaguugagaugaaggucaacuaucucaauaauuuguuauauugcuugcauguugagaugauaugguuauauuagauuaaauaaaauauauuuaaauuaauuucaccuguuuuuacuuuuuaauguggcuacuggaaaauuuaaaauuucuuauauggcuugcauucuauuucuauuagaaauagaaacacagcuuuaaaauguguacuuuuuguuuccuaacuacaauaagaccuaguucuaacccuguucuuggugcuuguguccagcacugcuuuaaaauaaaagacuuguucuucaauauuugaauaggccuaagauagacccucuuuguaguaaauucuucacauagcaaauaguccaagucacacucuuacucuuuuacuuggaggaaguagguuauucugaccuucaguuuuuucauguauaaaauugggauauaaauacccucuguauagauuuauaauuaggauuuagugagauauuguauauguguguuaagucugugaagcacauacuagguauguaauacaugaaagugugguaauguuauucuaauuaugccacucauuggacaccaguaauugaaaaugugauuuucuggugcuguggucauauacaauuggagugguuacuauugagauaucagaauucagaaagagggaauuaguacacaguaggaaacaauuuugaagucaaucacauucuguacucagcuuaucauuuuaauuuugguuuucuuaaagucagcucaauagggguuauggaacuccaacaguuaggugaguaugaguaacaaaauauaaagcaauuaauacaaacauggguuaaaaaugauaaggucaaauauauaaauuauacugagagaauguuuacugcugcagagacacaaacauacuugaaaggauguuaaaauuguugaagaaaagaaaacucgauuaugggaaauagauguauuuaaauugaauacuccaagggacaguuuaagacauuuuauuauaguucugacuccugugucuucuggaccaguuuugugguucaccuuaauggcacaaugaugaaagcacuauguuacagguagauguuuaauguuuuucucaaccauccacucuuacacgaaaaugucaucuaauuuaugugauccugaucuuucuguccccuuccacuuaaucauuuuuguuuaucucucuuuacauucacgcccuuguucgucucuuuagcugucaauacucugcuguauucuaguuuuguauuuucuguaguuauaugggauuaaaaauguggguuugaauucuagccauaauccuuucuagauauguaacuucuugugaaacacauuccuucuguaaaaugaggauaaacaguuucuuucuagagcucuugaagcuuauagaccacauauguaaagugccuuagcuaauagguaccagguaguguggaaucuaauagguaccagguaguguggaaccugguaucuaauagaugacaauaguaaugguaaugaugaaagaaacaguacuacgacuacuuccacuaagacuauaauuacuacugaugguuaugaugaugucccaaacacaccauccuaacaccggcuucuuaccaguuugaaaacuuuuaaggcauuguuugacuucucuuuaauccuagauacauucugcuuaaaaguccuucauuauuuucuuuaaaaguguaacauuauuauuuaucccacaguuacuacccuugcucuuuaccaguuagcuugugacugaauuacugaagcauuuucuuagcgguuuccuacuuuauacuuucucuuuuuguaauauacucaguauucuucugccaaaugaaucccucccaucucuucccuaugauaucuaacuuaagcucugacaauuugagugugggaguaguuagcagugauucuggugagguaagcaggggcaagaucauaaaggaccuuaaguuacaagguaaagaguuuacauuuuggcugggugcgguggcucacgccuguaaucccagcacuuugggaggccgacguagguggaucacgaggucaggagaucaagaccauccuggcuaacacggugaccccaucuguacuaaaaacacaaaaaaauuagccaggcguaguggcaggcaucuguagucccagcuggggcaggagaauggcgugaacccgggaggcagagcuugcagugagcugagauugcaccacugcacuccagccugggugacagagcgacacgcugucucaaaaaaaaaaaaaaaaaaguuuacauuuuuugugacauaaugggacuacuuuuaaaggaucuucagugagggcaugcuugagaaaaucagucuucauucaguauaguuugaagacuggaggcagggagacuacuuaugagacuagugaaauaauuuggcucuaauugaugauuuuguuuaaaacaaaacauuccuaccuuccuaaguaugucaagaauuguaaagauuuaaacacauguaugcuuuuuauagguuggugaaaauuuuugguuucaacaugucuuaaaacauauuaaagcccaugcacauagaccugacauguuauaauuaucuuuaggcauauagaaaaugauuugagugauucagcucugauuugcguuaacaauaaugaacaaaacuguggcccagugguagcuaauucaguagccuuucugacuuaaagagcuuucagggcaaagccaagugccuccacuugaucuccauggaauuugaguaugaaggacacucugcuaggugauggggauacaaagaaggacauacagucuaguugugguuucuccuuugaagcuuaugacuuaguuggaagaaaaagacugcuauauaaaaagaaagugauuuccaugacguguugaaugaauaguaugugagcaauuaguguuccuguaccuagaguuguaagggaaguuuuaaugcagggaguaagacuugggcuauauccuaaaggauuuugauaacugaaaauaacagugagggcgacauucuacugggaacuccaguauguugaucucuuucagaagaaucaauuuuauauaggcuggaagauuuacaggaugguaaguaauaggagaaaaguuuagggagaugaauuaggacuuugagauguuggcuuuucuugaaagcaaacuuugucuugaggcaguaaagcaucagcaguucagcucaacaaucauaugcgauuauuugcuaaaugccuuucauucucuuuuggauuacuaauaguucuuaaguguuuauaccuaguuaugggacguuuggcaaaucauuuaaacauucucagccuuaguuuccuuaucugucuucaauguuauaauaauuaacugccaaacuugugcauaaauaaaugauagagugucuagcacagugccuaauaguaggcauucuauaaauauuaguuuaucucucuucucaagaugcuuugucuuuucuuaauaucuccaauuagcucauaaaagucuaaggguuuuauauuugguguugcuguuagcauagauuuuaugaucuaaacgugaaauaacaugcuucuuuugguaaaaacaaacaaauuugguuuguuuuugguaagaaacaaacaugcuuuguuaaaauucagugccuugguuuacuuuccuugauaaugugaaaaguaaucuuauuuaguuguuuauuagauugaaguagaugaaauucccaauaugugacuguaauuuaccuacaaaaaugguaaugucaugugauucaaccuaaucuaacuuaccacuauaucuauaaaacaguagauacuuaaaauacuuagaauuuuuuucuucauuuuucucuuuaagauccugauaacuuaagugacucucucuuuuccggugaugaagaaaaugcugggacugaggaaauaaagaaugaaauaaauggaaauuggauuucagcauccuccauuaacgaagcuagaauuaaugccaaggcaaaaaggcgacuaaggaaaaacucaucccgggacucuggcagaggcgauucggucagcgacagugggagugacgcccuuagaaguggauuaacugugccaaccaguccaaagggaagguugcuggauaggcgauccagaucugggaaaggaaggggacuaccaaagaaagguugguauauaucauguccaacaaauggaagauaaacaaguggaaaaaaauugucugguucuuguacuacacuuuccuuguucuaggaaugagagagauucaaaaagugaaaauguaaggcuuuacaguuuguauauauuuuuacuuaguaauaaugugagaaccaucucacuuuuucuuuagguugauguuuuuucuuguuugaguagauuuaauuuucuugagcagaauguuaacgauuuauuuccagcaaaauauacacugauguuuuucacuguuacgaguuuuacguauauucucuaaguuugaaaggagucagaaauccaucauacuuauuuaauauaauuauguccauuacuacuacuaauaaauauacauuugauugauaacgucuagaucugaauuuuaauguuuuccuagaucucacggugaguucucuuuagcucuuuauuuuggguucuguaguagauuggucuguuucacugcuguuucucuaguacccgaaauagugacuaguacacuguaggcaaauauuuguugaauaagaguuuucugacgauuucaucaccuucugaauggugggaacuucaauuuauagccuagguuucuuguaaaauguuuuugugaucugucaaaaauuaguuuuguuaaaugccucugcaaucauguuuuauaucaaaaugaaaccugguugucagauucuguuuuggucugauggcaaggauauacuugguacaaaauaaaaaccuccaaaaacagaaauguuggugacauuguaaagguucuuuaaaaaauaguguaguacauuaguccuuaaaacauuucaguaaguugauguagaaaagcaacuuugaaaauuggaauuguuaagcuucuuuugguuguuuuguauuuagaaaacagaauuuucagggcuguuaaugcuuaaaagcaguuagaauucuuuucuauauuuauaacauauugcuaguuguaugguuuaauguguacuuuaauauuuaaagaguacuguauuugaccuuaaaauauuugauggugguuacuguccuuuuuuguuaaauaauuuuucccuuguugaguuuucuaugcuaagcuuuaccggcccagaauguuucuuuuugucuuagucucaaagaaaugucgaauaaaauuuagagcucagcugcaauaucaucuccuuugagguccucaauauagcuauuuuuuuaucuuuauuuguuuuugcuuuuauuuuaaagcaucugcuuuuuuaguuuuuaacuucauaagcuauuuuaacuuaauguuuuuggaaauauugaaagaguggucugaacaaaaaccaguaggggaagaaaacuggaaaaaaacuaacacguuaaauacaauuuuuuuuuagcuguuguuuaacaucggaacauuuuauuuuagauuucaacaaauugaugaauuuuguguuuuuucuuucucaaugcuaaacuuuuucagguggugcaggaggcaaaggugucugggguacaccuggacagguguaugauguggaggagguggaugugaaagauccuaacuaugaugaugaccagguaucagugcuuugcuuuuucauaauauuuaaaauguuuaugaacuuuuuugacuucauguuuguaguuuacucauacaugugucaaaucauauguauaaauguuuuggauuaggaaaccaaguaaacugacaguaauacaugcauaacuuucacuugguuucuguagugagucaaaaauagcucuuuagaaauucacuuaggauuauuaaguuguccauuuuucaguaaauucuguuaauauaguuuguuucuauaguaaugauaauugagaauaucuucuuuugaauauuaugaguuacagauauuagauuccuuuuaaauauuacuguuuagaaugguaacuauauaauacauuuuguuuuggggacaugcgcaucuuucuuuuagggauaaugcugaaaauguaaauuuuuaauagauugugaagugaauuuuuuauuuuuuuuaauggaaaaaauuuaaaguagaauaguauaaucugcuuguacuccucucuuagcuuuacaaacuuaaauaauuacaaacucauaggcagucuuguuuaauuccauuuacucuccgucuucuauuggccccuuugccccacccuguuuuggauuauuuugaagcaaaucccaaauguuuugauuauguuuuuugaaaauuugucuuugcacaaggugagacacggugauggaaauuuuagacaggaaaacguuaagaguauguguuagguuguuuuuauuguguguuguauguauguauuuaaguguuuuaacuaauagauauggaaauauuucuaagagaacaugaaaaauaugaaacuaguaggauucaaguacuguagaaucuuugcuaaaaauguauuaaucuuucaaguauauguuuuuaggcugaagccagucacaaguuguaaauauagcaguccccucuuauccgugguuucacuuuccgcaguuucaguuacccaugguccaaugugguuugaaaauauugaguggaaacuuucagaaguaauucauaaguuuuaaauugcaugccauucugaguagugugaugagaucuccugcuguccagcuucauccaccucauccugcccaggaugugagccauuccguuguccagcguguauccgcaauguauacacuacucgugcauucgucacaugguagcugucuagguuaucggauugagaaaacaguauuuauuggguucgguacuaucugugguuuaaggcauccucggacggggcuuggaacauaccccuuguagauaagggggcacuacauuucagagcuuuuuuagcauggggagagaggaaugguuugaugauggauguuaauuuucuuuuugaaauuucaauugaacagugcuuuuuuccuuagagauuuuuuuucugucacuacaacauugaucuuuguguuauacuuuuuauuauaauaaugcuaaucgugaaggcuuugguuccugcuucauuuuuuuuuaaagugaaauuuuaauuaaaacaccauuuaugauaggaagccaucaugaaacuuuuugauuacuaaaagauugguuuugagagagacauaaaaauuuugagagaaaaaauuaacagaagacauggggguugggagcaaauuauguauuugcugugguuaaugauucuaaucuauauauuggcuuauuguauucugauuuuguaaaagagcagugacauauaaauucuacuauuuuuauuaugauuuauuauuauuauuuuuuagcuuuguuguccaggcuggagugcagugaugaauuauagcucacugcagccucgaacucuugggcuuaagagauccuucugccucagcuuccugaguagcuaggacuacaggggcaagcuaccaugucuggcuaauuuuuaaaacuuuuuuguagagacagggucuugcuauguuucccaggcuaguauugaacuccaggccucaagugaaccucccgccuuugccucccaaaguguugggauuauagguaugagucuccuugccuggccuagauucuauuuuuauaugcgaucaauguauguagcaugucuuugucuugugcuaaguggggauuauuaaccacuuagaauauaaaauuguacaacaauuucacuuguuuauuugcauuuuguuuuuuauaacucuuacucccuuuuccccucaaaggagaacuguguuuaugaaacuguaguuuugccuuuggaugaaagggcauuugagaagacuuuaacaccaaucauacaggaauauuuugagcauggagauacuaaugaaguugcgguagguuuaaaguugcaaguauaauuuauuuaauauaggagagaagacaucuuuuauaagcaaaauacaucuacaaugaucuugggucacugaauaaauuuaaucauuuucuuuugcauaagugaauuucuaagaaauggaauaaaaucucauuacauuaaaacaguuauauauuugggaugugaugagagcugugugccauuuuguucucugaaaaaugacacaauauuuuuauaauuuuuauaauuauaauuuguaauguauaugaauuuauaaaaucuguuuuuauaauuuauaaaauauaauuuuagcaguuugagggcacuucuagacgccccccgaaaccucuucagggaucucaguuaagaaugccugacauaguuucauuuuuuugacauuuauuucacguauguucagaaguaggauaaaaucuuuuuguacuuuguccaaaaaaaaccccacaaauaauaaagauuugaaaaagaauauacagaagccaugagaauaaucaugauuuguucauaaaguaaaucuaggauaaaauaaaaccauuggucuaguuaggauuaucaaauuaaaguaauacaauuguaacucuuuagaagacuuugaucauuuagauucuuaaaauuuagacuggacuuuuaugauuugucugauacugugagguuugauaucuuuggauuuguaggauuugaauauaagacaaauauuuguucagugcauaccaucuggaggaauuuguaauaggugauucuugcccuuuugaagcccagucaagugaaagaaaugauauguaaacagauuauuaaaauacgugaaacguucuguuauagaggaaaaguuuccaugaguccuaugagggcagggacuguugaaaucuuguuaaucuaccuagcauaagaucaauuguauacuauguaucuguuaacugaguacuguuuggaaagcauaaaauagagaguaauaguagagaugauucucugcugucugaaggauguugaggaguucgccaguuaagauaguuuuccaggaaagaggaguauuguguuugaggguaguggauuaguuguuaaagugcggucaaggaagaugaaaugcagucagugagaagagauuacuaacaaggacaccaguuacguggcugugaaaauaguuuuggcacucucuuaguaguauaucaugauuuaaagauucuaagaaaacuuucauuaaagaggagggcacucuaacugaauuagaacuuagcuucuagagucagacugccuuuauuccacuuucaguuuggcuacuccagcugugugcccucucuccuuugaguaugauaggugugauaauuuaauacucaaagggcuauuugaguauuaaauaagauaauauaacuaaagaggcuauuauaaugccugauacauuagucaauaaguauuagcugcagcuauuauauuucuaaaaggaaauuuuaaauuuaccccagaaucuuaaaccaauaaucccauuuaaaaacaguuguuuaagaucucauuuuaaacuugauacaaaagugugaagugaauuuuuauuucaagagaagucuuugaagaaaaguagaauauaaauagcuuaugauaaucuaaaaugaauuuuuccacaaauucucauaaaacaauauuuauaguaauaauagauuguaaggcagguuaguuaacuccuaauaccaaucucagcaauauuauguaguuuaaugaacuagccaugagcugcauaaugacguuuccaugacagacugcauauauaccuuuggucucauauaauacucuuuuuacuguaucuuuucuguguuuagauagguaaccacuguguuaacaguugucuacaguauucaguauaguaacauacuauacagguuuguagcccgggagcaauagguuauaccauguagccuacauguaggcucugccauuuagguuuguguaaguacacucuauaaugauugcacacugaugaaaucaccuaaauggugaauuucucagaauguaucugugucgugacccaugacaguauuuuaaagguauuucacauuuuugaauuuagcgauguuaaggcaguuaaagcuugacaaaguggaucaaugucugauuuaugcacagggaaagguguguuuauccuaucuucuaaaacaugacugggucuuuugauuauuuccaaagagugagacguagagauauauagauaaaagcucaauuuuucaaaaauaaaauuuuauugaacuauagguagugauacacuuuuaaaauguuuuuaaauuauuuuuuugaacaggaaauguuaagagauuuaaaucuuggugaaaugaaaaguggaguaccaguguuggcaguauccuuagcauuggaggggaaggcuagucauagagagaugacaucuaagcuucuuucugaccuuugugggacaguaaugagcacaacugauguggaaaaaucauuugauaaauuguugaaagaucuaccugaauuagcacuggauacuccuagagcaccacagguuuguaugauucuucuuuuuguucauucccucccacuacuauauuccuaauuguggaaauaauguauacuccuaggaaauuuuaguagauggaaggggauggccaacauuuccuacgacaccgaaauauuccgcuagcauuuugauguauuuuuuccuaguucuuuuguuuuuuaaacauggucuucaucaugcuauaaauuuaauguuaucuuguacuuuuccccuaugaucugcauaguuuuuagguaauuuuuuuuuuuuugccauauauauagucuuuguuauauguaguuguuuuauuagcuaagauuuuuaaaaaauguagguuaugauugaaugcuucacuaauguuuauuauaagaagucauaaauaagacucuucccuuuuguagcuuugaaaaugugaaauuguugcuauugucaaaaguuuuuaaucaagguaaaaucacuuuacuuaaaacauuaauuuagaaauagaauauaggcaugucaguuccuaaaugcuguuucuguuaaacuuaaugacagacaauacucgguaugagauauuaaguggugauucuaaugcagacauuuuuuccuuuuauaccaauacacauacuuuaagaaaaugauuacauaaguuuauauuuauuguagaauuuuugaaaaauaaaagccagaaagaagaaaggccagcaaaaacugcuacugguguuaaguuuuccauucuccuuucuguggguauauaucaauguauggcuucuauaaauccuuaauuuuuuaaaauuaaaaaaauggaaucauaccauuaugcuauuuuauaaacuugauuuuucucauaccauaaaauaugguaaauaucuuucccuguggccacauaguauaccauuuuauguguauaccauuuaaccauaccuuuauuuuuggacaccaauuuccaguuuuuauaauaaguaaugcugugaacauacuuucaacuauuucuauacaacuuuuuuucuccacaagauaaauuccuuugauuaguuuuugagagaaccuaguccuuuuuuuuuguuuuguuuuaagaagagaggacgucacuugaccuuaaaucauucguuuaaccccagcacuuugggaggccgaggcaggcggaucacgaggucaggaguucgagaccagccuggccaagauggugacaccccgucucuacuagaaauacaaaaauuagccaggugugcgccuguagucccagccacucgggaggcugagggagaagaaucacuugaaccugggagguggagguugcagugaacugagaucgugccacugcacuccagccugggcgacagagcgagacucugucucaaaaaaaaaaaaaaaaaaaaaaaauuugaucauaugcuauguauucaggcagugugcaagguguuagggauucauuagugagcaaaacagauguggcccccacucuggcacuuaacuugaagguuaagaugugggaguguaugccaggcauaacagguacuacauagguuuuuuuuuaaaaaaaaauuccagcaucuuuuagguacugacuguguacuucagcuaaucuucaucauuuauguauuuagaaauugugaccuauaaaaguuauuuaacuuuuuuuauagcucuuuuuuuuuuccuuuuuacaguuggugggccaguuuauugcuagagcuguuggagauggaauuuuauguaauaccuauauugauaguuacaaaggaacuguagauugugugcaggcuagguaaguaaaucacuuuuccuacuuagaauuucaaaauaggggaaaauucuacaggauccuauugaaaugacacuuguguuaaucagacacucuguacaucuguuugucacuucucuauauucuccacuguuaaaauggagagacuauuggcaugauauaccaggaagaggacaguacuauaauggaaaaguucuggaguuuagcuaaaucauuaauuaccuucaugucaagccacucuucuuugggccucaguuucuuuauuuaugaaacaaaaccauuggacagaucuuuaaguucuguuuucagguucuagcauuguguaauaguuuaauauucuaauaagauggauaaccuuaagaagagaggccugauuuauaguuuuauuuuguauuuaucuacuguagaaaucuuagucagaaaguaucuuuuucacucuugugauuuaguauaauuaauaugauauuugguauaacuaaaugugauauuugggaguuaugcuauuugauuuuucuuaacuucuuggagacuuggacucagccaugucuuaguuuuccucaggucuauauauuaacuuaauuuucuagggcuacuucacaucauaguggaauggugucccuggguaggaaggcauggaucuaggugaaaguuaauuauaugugaaguguuucuucucaguguagaucaguuauuuuguaauguguuuugauuuuucuugaaugagaaaugaaauagagcaugagaauauuaacaugaggaucaacuucuuuuugcuccuuuuuguuuugaaaaaguguuuugaauuuuauuuugcuuuuauguuaugugaaagauuuagggcauauaggauuuugucagcuuuaucccuaauuuaguaaacuuuagguauguccagcuaucaaacuuaaauuuuuuucuuucucuguagagcugcucuggauaaggcuaccgugcuucugaguaugucuaaagguggaaagcguaaagauaguguguggggcucuggaggugggcagcaaucugucaaucaccuuguuaaagagguaaugauuggguauuguuuuuaacuuaauuuauauguauuccucugagugaaauaaauuguggcuacuagcugguauuuuuauggacaaaaauuaaguucggucuuacagcugcaauuggaaaaugaaauaauuuuuuuaauauguggcuuuauaaccuuuuauuauaaauuauaugauuaaaaaaugagucuguuaaaauggcuuucaugaauaauuauaagcaagccaucuaugaacuucaaaggaaugccugaaaucuuuuucuuauaguauuauuuaauaauuuucaaaugcuguugaaaugagauuuucuguguuuuagcuauucaauaaauacgcuuuuauaugagcaauuuaaaacuagauagucuuaaauaaugaguuaugaauuaugagcacuagagcagaucagaguguuagauuuuugugaggacauucacuacccauaugcauguuuuaaaagaaaauugauuguaaucccagcacuuugagaggcugaggcggguggauugcuugaggccaggaguuugagaccagccuggucaacauggugaaaccccguuucuacuaaaaauacauaauaauuagccaggcaugguggugcgcaccuguaaucccagcuacucgggaggcugaggcaccaguauugcuugaacccaggaggaggagguugcagugagcugagaucacaccacugcacuccagcaugggugacagagcaagacucugucucaaaaaaaaaaaaaaaaaaaagcgauuuauugcauuaaaaugccagauuuauucccuauggauuuuuuuuuuuucuggcugcaaugugguguccuauaacaagaaaccaaaaaacagaaaaaacuccuuaucugcagaucucuuuaagaaaaggcaugcaacuagaagauuuguaguucaugugcuucugauuuuugaguauaaucuuuucauguaacuacaauuuugauuuuuaguaagucuuuuaaugagguguguguguguguuuguguauguguaucuagcuuaaguguuaaggaguucaaauuguaguuagagccuugacuguuuuugcuuuuauauauguuaaaauagaugagucaguguuuguaaugucgugauugcaguaucuguuuuuuaaaaauuaaacaauuauuagaaaaauugagguauaaaaauagucaagaugccagggcaauuaggcaggaaagauaaaaggcauccagauuggaaaggaggagauaaaacuaguuguauucccagauaacaugaucuguauacagaaaauuugaaugaauccacauuuuuuaacuccccaaaacugaaaccaaacuauuaacuaaaaaaugaguucagaaagguugcaagauaaaagaucaguacacaaaauucaauucucuauacaguagaaaugaaugaucugaaaugcaauuauugcauuugugauagcaucaaaaauaaaauacuuaggaauaaauuuaacaagacaaaugcaagucuuguacacugaaaacugcaaaacagguugaaagaaauuaaggaagaccuaaauaaauagaaugauaucccaugguuauggaugaggauacuuaauauuguuaagaugguaauacucuccaaaauuaauauuuuuggaaacuggacaagcuguuuuauggugugugaauucucucucaauaaagaaaauugacaagauaaaaauggaaauaaaacugccaguauaugaguuugagguugacauuauuuggauauuugcuuacauggaaggguuggaucaaagaagacuuuuagaaauguauaaauguauuuguaauuuaucauucucagaagugcauggaauuugaugggggauauuuuuaauacuucuaaaguuauguaacaaauguuaaaaguaaguaauauaauuugaauaacaaguacagucacgugccacauuaugauguuuuggucagugauggacugugugggauggugguggucccauaagguuauaacggagcugaaaaauuccuaucguugagugauauggaggcaguuguaauguuguagcacaguuacuuuauuuuuucauaaauuuaauguagccuaaguauacaguguuuauaaagugcauagccaguguauggguaaugucuuaggccuuuacauucacuaaccacucacucauugaaucacccagaguaacuuccauccugaaagcucuauucauauugagugcucuauacagguguaucauuuuaaaaaucauuuacacuguuuuuuauuguaccuuuucuauguuuagauacacaaauaccauuguguuccaauugccuauauuauucaauauagugaccugcuguacagauuuguagccuaggagcaauaggcuauaccauauagcacugguguguaguaggcuauaccaucuagguuuuugugaguauacucuaugauguuugcaccaugacagagucaucuaacacacuuuucagaauguaucccuguuaaacgaugcaugacuaugcauuaguuuguaauuguaaaaauacucaaaugcuaugcuuuaaauauuuacuuacauguaaauauuuaaauacauauuuacuuacauguaaauauuauauccuaaagcaugacagcaauuaaauuuuacuuuaccuuuuaugaaaauaucuuauagaaguuggaaggauacuuaaauaugauuuuuuaaauucagucagccaacauucaacauucaggcaacuagauaugugcccaccaaauacaaaggggauuuuaacaaauaacauauagggaaaaauauuccuaguugaaacucuugugcugaaaaaguucucccacuuuuuugagauguucaaguuugagcgggaaaaucaagacuugucucuuuagcuacagcuggaaacugaauuauugaacauuuuagauaaugaguuucaaauucucaguuguagagaaaagagaaacuauguggaaaucuuugcccucucuaguaaugccccauuaucaucucucauuuuuuggcucucagugcacuauuaagagcgucuugauagaagugaaauauuuugugccacuuuauguugaaacuuuguuagugcccucuagugguauuuaaaaucccuuauuuuuaguggcacacuagagcauuauggucacaacccaggacgcaugcauuauaaaccuauucguaguucucagugauucagacacacugaagcauugcauuugaaucauaauuaugaaccauuuaaaaauuggggauuuauuuuuuaauuaugaaaaauucuguuguaauaguaccacauccaauguauauguuauuagcuguuuguuacccacuauuucauuauauuggaaugagggcaaauaauccuguaggcaagcacgauauuuuaaaaguuaggaauucugacacaucucaacuuuuaaaucuaauagauugauaugcugcugaaagaauauuuacucucuggagacauaucugaagcugaacauugccuuaaggaacuggaaguaccucauuuucaccaugagcuuguauaugaaguaagauuaccuugccaugucaaagauaauuauuaaguguuccuuuuuguacuguagcgacuuaugcuuuuuaaauaauguacauccuuuuuuuaauaucaaaggaggaagugguuauuaaauuucuacgauuacagaaggcaucuaggugcauuuuaggagcaguuucauauaugaauuaaccaaaaauucacucauugauucaauuuuuaggcuauuauaaugguuuuagagucaacuggagaaaguacauuuaagaugauuuuggauuuauuaaagucccuuuggaagucuucuaccauuacuguagaccaaaugaaaagaguaaguauaacauuguuuuugaacaacuuguaggauuaugucuuaaauauaugauugaauacagauuaugaauugucagugaaauuuucuuuagguauguuuaguguuaauaugccuauauguuuuguuuuuucuuaaugguaauguuugagguuugaaccuuuugcaaccauuuuuuggaaaguaacacugcaguguuuuuuuuuuuuuuuuuaccuacuuuaacaaauguaauuauguauucuaccucaaggguucgguuucuaagaugugacaauuucuauuuuauaucuagagagaaacaugaaccuuuaacuuuuaacaaauuauaaaguacuuuuuuccuauuaaaaauuuuaugauuauuguuuuaaauguuugugagguuuuuguuugccuuguauuuuuuuaaaaagguaguaaguguaaauagagaaguagaugggaaaggaguuugcccaaugucugaugucugcuuacagcucuuuuaagagaacaguauuuaaaaaaaauuuuuuagcuauguaaccaguuuuacuuauuuuuuuauuuauauuuuuaauuuuagauaucagagggguauauguacagguuuguuagauggguguuuugugugaugcugagguuugggcuucuaauuaaugauccugucccucagguaguaaauauaguaccugauagguaauuuuucaacucuuguccucuuuccuaccuccccacuuuugaaauucccaauguuuauuguucccaucuucaugucuguguguacccaauguuuagcucucacuuacaagugagaccaugcauuauuugguuuuauguuugugauaauuuucuuaggauaauggccuccagcugcauccacguugcugcaaaggacaugauuuuguucuuuuuuauggcuauguagcauuccaugggcguauauguaccacauuuucuuugucuaauccaccauugaugggcacuuggauugaugccaugucuuugcuguugugaauaguacccgauaaauauacaaaugcaggugucauuuugguagaaugauuuauuuuccuuuggguauacacccaguaaugggauugucggguugaacgguaauucuauguugaguucuuugagaaaucuccgaaccacuuucuacaggggcugaacuaauuugcauucccaccaacagcguauaaaccuucccuuuucuccucaaccuugccaaugucuguuauuuccugacucuaauaaaagagaacaguuguaaaacacuguaacaaaucuacuuucugugcuucucacgauucaaaucugacuucaguuuaaccauuugaauauuuggccuuaaauacaaauugaugacauagugauggauuguguuuuaugacauuuauuuuauaugggcuaacaauucugcauguaauuucauuguuguaggguuaugagagaauuuacaaugaaauuccggacauuaaucuggaugucccacauucauacucugugcuggagcgguuuguagaagaauguuuucaggcuggaauaauuuccaaacaacucagagaucuuuguccuucaagguacuuuauuuaaauacuacuuucucaauguaaaauaguggaugagaucuuugggaagguuaacugcuaaguuaguuuaucguucccugaagucacugaagaacgugacucuugugaguucauggagaaagaagggcgaagcuuguuuuagcccccuuguaaaucuguacaggacugccucaugaaguccuaguuuauuugaaagaaacuaaucuuguggagcagguccuuuguuguaaguaguuucaguguuuagaguagguauuaucagugauaagaugagaaaauugaggcuuagggagguauaauguacuuuuucuaaggucacauggcuaguacaugguagaagccaaguaugaauucaggacuuuucuggcuucaaagaucuaggcucuuaccuguacuggauguggcuuccuugacuucuuuacagguuggagaauuagggcuaauuggauguucucacuagaaaguguguguguugggggguguguggaggauguucucacuggaaaguguaugugugugggugauuuuccuuggagcuauuaauauuuuugcuacuaguugguaaguuuuuuuguuguuguuaaagcuaauaaugaagcuuauaauguaauaauauaaauguuuaguaauagcuaaacuuuuugcuugugugggucaguuuuauauaaucuuaaguucuuauaauuuuuuaucuggaaaauuucuuaagcuuugauauuuuuaagugcauuguaagaauuaaaagucagaaaaauauuuccugguaggggccuuugcuuuagaauuuuagaagccauuaaaagagagggaaaagaaagugaugaaagauaguuuaauagcuuuacuagaaauguuuggaaauacagacguuagcuuggugauggcaggauuuauguauggaugugccaagugauauacaucaguaaaaacucugaacuuuggccuucuuauuauugacugcuuuuucauucccuaccuuggucucauacagucugaagccuuuauguucaagaugauguagcuguuuuccacuuagacuuaauaugaaaaggggccaguacccuggcauuggcuuuuugaaaguuuuucagccucuguuugaaagucugauuguuucuguguggcuuuauucucaagggucacaugaggcaauaaacuuucuguguauacauaccauacagcuuugacuuggguccuucaucuuuuagccuauuuggguaaggugcacauuugugugugguuuugcaugcuugugccuauuggccuggggucagagaguaagggcuaauguugccuaaguucuauuucccacuuacugcuuuaggccacuggccagcuguuccuucugggcuauugccacuacauguagguaagagugugguuacauuauagagcagggcuucuugaguuugacaaagcacgaaucccaaaauggggcauaggcuguaauucugauuuuuuuccacauucaaguuauggcuuuucuacaguugauaaaacauuuuuuuuuaaauugccaaacauggauauuuugauagguugcacagcuccaguuugcauaauucugaauuauguuaguguuuccuauuuggcuuacuguuaagcuuacaaauaauaauuagaaauuaauuagaaauaauuuuaaauuucuaaauaaaauguuuuaguuugagucaacuuuuuuuaaugugacucuguuuggauagugaacuuauuaaaacaaaaacucagauuugauauugauguuuuaugcuaagauauauaguagggagucuuuuccaaaggaauuagaggcaugcuuuuuuuuuuuaauggaaaacccuuuaaaagcuaacacguaacgaaaaaauaccaaguuuuuaauuuuuuuauauauugacuauagucagaauuuguaucuguuuucaugucuuuuuuuuucuucauuacaggggcagaaagcguuuuguaagcgaaggagauggaggucgucuuaaaccagagagcuacugaauauaagaacucuugcagucuuagauguuauaaaaauauauaucugaauuguaagaguuguuagcacaaguuuuuuuuuuuuuuuuuuuuaagcacuuguuuuggguacaaggcauuucugacauuuuauaaaccuacauuuaaggggaauuuuuaaaggaaauguuuuuucuuuuuuuuuuguuuuucgagggggcaaggagggacagaaaaguaaccucuucuuaaguggaauauucuaauaagcuaccuuuuguaagugccauguuuauuaucuaaucauuccaaguuuugcauugaugucugacugccacuccuuucuuucaaggacaguguuuuuuguaguaaaaucacugguuuauacaaagcuuuauuuaggggguaaaguuaagcugcuaaaaccccauguuggcugcugcuguugagauacugugcuuugggaguaaaaaaagaaaguuauuucuuugucuuaaagaauuuuuaaaaaauuagucaugagacuuauucaucuuuccagggaacauacugauuggucuuaaaagacuagacaguuaaguaaaagguggcuggaacaucuauuuuucuacaaaacuggaaaaaugaaccugguucuagaagaauguacaccaaaauaaaacaugugaagcaguauu

SEQ ID NO: 21326 - RNA, 39352 nt, Homo sapiens
aauacugcuucacauguuuuauuuugguguacauucuucuagaaccagguucauuuuuccaguuuuguagaaaaauagauguuccagccaccuuuuacuuaacugucuagucuuuuaagaccaaucaguauguucccuggaaagaugaauaagucucaugacuaauuuuuuaaaaauucuuuaagacaaagaaauaacuuucuuuuuuuacucccaaagcacaguaucucaacagcagcagccaacaugggguuuuagcagcuuaacuuuacccccuaaauaaagcuuuguauaaaccagugauuuuacuacaaaaaacacuguccuugaaagaaaggaguggcagucagacaucaaugcaaaacuuggaaugauuagauaauaaacauggcacuuacaaaagguagcuuauuagaauauuccacuuaagaagagguuacuuuucugucccuccuugcccccucgaaaaacaaaaaaaaaagaaaaaacauuuccuuuaaaaauuccccuuaaauguagguuuauaaaaugucagaaaugccuuguacccaaaacaagugcuuaaaaaaaaaaaaaaaaaaaacuugugcuaacaacucuuacaauucagauauauauuuuuauaacaucuaagacugcaagaguucuuauauucaguagcucucugguuuaagacgaccuccaucuccuucgcuuacaaaacgcuuucugccccuguaaugaagaaaaaaaaagacaugaaaacagauacaaauucugacuauagucaauauauaaaaaaauuaaaaacuugguauuuuuucguuacguguuagcuuuuaaaggguuuuccauuaaaaaaaaaaagcaugccucuaauuccuuuggaaaagacucccuacuauauaucuuagcauaaaacaucaauaucaaaucugaguuuuuguuuuaauaaguucacuauccaaacagagucacauuaaaaaaaguugacucaaacuaaaacauuuuauuuagaaauuuaaaauuauuucuaauuaauuucuaauuauuauuuguaagcuuaacaguaagccaaauaggaaacacuaacauaauucagaauuaugcaaacuggagcugugcaaccuaucaaaauauccauguuuggcaauuuaaaaaaaaauguuuuaucaacuguagaaaagccauaacuugaauguggaaaaaaaucagaauuacagccuaugccccauuuugggauucgugcuuugucaaacucaagaagcccugcucuauaauguaaccacacucuuaccuacauguaguggcaauagcccagaaggaacagcuggccaguggccuaaagcaguaagugggaaauagaacuuaggcaacauuagcccuuacucucugaccccaggccaauaggcacaagcaugcaaaaccacacacaaaugugcaccuuacccaaauaggcuaaaagaugaaggacccaagucaaagcuguaugguauguauacacagaaaguuuauugccucaugugacccuugagaauaaagccacacagaaacaaucagacuuucaaacagaggcugaaaaacuuucaaaaagccaaugccaggguacuggccccuuuucauauuaagucuaaguggaaaacagcuacaucaucuugaacauaaaggcuucagacuguaugagaccaagguagggaaugaaaaagcagucaauaauaagaaggccaaaguucagaguuuuuacugauguauaucacuuggcacauccauacauaaauccugccaucaccaagcuaacgucuguauuuccaaacauuucuaguaaagcuauuaaacuaucuuucaucacuuucuuuucccucucuuuuaauggcuucuaaaauucuaaagcaaaggccccuaccaggaaauauuuuucugacuuuuaauucuuacaaugcacuuaaaaauaucaaagcuuaagaaauuuuccagauaaaaaauuauaagaacuuaagauuauauaaaacugacccacacaagcaaaaaguuuagcuauuacuaaacauuuauauuauuacauuauaagcuucauuauuagcuuuaacaacaacaaaaaaacuuaccaacuaguagcaaaaauauuaauagcuccaaggaaaaucacccacacacauacacuuuccagugagaacauccuccacacaccccccaacacacacacuuucuagugagaacauccaauuagcccuaauucuccaaccuguaaagaagucaaggaagccacauccaguacagguaagagccuagaucuuugaagccagaaaaguccugaauucauacuuggcuucuaccauguacuagccaugugaccuuagaaaaaguacauuauaccucccuaagccucaauuuucucaucuuaucacugauaauaccuacucuaaacacugaaacuacuuacaacaaaggaccugcuccacaagauuaguuucuuucaaauaaacuaggacuucaugaggcaguccuguacagauuuacaagggggcuaaaacaagcuucgcccuucuuucuccaugaacucacaagagucacguucuucagugacuucagggaacgauaaacuaacuuagcaguuaaccuucccaaagaucucauccacuauuuuacauugagaaaguaguauuuaaauaaaguaccuugaaggacaaagaucucugaguuguuuggaaauuauuccagccugaaaacauucuucuacaaaccgcuccagcacagaguaugaaugugggacauccagauuaauguccggaauuucauuguaaauucucucauaacccuacaacaaugaaauuacaugcagaauuguuagcccauauaaaauaaaugucauaaaacacaauccaucacuaugucaucaauuuguauuuaaggccaaauauucaaaugguuaaacugaagucagauuugaaucgugagaagcacagaaaguagauuuguuacaguguuuuacaacuguucucuuuuauuagagucaggaaauaacagacauuggcaagguugaggagaaaagggaagguuuauacgcuguuggugggaaugcaaauuaguucagccccuguagaaagugguucggagauuucucaaagaacucaacauagaauuaccguucaacccgacaaucccauuacuggguguauacccaaaggaaaauaaaucauucuaccaaaaugacaccugcauuuguauauuuaucggguacuauucacaacagcaaagacauggcaucaauccaagugcccaucaaugguggauuagacaaagaaaaugugguacauauacgcccauggaaugcuacauagccauaaaaaagaacaaaaucauguccuuugcagcaacguggaugcagcuggaggccauuauccuaagaaaauuaucacaaacauaaaaccaaauaaugcauggucucacuuguaagugagagcuaaacauuggguacacacagacaugaagaugggaacaauaaacauugggaauuucaaaaguggggagguaggaaagaggacaagaguugaaaaauuaccuaucagguacuauauuuacuaccugagggacaggaucauuaauuagaagcccaaaccucagcaucacacaaaacacccaucuaacaaaccuguacauauaccccucugauaucuaaaauuaaaaauauaaauaaaaaaauaaguaaaacugguuacauagcuaaaaaauuuuuuuuaaauacuguucucuuaaaagagcuguaagcagacaucagacauugggcaaacuccuuucccaucuacuucucuauuuacacuuacuaccuuuuuaaaaaaauacaaggcaaacaaaaaccucacaaacauuuaaaacaauaaucauaaaauuuuuaauaggaaaaaaguacuuuauaauuuguuaaaaguuaaagguucauguuucucucuagauauaaaauagaaauugucacaucuuagaaaccgaacccuugagguagaauacauaauuacauuuguuaaaguagguaaaaaaaaaaaaaaaaacacugcaguguuacuuuccaaaaaaugguugcaaaagguucaaaccucaaacauuaccauuaagaaaaaacaaaacauauaggcauauuaacacuaaacauaccuaaagaaaauuucacugacaauucauaaucuguauucaaucauauauuuaagacauaauccuacaaguuguucaaaaacaauguuauacuuacucuuuucauuuggucuacaguaaugguagaagacuuccaaagggacuuuaauaaauccaaaaucaucuuaaauguacuuucuccaguugacucuaaaaccauuauaauagccuaaaaauugaaucaaugagugaauuuuugguuaauucauauaugaaacugcuccuaaaaugcaccuagaugccuucuguaaucguagaaauuuaauaaccacuuccuccuuugauauuaaaaaaaggauguacauuauuuaaaaagcauaagucgcuacaguacaaaaaggaacacuuaauaauuaucuuugacauggcaagguaaucuuacuucauauacaagcucauggugaaaaugagguacuuccaguuccuuaaggcaauguucagcuucagauaugucuccagagaguaaauauucuuucagcagcauaucaaucuauuagauuuaaaaguugagaugugucagaauuccuaacuuuuaaaauaucgugcuugccuacaggauuauuugcccucauuccaauauaaugaaauaguggguaacaaacagcuaauaacauauacauuggaugugguacuauuacaacagaauuuuucauaauuaaaaaauaaauccccaauuuuuaaaugguucauaauuaugauucaaaugcaaugcuucagugugucugaaucacugagaacuacgaauagguuuauaaugcaugcguccuggguugugaccauaaugcucuagugugccacuaaaaauaagggauuuuaaauaccacuagagggcacuaacaaaguuucaacauaaaguggcacaaaauauuucacuucuaucaagacgcucuuaauagugcacugagagccaaaaaaugagagaugauaauggggcauuacuagagagggcaaagauuuccacauaguuucucuuuucucuacaacugagaauuugaaacucauuaucuaaaauguucaauaauucaguuuccagcuguagcuaaagagacaagucuugauuuucccgcucaaacuugaacaucucaaaaaagugggagaacuuuuucagcacaagaguuucaacuaggaauauuuuucccuauauguuauuuguuaaaauccccuuuguauuuggugggcacauaucuaguugccugaauguugaauguuggcugacugaauuuaaaaaaucauauuuaaguauccuuccaacuucuauaagauauuuucauaaaagguaaaguaaaauuuaauugcugucaugcuuuaggauauaauauuuacauguaaguaaauauguauuuaaauauuuacauguaaguaaauauuuaaagcauagcauuugaguauuuuuacaauuacaaacuaaugcauagucaugcaucguuuaacagggauacauucugaaaaguguguuagaugacucugucauggugcaaacaucauagaguauacucacaaaaaccuagaugguauagccuacuacacaccagugcuauaugguauagccuauugcuccuaggcuacaaaucuguacagcaggucacuauauugaauaauauaggcaauuggaacacaaugguauuuguguaucuaaacauagaaaagguacaauaaaaaacaguguaaaugauuuuuaaaaugauacaccuguauagagcacucaauaugaauagagcuuucaggauggaaguuacucugggugauucaaugagugagugguuagugaauguaaaggccuaagacauuacccauacacuggcuaugcacuuuauaaacacuguauacuuaggcuacauuaaauuuaugaaaaaauaaaguaacugugcuacaacauuacaacugccuccauaucacucaacgauaggaauuuuucagcuccguuauaaccuuaugggaccaccaccaucccacacaguccaucacugaccaaaacaucauaauguggcacgugacuguacuuguuauucaaauuauauuacuuacuuuuaacauuuguuacauaacuuuagaaguauuaaaaauaucccccaucaaauuccaugcacuucugagaaugauaaauuacaaauacauuuauacauuucuaaaagucuucuuugauccaacccuuccauguaagcaaauauccaaauaaugucaaccucaaacucauauacuggcaguuuuauuuccauuuuuaucuugucaauuuucuuuauugagagagaauucacacaccauaaaacagcuuguccaguuuccaaaaauauuaauuuuggagaguauuaccaucuuaacaauauuaaguauccucauccauaaccaugggauaucauucuauuuauuuaggucuuccuuaauuucuuucaaccuguuuugcaguuuucaguguacaagacuugcauuugucuuguuaaauuuauuccuaaguauuuuauuuuugaugcuaucacaaaugcaauaauugcauuucagaucauucauuucuacuguauagagaauugaauuuuguguacugaucuuuuaucuugcaaccuuucugaacucauuuuuuaguuaauaguuugguuucaguuuuggggaguuaaaaaauguggauucauucaaauuuucuguauacagaucauguuaucugggaauacaacuaguuuuaucuccuccuuuccaaucuggaugccuuuuaucuuuccugccuaauugcccuggcaucuugacuauuuuuauaccucaauuuuucuaauaauuguuuaauuuuuaaaaaacagauacugcaaucacgacauuacaaacacugacucaucuauuuuaacauauauaaaagcaaaaacagucaaggcucuaacuacaauuugaacuccuuaacacuuaagcuagauacacauacacaaacacacacacacaccucauuaaaagacuuacuaaaaaucaaaauuguaguuacaugaaaagauuauacucaaaaaucagaagcacaugaacuacaaaucuucuaguugcaugccuuuucuuaaagagaucugcagauaaggaguuuuuucuguuuuuugguuucuuguuauaggacaccacauugcagccagaaaaaaaaaaaauccauagggaauaaaucuggcauuuuaaugcaauaaaucgcuuuuuuuuuuuuuuuuuuuugagacagagucuugcucugucacccaugcuggagugcaguggugugaucucagcucacugcaaccuccuccuccuggguucaagcaauacuggugccucagccucccgaguagcugggauuacaggugcgcaccaccaugccuggcuaauuauuauguauuuuuaguagaaacgggguuucaccauguugaccaggcuggucucaaacuccuggccucaagcaauccacccgccucagccucucaaagugcugggauuacaaucaauuuucuuuuaaaacaugcauauggguagugaauguccucacaaaaaucuaacacucugaucugcucuagugcucauaauucauaacucauuauuuaagacuaucuaguuuuaaauugcucauauaaaagcguauuuauugaauagcuaaaacacagaaaaucucauuucaacagcauuugaaaauuauuaaauaauacuauaagaaaaagauuucaggcauuccuuugaaguucauagauggcuugcuuauaauuauucaugaaagccauuuuaacagacucauuuuuuaaucauauaauuuauaauaaaagguuauaaagccacauauuaaaaaaauuauuucauuuuccaauugcagcuguaagaccgaacuuaauuuuuguccauaaaaauaccagcuaguagccacaauuuauuucacucagaggaauacauauaaauuaaguuaaaaacaauacccaaucauuaccucuuuaacaaggugauugacagauugcugcccaccuccagagccccacacacuaucuuuacgcuuuccaccuuuagacauacucagaagcacgguagccuuauccagagcagcucuacagagaaagaaaaaaauuuaaguuugauagcuggacauaccuaaaguuuacuaaauuagggauaaagcugacaaaauccuauaugcccuaaaucuuucacauaacauaaaagcaaaauaaaauucaaaacacuuuuucaaaacaaaaaggagcaaaaagaaguugauccucauguuaauauucucaugcucuauuucauuucucauucaagaaaaaucaaaacacauuacaaaauaacugaucuacacugagaagaaacacuucacauauaauuaacuuucaccuagauccaugccuuccuacccagggacaccauuccacuaugaugugaaguagcccuagaaaauuaaguuaauauauagaccugaggaaaacuaagacauggcugaguccaagucuccaagaaguuaagaaaaaucaaauagcauaacucccaaauaucacauuuaguuauaccaaauaucauauuaauuauacuaaaucacaagagugaaaaagauacuuucugacuaagauuucuacaguagauaaauacaaaauaaaacuauaaaucaggccucucuucuuaagguuauccaucuuauuagaauauuaaacuauuacacaaugcuagaaccugaaaacagaacuuaaagaucuguccaaugguuuuguuucauaaauaaagaaacugaggcccaaagaagaguggcuugacaugaagguaauuaaugauuuagcuaaacuccagaacuuuuccauuauaguacuguccucuuccugguauaucaugccaauagucucuccauuuuaacaguggagaauauagagaagugacaaacagauguacagagugucugauuaacacaagugucauuucaauaggauccuguagaauuuuccccuauuuugaaauucuaaguaggaaaagugauuuacuuaccuagccugcacacaaucuacaguuccuuuguaacuaucaauauagguauuacauaaaauuccaucuccaacagcucuagcaauaaacuggcccaccaacuguaaaaaggaaaaaaaaaagagcuauaaaaaaaguuaaauaacuuuuauaggucacaauuucuaaauacauaaaugaugaagauuagcugaaguacacagucaguaccuaaaagaugcuggaauuuuuuuuuaaaaaaaaaccuauguaguaccuguuaugccuggcauacacucccacaucuuaaccuucaaguuaagugccagagugggggccacaucuguuuugcucacuaaugaaucccuaacaccuugcacacugccugaauacauagcauaugaucaaauuuuuuuuuuuuuuuuuuuuuuuugagacagagucucgcucugucgcccaggcuggagugcaguggcacgaucucaguucacugcaaccuccaccucccagguucaagugauucuucucccucagccucccgaguggcugggacuacaggcgcacaccuggcuaauuuuuguauuucuaguagagacggggugucaccaucuuggccaggcuggucucgaacuccugaccucgugauccgccugccucggccucccaaagugcugggguuaaacgaaugauuuaaggucaagugacguccucucuucuuaaaacaaaacaaaaaaaaaggacuagguucucucaaaaacuaaucaaaggaauuuaucuuguggagaaaaaaaguuguauagaaauaguugaaaguauguucacagcauuacuuauuauaaaaacuggaaauugguguccaaaaauaaagguaugguuaaaugguauacacauaaaaugguauacuauguggccacagggaaagauauuuaccauauuuuaugguaugagaaaaaucaaguuuauaaaauagcauaaugguaugauuccauuuuuuuaauuuuaaaaaauuaaggauuuauagaagccauacauugauauauacccacagaaaggagaauggaaaacuuaacaccaguagcaguuuuugcuggccuuucuucuuucuggcuuuuauuuuucaaaaauucuacaauaaauauaaacuuauguaaucauuuucuuaaaguauguguauugguauaaaaggaaaaaaugucugcauuagaaucaccacuuaauaucucauaccgaguauugucugucauuaaguuuaacagaaacagcauuuaggaacugacaugccuauauucuauuucuaaauuaauguuuuaaguaaagugauuuuaccuugauuaaaaacuuuugacaauagcaacaauuucacauuuucaaagcuacaaaagggaagagucuuauuuaugacuucuuauaauaaacauuagugaagcauucaaucauaaccuacauuuuuuaaaaaucuuagcuaauaaaacaacuacauauaacaaagacuauauauauggcaaaaaaaaaaaaauuaccuaaaaacuaugcagaucauaggggaaaaguacaagauaacauuaaauuuauagcaugaugaagaccauguuuaaaaaacaaaagaacuaggaaaaaauacaucaaaaugcuagcggaauauuucggugucguaggaaauguuggccauccccuuccaucuacuaaaauuuccuaggaguauacauuauuuccacaauuaggaauauaguagugggagggaaugaacaaaaagaagaaucauacaaaccuguggugcucuaggaguauccagugcuaauucagguagaucuuucaacaauuuaucaaaugauuuuuccacaucaguugugcucauuacugucccacaaaggucagaaagaagcuuagaugucaucucucuaugacuagccuuccccuccaaugcuaaggauacugccaacacugguacuccacuuuucauuucaccaagauuuaaaucucuuaacauuuccuguucaaaaaaauaauuuaaaaacauuuuaaaaguguaucacuaccuauaguucaauaaaauuuuauuuuugaaaaauugagcuuuuaucuauauaucucuacgucucacucuuuggaaauaaucaaaagacccagucauguuuuagaagauaggauaaacacaccuuucccugugcauaaaucagacauugauccacuuugucaagcuuuaacugccuuaacaucgcuaaauucaaaaaugugaaauaccuuuaaaauacugucaugggucacgacacagauacauucugagaaauucaccauuuaggugauuucaucagugugcaaucauuauagaguguacuuacacaaaccuaaauggcagagccuacauguaggcuacaugguauaaccuauugcucccgggcuacaaaccuguauaguauguuacuauacugaauacuguagacaacuguuaacacagugguuaccuaucuaaacacagaaaagauacaguaaaaagaguauuauaugagaccaaagguauauaugcagucugucauggaaacgucauuaugcagcucauggcuaguucauuaaacuacauaauauugcugagauugguauuaggaguuaacuaaccugccuuacaaucuauuauuacuauaaauauuguuuuaugagaauuuguggaaaaauucauuuuagauuaucauaagcuauuuauauucuacuuuucuucaaagacuucucuugaaauaaaaauucacuucacacuuuuguaucaaguuuaaaaugagaucuuaaacaacuguuuuuaaaugggauuauugguuuaagauucugggguaaauuuaaaauuuccuuuuagaaauauaauagcugcagcuaauacuuauugacuaauguaucaggcauuauaauagccucuuuaguuauauuaucuuauuuaauacucaaauagcccuuugaguauuaaauuaucacaccuaucauacucaaaggagagagggcacacagcuggaguagccaaacugaaaguggaauaaaggcagucugacucuagaagcuaaguucuaauucaguuagagugcccuccucuuuaaugaaaguuuucuuagaaucuuuaaaucaugauauacuacuaagagagugccaaaacuauuuucacagccacguaacugguguccuuguuaguaaucucuucucacugacugcauuucaucuuccuugaccgcacuuuaacaacuaauccacuacccucaaacacaauacuccucuuuccuggaaaacuaucuuaacuggcgaacuccucaacauccuucagacagcagagaaucaucucuacuauuacucucuauuuuaugcuuuccaaacaguacucaguuaacagauacauaguauacaauugaucuuaugcuagguagauuaacaagauuucaacagucccugcccucauaggacucauggaaacuuuuccucuauaacagaacguuucacguauuuuaauaaucuguuuacauaucauuucuuucacuugacugggcuucaaaagggcaagaaucaccuauuacaaauuccuccagaugguaugcacugaacaaauauuugucuuauauucaaauccuacaaauccaaagauaucaaaccucacaguaucagacaaaucauaaaaguccagucuaaauuuuaagaaucuaaaugaucaaagucuucuaaagaguuacaauuguauuacuuuaauuugauaauccuaacuagaccaaugguuuuauuuuauccuagauuuacuuuaugaacaaaucaugauuauucucauggcuucuguauauucuuuuucaaaucuuuauuauuugugggguuuuuuuuggacaaaguacaaaaagauuuuauccuacuucugaacauacgugaaauaaaugucaaaaaaaugaaacuaugucaggcauucuuaacugagaucccugaagagguuucggggggcgucuagaagugcccucaaacugcuaaaauuauauuuuauaaauuauaaaaacagauuuuauaaauucauauacauuacaaauuauaauuauaaaaauuauaaaaauauugugucauuuuucagagaacaaaauggcacacagcucucaucacaucccaaauauauaacuguuuuaauguaaugagauuuuauuccauuucuuagaaauucacuuaugcaaaagaaaaugauuaaauuuauucagugacccaagaucauuguagauguauuuugcuuauaaaagaugucuucucuccuauauuaaauaaauuauacuugcaacuuuaaaccuaccgcaacuucauuaguaucuccaugcucaaaauauuccuguaugauugguguuaaagucuucucaaaugcccuuucauccaaaggcaaaacuacaguuucauaaacacaguucuccuuugaggggaaaagggaguaagaguuauaaaaaacaaaaugcaaauaaacaagugaaauuguuguacaauuuuauauucuaagugguuaauaauccccacuuagcacaagacaaagacaugcuacauacauugaucgcauauaaaaauagaaucuaggccaggcaaggagacucauaccuauaaucccaacacuuugggaggcaaaggcgggagguucacuugaggccuggaguucaauacuagccugggaaacauagcaagacccugucucuacaaaaaaguuuuaaaaauuagccagacaugguagcuugccccuguaguccuagcuacucaggaagcugaggcagaaggaucucuuaagcccaagaguucgaggcugcagugagcuauaauucaucacugcacuccagccuggacaacaaagcuaaaaaauaauaauaauaaaucauaauaaaaauaguagaauuuauaugucacugcucuuuuacaaaaucagaauacaauaagccaauauauagauuagaaucauuaaccacagcaaauacauaauuugcucccaacccccaugucuucuguuaauuuuuucucucaaaauuuuuaugucucucucaaaaccaaucuuuuaguaaucaaaaaguuucaugauggcuuccuaucauaaaugguguuuuaauuaaaauuucacuuuaaaaaaaaaugaagcaggaaccaaagccuucacgauuagcauuauuauaauaaaaaguauaacacaaagaucaauguuguagugacagaaaaaaaaucucuaaggaaaaaagcacuguucaauugaaauuucaaaaagaaaauuaacauccaucaucaaaccauuccucucuccccaugcuaaaaaagcucugaaauguagugcccccuuaucuacaagggguauguuccaagccccguccgaggaugccuuaaaccacagauaguaccgaacccaauaaauacuguuuucucaauccgauaaccuagacagcuaccaugugacgaaugcacgaguaguguauacauugcggauacacgcuggacaacggaauggcucacauccugggcaggaugagguggaugaagcuggacagcaggagaucucaucacacuacucagaauggcaugcaauuuaaaacuuaugaauuacuucugaaaguuuccacucaauauuuucaaaccacauuggaccauggguaacugaaacugcggaaagugaaaccacggauaagaggggacugcuauauuuacaacuugugacuggcuucagccuaaaaacauauacuugaaagauuaauacauuuuuagcaaagauucuacaguacuugaauccuacuaguuucauauuuuucauguucucuuagaaauauuuccauaucuauuaguuaaaacacuuaaauacauacauacaacacacaauaaaaacaaccuaacacauacucuuaacguuuuccugucuaaaauuuccaucaccgugucucaccuugugcaaagacaaauuuucaaaaaacauaaucaaaacauuugggauuugcuucaaaauaauccaaaacaggguggggcaaaggggccaauagaagacggagaguaaauggaauuaaacaagacugccuaugaguuuguaauuauuuaaguuuguaaagcuaagagaggaguacaagcagauuauacuauucuacuuuaaauuuuuuccauuaaaaaaaauaaaaaauucacuucacaaucuauuaaaaauuuacauuuucagcauuaucccuaaaagaaagaugcgcauguccccaaaacaaaauguauuauauaguuaccauucuaaacaguaauauuuaaaaggaaucuaauaucuguaacucauaauauucaaaagaagauauucucaauuaucauuacuauagaaacaaacuauauuaacagaauuuacugaaaaauggacaacuuaauaauccuaagugaauuucuaaagagcuauuuuugacucacuacagaaaccaagugaaaguuaugcauguauuacugucaguuuacuugguuuccuaauccaaaacauuuauacauaugauuugacacauguaugaguaaacuacaaacaugaagucaaaaaaguucauaaacauuuuaaauauuaugaaaaagcaaagcacugauaccuggucaucaucauaguuaggaucuuucacauccaccuccuccacaucauacaccuguccagguguaccccagacaccuuugccuccugcaccaccugaaaaaguuuagcauugagaaagaaaaaacacaaaauucaucaauuuguugaaaucuaaaauaaaauguuccgauguuaaacaacagcuaaaaaaaaauuguauuuaacguguuaguuuuuuuccaguuuucuuccccuacugguuuuuguucagaccacucuuucaauauuuccaaaaacauuaaguuaaaauagcuuaugaaguuaaaaacuaaaaaagcagaugcuuuaaaauaaaagcaaaaacaaauaaagauaaaaaaauagcuauauugaggaccucaaaggagaugauauugcagcugagcucuaaauuuuauucgacauuucuuugagacuaagacaaaaagaaacauucugggccgguaaagcuuagcauagaaaacucaacaagggaaaaauuauuuaacaaaaaaggacaguaaccaccaucaaauauuuuaaggucaaauacaguacucuuuaaauauuaaaguacacauuaaaccauacaacuagcaauauguuauaaauauagaaaagaauucuaacugcuuuuaagcauuaacagcccugaaaauucuguuuucuaaauacaaaacaaccaaaagaagcuuaacaauuccaauuuucaaaguugcuuuucuacaucaacuuacugaaauguuuuaaggacuaauguacuacacuauuuuuuaaagaaccuuuacaaugucaccaacauuucuguuuuuggagguuuuuauuuuguaccaaguauauccuugccaucagaccaaaacagaaucugacaaccagguuucauuuugauauaaaacaugauugcagaggcauuuaacaaaacuaauuuuugacagaucacaaaaacauuuuacaagaaaccuaggcuauaaauugaaguucccaccauucagaaggugaugaaaucgucagaaaacucuuauucaacaaauauuugccuacaguguacuagucacuauuucggguacuagagaaacagcagugaaacagaccaaucuacuacagaacccaaaauaaagagcuaaagagaacucaccgugagaucuaggaaaacauuaaaauucagaucuagacguuaucaaucaaauguauauuuauuaguaguaguaauggacauaauuauauuaaauaaguaugauggauuucugacuccuuucaaacuuagagaauauacguaaaacucguaacagugaaaaacaucaguguauauuuugcuggaaauaaaucguuaacauucugcucaagaaaauuaaaucuacucaaacaagaaaaaacaucaaccuaaagaaaaagugagaugguucucacauuauuacuaaguaaaaauauauacaaacuguaaagccuuacauuuucacuuuuugaaucucucucauuccuagaacaaggaaaguguaguacaagaaccagacaauuuuuuuccacuuguuuaucuuccauuuguuggacaugauauauaccaaccuuucuuugguaguccccuuccuuucccagaucuggaucgccuauccagcaaccuucccuuuggacugguuggcacaguuaauccacuucuaagggcgucacucccacugucgcugaccgaaucgccucugccagagucccgggaugaguuuuuccuuagucgccuuuuugccuuggcauuaauucuagcuucguuaauggaggaugcugaaauccaauuuccauuuauuucauucuuuauuuccucagucccagcauuuucuucaucaccggaaaagagagagucacuuaaguuaucaggaucuuaaagagaaaaaugaagaaaaaaauucuaaguauuuuaaguaucuacuguuuuauagauauagugguaaguuagauuagguugaaucacaugacauuaccauuuuuguagguaaauuacagucacauauugggaauuucaucuacuucaaucuaauaaacaacuaaauaagauuacuuuucacauuaucaaggaaaguaaaccaaggcacugaauuuuaacaaagcauguuuguuucuuaccaaaaacaaaccaaauuuguuuguuuuuaccaaaagaagcauguuauuucacguuuagaucauaaaaucuaugcuaacagcaacaccaaauauaaaacccuuagacuuuuaugagcuaauuggagauauuaagaaaagacaaagcaucuugagaagagagauaaacuaauauuuauagaaugccuacuauuaggcacugugcuagacacucuaucauuuauuuaugcacaaguuuggcaguuaauuauuauaacauugaagacagauaaggaaacuaaggcugagaauguuuaaaugauuugccaaacgucccauaacuagguauaaacacuuaagaacuauuaguaauccaaaagagaaugaaaggcauuuagcaaauaaucgcauaugauuguugagcugaacugcugaugcuuuacugccucaagacaaaguuugcuuucaagaaaagccaacaucucaaaguccuaauucaucucccuaaacuuuucuccuauuacuuaccauccuguaaaucuuccagccuauauaaaauugauucuucugaaagagaucaacauacuggaguucccaguagaaugucgcccucacuguuauuuucaguuaucaaaauccuuuaggauauagcccaagucuuacucccugcauuaaaacuucccuuacaacucuagguacaggaacacuaauugcucacauacuauucauucaacacgucauggaaaucacuuucuuuuuauauagcagucuuuuucuuccaacuaagucauaagcuucaaaggagaaaccacaacuagacuguauguccuucuuuguauccccaucaccuagcagaguguccuucauacucaaauuccauggagaucaaguggaggcacuuggcuuugcccugaaagcucuuuaagucagaaaggcuacugaauuagcuaccacugggccacaguuuuguucauuauuguuaacgcaaaucagagcugaaucacucaaaucauuuucuauaugccuaaagauaauuauaacaugucaggucuaugugcaugggcuuuaauauguuuuaagacauguugaaaccaaaaauuuucaccaaccuauaaaaagcauacauguguuuaaaucuuuacaauucuugacauacuuaggaagguaggaauguuuuguuuuaaacaaaaucaucaauuagagccaaauuauuucacuagucucauaaguagucucccugccuccagucuucaaacuauacugaaugaagacugauuuucucaagcaugcccucacugaagauccuuuaaaaguagucccauuaugucacaaaaaauguaaacuuuuuuuuuuuuuuuuuugagacagcgugucgcucugucacccaggcuggagugcaguggugcaaucucagcucacugcaagcucugccucccggguucacgccauucuccugccccagcugggacuacagaugccugccacuacgccuggcuaauuuuuuuguguuuuuaguacagauggggucaccguguuagccaggauggucuugaucuccugaccucgugauccaccuacgucggccucccaaagugcugggauuacaggcgugagccaccgcacccagccaaaauguaaacucuuuaccuuguaacuuaagguccuuuaugaucuugccccugcuuaccucaccagaaucacugcuaacuacucccacacucaaauugucagagcuuaaguuagauaucauagggaagagaugggagggauucauuuggcagaagaauacugaguauauuacaaaaagagaaaguauaaaguaggaaaccgcuaagaaaaugcuucaguaauucagucacaagcuaacugguaaagagcaaggguaguaacugugggauaaauaauaauguuacacuuuuaaagaaaauaaugaaggacuuuuaagcagaauguaucuaggauuaaagagaagucaaacaaugccuuaaaaguuuucaaacugguaagaagccgguguuaggaugguguguuugggacaucaucauaaccaucaguaguaauuauagucuuaguggaaguagucguaguacuguuucuuucaucauuaccauuacuauugucaucuauuagauaccagguuccacacuaccugguaccuauuagauuccacacuaccugguaccuauuagcuaaggcacuuuacauauguggucuauaagcuucaagagcucuagaaagaaacuguuuauccucauuuuacagaaggaauguguuucacaagaaguuacauaucuagaaaggauuauggcuagaauucaaacccacauuuuuaaucccauauaacuacagaaaauacaaaacuagaauacagcagaguauugacagcuaaagagacgaacaagggcgugaauguaaagagagauaaacaaaaaugauuaaguggaaggggacagaaagaucaggaucacauaaauuagaugacauuuucguguaagaguggaugguugagaaaaacauuaaacaucuaccuguaacauagugcuuucaucauugugccauuaaggugaaccacaaaacugguccagaagacacaggagucagaacuauaauaaaaugucuuaaacugucccuuggaguauucaauuuaaauacaucuauuucccauaaucgaguuuucuuuucuucaacaauuuuaacauccuuucaaguauguuugugucucugcagcaguaaacauucucucaguauaauuuauauauuugaccuuaucauuuuuaacccauguuuguauuaauugcuuuauauuuuguuacucauacucaccuaacuguuggaguuccauaaccccuauugagcugacuuuaagaaaaccaaaauuaaaaugauaagcugaguacagaaugugauugacuucaaaauuguuuccuacuguguacuaauucccucuuucugaauucugauaucucaauaguaaccacuccaauuguauaugaccacagcaccagaaaaucacauuuucaauuacugguguccaaugaguggcauaauuagaauaacauuaccacacuuucauguauuacauaccuaguaugugcuucacagacuuaacacacauauacaauaucucacuaaauccuaauuauaaaucuauacagaggguauuuauaucccaauuuuauacaugaaaaaacugaaggucagaauaaccuacuuccuccaaguaaaagaguaagagugugacuuggacuauuugcuaugugaagaauuuacuacaaagagggucuaucuuaggccuauucaaauauugaagaacaagucuuuuauuuuaaagcagugcuggacacaagcaccaagaacaggguuagaacuaggucuuauuguaguuaggaaacaaaaaguacacauuuuaaagcuguguuucuauuucuaauagaaauagaaugcaagccauauaagaaauuuuaaauuuuccaguagccacauuaaaaaguaaaaacaggugaaauuaauuuaaauauauuuuauuuaaucuaauauaaccauaucaucucaacaugcaagcaauauaacaaauuauugagauaguugaccuucaucucaacucagaguagccacauuucaaguacucaacaaacacauguggcuaagcacaguggugcacacgccuguaauccagcuacugaggaggcugaagagggaggaucacuugagcccaggaguaauaaccacauguagcuaguggucaccauacuggacagugcagaaaagaagcaauuaccuauauguaaaauauauucuaaacuguauuaccauccccaucucaauuaaguagguacauauuauccauuuauaacccuaaagcauacucauacagcuauuguauacagcagcacagaaaugaucauuaauuacauaaauuuuuuucaauuuuuuaccauacuuuaaaaagaucuguaaauaaacaaugguaaagaagcuucaaauucaacauguuuguucagaucaaagaaaacuauguacauuguaaacaauagugaguuaagucacugaggaaagaaagauguaguauuuaguuacgaaauacacuuaaaaugacagaaaauagcuuucaauauuaauaaaauuauaagacaaagaauuauccaaaguauaccaauaugaacuguucucacuauucagauauuacacaauucuaauuaacuuuuugggagauuauuuuuaaaacuauaaauacauuuuaaauuaucuugaguuacucacauuuggucaucuauuccacaaaacuguucauuuuuaugauaauaacaugcuauugaagcaccauggagaauuagggaaaauacccuagguaauuuagaauauaaaaauuauuuguuaggaaagauaccaaagauaccaguaaguuuauauuacagaaaucacuaacuagcccaugugaaaauaagcaggcucacuauucuucucuauucuguacuauauaacagagaauaggaauauguggaaugugaaaggauaggcagaaaaauaggacauguaaugaauuuccaugaaaauaaaaaucacaaacuugacuuuaaaaauaauauagccuguuuucuuacagcaugaauaaaagaguauuuaaagauaguuuuucuaucauguuuuuauaaaauauggaauggucugaagcuuccucacaacauagucaagcuucaagauauuucagccuaggcaacauagugaaauccuaucucuacaaaaaauaaaaaauuagccuggugugguggcacacaccuguugucccagcugcugaggaggcugagauaggggaggaucucuuaagcccaggaaagucaaaacugcagugagccaugaucacaccacugcacuccagccugggugacagagcaagauccugucucaaaacgaagaaaaaaagaaaaaaggauauccuuacuuaccugcaggguuuacauucaguaucugcucauuuucuacauccauuuucccuuaauuucgcuugcacugauuaaacaaauuaccuaauggaaaucuuccuucagaaucuguuuuuuuaaaagaaaaaaagaaagcuucaagaucuuuuaaacugauguaauuaagcugaauuaaacuuacuuaagcacacuguaaaaacaaacgacaacaacaaaaaacacacaauuccauuaaauaaaacaguucacuuuacuuucaaagacaacuuacccuaauuaacauuugguuccaaucuuuuugauaaauuuaucaaagucaaaaaaaaaaaucccagauuucagcaugugccaaagcaccccuuuaauuggaauuaaaagauauguuugugauacauguuuacgucaaguuaaagaaauacacacauccaaaucuuuuaggaauaccaagccucaaaauuaaucugauauacauacauaggaauauaaauacuggauaguucccuaccaaugaauuaugagaacuacuccaaaauaaaaacaacacaguuuuaguuaauaaagaauaucacaugacuguguuauuuuucacauuacggcauaucugaaaggcagauauaucugccacucauuaccuaggucucuauaauuacuagaauaagacuuugggagaaacuuuuaaaaucagcuuuuuugauaauauuauuuauaugagaaauccuuuuuugauaauauuauuuauaugagaaauccauuuuuuaaaaaucugaucauuucagaaaggaguaaguacaacgacauaagcauuucaguauuuuaggccucaguuucaaaauggcuuaaaaauuauuaauacuggaagguuugaugaaaucaguuaccuuuuagacaauuaacuuagugauacagauccaauaauguuauaugaaagaaauaucaaaauaguuuucaaaaaauauauuaccagaaagugcaaccaaauuaagauuucagaaucucucuagaaguauuuuuuaaauagugguuuagaguacuuaaguguauguuuaagucacauagguuggauauaaguccuucuggucauuuacaaucagguugcuagcagugugcucuucagagauauaaaaugcacaaauuagugaaaaugccuaauaaauuaauuacagaaaagcacauuuuuuccuauauaacuuaaccuacuguuagaugucauuuuaggauaacaaugauauauacagagccuccugggacucaaaggugaaacugacuuuuaaauuccucauuauguacuacuauuugcuaacauaaguuuauagcccuuuucuucagaaaacgguauuauuuugugaaacaaaaacaaauggaccuuauguuaaaauuauaggcuucuuacuaugguauaauccucagacuaauaugcuaucauauugcuugggaacuuaagaaaauggugagaucauucucuaauucuguuaagaauaaauuaauauaugugaaucuuuauaaucacuuuucacuauaacucccgccaacuuuagauaugaaaaaaaaaucuuaaaaauauguagagauucauauaaauauaugaacaaaaaugguuugcaaaucuaaacacucagcauccuucauggcugaaaaggcuacauucuguuuuaauuccaugcaugaaauacauauaggaaaggaauaaugucauaugauacguguuucaguuuuuuagaguuccauuacaaagucuuuuucauucuugaugaaaguauaacuuuugagagaauacuuucugcagaaccuaauaagcgaaaugauuauaauugauguucauaaagcccuuuacaauucaaaaagaauuguacauguauuauuuaauguaccuuacagaaaaaccuucggguagguauuccaccuuacacacaacuaaacagauucagagaggguaggugauauguccaaggacagacagcugcuuaguggaacagccaggaugagaauccagaccuuccaaauccaguacuguuugcacaaguucaauccaaaauuuuaauaucccacaggaagauucuuuucaaggguuaacagaagcuucuuaaaacagacuucugcuguucaaacuuuuaaaugcuguuuuccaaacacuaaaaauaauuauuuuaaacuauuauacagaaggcauuccgucagacaaaacugucaggaaaugacuaucaucucuuuuauuaagauaaaaacaaaguuaucuuaauaaaaaaaauaguccugugucuuuaggcaaugauaacccgaucaggaacucaagucauauuugacagcaacaaacacguuuuaagaguuuagauaagacauguuccacguuuuuacgcucuuuaaaguaguaggauuuuuuccaauuuauuuaacaacccuuaauuggcccaaacaagaaaauauaaagcaaaaaauccaaacgcuauuuccuucauacuaaccuacaaaaaugaauuuucgaugagaaaacuauacauacaaguuagaagaaaaugaaggcugacauuaaacacuguucuuuucuccaguguguuacacgaaauauacaaucagaaguauucaacugccaagacauucccuaagagacagacccuccacucccccacgaaauauauacauauguauuuccugaaauauaccucauaaauugcucuggcauuuuggggagucaagcuuuggccauuuauuaacuaggauuacuuguauucauucuucggcuacgaacggcuaauuagcagcuuaaaaccagcuaaaagcauucuacuacaguaaugcaaaagcaagcacuacagauaauauucaagcggcauuuauuuuugcaguccuaauauuuuuuccuuucacauuaguaccacagaaaaagccagucaauuauaauucaaauacacuuacugagauauuaacguauucaauaagccuauaaugaaggaauauuaagggcauaaauaccaguaacuccuugcuuaaaaagcacuuggugguuucccaaaaaagucacguuaagaauaucaagauuguaacaauuaaaguaaaaauacaaguuaaaaacaggggaaacccuuuuuuccccgacaccuaaucgcauuucugaucguuuucaucauuuguagacacuacacaguugcuggcuacguagcgaguucucacaagggggaggggggcgaaauugacgucugcagacaguuuugaagcucuugcaaaaccccauguacguuacagcaucaaacugacaaauggagaagauggcaugcguuucacagaaagggggcucccuucccggcuuuguuuucucugggagauuuuauuuuaccuaaacuaaaaaaaagagacccuuugccggaagacgggcgcgacgaaguucgcgcagggauggggcggcgggcacguguucgccucccagcgcccccggcgaggauagcgcgcggccccuccccacagcggccgggccuguucucccgcagcgggcucaggcuaggacccccgaagucccagcccgggucggcccccggaaggggcugggccggggccgaggccggggcuccggguucacgaaggacagggggccgcaucuucagaggauucccagggagggcagggggcggggagggcgcgaaucuuccucacaggauuucaguccagccggaaacacgccuuccaaucccggcccccgaauucaaccuccgccagagggggaggagggcugagggggaccuucaagggcgagcgccucgcgcgccccucucaguggggagauggcuccgggagggggcgggcccgcgccgacacgcuccaggcugggcucagaaagagggaaccaggccggaugcccgcaguccggggcguuggggagggcgcggcuggaccugcggggcuacaagaaggcagccggacccccgcaccgcaggcccggaccugacaggaccgcgacccccacgccuccgcccccgcccccucccaucuugcggcugccuccgaggagggaugggggagagggcgcagucuucccgagcgugugagccgcgccuacugguacugaccccucgggcccccgccgcugcucgcccagguuccuggucagccggccccgaccccgcucuucugucucugccgccgccucggagagucucuggcccuucucgcucuguuuguuuuuguuuucuucuacccaguaacacgggggcgagagggcggcgcuuauuggccgaggccggguggucggcuggccaaucguggcggcggagccggagcugaggaggaaaagggagaggagugaaacguggaaaguuggggaggggcgcgggagggcgcaugcgcauguggcuccugggacuggcuggagcgggaguugagcgggaagucgggguggggguauguugggaggcguggcgggaugggagcguugggaaaagggcagugcugggggauggggacgaggaugaagcuuccucgacccagcucacccauucuccucacagggcguucugcaaacucggcugaagcaaagguuuugagcuuccugauggucccugccuccauuucuagaaacugcuuaggcgaacacuccaagugaucagccuguccgauuccuccucccucuggccgcugcuuucucuguggcuuccaguuucuggagaucccaugcuaagaaguuucucucagcgaauccccucaaaccuuugagauggaaauaauucccauuucacagauauaaagcaggcuccaaaacucuuugaaguuccuuugcuaaucaugacuagccaagccucuggcguucaaacgcacaaauuccggccuccagugcugggguucucagccauggcuacaauuucuguauugaaacuuccaccuccccucgcuguucucugugacuuuuccucuuggcugcauugguuuuggcugguacuauccuuacucuuucaaggucacgguccccugagggugauaaccagaaccuuaggcuuccuuuguguucccaggcggggacuuagccacugccucugaucagauuuuucaguugucugaugggcagcaccgaaugauugcuugugcucuccagaacccaacugccucaucccgcacaggccagcgcuuucccuuggcugcccagucacccugccugggaaucaucucuaaugcuacuauuucucugcacacacacgcacacacacacacacaaaccuucacuggcuucccauugccucucuugagugucagcgccucggucggucauucaaggcuccgugaugugacuucaagacuuucaggcugugucuccacacaucuccccauaugcuuccucacccccugguaguucuuuauauaucaccuugaaaugucucucuucucaucuccuaucuccgccugaugcaauccuucugugccucauggcccuuccugguaguuuuuuauuuuguuguuguuguuguuuuauuuaauugaggcaggggcuugcccuuuagcccaggagaaugcaguggcaugaucacagcucacugcugccucgaccuccgucagccucccuagcucaacgauccucucaccucagccuccugaguaacugggacuacaggcacagcucacuaugcccagcuaauuuuuguauuuucuguacacacaggguuucaucauguuguccaggcuggucuugaacuccugggcucaagcaaucagcccaccucugccucccaaagcguugagauuacaagcgugagccaccauuccuggacccucguaguuuuucuggagccucgugauuugauaugaucuuccugccgcugauuccucacaguguuggcuugccacaccuccaggggcacugaucacauucuaccuggcauuauuucaucugagucccuguccuagcccuucugcccauuagacuguaaccuuguuuagggaaagaccugugucuuacucaucugugauuuuguuguuguuguuguuuugagacagggucuugcccuguugcccaggcuggagagcaguggugcaaucuuggcucacugcagccucaaccuguuggggucaagccauccucccaccucagcuuuccaaguagcugagacuacaggccugugccaccacacccagcuaguuuuuuguauuuuuaguagagaugggguuuugccauguugcccaggcuucucuugaacuccugagcucaagggaucugccugccucggccucccaaagugcugggauuacaggcgugagccacugugccugacccacucaccugucauuguaguacuuaagaugccuuguucauuuauugugccugugcaauaaauacaccuugauuugaguuuacaaagauucucagcaguugguggucauccucaucuccugggcgggggccuccugguguggccaguaucugaauuagucucauaacucauguucacuuuuuaaaaucggagcuucccagaccucaguuuuguuuuguuauuuuccauuaucugcagcugucuccuuuccccucucucaccuauacucuacugaucagugacugcuggcuccuuuguuacccauccuucucuuucuccacauuuuuucucuucucaucccuuucaguucuggacuguuuccuucuuccucccugucuuucauuuagucauucauugaauguacuuacuaagcacauauagcauaaucaggcuguguuggguaggcaucccgaguucuaugagauaaagaaagaaugggauaugauuaccaauuuuaagaagcaucuaaaacaaccuguuauguuuuagcaaauugcccccaaaggacccauuagggaggaaaacguucauguccuuuuugcguaucaucucaagcaguacccaugauggcugggaucccagaacccaccuuugagaaugcugccguauuugcgugugguugacaagguugggccagacacucaggaaauaggguugucguccuaccucccccacuaacuuccuguaagaacuucagccccucucaggaccuuuuucuuuaccaauaaaauucagaaauugggcucaaucaguaauucccaaguuauuuuccaaagaacaugaauuuuguggaacuuuaauagauaucaugcaaaaaaaaaugugggagggauuguuccauggucaaauggucuuggaaauaacucguuuaaacaaaaauaaaacuguuucuuuacccacaacucuucucagugguuuuuuguuuguuuguuuguuuuuugagaugaaguuuugcucuugucgcccaguuuggaguguaauggcacuauuuugacucacugcaaccugugccuccuggauucaagugauucuccugccucagccuccccaguaacugggauuauaggcgccugccaccacgccuggcuaauauuuauauuuguaguagaguugagguuucaccauguuggccaggcuggucucgaaccccugaucucaagugaucugcccuccucggccucccaaagugcugggguuacaggcaugagccaccgugcccagccuucucaguguuuuuaauaagcuaugugccuuuagugucuugggagaccaagguaggaagauuaguaauguuuccuaccuuguuuaaacacagaaccuuuuuuucucaagauaccccagaagcaguguuauuuagaaaccaacuugggaaauauagaugacagccacugucaccaacauuccuuccagcuguguugaacacuuagucaccugugccuuugcagcugaacauuuaacaaaaaaaauuuuuuuaagaauaagcugaaaauggagaaguauccaagugccaagaauuuuugccuaccaaaucaauccacaaauauuuuagugugugccuguucuaugaaaagcacaguugauucagcuguguucuugguaaaaggcauuauacuacuuuaggguagguaauaucugaagccuagggcugcccgggcuucugggccacaauguauguuuucauuucacguuguaauugucacaaacuagguuucuguuaccugaaucccugugccuaugggcuuauguuaauuuagcuauuagaugacagaaaaggagagaggccuuccccuuaacucacucuauacagaauaauggaauugcaacuuccauuucccuuaagaaagauucauuccaagagcuuaggagaggaagggagaucacaguugcccagaacaagacagcugcucagagguggcaacagaaacucugugcuuugugaguagauaaacguuacauacuucaucuuccccguacuccucaggcuuaagcaguauugagauacuuggaggggcgcaaagaguguuugguuuugucaggggagagggugggagauaguuccuauuuuucgccucuuaagacaagguagugacccugucccuaacuagcuguguugcuuuggguguuucacuuccucucccugagugaauugaaugcuucaauuuucugugcuguaaaagaaggaggugcccauugcagggaguccauaagcagccauucaguucuaacacccugggaugcugagcaagguacugaguugguaccaugggaguccugggaauggagaacaagagauaagaaaguuugcuggccgggugugguagcucaugccuguaaucccagcacuuuaggaggccaaggugggcggaucacuugaggccaggaguuugagaccagccugaccaacauggugaaaccccaucucuacuaaaaauacaaaaaaauuagcugggcgugguggugcaugccuguagucccagcuauucaggagacugaggcaggagaaucucuugaaccuaggaggcgaagguugcagugagcugagaucccgccacugcacuccagccugggugacagagacagacuccaccucaaaacaaacaaacaaaggaguuugccacuguuggcaggagaggauuccaccggguauggacagagggacugucaacccaggggcuuucuccuaaugcaaagcucagauaauaucaccucccuccaucccaaaggcaaagugauggcugguguggguuuaggagcacuaauuaauuaauuuggguaaaguacuugaaaaagcacaguugaaggcaaaagauaagcaccuagauuuacuauuaaugccuuuggaacucuccaaggccuuuucauucuuaggguaaagccucauuugagaguucuguuucuuaauaagaaauggucaugccccuaaaugaaauugaggagaauuugucuuucugggggcuaaggguaggucuuagcccacuuccuuccuaagaaauuuuagaugcugcugucauuugcagcaacuucaucuaccugaacugacgccuugucuccuuuugucaaaccaaagccugaauuuugagaauuucucuaaggcaaaaauugcacuuuagcacaaaugguaaaagauauaaaacauguucugaagaaagagcugcauaaagaauucuuauaauaaugaugauagcugacauuuguguuggccuaagauuuacugagcacaugugcauagacuuucaccaccucccuaugaaguggacaagauucugugcuuuaaacaugagggaaauaaugaaccuugagcaggucacugguaaucauggaacuuuuauacugaaaggaaauuuggggauucccuaguccaaaccuuuuauuuuacaaauggagaaacagauucagagaaguuaagugggucaccuaaagccacacagcuaaguuaguagcugagccagaaguacauaugagaucucugcccagaguuguagggaaugugcagaccaggaauccagaccuucuggcacccaggcugggcuggacuuucccucacaugccucuugauugacaguuaaauuucuggguccuagaggcuccugguaucagaugaauccaucucaggggccugaaaguggggaagagggaaaggguaguaagcauuguacaacguuuagaaacccuucaaggggcauuucuugcaugucuuuccugggguaaaaagcaagcacagaguaaugugaagcauaguucaaaaaauagaugcaauauuuuacugugguauguaccaagaaaaauugaaagacuacuaagauuuuauuuccucaauucagguuucgaaagguuuucuuaguacauuugucuuuuaugggguuucccccccucaaaucacuccuaccaccuuagagauuuagaaaaaaagcucaauuaacauugaggaacuccagcaagaaaucuuucccgcaccauaucccccgccaaaacacaaauuuuaccacaucuccuauacuuggccuaaguucuaagccuuugcaaacuccaguucauuagacuuuugcaaacacagaccauuccacccgaugcuuuucagcauuuauuauaacugccacgcccugcauuuaauaguguugagucaggguagagaagugcuccuccaguuguaucucucggggcuuuauucgcauucuucuggaacacuggauccugggcuaggcuucacaugucucagaauuaauccucuuuucuccagcugcccugagugcacauagcugccauuaugccccccuccccucuaugucugcagugucggcuugcuucccagacaaggagguagggcccagaaagccugguauagaaaugaggaacuuuucauucuggaaaauaaaugaaaugaaugaucuuggguugugauuaagacagccaaaucuauaaggaaguacaaacagagaaggcuagagaagggcagggguaaggcagggcugaggaagggggauggcugaagagacaaaugcuggguagaaguuaauuaauggaacuaaucgaaccucuauuuauuuugagcaaaaauaaauaaauaaaaguaguggcaagagaagaacaagggaaacccaagaaagauguugcuuuuuguuauuaaauguuuauaauaaaaaugaagcuagccccguagaaguucagagaaaagaauaaagucccaggagaugaccuggugaggacaacuugcucagauaacaaaugagcaaaccaaggcccagacagaaguggugcggcuccuggcaagacacagacagagccauaggaccucauuccacggccaacagcugccuuccuuuuccauaugguucucugcaugugucuuguccuucugcccuguuuuuuuuuucuuuccaaaaagcuaggaggacagcauucagaaagagaaacuaggacuggcauuuguaaacaacagcuccaggaaguccccaaguaccgcaguugaaguaacaugauugacagucauucagcgcaauugacaaagccaacaucaaaacaggaacuagcaagcaacaggccacccuccaagaaccaagaguucaaaagaaagaaaaaaaauaacugcucaggggacaacugagagucuuacuaucguuucuuguguuacauaggucuaugauauguuuuguuuucagagagcucucuuugaggacaguaaaucuagcccagugauuuacugguuggcuucagagggugcaagaacacccuaaaauuuuaugcaaguuuuauuaugaauaugcauuugaugccacaaugggucaauaacuuuuucccauaaggcccccaaaagaaucaugucccagaaaagaucaagaacaucuggaauauguuucuacauuuauguuauuacauguuauuacauuugggcccauuuucagacuggguguuuguaugguaaaugcaucugauagcaauaacuaaagcauacccugagaaugaacuuguaugacaaaugcaccugaauguguguucugagcuagggaaucuggaaguggccaaccaggagauucguuccuugucugucaggaacaucugagcccccagaccauccugugaaacaugggcuguacagcagcuugaggcccugaguuuuggguugagugaagguugccagguggagguuauuagggaaaggaugcuaagugaaaaagauauguaaacugcaugccuuuugcaaucaguugugguucuucuguccagccggccaccacugcacuuugcaguuaucuuguccagcccaccaucacuggacucugucuccuguauguaagcccccagccaaaccccaugucucauuugcuggcucugggucucuucuucugccucuugauccuggcgcuauccccauuggaguagauagggguuugacacaacaguauuucaucaagagaggccaccagacuuaccuuuccucuguaugucaaaccaggcgcagucaaaguacuucaaaguaacaauaggaaaacaaaacaaaauugguuuuuaagacagcagugguccuaaaaagagaugaauugccaucuuggaacaccccauagucauuccagucaggccuggcaccuaccucccauuaugaugacuucaaugggccaaaaauauaagccaaaccucccaacauuuccuaaacaaaagucagccccauuacccaugaguguaucuuuaaaaaacucuugaacuuauuuaagagaggaagcauuacauggugucucucaaaauaugcuccacagauguuccaccacaaaaggguuuuaggaugaaguaaguuuagggaaacugcuaaucaucuccccucuuagaaaaucacaauaaauaaugguguuuuaaaggcucugagaaguucugucauaaguaacccauucaauuuucuuuaaccccauguuugcuguucuuaucugaccauaacacccuuuuguacauagugucuauuaacgucuuauggaauacauauuggaaaacacauuuaauggacugggaucuggacgagaaggcaagagguuuggauuccaauccuaguugugcuacuaauuggaaguaugaccuugaguaauuugauggcuccaaggguguagaacuuaaaacguuucccagauucuuucuggggcuguaaucuauccaauaugaucugugaguuggcugagaucuggucuaagauucugcuuauagccauugcccacgauuaugcauguuuucuuccaggagacuguguggugcaaugauuucacuuauaagcuaccuucucuuaagaacucuuuggaaagauaaggcaaacgucgaggcaccagaacaaaauguaaccagugcuguaaagcuuggucagcuuuauucacugugaugaauauaugugguagguccauagccauagaacucagcaaacacaaaggcagcugacugguggccaugugcauuugauggggcuguauuuuuggaaacuacacaaccucuuugaagccaccaagguuuuagcaacugugaucacauaaccuuaaagagaaaacuccucuuuucaaagaaccaaaguuauuaccacagguauuguuacucugugggagaacccccucucucagagaaaaggagugcugacuccagcuuaccuucaaaggcauuugagucaguaacagcccugacagcaagcuuucccagggaauacuagaggccugggaauacuuuaaguaccaccugugaagcgucucgagcucuugcacaauuauuauaaguugucuuaaugcgucacccagagcaguagcccagggugacacauuaagacuacacgugguuucugcauccuaggcacaggaaguuccguaaaauuuccacaggcagaucauggggaagacaucuuaaaaagcagaggccgcagggcugcaggcaacagggccagagauaagucagaacuuguuccauggaagggcuuuucuccagccaccacuguggcaguacaucaugucuuuguacugagguggggcuacauguuuaggcaggcugugcugugugcaucuuccuaccuaauauaaggaaucuucuaaaaauaaauccauaucauuaccccuuugcuccuuggugccucaugaaauuuagacaguuuagcaaagccuaccuauauguuuccagcugaacuuugccuuguguuugaaagccugggcucagcaaaugaguacuauacaacugugcaaaagaaugaggaagauugcuauauacuccaauaaaaagcucuccaagacuacauuaaguacaaaucaguguuaauauaugccacuuuugaauaagaaagagggguaaauaagaauauuuacucagacucauuuauauugacauaaacacugaauaacauauaaaaaaccaauguaacuguuuacaucuauaagggcagcaggcaguugguguguaugggauauacagagaccagcaggagaugccaggaggggaacaagacauuuaccuauuuauauuauuauauuuuuugaacauauuaaaaagcauaaaagccugggcucuggaaucugcagaaguugguuugacuauuuguucuucuauuuccuaguuuugagugaguuauuucacauuuucugauccucaguuuccucaccuguaaaauggggauaauuacaguaucguugaauuagggauguuauucaaauuaaaugaaauaauguuuguaaaguacuuaguaggaugcuugacauauugcaaguaucuaauaaauaauaauaauacuuuaauagcuuucgauauuauuuuuacuuauugaaaucuaacugauccuucaggcuuagguaaaguaaugcuucccaugagaaguuuuccccaggccagggcagagugaagagacucuuccuccauuccugccaugauaugccuaucuguuaucaugcugcuccccaagcucagcuguuuguuuugacaucaguuccccacuggacuguggccuucugaaaggcaaaaaccuugccccugcaucaggcuuauuguaggcaggugguugucaauaaauguuuggugaaagacuaaaggaacuaauaagauuucuauuuucuguacaagagccugucugaggcugcccacagaguuuuacuuccugguuuagcccggcagaugccuaccugucauuugcuagguguguguggaguuacucaggagaaugaacugcaauaagcuguccucagcacuugcagcucaugcuugaguuugcugugaauuugccagaaggugaacuguggccaucuguagaggccucccaggaauggcgggaagcugaagcccuccagggaccgcagccaugcuggaucccaggcagaacgcgcaggcugacacuccagcugucccagccugaggcagaacugaugcuucuacaucagcccaggggcuaggcccaauagccccagagcuguuccugcccucccugagucugcuucucuggggugaggccugguucagaggaagagcugacaaaaauaaaaccagagugacaacgugcugugcaggaaguugcaagucugagagccagaacagaacacagguaccuaggugacauaccacaagaaaaguugccugaagagcagaccauagaacaaaaccccgacuguauuugcauuuguggccuucuucuuuuaggagucaagccaacaaugccuacuguugucaagcagaucuaagcccaggguggaccucuggcacuaaccagcagguugaguuuaaacaagaagccucucugagccucacuuuccuugucugagagccacugggagaauuauagaaaaaacauauacuaaaggaucaagcauuucuaaaauaaauaugugucuuuccuuccuguacuauugagcacuguugaaggugagaaagacaaggcuuccacaaucuuaccguagagaagcauguacaccacauauauauauauacacauaauacacauacaucacacacacauauacauacaugccauacaccacacacauacauacaugccauacaccacacacauacacccccauacacaccacauagauacacacacacccccauacacaugcuaaguuuagaacauuuaugaagcaacagcucuagcaacaacugaagaauuucacaguucuuccauuggcugcuuccuaacuagaaacagauugccuuacccccagcuguuucugggccaaaguuccucuaaauguggguuuacuccugguaauuucguuuccuuuucucaguuaacagucaugugacaccauugccuggguguccucugcagcccuggccuuuuaucaguucauaaauccagaaacagaaggaaugcuuacaaaaauguauguggacuccaccauuuauugagugacugcugugugccugcguacuccuuggucucugauccucaucacauccagcaagauacugcuauuaucccccucacacaacaaaugaggaaauuaagguucagaaaggucaaaaaaaucgcccaaggccucacaagcaguaaagggcaggcuugagauuugaaauuagccugagcuguuucaacacaaaacucaauuccagcucuuaaggaguucccaaucuacugcccuaaauacugccgaggccauuucccucucgaguuuccacuuggguccuucuuggccugagcucccucuccuccccuuuucccucugggagcagacuccugcuggcaaaaggcugguggucuccacuucccuugccuccugccaguguaggcaaugcaaacuucucacuggaaaacaccaugccuucuggacaaaggcucugugugauguucuaggaccugcccgacaggccuucugugaaaagacccagcugggguagcugugcugccaggccuuggaugggcagaguucauaaacagcuucuccagccauggagcuccaaaugcaccc

SEQ ID NO: 21327 - RNA, 15714 nt, Homo sapiens
gcacagggaccucacacccucaggcagagcuguccagucacacucuaacacagaauagucacacacaauccaucccagucaccccugacacagugacacagucccugucugguacacaugaggacccuccacugcuagccagccugccccaggcaggggcucauggcugccauggugucugccagaucuugucugauacgaaggagcuucagaaggaaaucaacucccuaucugggaagcuggaccggacguuugcggugacugaugagcuuguguucaagguguggggcagguugggcgggggugaguggggugaggcugggcugcugccuugugcaucugcuaauuggcuggcugggguccagacccaggcccugugcgaggcuggaggugcacugauacccagggcuggcuuuguuucauggaggaugaagcuagugggguggugggagaggguggccuucuuagggcauggagauggucaagggcagcccacugauaccuuugaggucccugugucuggucaggaugccaagaaggacgaugcuguucggaaggccuauaaguaucuagcugcucugcacgaggugaggggagacaugugccugggguggggcugcugggggugggugggacugggugcaagccuucugcuccuguuguccccagaacugcagccagcucauccagaccaucgaggacacaggcaccaucaugcgggagguucgagaccucgaggagcaggugaggccugggggcaggauggggagccaaggcgggccggggggacaguuccucagguuaugcugacagaggcuguggagccacacacagccgauggcuggacacccagcccugccccuuagugccugugaccugggacaggcaaguggccuacugugagccccagcuuccaccccaagggcccuccugucugccucccagggccaugggcagaggcuucagcuuaaagauguagggggaauccugccacauggcgaaggaugcuuuggguagagggaacaccacacgaggccuggccaugggacagagcaggcuguuggaguuggugggaggggcccagaguggcugugaugggggcuggugagcaggagcugggaaaggggcugugugugcugagggggcauguguucacauugccucagaucgagacagagcugggcaagaagacccucagcaaccuggagaagauccgggaggacuaccgagcccuccgccaggagaacgcuggccuccuaggccggguccgggaggccugaggagccgccggcagaggucucuccccagccucaggcagggauuuggggugcuggaggcaguggccaagcacaugcccuagcuacuuccuccgcuguccaguuccuccugcugcggccuuggacccagaccccugcccacugaccgcaacccuuauauggggugauaguccagcauguggggagcucggcugcaguuuauuggggacgguacuguggguugggggccuuggaucccaaauaaaugaguaguuccucugcagucuaagcugaggcauggaucagggcucagggaaugggagugaggugaguggcaggggagacacgggguauuuuuggcaaggcaguguguguggcugugugugucugcacgggacucaagagacccacuggggggcugugcgugugcauaugcgugagauacacaggugaauucuaacaggccgugugugugagcgagcacguguugggaccucagauccugaggguacugacgcugcuucuguguaggccucugggcacaccccuguguugacagugccccugugggcccugaggcuggcugugggugcgugccuugggguguguggguugucagggcugugcuugugugugauugugugaugaugcagcuuugagguuguuugaguguacugaggcaggcucucuguguuuugggguuuguguugagugagggacaggauugugacauuuugugugucugugugacuuuuccagcccugaaguaaucugugcgagcagcugaggcaggcucuguguggcugguugugaaggcucuguuuggcugcagggcucgacuggggggugugucuggggcggaggugggggcuggggccaggaccggggccccucugagcagccuuggggcaaaggauaugaugggggaggggguggcugccagcgggggaacaggggcccuggcaggcaagacaguggaaaccucacuucuuggucccugugggcacauccagggccuaucaucccugcccccaccaccucugccucccaccaguuuggccccuguucguccauccuccuuuccuugaucuugaggucaggggccagguguaggguuggaacaccugcugggccucuggcuccguuucuugcggaacuccagcucauccacgguccacacagcccccuucucgcucuccacccgcacaaagcacuugugcagacucagguuguggcggauggcguucuguggaaggccggggacagggagcaggugggcgucaaccucugaggccagcagccaccaccaacaacccacaucccguuccuccccaaugugccuaugagcccagacccaggccugcccacuuugagcugcgauggcacuugaggccaucccagucaccgccaccucagaggagcucaccuuccagguggcaggaugguuucugaagaaggcaaacaugcgugugaaccagugguagaucucauugaguguccgcugcuucucuggagccuccaggauggccuggaaguuggggggugggguaaggggcacauuccccaaacuugggguuuagaggggcuaugaccuaccccgagccaucugacaugggggcggaauuguaggggcagguaaucagggacaggacuagauguggggugaagcauggggucaaagaugggguuagaaaaggggugaagugucggguugggcaggguuagauggguguggguaugguuguucugggauuagguaagggaucaggacugagguugggaguggggucuuguucagggcuagggcugaagugaggugaaaggucugggauggaguuggaguugggguucucuguggaggugacauuucaggguuggggaaggugaagggucagaaguggggucaaggauuuggaagggguaaagggccaggccaacuuaagggucagggaagggguggguuaagagucaggcugggguggacucagguggggggucuaggggugagggaugggaugacuuggcuuuaggucagaagccagagaugguuugaauuaucgaguaucuuacgugucagggacaugguuaggugguuaggcucagggcaaggaugagguuaguugugggguucgguguggagugaggcugagggucagggaauuugaucaguuuggauucaggaaugggauuacagagucagcgaugaugauugcagugaggcuaucagucaggauggggcuaggucaggguuucaguucagagacagucggggaauaucugguaucauguaggggugagguucagguuugggguuagguguggcgcuaggaugaagguucugagaaggcauuggggaggcugagaugaaggaguugggauggggugaugaaguuaaggaucaaauggguguuacaaggaaagguugggaauggugcccaguuggggguguauugacauacugggguacguuggggccagggaaggagaugggguuggguuggcauaaaggcuggggaaggaguuagaguaagagcugggguacguuuagggcaaggugcagagaugggguuagcuuuaggcuauuuuauggguccaggagaggguuagguauggggcugagguggacaucuggaaagggguagguuuagggucagaauuuggcaugcucuggccuggauggugguuuagguuuggauuugcggacagguuuggggugaagccagcaugaggggucacauuugaggcacggcuuggggauccuuggggcuggggcuugggaauggaggaacccacucugagggcacucagagggagacaggaguuugggaggcaggucccccaccccaucuuugucuuccuccuccuuggggccgagcugcccugcuuacccagcggaugagcguggcguaggugaaagggggucgcauguuguggaacuugaaguaguccauguuguggaggaacucugucagaggguggggaugaaucaagccccaugcaggaccuccuagcuagcucccuguccccucccccuacaaggugagucuacaggccugagaucucaccgucaacacccguguccacgggcacagguacuguuugcugagcaccugacauaaguuguaucauuuauucuuugcaccacuucugccaaaauaguucuccccgagguugaaaagaagcggaguaacuugcacaccaaaggaugcaagagguuaaauggcagagccaggaugacagucaaggucucugaucccugcuaagcccacaggccaggccugguggagagcaguggauaggugagcucgggcgaauccaccccgauuuuccuuggucaggggaggaaaggaggugcuccuggaauuacuuagcagggucccucccuucugauggccgaauauaguagcuggaguccagagugggugaggcauggccccaauccccaagggagucagggcuaggggcccgacacucgagaccauauggggggcuuucaggccacggacaucccgaaaggaagcuuuugugagcggaugcauuuucccaaaggcugaguggcggcagcugcagugguggugguggugggaaggggcagcauggagcuccuuugcacccuccacccagagccugucaggauuaggagcuugggggcaccguguagugcaaggaccauucuuaccugggaaugugcuguuuccauggcuaccccacaggugccuccggacagcaaacaggcugucaggggccucccgggggccagaccaggcugggacgacagggccuuggcugccagcagcuacgaugcagcaggagcccuugucggaugaugccugggugagggggagaggcuggugacccagaggcuuaaacuucccacuuuuuacuuucuauuuuauguuuuuuauuuuuuuugauacugagucuugcucugucgcccaggcuggagugcaguggugcaaucucggcucacugcaacccccaccucccagauucaagcaagucuucugccucagccucccgaguagcugggacuacaggugcccgucacuacgcccagcuaauuuuuguauuuuugguagagaugggguuucaccauguuagccaggcuggucucgaacuccugaccucaugugauccacccgcuucagccucccaaagugcugggauuacaggcaugagccacugcgccuggcuccacuuuauuuuuaaaucaguguuuuucaaagcaaggacgcccucuucuaaauuccagucugagguggaaucccacaaaacagcaugagccguauuuauuagagcacaggugcggaugucguauguggccacugaugcugggaccaugaacugggguugaauagggcucuuuaccacccaacugugaccuugggaaagucaccuaaaccccccuggccucaauauuccucaucuguacauucgcaucaugagaaauaaauuaccaccagcaaagcgcucagaaacagugccuggccuccagggcuggcuucaugggcgugugaccuaugugguuauguggcacccugugcuuuguuuaaugcucuguggucgccaucuugaaaucugaacaaggggcccugcagguuacauagcugguccugcuggcacacagccugcaucuggcaagucuggcuauuugcauuugcuuuaacaacucaggaucacaguguuuggggaucuuagagucagaggguuuuuuuuuuuuuuuuuucuugagacggagucuugaucugucgccuaggcuggagugcagugguaugaucucagcucacugcaaacuccgccucccagguucaagcaauucucugccucagccucccaaguaguugggacuacagacaccugccaccacgccuggcuaauuuuuuguacuuuuaguagacacaggguuucaccaucuuggcgaggcuggucuugaacuccugaccucgugauccacccgccucggccucccaaagugcugggauuacaggcgugagccaccacgcccagccggggucagaggguuuguaaguagaaggggacagauuuccaggucugggcauguuuggagcuggggacaggggccccuagcucucaggaccugaaugugagguuagguucccugcaccgugcagaccuccucccugccccccagcagucugagucugccaccaccaguccuggggucgcucaccacagaugaagccuuggucagugccauuuucccagccaggugggccugcauggcacucagcuucuccuucuccagcaccagcugugaaauggcacaaacaugaggccucagccuggcccuucucugccacaucuuugcccaggcuacggucuucccugggagugcccgcuccucuuccuuccuuuauaccagcccucgucccaggugaacuugguuucuggcacaugguggacagaagguuuugcgcacuaucccuaucccuuacccuccaccgcccuggcauuaccugcugcuccagagacuguaccaucucucucuggaggagacauugugcccugcccuucucauccagaagaugguccgccuggcagugccuaaguagggagaagauuccaugcaggugaccacgacaggccuggucuggcucaaugcucugaauggggagggcccagacccucugggaguucucuccucugagccccagcuccccuccccucucuaccucagucucccucucacaccccucguucccuuaacacaugccccucagcaccuacugcaugucaggccugaacucaccacuugagccuggccagagugcuggagauaauguuggaaguguggugaguugagaaugggccagggaggugagagugggcaaagcauucuggguggagggacggccugugcaaaggccuggcugcaaggaggacaggacaugugggguugcugcuaaggguuguguguagugugguguguauuugugugugugugugugugagagagagagaaagagagagagagagagagagagagagagagagagagagagagagagagagacauauggggggacugaggggaggcagcagcagccaucuagaggagcuagaacuuugggaacaguggaauaaggcuggcauguuggcaugaggaguagcagggcaaagcaggagugcagauucuagagccuggcuacauggguucaaaucccagcucugucacucaggaacugggagauuuugaucaagacacuuaaccucuuuggccucagucuccuugucuguaaaauggggguaaauaacagcacaaacguuucuuauuauacauacgagaaaacugaggucgagagaagcuaaguaauuuguccaaggucacacagccagucagggauggagcugggauuugaacccacagucucagaguuuagcucuugcaucuuacuacuuauugggaugaagccugagcugagaucugcacccuagaccucuccccacaagccagggccgguagacuggcacaggccugggccacucacuugaggaaguccucuggcucuucgaagaccuucucacauccgggccacuugcagacaccauuugccagcaguggguaggagcucuggggcacagccgaaagggugcuggggggacagagggugucaggggaggggauaggagggcgaggauccuucccagcccuguccacugaccuguccuuccugggugcacugggauuugggaaggugcagagcagugccggcucccuggacacccauuccaggcuggccacguugaucccuguggguggggacagggcaccuauggaggcugugggcugggcucuggagcuuggcccacaaggccucucauuuugagcuucccacccuccugagccucgaaaacccugacucccagggggcucugcuguccccaaagucccaggcuucuggcagagaagcuuaaagacggccauucgcaggugcugacauuuugacuagcuuuguaaagcucugugguuuugugauuuugacauucugcaucuuuaagguucugcaccugacguuuuuuggaggguggaguuuccaagccucugagaccugacaccuuugacccccagaguacugcaauucagaauagccuacacugcucacagccaaggaucuggggacuuggggguucugugaagccaugggguacgggcugagguguuaccaggugggaggccaggccgggccuugagggagaagaccccaguggcggugguggguggugugaggcugaucauggcugggcucuccagggggugcaccugcagcacagggguccgggcgugggcauccaccguugagagcuggggggcacaugugggcugugguucagccugacucggggccccuccccacaguucucccaccugcucccuccucccugcccauucaccguccauaccuggugcaugaaauguggccuguccuggaggagugccuguaaguggggcaaggggcccagccgugccccggagggugccaccaugacuaggggcagugugggcagcugggcagaaaggcaggugggugagaggccauccugauccucacuguucugugucuaauucaaauacucugcacugcaagcccacaugguagaugcuaugaucaucccccuuuuacacguauggaaacugaggcucauggagaucgaguaacuuuuuaaagaucaaacagcuaauaaguugcagagcuggccucagcccugucaccucaccuacuuggccccaguccucuucucuugucacauggggauggggacacauagcuaugcucaugggacuacaauacggccuccuccucuccugagacagggauugggaggucggggagagccuccaaucucugaggccuggcagguggggauuuucuuggcccugcaacaucugcauaagucacagacuugccugggacccagaaaccacuuccugugccccagccagccccccucccgcccagugccacaguaaaggucggcaccuguagguccagguaccccacccugccugccccauccugggcccagggccucaccugcagcugcgaugguggcaugggguucaaggaagaagaggaggcaugggccccgccucgaagaucucggcccuggaagguucccccugggccccgggcccccagcaggucugaggcuuugggugcagcccuccagcugggcgaggcuccuggggaugggccaagggccaaggaaggggccgagggcuugccaggccugggguugggcaucggguccuuguccaagggcaggcugcguagacaauaggggaaaggagucacacgugugcuagggcgguaugagauacucgaccaccugagccacguggacacuccucuggucaaagcaggcauuggcugggacaugucccgaggggccccauaguugcaccccagcucuagacacacacacacacacacacacacacacacaccaagaacacagguacauguacauacccacacaugccccacgugcagagguccagcaccuggcuugccugcccacgcuagcacagcccugguguggauguguccucuaugagggcaaugguuguuucccccuccacuugagagcuguuucaagccucaggccucuagcccucccugcacccugcacaggcuguguuugcucaucuugccggagcuggucucggacuuucuccucggaguccuauuuugccccagugacuaggcauggacucaaaagauucaucuggcugcugugaguggggcuagugaggaggcuauuguaacaguccuggcaagugaugaugcuggcacagaaugggcugguggcaguggagaaggcgagaaguggguagauucugagacuuaaucugaagcuggaucaggagcagugcuagcagcuuggauguagugggcaagagggagagucaaagugacauggguuuuagcuugagcagcuggaaggaccgagcugacauuaccugagaugggggacauggcggggaguuggauugggugcaaaagugcagguguagauagacaugaagagucuggcauuaaauaugugaguggaggagcugagggggcagcugaauacgggggucuggaucucagggcaaggaggcgaguccaggagugugaucaugcacggauccagcauggcaagugacagagaggaggagagauggggucucuugagcuggggccuguagaagcuucucuacccagcccccaucagaguucaccccaauuucuggcccucaagccuggcucaugcuacacccccugccucaaaugcccacuccuucuccucuuucccuguccaagccacgcaagaccugcucuucuauuguccucaccuugaaagcccuccacaauggcuccgggcccccugcugagccccagaaccuuccacucccugagggaagcacuggcuuuucaggauccuauaauccuggucugagaggaagccagagcuggaagggacugcccagccaaccccauuauacagaaggggaugcucagaugccgaguuccguagucccauagugacuugagaacuccacuucuuucuuuaggaaguguuuccgugugcacauuuuauaaacucucuggugugugugugugugugucuccaucuccccguuccaccucacagcacugaguugggcacacagcugcugagagcagcccgggggaguauagaaggguucugggggagcaguugcuccuuccuuucuuugcugucaccuccugggggugguugucagagcuguggugcugagggagaugagugugagaauccagguauuaaguucuuagucuccugggggcuuagaacauuacugcgugagaaacaggagugugggucuguggaggcuccgaacaagggccugggagagcacuggugagaugagaaggugagugaaugaaugaagccagagauggggugaugcuccuucaagccaagaaauaacaaagauugccagcaaccaccagaagcugggggagaggccuggagcagcuucucccuuauggcccccagaaggaaccaacccuggcaacaccuugaucuuggacucuggccuccagaacugugagaugaucaauuucuguugcugaagccacucaguugugguacuuuguuauagcagccagaacaaacuaauaccgauuucggugcaaauggauguuuuccaccacucuggccuggcccauguggcuggccuguggucacuucugaagcugccuggacacuuggccagagcuaagaauucuccccaaacacaugugggauggccugacucagcaaagcauagauacauucucagacagggacauggagaugaucugucuggggguagaggaccuagagggccgggcugggcagccggcuuccugcacugucuguugggacgucccuuucugacuggguuucucagaagcugaaugggggauguuucugggacacagauuauguuuucauaucggggucugcaucugggcccuguugucacagcccccgacuugcccagauuuuuccgccauugacgucauggcggccggaugcgccgggcuucaucgacaccacggaggaagagaagagggcagauaccccaccccacagguuucguuccgagaacuggcugcccuguccugcagcaggcuuggcccagguggggugacaugggugcugguggaugugguaggugauguccaucuggccacuaugacaagccccuagcucugaagaccuggcccuucuuggguuguggagaggacccagguuugaagcucugagagugccaggcaggcuccacagauacugggaccccuggggucuucaaauaguauaacaccaggaccucagaaucauagaacagcauuucuuagauuuaaaggauccuagaaucucaaaaccacagacuguggggucuacggucccaaagucucaguauguguaggccagugucccugguguccaaacuccuuggaaccaucugaaagucaggcagcuugcugcuucauagggccucuugccuaccaggccuggaaacagagccagccucccuagggccucagucucccuguccacucuggaacaacguucccaaauacauggccacuccgccagagauggcaacagggggaggaggagguugaggcuggugugccuuuggucugggccucauggggggagcuggaaaagccucagccuucgccaauacagagcccaucaucagacucucuagaggggccccacaaucaagguuuucggggaccagcaccagcucuggggacacacagccugacugacugacaugccuccaucaucaccacgcucuggccaacuaggccuccugaccuauggaguccggggccucaccuagcccagcucuugugaggcugggccccacacugugaucguggaucguccaaccugugggaaguugggguccaacgugugagaaggcagaagggggaaugguagcccagguuccccuucccccuucugggugcugagggguaaacugaggccuucaguuggggagagagccagaaccagggucccaccuagaguccugagaucuaggcuuggauuucaacucugccgcugcauuucggugaggcccugagaucucuggucuucaauuugcccuucuacacugagcacggagaggcguggaguagacaagggccagggcccuucuacgcugucugguuaagucauuaggugucugcagggcuucaaguugacaauugccccucuauccaggggacuggcugagagauagggauacauagagacaaagagacacacacaaagagcgagcaagagagaacaagagauagugagagacauugagagaaauggacacaugcauggagagccagagugcaugugugcgagaggaggauugccucaaauaagaacauuugcuggucucuggcugguucaacugaugcugccugaaauaaucaagaauaaagaagggcaaggugccagggacacccauggcuggguauugaauuguauugcaaagcaacaaucagcaaaacaguguggcccugguauaagaacagauacuggggaagagaacagaauagaaagcuuggacauggacccacauauggagagaacugaauuugugaugaauguggcauuucaaacuggaggaccauggaguaugguuuaacaaaugugucugagauaauuagggagaagauaaaguuauugagugaauagucaguccauuaucccaacaaccccucccugcccaguuugaaaugucaccaucaucauauacccuaaaaugcccagauccauucaagauauaaguuuuaacaccuaaugcugaucuuggguuuauugugugucaggccuugugcuaaguauuuacugugguuaaaaauuuuaaucuaaacaaagacuccugaggaagguacuauuauaaccauugcaguacauaugaggaaauggagguauggagagguuaagugccuggcuaaaaaucacacauagggcuuggggugacgcuggguuugucccagacagucuggcuccaguacccacacucuuaaccucuauaguaaauggaaaaaaugaagccauaaaagagacuagaagccaacauaggugaacauuuaucucauuuucaaguaggaaaggacuuucuaagcacaaaaccagagacagaagccacagaaaaaaagacuaaccuauuugacuguauaaaaccaucauaagcaucacaaaaaacaccauaaacaaauagaaaaaaagcaaaugaugaauuggggaaaauauuugcuauauauguaauggcugaugaaagguuaauaaccauuccaaauaaagagcuguggcaaaucaauaagggaaaaauaagaugaacacccuauuaggaguaaggacaugaccagacaaccaaaaaaaaaaaaaaaaaaaagcaugaauggccaaugaauaguaaaaguaaucacaagaugcaaauuucaacaaugugauaauguguuuuucuuaccugucauguugggaaauaauuaaaacauaauaauacucaccuaggguuagcuuaaguagagggagcauaaaauaggacaaccuuuuggaaggagaauuagcagagagggucauaaacuuuaaaaaugcacgcccccuuugccccagcaacucccuuuucaggaauccaaggaagcagucagggauguuuauagaaaaaaacgagaaacaaccggaauguccaacaaucggcacuuggucaaaucaaucaaaguucaugcugaugugaggacagucuuguccaucaugaaagaucauguguucaaacaauuuuuaguaagcuucaaaaacacuacuguuaauugaauaaagcaggaacaaaaccaauauauagcaugauucuaauuugguuacagaaauacuaauagcuaacacuucgugagcacuuacuuugugccaaacgcugugcuaagccugcagaaucgagcucaccccagcccugaacaaccuguuugcuuccugaauauggacucuggucacacacaugcaguccugggguagguccacacagcuaaacuacgguugacaauggugugaagugcucccugcccccccgccccaagggucuccucuaaagcgauacaagcaaaguucaguuaagugcucagcuugccccggcaccuugcaauccuccugcuacuagggugaacagaacugaugcucacucucauaaaauguaaagguccucggcgacauuacuauuauuaaacgccagcuguguacaaagcucuaggcuggaugcuggcugggaaggcaggugggggaaggcaagaaaagagagcgggagagauggaggaaaggagaucgauggaguguggucaagauggaggagacagagauaggggagauggucagaggccaggagagaugcggggaaagagagucugaguguagcgacagacagauggcgggagaaagagaggcagagaaacauguaaaagagcaagacagggugagcagagagacagagaaggaugagaggcaucaagagcuaagagacaaagagaugagagagaugcaguugaaauuuucaguugcaccuggacagcauuucaaguuguucaaagcucugaaauccauaaagacuggcagcugacauauuuuaaaaauccuauccaucuacguaucaauugaugaauucauuuauuuuugccccugcccaugcauuaaguacuucaccuuuaagucuucugccauuuauucuauuauuauuuuuuuaaagaccuuaccuggcuggaaucacgguagcuggguacaucccacuguaccagagggccccugacccccccgccgugccuaccucccugccaucuccuccaauggggcccacaucugguaggggagagcagggacacucaccuuggugaaguggacugacagaaaaggaucagcc

SEQ ID NO: 21328 - RNA, 3677 nt, Homo sapiens
ggcauggaggcagcuuugaaacccaaaacaccauuuauuuaauuuugcacaaaaucuuucaacuugacauaacaaaagcaacauuaggcacucccauguuaccaaaaagccccucaccaagugaaaacaagagagauguccaucuuucccuaguauaccugaugugucccucaaagcuaguugccucaggggucucaugucaaaugaacaaucacccuggccuggggaaaggucuacauuucuuggccaagaccuucaggccacagagcagccacaguggcagguggccuucuggugccgggucuucucccuacaggaccuugccaugggcuccuucgccauggccuccuggacccucuggaucucauggaccagcagggaaaaggccuccuccacgccuugccguguuuuggccgaggucuccacgaagugggccccccagcugugugcgagggcugcagcagcggcaugagcaucuccagcaguggucacaaggucacacuuguugcccacgaggacaaggggcugggcggggugagggccccagguggcccauaucugcugcagcuggaucagagacgaggggucaucgagagcgaagacgcccagcacaccaucacagacagccaggcacuggucacgcagggcccuauggauggccugcccugcuguguccagcacauucagaaugcaguccccacuguccagggucaacuccuuccaguaggaauccuggaugguggggucgugguccuccacgaagcacuggugguucagcuggauggucagcgcacucuugcccacgccacuggcgcccaccaccacagccuuguacucaggcagcugccugccaacaucccugcggcgugccugagcccgguggguuucccccuggaaggaagggcuccauguggccaggcccaggucgaaggugccaggcuuuguuggcagcuccaugaccccagcaggcagcucagggaagagacgugggcagcaggcucugcaagugggaagagaagaagcaagacaacaggggauacguuaggggagaccauuugagggcaaggagacaguggggugucauuauuucaacauuuauugaaugccuauugugugcugaucaccuuccaauuugcaugcuauauauauaugauuuauguuguuuucucccugucccacguccccccaucucuccuucccuccucacgcgaaucaacaacugugaaggcuggauuucccaaacagcuuuauugagauguaauuuacaucccaucaaguucagccagcuaguguccaauuuaacggguuuuagcauauucacgaaguugugcaacuaucaccauaaguaaauuuuagaacauuuuccucacccagaaaagaauccccaugcccauuagcaguuccuccccaugacagagggagggcaggauuuugccgguuuuggucaccauugaacccuagcccagcacagugccugccagacaguagggacccaacauucccacccccagaagguuuauguucuaaaaggcagaggcagauaauauaauaaaccaaauaaauauguaaaucacguggucuguuagccauuaucauuagaauguagucuuuauuaauuauucaacauacauuuauugggaaccuacuguguggcaaggacauggaguugggcaauaaauagacaacaaacuguagcccucaugaagguuauauucuggucggggugagagacaacaaacuagguuaaaaagggggcggggcacaauggcucacgccuguaaucccagcacuuuggaggccgagucggguggaucaccugaggucaggaguucgagaccagccugcccaacauugcgaaacccugucucuaauaaaaacacaaaaaaauuagccaggaguggugguggacgccuguaaucccagcuacucgggaggcugaggcagaagaaucgcuugaacccgggaggcggagguugcagugagcugagaucacaccacuugcacuccagccugggagauaagagcaaaacuccgucucaaaaaaaaaaaaaaaaaaaaagugaacuauaugucaguagcgggugauaagcaugcagaaggugcucaguucaugccaggcuuuuaaauuauaauuuaaucuccauucauuaauucaagaaucuuccuucgugccaggcauugugauauggcaguuaacaaaacagaccccagucccugcccuugugaggauuggauucuggcagagagaaagagacaguaacaagauaaggaacaaggaaguugcauguucgaagaggaugggcacacggcagguggucaauuaguguuaguuauuagcagcacauccccauucacucagugaaugccccucgguguccuugggcucaggaagugcccugcuuagugcauccuaauggcuguugccacgacuccccuccgaaagccuggcgcagcggcaguuugggggcggaugguggcuucgagguuugguggagcuggagauccggaggucggagucggggcaaggucccaaauggggaugcggccgcggcguccucagcucugagggaucccugggaauagucacuggcggcguuggcccagaaggagcgggggcgggauaaagagagcaggaagcggaggacggagcuuggggguccccgacgguuggggacaggaagaagaccuggaggacugcggggaggggcgaggcggcggcgcacguggagggagaggucggcuucuggggguccuguaggggugcccggccaucuuuagggaugggucagaaggcagaggcggggucgaggcugccucuuaagucggggucugagcggcuggagucugggggcgccgacggugaggaaggaaagcccggggccuggccgaguggcggagcgcagcuuccaccccaggugccuggcgggacggggccacacucgcccaguccccgcgacgcgcagggaggccgcggcccugguccccaaggcuccgcucccgggaggagcccgaggcgcagaggcacgugccgagggcacuggcccggggccucagcccgcgggaggcgccggagauugggggcucgguccucucaaguggcgcggagcccccggcggguccccguggccgcgcgcucagagccgcugggaccagguuggggggcuucgcccagcucaccaaggcuggcgcgcuaaggggccgggaccugggguuagggcggccucgccaggucgugcuuucccggacgaggccgggugaggugcaaagcucggagugcggaaggguccccgaaaccaggacuccacuucgggcucggugugagcagcgucgcccgggcauccugucaagacccaucccgacuccgggugaggcggccccgcuuccagccaagcgccgacaccccucccggccggcccgagugaggggccgcucgcccgggagaaggcuuggcgcuugggggacgaucccccaaagccggcgcggggauacccccaggccuggcagggccaggggcaccggcgccucgcucaccuguguccguggggaggcgggcgcgcugggacgcucugacaggccuggcggggggcgacgcugcuccccggggcaccccggcggcgguugggggaguggacaugcgcagccgcccucccucggcuccucaggccgcccaccccccu

SEQ ID NO: 21329 - RNA, 3677 nt, Homo sapiens
aggggggugggcggccugaggagccgagggagggcggcugcgcauguccacucccccaaccgccgccggggugccccggggagcagcgucgccccccgccaggccugucagagcgucccagcgcgcccgccuccccacggacacaggugagcgaggcgccggugccccuggcccugccaggccuggggguauccccgcgccggcuuugggggaucgucccccaagcgccaagccuucucccgggcgagcggccccucacucgggccggccgggaggggugucggcgcuuggcuggaagcggggccgccucacccggagucgggaugggucuugacaggaugcccgggcgacgcugcucacaccgagcccgaaguggaguccugguuucggggacccuuccgcacuccgagcuuugcaccucacccggccucguccgggaaagcacgaccuggcgaggccgcccuaaccccaggucccggccccuuagcgcgccagccuuggugagcugggcgaagccccccaaccuggucccagcggcucugagcgcgcggccacggggacccgccgggggcuccgcgccacuugagaggaccgagcccccaaucuccggcgccucccgcgggcugaggccccgggccagugcccucggcacgugccucugcgccucgggcuccucccgggagcggagccuuggggaccagggccgcggccucccugcgcgucgcggggacugggcgaguguggccccgucccgccaggcaccugggguggaagcugcgcuccgccacucggccaggccccgggcuuuccuuccucaccgucggcgcccccagacuccagccgcucagaccccgacuuaagaggcagccucgaccccgccucugccuucugacccaucccuaaagauggccgggcaccccuacaggacccccagaagccgaccucucccuccacgugcgccgccgccucgccccuccccgcaguccuccaggucuucuuccuguccccaaccgucggggacccccaagcuccguccuccgcuuccugcucucuuuaucccgcccccgcuccuucugggccaacgccgccagugacuauucccagggaucccucagagcugaggacgccgcggccgcauccccauuugggaccuugccccgacuccgaccuccggaucuccagcuccaccaaaccucgaagccaccauccgcccccaaacugccgcugcgccaggcuuucggaggggagucguggcaacagccauuaggaugcacuaagcagggcacuuccugagcccaaggacaccgaggggcauucacugagugaauggggaugugcugcuaauaacuaacacuaauugaccaccugccgugugcccauccucuucgaacaugcaacuuccuuguuccuuaucuuguuacugucucuuucucucugccagaauccaauccucacaagggcagggacuggggucuguuuuguuaacugccauaucacaaugccuggcacgaaggaagauucuugaauuaaugaauggagauuaaauuauaauuuaaaagccuggcaugaacugagcaccuucugcaugcuuaucacccgcuacugacauauaguucacuuuuuuuuuuuuuuuuuuuuugagacggaguuuugcucuuaucucccaggcuggagugcaaguggugugaucucagcucacugcaaccuccgccucccggguucaagcgauucuucugccucagccucccgaguagcugggauuacaggcguccaccaccacuccuggcuaauuuuuuuguguuuuuauuagagacaggguuucgcaauguugggcaggcuggucucgaacuccugaccucaggugauccacccgacucggccuccaaagugcugggauuacaggcgugagccauugugccccgcccccuuuuuaaccuaguuuguugucucucaccccgaccagaauauaaccuucaugagggcuacaguuuguugucuauuuauugcccaacuccauguccuugccacacaguagguucccaauaaauguauguugaauaauuaauaaagacuacauucuaaugauaauggcuaacagaccacgugauuuacauauuuauuugguuuauuauauuaucugccucugccuuuuagaacauaaaccuucugggggugggaauguugggucccuacugucuggcaggcacugugcugggcuaggguucaauggugaccaaaaccggcaaaauccugcccucccucugucauggggaggaacugcuaaugggcauggggauucuuuucugggugaggaaaauguucuaaaauuuacuuauggugauaguugcacaacuucgugaauaugcuaaaacccguuaaauuggacacuagcuggcugaacuugaugggauguaaauuacaucucaauaaagcuguuugggaaauccagccuucacaguuguugauucgcgugaggagggaaggagagauggggggacgugggacagggagaaaacaacauaaaucauauauauauagcaugcaaauuggaaggugaucagcacacaauaggcauucaauaaauguugaaauaaugacaccccacugucuccuugcccucaaauggucuccccuaacguauccccuguugucuugcuucuucucuucccacuugcagagccugcugcccacgucucuucccugagcugccugcuggggucauggagcugccaacaaagccuggcaccuucgaccugggccuggccacauggagcccuuccuuccagggggaaacccaccgggcucaggcacgccgcagggauguuggcaggcagcugccugaguacaaggcugugguggugggcgccaguggcgugggcaagagugcgcugaccauccagcugaaccaccagugcuucguggaggaccacgaccccaccauccaggauuccuacuggaaggaguugacccuggacaguggggacugcauucugaaugugcuggacacagcagggcaggccauccauagggcccugcgugaccagugccuggcugucugugauggugugcugggcgucuucgcucucgaugaccccucgucucugauccagcugcagcagauaugggccaccuggggcccucaccccgcccagccccuuguccucgugggcaacaagugugaccuugugaccacugcuggagaugcucaugccgcugcugcagcccucgcacacagcuggggggcccacuucguggagaccucggccaaaacacggcaaggcguggaggaggccuuuucccugcugguccaugagauccagaggguccaggaggccauggcgaaggagcccauggcaagguccuguagggagaagacccggcaccagaaggccaccugccacuguggcugcucuguggccugaaggucuuggccaagaaauguagaccuuuccccaggccagggugauuguucauuugacaugagaccccugaggcaacuagcuuugagggacacaucagguauacuagggaaagauggacaucucucuuguuuucacuuggugaggggcuuuuugguaacaugggagugccuaauguugcuuuuguuaugucaaguugaaagauuuugugcaaaauuaaauaaaugguguuuuggguuucaaagcugccuccaugcc

SEQ ID NO: 21330 - RNA, 10677 nt, Homo sapiens
cggcggcuguagcggcgugacaggugagggcgggcccgggagggcucgguuucuggagcggcugccgggcacgggcagggagcccggaccgaaagcucagcuccaggauggcugcgcuugggccccggcguucccugcccggaaccggaggagugguuugacccggggcgagaccaucgucgacagcgggggugggguggguaacaggaauaggcgggcaaggcugcgggugaugguuucgcccgcugcuagugguggugcgccugcgcagagccggaagcccuuugguaggcgggacccgaccgaguggugccgggauuccgucuuaacccccgcuaagguguccaaugaccuuuccuuaccaacugcggggaguguguggaaacgcgguucacuccccgguuuccuuauucuggaucagugucugaccgcccccgccgggagaaugucaggauucucgccucuguaaccgccuuccaugaucccucauucaguuuagaccaguaauaugccugugaccccucacagguugucaaggagaauuuuggagcucccucuuuaccuccauuuuucuccccgcaacaccauaccuuccuucuccuuuugcuaugacaaugucuggugguccaccauuaccuccccaguucggcucaaugucuggucauuuccauuuccacccuucuccccauuacagucccuagugacgccuguuacaucucccuuccgcauaguauguagugaccccccccccccaugaauuccucaucauagaggcuugggacuuccauuagccaccuaacaacggugucugugguccuaacaucaacauuacaccccagggcuuagggauguccacagugcccuuuaaggacauguuuggugcaaccuccaucuuccccaaacuaagggcaguaucugauaauccucucuuucccaucaccgugccugcgacuccucccucaccacaguaacuggcauuucccccguucucuguuaaaaaaccaggacacuuugggaggcugaggcggguggaucaucugaggucaggaguucgagaccagccuggccaacauggugaaaccccgucucuacuaaaaauacaaaaaauuagccgggcgugguggcacacgccuguaguuccagcuacucaggaggcugaggcgggagaauggcuucaacuugggagguggagguugcagugagcugagaccaugccauugcacuccagccugggcaacaagagcgaaacucugucagaaaaaaaaaaaaacagaaaaaaaaaaaaaaaaaacccaggacauucuguucgugcuucuuauguaccugacggcucagugcaguguguacugacuuccccauugguccccagcacagagucuugugugcuccucuacccuccaagacaguaugcucugucccccuucccuguucucucccccgcaacccugugcagugaagcugagaccuuggcacucaagagugagacaagcaacaggagggccugagcagagaaggaacuggaaggacuucagaugugagcaggaucucuuggacugucgugugaaaauuaggcugcagggggcgacaggagccuggacuuugaauuuuauuuuguccccugccacuuugcuucuagacuaucauuauuggaccucugaauucuugucugccuucuuguaggagccccauggcaccugcccagccccaccucagcccaucuugacaaaaucuaaggcuccauggagccaccacggggccccccugccaauggggccgagccaucccgggcagugggcaccgucaaaguauaccugcccaacaagcaacgcacgguggugagucauggaagcgaaauggcaggggcuguggauggacccaguuguaacucugggaucaaaagggugacaacgguugggggaggccuuugcagaaggaugggaacaucagcugcgcuucuguugggcauugaggaccccuacaucugcacauacacacaggugacuguccgggauggcaugagugucuacgacucucuagacaaggcccugaaggugcggggucuaaaucaggacugcuguguggucuaccgacucaucaaggggugaguguggcagccccacgcccacccacugggugucccaccucccauccccuccucagucauuugauuccuucuguacuuuaucacagagucuuccauuagucuucccuuagucuuuaguccccccuuaucugcaggguacauguuccaagacccccaguggaugcuugaaaccauagauaguaccgaacccaauugcuaucagucggaacauguuucuauucuugucuucuacccauaaauguaaugccuuuuccgucuuaacuaagcacguaucaugcacuccggccaucacuuuugcaguuugagguaugacaucaaaacuagcaugaauuuauuuuuccuucuucacaauuccaaagauggaagauucuuucuuacaguagaucucagcaaccucagcauaugauuuucuuuuaagucaagaacuuuuaccuuuuugcuuaaaggaagcacauuacagcuucucuuuggcauguccgaauugccaccaacacuacucuugugcuuuugggccauuauuaaguaaaauggcggucacuugaagacagccacuaugauauugagucaguuguuugauaacugagcaggcuacuaagugaugggcgguagcguagacaguguggaucugcuagauaaagaggugauucacauccugggugggauggugcaggauuucaucacgcuacucagaaugcacguaauuuaaaacuuaugaauuguuuauuucugcaauuuucaauuuaauacuuucccacccgguugaccacagguaacugaaaccauggagagugaaaccacagauaagggaggacuacuguaguucaaguaaucuaugaguucauccaucuuuuguuuuguuacuucauugguuuauuggccuguaaggucagcaacucauucuccccuggcccccaaguccucacccugguccaucacuucugcccagauuucaucuauuuuguccuuucacgaugucaugacuucaucaggucucuucuuccucauuuuccccauucucugucugcugaguugggucuugcugacuuuauuuauuccucucucguggguuuccuuaauuuaugaugcaguucacacacugcacuuuauuuguuguuucagugccuccucagcccccuuuucaggggcuggcuuagcgcuucuaagauguaguuguuuaguuucauuugcuucuccccuuccguuucagagcauggacucuucacaccgucaugccucucauuacccuuguggcccagggccagucacuuuaucccucugagccuguuuccccaucuguaaaguuggggcaaggauagugacuaauuucuagaguugcugugaugagaauuaaacaugccagacaugacccuguggguagcaggcuuggagggacuuguggggguucccugccuccccauggccccuacccaaccucccacucauuccuuuccaugcccccugcagacgaaagacggucacugccugggacacagccauugcuccccuggauggcgaggagcucauugucgagguccuugaagaugucccgcugaccaugcacaauuuugugagugcaggguggacgguggggguggaccaugguuggggguguccuugaccaggucucaaacuucccugcucuguggcaucagguacggaagaccuucuucagccuggcguucugugacuucugccuuaaguuucuguuccauggcuuccguugccaaaccuguggcuacaaguuccaccagcauuguuccuccaagguccccacagucuguguugacaugaguaccaaccgccaacagugagcccagccugggguggguggggggauggggagcacagaggcccagccacgaggcccuuacagacagcugacccguguccccuugcuuuauacccuucaugcccucaagguucuaccacaguguccaggauuuguccggaggcuccagacagcaugaggcucccucgaaccgcccccugaaugaguugcuaaccccccagggucccagguagggaugccuuagcugaagagcugcugggggagaaaaagaucuuggggcucuuguagaccacgagccauacuuuauucauuuguuuacuugacaaacauuuauugagcaccuacaagugugaguaagggcaugaaacugggaccuugggcaagucaccucauuucucugggccucaguuuucucaucuguaaagaggggaugaugauacuuucuaccauauaaagguucuggugaggcuuaaaugaguuaagacauguucagugccuagaacaggaucugguacaguguaaauaaucaauuuuuuuguuauuaauuauaaauauauuuauaagcaucuaacuacuuugcuaauucuaguauaaucauacucaagccuuuccauuuugaaauacguauuauuuuaucauaaauuacuucccuuuuauugcuuuuuuauguuaaauauuauauaaaacuauagcuauauuaaaauauauuauugcucuaauauauauuuuaugaugugcauauuuuaugguauauuuauguuauuguaucauguuguauuacauaauuuuauauaauguagaacaucauacauguuuauaugauacauaaaauaaaguuaggguauuauuuuaaauuaugaguguaugugcauuaauuaccuuugaguuucauuucaggauagugaagggaacauuaacauauuuuuguaacuuuacaauauguuuagcauauaucauauguauaacauguauguauaacaauaugguaauauguauauuuuaaaacauugccauuuuuauauagaugauacauauuauauaacauuugaaaaguacauguaauuauaauauauaauuauaaaauaugauacauuacccuuuccccacuaucuguguggccugcuauccugccuuuaggcguuuacuccauugucaucuccuccucagagaaaccuuuccugacacuuucuaggaacacuuugugucuccuuauuuugcuuuacuauuuuucuuuauugcaccuaucaccaucaggcauauuauauauuuguuuuuuauuucagccccaccagggcaagaacuguuauuuuguuuuacaguuuuaucuccaccaccuagaaugguaucuggcacacagcaggcacucaauaaauguuucuugaagcaaugaauaauaguacugccaguggacauucgcucugugugagccaaaugcauguuuauggcugggggugggguggggggcuuucucgguucucugauuccuggcagugauuucacagccuuuccccuggcagcccccgcacccagcacugugacccggagcacuuccccuucccugccccagccaaugccccccuacagcgcauccgcuccacguccacucccaacguccauauggucagcaccacggcccccauggacuccaaccucauccagguuggugcugugggggacaaugccggggaccacagggcagaggguagagccaucccuguuggccuccaugcccucuuuuugacuccugucccucuucuucuagcucacuggccagaguuucagcacugauggugaguccccugugccugcacccugacccccgcugccccacuuaccuccacucacauccucucugcaacugcagcugccgguaguagaggagguagugauggaaccccccgggggagccccagcccagccagcguguccucggggaggaaguccccacauuccaagucaccagcagagcagcgcgagcggaaguccuuggccgaugacaagaagaaagugguaugcucgagggggauccuuuuggggccaccaaggcugagugacgugggaugagggaugugggcaggccucuuagaugccacccaucuggcccacagaagaaccugggguaccgggacucaggcuauuacugggagguaccacccagugaggugcagcugcugaagaggaucgggacgggcucguuuggcaccguguuucgagggcgguggcauggcgauguggccgugaaggugcucaaggugucccagcccacagcugagcaggcccaggcuuucaagaaugagaugcaggugcucaggugagguggcaugugugcguggauggggguggcaggcccggccuuggcaucucucugggaaaaggccaugcuuggagugcuuccuggacaucaccuguguuuguguuguuaaaccaucaucagaaguuguuucucucugaagggugucccuuuccccucugggaaaugaguauguuuagaggaccugugaucaugcaguuguuuguguuuggguuauuaaugaaugguucugccuccaaaaugugggucuucucauuugccugcugcgaacugggucugugugugggccaccauucuuguuacugcauugccaggaaggcuuccaucuuuccuuccccucugcuugggcuacaaugguaauguucuguuuauaguguugguucuuguuauucauuaauucuaauaccuugauuuaaacaauauuaucaucaucaccauaaucuaaucauugcuuaauuauuauaauugcuguaauauguaaucaauacaguauucaucuagucacgcuaagaaagccaggugucuccuuuuugcugcuauaguuacuauguagcauaguacuguauaccuauauacuacagguaguacuggauagcgucuaccaacccuggggauguuggcauuggcuuuuccucugugucagaugggcacaauuauguuacagagaauaagguagcuaaugcaaugaucaguuuuacaguugaggaacaugaggcccagagagguuaaaugucuuucccaagguuguaccuugaguaccuggugaggccuagauuugaacaugaguccagacuccaagcucuuuaccucuaagcuucucaugcugcugaacaggcucuaaucaucauauaucaccaauguuuuaauccugcaucuauccauauuauauugauacaucagugaggaagguuggcauucugcuuucucaucugugagauggucacagacccagguaauggucagagucagaggggugggggauguuaaugauuagaaaugcugcuguaggcagggagggggaggggcagcaauuccucccuccugcuuuuguugggagacucggauggggaagcuccacauaugagcccacagcacagaaucauagcccaguaaacacaucucacaaauucauggaaucuggcaaugcuuugguccugagugccccaaaagacagggugaaaauaaaugaccgaggaagguaaagaacagugccacuccugaugcucgguaagugacaguugcuauuuuuccuccccaccucugacacugcccucccugccugcaggaagacgcgacaugucaacaucuugcuguuuaugggcuucaugacccggccgggauuugccaucaucacacaguggugugagggcuccagccucuaccaucaccugcauguggccgacacacgcuucgacaugguccagcucaucgacguggcccggcagacugcccagggcauggagugagccucccagccuggggagggguggggggaaagggugggggaaaugagguaacccccagccaauccgccaccugccuccacccccacagcuaccuccaugccaagaacaucauccaccgagaucucaagucuaacaguaucuaucugucccugggcugggguugagugggggugucaagggcuuagaaggaugccucuuguggggguucugggaauuacaagggaggggcaugugucccagagcuccuugccagguggcagagcuguggccagccagggggcuuuaauggcagucucuuagaagucagagguguggcugguucagguacuauucuuggggacucugguuagagucugaugucugacaguuguggagggcauuauggucaacaucagaggcauaguggguucggaugcccuccgaggggcuuccuguucaggagucacagcggggcugaguguggggggcauuagcaggcguucccugcccacgucaagguuguggauaguuugcgugauauuaaggggcuccuggucaggaucagagggaugagugguauaggggcaccaaugggaaccucccaggcagggugagaggcauggcuauuaggagucccuguagugguccuugacccuggcggacaucuuccuacaugaggggcucacggugaagaucggugacuuuggcuuggccacagugaagacucgauggagcggggcccagcccuuggagcagcccucaggaucugugcuguggauggugaguugggccaggcuggauggggggcacauggggacgugggcuccgggauugggguguguggggccaaguggggacggggaugccugugccagaugugggugucuggacuccucaugucccaccucguguggguggcucugaguuguacccuguguggccagugggaucugggacuguggaccagccauuugcugaccuccguggucccccugccuggucuggccuguuguaggcagcugaggugauccguaugcaggacccgaaccccuacagcuuccagucagacgucuaugccuacgggguugugcucuacgagcuuaugacuggcucacugccuuacagccacauuggcugccgugaccaggugagccccacaccuuacccacaguucccugggcugagggauccccucaggcauccauaccccacauccccuccuuugcacugauaaaugccacacuuuccccagaaaccuaaaauuuucuaggauaaggacucccagaaucccuugggcuccagacacuuacaauaaauucucugggucuccccuaccccaacuucccucuucucacauccacagcccucugggacaaaaaucuuugaaguccaaaaugccccgaaucucuauaccuagaauccccugaggcccccaaauaccccaaagcccucuguaucccuagacgccuauagucgucugcucuggguacucaaaaucccccagauccucaaagcccagaucucauuucucccagcaucccauuuuuccccagaaacagaaccccuuugugcuucuggaauagucauggacacccacagucaccuaggccuuggguaucuagcaggccccagggccgggauaccuagaacccucuaggccccagacccccacagaaguacaagcucccccagacccagaacuccauguuuucccgagacucaguacuuuccaggucccuaagccuccuagaaacccgugggccuauaauccucugagccccagauaccuacaauccuugacaaccccaaauuuaaaucccucuguucugaaagcagagaauccucccaaguccucaaggacagagaauccucugggccuugauacugacaguaccccagcucgcuaaaaaugaaccuuccaagucccucaauacaaaauuccuugggccucccagccccugaccccagaucaccccuuuccugcccccgucugcccccagauuaucuuuauggugggccguggcuaucuguccccggaccucagcaaaaucuccagcaacugccccaaggccaugcggcgccugcugucugacugccucaaguuccagcgggaggagcggccccucuucccccaggugggcuggguagggggcuggacaccuugggugggugacucugggauagaggaagacugagauggaggcagaugugaauaugaaagcucagagguauaguguguguguguguguguguguguguguguguuucaccaugaggcugggacuguuggggguguguguguauguguguuucgccaugaggcugggacuguuggguguguguguguguguguguguguguguguguguguuucgccaugaggcuggggcuguugggaugcccacagggcucuggacaccccuccucacccccaccugcccucagauccuggccacaauugagcugcugcaacggucacuccccaagauugagcggagugccucggaacccuccuugcaccgcacccaggccgaugaguugccugccugccuacucagcgcagcccgccuugugccuuaggccccgcccaagccaccagggagccaaucucagcccuccacgccaaggagccuugcccaccagccaaucaauguucgucucugcccugaugcugccucaggaucccccauuccccacccugggagaugaggggguccccaugugcuuuuccaguucuucuggaauugggggacccccgccaaagacugagcccccugucuccuccaucauuugguuuccucuuggcuuuggggauacuucuaaauuuugggagcuccuccaucuccaauggcugggauuuguggcagggauuccacucagaaccucucuggaauuugugccugaugugccuuccacuggauuuugggguucccagcaccccauguggauuuuggggggucccuuuugugucucccccgccauucaaggacuccucucuuucuucaccaagaagcacagaauucugcug

SEQ ID NO: 21331 - RNA, 10677 nt, Homo sapiens
cagcagaauucugugcuucuuggugaagaaagagaggaguccuugaauggcgggggagacacaaaagggaccccccaaaauccacauggggugcugggaaccccaaaauccaguggaaggcacaucaggcacaaauuccagagagguucugaguggaaucccugccacaaaucccagccauuggagauggaggagcucccaaaauuuagaaguauccccaaagccaagaggaaaccaaaugauggaggagacagggggcucagucuuuggcgggggucccccaauuccagaagaacuggaaaagcacauggggacccccucaucucccaggguggggaaugggggauccugaggcagcaucagggcagagacgaacauugauuggcuggugggcaaggcuccuuggcguggagggcugagauuggcucccugguggcuugggcggggccuaaggcacaaggcgggcugcgcugaguaggcaggcaggcaacucaucggccugggugcggugcaaggaggguuccgaggcacuccgcucaaucuuggggagugaccguugcagcagcucaauuguggccaggaucugagggcaggugggggugaggagggguguccagagcccugugggcaucccaacagccccagccucauggcgaaacacacacacacacacacacacacacacacacacacccaacagucccagccucauggcgaaacacacauacacacacacccccaacagucccagccucauggugaaacacacacacacacacacacacacacacacacuauaccucugagcuuucauauucacaucugccuccaucucagucuuccucuaucccagagucacccacccaagguguccagcccccuacccagcccaccugggggaagaggggccgcuccucccgcuggaacuugaggcagucagacagcaggcgccgcauggccuuggggcaguugcuggagauuuugcugagguccggggacagauagccacggcccaccauaaagauaaucugggggcagacgggggcaggaaaggggugaucuggggucaggggcugggaggcccaaggaauuuuguauugagggacuuggaagguucauuuuuagcgagcugggguacugucaguaucaaggcccagaggauucucuguccuugaggacuugggaggauucucugcuuucagaacagagggauuuaaauuugggguugucaaggauuguagguaucuggggcucagaggauuauaggcccacggguuucuaggaggcuuagggaccuggaaaguacugagucucgggaaaacauggaguucugggucugggggagcuuguacuucugugggggucuggggccuagaggguucuagguaucccggcccuggggccugcuagauacccaaggccuaggugacuguggguguccaugacuauuccagaagcacaaagggguucuguuucuggggaaaaaugggaugcugggagaaaugagaucugggcuuugaggaucugggggauuuugaguacccagagcagacgacuauaggcgucuagggauacagagggcuuugggguauuugggggccucaggggauucuagguauagagauucggggcauuuuggacuucaaagauuuuugucccagagggcuguggaugugagaagagggaaguugggguaggggagacccagagaauuuauuguaagugucuggagcccaagggauucugggaguccuuauccuagaaaauuuuagguuucuggggaaaguguggcauuuaucagugcaaaggaggggaugugggguauggaugccugaggggaucccucagcccagggaacuguggguaagguguggggcucaccuggucacggcagccaauguggcuguaaggcagugagccagucauaagcucguagagcacaaccccguaggcauagacgucugacuggaagcuguagggguucggguccugcauacggaucaccucagcugccuacaacaggccagaccaggcagggggaccacggaggucagcaaauggcugguccacagucccagaucccacuggccacacaggguacaacucagagccacccacacgaggugggacaugaggaguccagacacccacaucuggcacaggcauccccguccccacuuggccccacacaccccaaucccggagcccacguccccaugugccccccauccagccuggcccaacucaccauccacagcacagauccugagggcugcuccaagggcugggccccgcuccaucgagucuucacuguggccaagccaaagucaccgaucuucaccgugagccccucauguaggaagauguccgccagggucaaggaccacuacagggacuccuaauagccaugccucucacccugccugggagguucccauuggugccccuauaccacucaucccucugauccugaccaggagccccuuaauaucacgcaaacuauccacaaccuugacgugggcagggaacgccugcuaaugccccccacacucagccccgcugugacuccugaacaggaagccccucggagggcauccgaacccacuaugccucugauguugaccauaaugcccuccacaacugucagacaucagacucuaaccagaguccccaagaauaguaccugaaccagccacaccucugacuucuaagagacugccauuaaagcccccuggcuggccacagcucugccaccuggcaaggagcucugggacacaugccccucccuuguaauucccagaacccccacaagaggcauccuucuaagcccuugacacccccacucaaccccagcccagggacagauagauacuguuagacuugagaucucgguggaugauguucuuggcauggagguagcuguggggguggaggcagguggcggauuggcuggggguuaccucauuucccccacccuuuccccccaccccuccccaggcugggaggcucacuccaugcccugggcagucugccgggccacgucgaugagcuggaccaugucgaagcgugugucggccacaugcaggugaugguagaggcuggagcccucacaccacugugugaugauggcaaaucccggccgggucaugaagcccauaaacagcaagauguugacaugucgcgucuuccugcaggcagggagggcagugucagagguggggaggaaaaauagcaacugucacuuaccgagcaucaggaguggcacuguucuuuaccuuccucggucauuuauuuucacccugucuuuuggggcacucaggaccaaagcauugccagauuccaugaauuugugagauguguuuacugggcuaugauucugugcugugggcucauauguggagcuuccccauccgagucucccaacaaaagcaggagggaggaauugcugccccucccccucccugccuacagcagcauuucuaaucauuaacaucccccaccccucugacucugaccauuaccugggucugugaccaucucacagaugagaaagcagaaugccaaccuuccucacugauguaucaauauaauauggauagaugcaggauuaaaacauuggugauauaugaugauuagagccuguucagcagcaugagaagcuuagagguaaagagcuuggagucuggacucauguucaaaucuaggccucaccagguacucaagguacaaccuugggaaagacauuuaaccucucugggccucauguuccucaacuguaaaacugaucauugcauuagcuaccuuauucucuguaacauaauugugcccaucugacacagaggaaaagccaaugccaacauccccaggguugguagacgcuauccaguacuaccuguaguauauagguauacaguacuaugcuacauaguaacuauagcagcaaaaaggagacaccuggcuuucuuagcgugacuagaugaauacuguauugauuacauauuacagcaauuauaauaauuaagcaaugauuagauuauggugaugaugauaauauuguuuaaaucaagguauuagaauuaaugaauaacaagaaccaacacuauaaacagaacauuaccauuguagcccaagcagaggggaaggaaagauggaagccuuccuggcaaugcaguaacaagaaugguggcccacacacagacccaguucgcagcaggcaaaugagaagacccacauuuuggaggcagaaccauucauuaauaacccaaacacaaacaacugcaugaucacagguccucuaaacauacucauuucccagaggggaaagggacacccuucagagagaaacaacuucugaugaugguuuaacaacacaaacacaggugauguccaggaagcacuccaagcauggccuuuucccagagagaugccaaggccgggccugccacccccauccacgcacacaugccaccucaccugagcaccugcaucucauucuugaaagccugggccugcucagcugugggcugggacaccuugagcaccuucacggccacaucgccaugccaccgcccucgaaacacggugccaaacgagcccgucccgauccucuucagcagcugcaccucacugggugguaccucccaguaauagccugagucccgguaccccagguucuucugugggccagauggguggcaucuaagaggccugcccacaucccucaucccacgucacucagccuugguggccccaaaaggaucccccucgagcauaccacuuucuucuugucaucggccaaggacuuccgcucgcgcugcucugcuggugacuuggaauguggggacuuccuccccgaggacacgcuggcugggcuggggcucccccgggggguuccaucacuaccuccucuacuaccggcagcugcaguugcagagaggaugugaguggagguaaguggggcagcgggggucagggugcaggcacaggggacucaccaucagugcugaaacucuggccagugagcuagaagaagagggacaggagucaaaaagagggcauggaggccaacagggauggcucuacccucugcccugugguccccggcauugucccccacagcaccaaccuggaugagguuggaguccaugggggccguggugcugaccauauggacguugggaguggacguggagcggaugcgcuguaggggggcauuggcuggggcagggaaggggaagugcuccgggucacagugcugggugcgggggcugccaggggaaaggcugugaaaucacugccaggaaucagagaaccgagaaagccccccaccccacccccagccauaaacaugcauuuggcucacacagagcgaauguccacuggcaguacuauuauucauugcuucaagaaacauuuauugagugccugcugugugccagauaccauucuaggugguggagauaaaacuguaaaacaaaauaacaguucuugcccugguggggcugaaauaaaaaacaaauauauaauaugccugauggugauaggugcaauaaagaaaaauaguaaagcaaaauaaggagacacaaaguguuccuagaaagugucaggaaagguuucucugaggaggagaugacaauggaguaaacgccuaaaggcaggauagcaggccacacagauaguggggaaaggguaauguaucauauuuuauaauuauauauuauaauuacauguacuuuucaaauguuauauaauauguaucaucuauauaaaaauggcaauguuuuaaaauauacauauuaccauauuguuauacauacauguuauacauaugauauaugcuaaacauauuguaaaguuacaaaaauauguuaauguucccuucacuauccugaaaugaaacucaaagguaauuaaugcacauacacucauaauuuaaaauaauacccuaacuuuauuuuauguaucauauaaacauguaugauguucuacauuauauaaaauuauguaauacaacaugauacaauaacauaaauauaccauaaaauaugcacaucauaaaauauauauuagagcaauaauauauuuuaauauagcuauaguuuuauauaauauuuaacauaaaaaagcaauaaaagggaaguaauuuaugauaaaauaauacguauuucaaaauggaaaggcuugaguaugauuauacuagaauuagcaaaguaguuagaugcuuauaaauauauuuauaauuaauaacaaaaaaauugauuauuuacacuguaccagauccuguucuaggcacugaacaugucuuaacucauuuaagccucaccagaaccuuuauaugguagaaaguaucaucauccccucuuuacagaugagaaaacugaggcccagagaaaugaggugacuugcccaaggucccaguuucaugcccuuacucacacuuguaggugcucaauaaauguuugucaaguaaacaaaugaauaaaguauggcucguggucuacaagagccccaagaucuuuuucucccccagcagcucuucagcuaaggcaucccuaccugggacccugggggguuagcaacucauucagggggcgguucgagggagccucaugcugucuggagccuccggacaaauccuggacacugugguagaaccuugagggcaugaaggguauaaagcaaggggacacgggucagcugucuguaagggccucguggcugggccucugugcuccccauccccccacccaccccaggcugggcucacuguuggcgguugguacucaugucaacacagacuguggggaccuuggaggaacaaugcugguggaacuuguagccacagguuuggcaacggaagccauggaacagaaacuuaaggcagaagucacagaacgccaggcugaagaaggucuuccguaccugaugccacagagcagggaaguuugagaccuggucaaggacacccccaaccaugguccacccccaccguccacccugcacucacaaaauugugcauggucagcgggacaucuucaaggaccucgacaaugagcuccucgccauccaggggagcaauggcugugucccaggcagugaccgucuuucgucugcagggggcauggaaaggaaugagugggagguuggguaggggccauggggaggcagggaacccccacaagucccuccaagccugcuacccacagggucaugucuggcauguuuaauucucaucacagcaacucuagaaauuagucacuauccuugccccaacuuuacagauggggaaacaggcucagagggauaaagugacuggcccugggccacaaggguaaugagaggcaugacggugugaagaguccaugcucugaaacggaaggggagaagcaaaugaaacuaaacaacuacaucuuagaagcgcuaagccagccccugaaaagggggcugaggaggcacugaaacaacaaauaaagugcagugugugaacugcaucauaaauuaaggaaacccacgagagaggaauaaauaaagucagcaagacccaacucagcagacagagaauggggaaaaugaggaagaagagaccugaugaagucaugacaucgugaaaggacaaaauagaugaaaucugggcagaagugauggaccagggugaggacuugggggccaggggagaaugaguugcugaccuuacaggccaauaaaccaaugaaguaacaaaacaaaagauggaugaacucauagauuacuugaacuacaguaguccucccuuaucugugguuucacucuccaugguuucaguuaccuguggucaaccgggugggaaaguauuaaauugaaaauugcagaaauaaacaauucauaaguuuuaaauuacgugcauucugaguagcgugaugaaauccugcaccaucccacccaggaugugaaucaccucuuuaucuagcagauccacacugucuacgcuaccgcccaucacuuaguagccugcucaguuaucaaacaacugacucaauaucauaguggcugucuucaagugaccgccauuuuacuuaauaauggcccaaaagcacaagaguaguguugguggcaauucggacaugccaaagagaagcuguaaugugcuuccuuuaagcaaaaagguaaaaguucuugacuuaaaagaaaaucauaugcugagguugcugagaucuacuguaagaaagaaucuuccaucuuuggaauugugaagaaggaaaaauaaauucaugcuaguuuugaugucauaccucaaacugcaaaagugauggccggagugcaugauacgugcuuaguuaagacggaaaaggcauuacauuuauggguagaagacaagaauagaaacauguuccgacugauagcaauuggguucgguacuaucuaugguuucaagcauccacugggggucuuggaacauguacccugcagauaaggggggacuaaagacuaagggaagacuaauggaagacucugugauaaaguacagaaggaaucaaaugacugaggaggggaugggaggugggacacccagugggugggcguggggcugccacacucaccccuugaugagucgguagaccacacagcaguccugauuuagaccccgcaccuucagggccuugucuagagagucguagacacucaugccaucccggacagucaccuguguguaugugcagauguagggguccucaaugcccaacagaagcgcagcugauguucccauccuucugcaaaggccucccccaaccguugucacccuuuugaucccagaguuacaacuggguccauccacagccccugccauuucgcuuccaugacucaccaccgugcguugcuuguugggcagguauacuuugacggugcccacugcccgggauggcucggccccauuggcaggggggccccgugguggcuccauggagccuuagauuuugucaagaugggcugagguggggcugggcaggugccauggggcuccuacaagaaggcagacaagaauucagagguccaauaaugauagucuagaagcaaaguggcaggggacaaaauaaaauucaaaguccaggcuccugucgcccccugcagccuaauuuucacacgacaguccaagagauccugcucacaucugaaguccuuccaguuccuucucugcucaggcccuccuguugcuugucucacucuugagugccaaggucucagcuucacugcacaggguugcgggggagagaacagggaagggggacagagcauacugucuuggaggguagaggagcacacaagacucugugcuggggaccaauggggaagucaguacacacugcacugagccgucagguacauaagaagcacgaacagaauguccuggguuuuuuuuuuuuuuuuuucuguuuuuuuuuuuuucugacagaguuucgcucuuguugcccaggcuggagugcaauggcauggucucagcucacugcaaccuccaccucccaaguugaagccauucucccgccucagccuccugaguagcuggaacuacaggcgugugccaccacgcccggcuaauuuuuuguauuuuuaguagagacgggguuucaccauguuggccaggcuggucucgaacuccugaccucagaugauccacccgccucagccucccaaaguguccugguuuuuuaacagagaacgggggaaaugccaguuacuguggugagggaggagucgcaggcacggugaugggaaagagaggauuaucagauacugcccuuaguuuggggaagauggagguugcaccaaacauguccuuaaagggcacuguggacaucccuaagcccugggguguaauguugauguuaggaccacagacaccguuguuagguggcuaauggaagucccaagccucuaugaugaggaauucauggggggggggggucacuacauacuaugcggaagggagauguaacaggcgucacuagggacuguaauggggagaaggguggaaauggaaaugaccagacauugagccgaacuggggagguaaugguggaccaccagacauugucauagcaaaaggagaaggaagguaugguguugcggggagaaaaauggagguaaagagggagcuccaaaauucuccuugacaaccugugaggggucacaggcauauuacuggucuaaacugaaugagggaucauggaaggcgguuacagaggcgagaauccugacauucucccggcgggggcggucagacacugauccagaauaaggaaaccggggagugaaccgcguuuccacacacuccccgcaguugguaaggaaaggucauuggacaccuuagcggggguuaagacggaaucccggcaccacucggucgggucccgccuaccaaagggcuuccggcucugcgcaggcgcaccaccacuagcagcgggcgaaaccaucacccgcagccuugcccgccuauuccuguuacccaccccacccccgcugucgacgauggucucgccccgggucaaaccacuccuccgguuccgggcagggaacgccggggcccaagcgcagccauccuggagcugagcuuucgguccgggcucccugcccgugcccggcagccgcuccagaaaccgagcccucccgggcccgcccucaccugucacgccgcuacagccgccg

SEQ ID NO: 21332 - RNA, 15630 nt, Homo sapiens
gccucaaguaaacaguuuugcacaucaucuauuucucaaacguugagucgccuacagugagguuugucaccuacacaaucuuugccacaaucccugacaaccucuacuguaguuucaugcccacguagucucucacaugugguuuuggucacccagucugucuugcucgccaucaaacagugacagggcugcaguccccguucccuucucguagacauuauuuugugcauaccaucacagguucuuguacaguaccuugacuauucauccaggcucaguuauuuucugaaacacagccacaauuucccacauagacacaccaucaaaagucuguggucacaacuucugcacacucucacacacaaucacagcuuuccacgucucugacacacacaugguuaccgauaugcagucccuacuauuguuucucacacacgccaucacaccguuucucucacaaucgaccucugccucacacccuccacacacagucaugcgugucacgcucagcuaguccugacaacaucagagaaaaagugccagcagccuccagcaucacuuugaaaaauauauauuuacaggaacaauuccccauucucugggacucuuuagaaaaaaaaaagguccauuuuggggaaguaaaacaaacaguggagacgaguguagcacugucccccaaaucaccaacccccaggucccaaggccugggcugggccagcgcuaacaggugagcccaggagucuuuugaacccacucucucuugccuagaauagagacaggacaggcuuuaugucccccauuccucccucccaacuccagggacauugaaaggguccuuuguacccgcccgcaggaaauuggggggcugggagggagggaacugaaaauucauguuugguaucaaaaauaaacacuuggagugggggaggcggcaggaagauucccccccaaaucccuuccuucccacccaccccaccaaauauaggaagagaugacucccucuccccuauugaaaagccccauuuaaaaauagauuauacuaucaaaauggcagcgggggagagacagggagaccuggaguacuggcuggaggggccccccagacggggaccaccccccaaaaaaacccuccauugggaggaaacaggcaggaccccagggagguuggcagacaaaggaauggcuucucagggggaagaacaaaagggacauuccucccuggccaaaaaguugguugaaaaggauaagcugucugagagaaagguuggggagguggaaauuucuauuccaagggugugauucuuccuuggccaagacucccaacccauuaaaugguacaaauucuuccuggaccccugaguauggccaggaauaauaaaacaaaacaaacuaacucuucuacucacauccaaaaacgcagacagggcucccucaucuccccaagggcaggcugagaaauaaagaaagaaaggucguucucaagccagaccucgauugucuugucuuggggaaaaaaguggggaggugggggagauguccuaaccacccuaaaagguuaggucaggcuccucccaguggccuucaaaaaauaaauaaauaaaccgccccuaccauugaaguaggagacguguaagggcggccacugggggacugacagaaaacagagaaguuguggaagcuguguguuuucuguggaggagauaaugagaguuacucuugggaguaauucuucccaaggauccccaccccaccacaaucagagcaugagucuuucaguugaacuauguuucuccuugagauggcuggcuggagagagcauggauggagugaccccagaaggggugguggugguggugguaguagucauggcuucuggggcccuggggagagcaccacgggggucgagaggccauccacgcugauagaagggaugugcaccugggcgcugccacuggauggaaacugggggcaaaaagagggagaggucacagaugggggccauucuugggucucucacccuguccaaaacggggaaagaggauccuaccuggaaggagagcuuggccgggcuacggggcgcaaugggacucagggugcuccagaagugaaugcuaggaggcagcgagcugggugucagcagcaccggggucuguggggagaggguggucggagcucaagugaguagaaaguagaugugggaugcuggaagggacuuggucccggccccaccacagauuucccacucacacucccagggucacuccccaaagugcacacaccuagaugguaaccauggaggccaugccuaugaucucucaaacucugcagacaccccccacuccccacucccgagagcccacccucaguugcugagaccucauuggucaagaccacccacaagacccuauccaaaugcugcucucaaaccucucaagucaccaucccaacagcucagggucaacuuccaacucaugucccacccaugaaaccccauaugcacaucccagaccaaaaagcccugcucagguuccuuaagccacaccccaaccuagaaacagucccacagaaagacccucggucccacccacaaaaguccccagcccugcccuucacuaaucaaaccccaucccuccagccagcaucagcccagucaaucacacucaaaggcuccacccucuucaggaacaaccacacucacccuccucugauuccugucagucacccgccacaugccaaucccauuggugcuggcgcccacacaccccaccccuccgcaggcacucaccaauguaugcguaggaagcagggauggggucagcgccggccccggagccuggaggccggagccacuucccgauccugggguccguucgggucccggcccaccuagcaggcucgggcugaguggaagcucuaggucccggggcuuccggcccuucugcggcugggagaucucagggcuggaagccgcauggccgcccgccugcccugcgguguccauaacaaccgcgggcagccgggcuggcacgcccuccuguggagggacuucuggcucggccuuggugguuucuggcacaaacccucucucccccgcaacuuccaacucuuccuugggcccuucuacuuucacuucugggggcaaagcccggcccaaacccggcuccacauuaagcucuuccgauuucagguuuggggccucgggcggggucaggaugaccugguagaggagcaggcacaaagaggguguguaaggauuguugggaccacaggauucuccugugggccacccagugauuuccccgggaagguggcacuugguacucagggcaugacugcacaucagagcaaguccuccaacaggacauaggacuucgucaaggaaguagggcuuccucuggggcagguccuccuaugggacaggggacuuggggugagacaaccugaagcggguaggaaucugagggauaccauccucauucauuaaaacagugguucucaaaaauuuaccuuccucuggaccagcaauaucugccucauuugguaacaaguuaaaaaugcaaauuauugggccccuccccagccccacaaauucagaaacucugggggugugccuggcaaucugugguuuaacaagaccuacaggugauucugaugagcacuagagugcgagaaccagugcauuaaacauauuccaggcaccuacauguucggcagcuacuaacuguagcacaguauucuccccuuucugucucaggauuuguguagcucucugccccaccccuccuucuaagaggaugucuuccuuccaccauuaucuccuuuaacgggacagcuaugucucuucuaccagccucccucgucauccggggauuacacaucccuccucuuuacugccuccucuuacugaauuucuauauuccaguccuuaccugcagaggcaagccggccucuucagccuccagacaggccuccaaggggcuuggacuggugcuccugcuccccgaggggggcgcugcugccccugcaggagcugcacuggggagcaccacagcaggccgaggaugaggggguggcugcggcugcagagacuggauggugaagguggaauagaggcccgagcgcauguacucguuccggcugcugcgugccaaaccgccugggccugccauuccugcacccuugggugugccuggcuuuccagagacaguguccccuggggcggcauguauagcagcaggggccacauuuggcaugguggagguaacagacaccucuggcuggggcgggcaguccucaguggagcacccugcgaccucaggguaggacacaaacuuguagacgaacuucuggccgcucaccuugcggaugauguucuaggaagggaggagaggaacagagggccuuagaggaaaggggcaggcuggaggcagggugucaggggggaggagggggguggaguggcauuucucuucuccuaguggcuuucuucccacuugcuccucuccggcuuucccgucccuccucuguaaguuucucucucagcccauuuccucucccauugguuucuaccucuuuccucucccgccagauuccccuuaucuauaucccuccccaguuccuccccuuucucucuucucuccacaauaauuuuuucuuuaagccccuucccauccaccccuuuccaagccucccuuugucacucuccagguccgucuaucugauuuucccacucccuccacacuguagcuccucuucacaauggggcccaugaagggcaguaggugugggagcaggucuucuuccuggcuccaagaaccagagguucacagggccaggccuugugggugacugucaggacacaguuuuggagacuagcaaaugcaauaagacaagaaaaugaaguaacugauauaaauguuggaagaaaguaaauuaauguagauggauggggugaugaauuauuaauacagaggauuauuugaagcuaaugauacagaaguggaacagggcaaggucacugcagaggagagggugaggaggccucauuauuaauaccacuguggagguugaagcuaaaaugguaagaaaaugaaguaacuaacagcaauuagacaagaauauuaaaaauacugguauaaauauugggagggggccuauaucaaggcuggcuuugcugggucacagagcauguuugggguuuuucaggucuggugggucucagagaugaccuaguguucccagagggcagagugagauagccucauuacuaauauuguucuggaggguugagcucaaggaauaaaauaugaaaauggaauaaaugccauaaacuaugaagggugugcagcauaugaccagggcaguucugggaguguggaggcacuagggcauucuguggaagucuuagugcuggucagauaugucacagggugggccuguguuucucggaagaggaauaaaaagggauauucaugaauauuguuugggaaauuucaguagaaggauuaagaaaaugaaauaacugguauaaauauuggggggaggagaaacccagcaguggccugggggucugagagggcaggaugggggaaauuuuaaauuuuagcuguaggaauaagauaaugaaaacaauugauauaaauauugggguagaccagugcuccucugggaauuuaagaagacaguguguggaaguuggcauuaaacauguuguuucagagguuuuagcuuaaggaauaagagaagaaaauaauuaguuaaaaauguugggagucccagaggacgaaguaagcaaaaguugguauaauacugucagggagguuuugauucuaggaauaugaaauauucuggaauaagagaagacuaugaaauaacuagggaagcccagcacugguccagggguuucagaggacagaaugaggaccagccauuauuaaccguguuuucaagauguuggcuauaggaauacggcaggaaaaugaaacguugugcauggcagggcagcaucacuuuggggaucucagagugggaguagaaagagucaguauuaauaaugcaguggugguuuucgccaaagcaguaagacaagaaaguaggugagauaguguuuaggggcccaauacuggucuuaggguaccaauggauggguuaaaaacugauaaauuuuaacauugcuuucaaagucauagcuauggcaauuaaaacaaaauaaaaucucugauauaaaugucagggggggguuccagcccuggucugagagacuguaccuugucauaguaguaccgcaaggcccggcugagcuugucguaauucauguuggucuuguucuugcguagcccccacagccgggccaccuccucugcauccaccagcuugaauucaccaccaucccgugaaguccaggagaugauguggccauugccuugcucucucagcagcugcagcagaaacugccacagcgucacagauggguccaucgcugggggagugcucacgccaucccagggguaccuggagagcaaacagcugaguugagaggcuguggacauaggaggggcagaggucagcgggaggaggauuccuuuuuuugucaucuuuucuccaucucugucuucaaacccuaccaucauucccuaaaccuucccagacuaacuucuagcuccccagucuugcuugggaugcucccugugaugggauacaacucauggguaucuuaggauggugugaauguauuuugaaugugaaacaaaugugaaucugugggggucagagggcagacugugguaggccaaaugaugccaacccugcuccgcauccuaauccucggaaccuguauguuauuuacacuacauagcagaaaggaacuuugcagaugaaauuaagguuacaaacccuaagacagggagauuauuucuggauuauuugaugaaauucaaucuaaucauaugagcucugaaaagcagaugauggagaaagaaagguagcucagagaugugaugacagaagaggcaggggagauucaaaaugugagagggacucaaccugccauuguuggcuuugaagauggaggaaggaggcucagaaucaaggacugugggcagccucuuaaagcugggaauggcugucagcugacagacaguaaggaaacagggacuucaguccuacaaucucaaggaauuggauucugccaacaacuugaaugagcaggaaauggauuuuccccuagagccuccagaaggaacgcaacccugccaauaccuugauuucagcugagaccagugugggacuucugaccuacagaacuguaagauaacaaauguguuguuuuaagcagcuaaauuugugauuauuuguuacagcaagaauagaaaacuaguuccauccuccucauuugaauauuaucuguaucuucuaccauaucaaugucaaguuuuucaggagguuuuuuuuuugccagacccuugcaaaggcugcucacuccacguggggcuuccuucuuucgccuagcagucuuucuuaucuuucaagucccagcccaaagguccuuuccuuuaugaagccguccuaaaacugaaugaaugccugaucucucuguccuguuacugucccugaauguucucguucuuuuuuuuuuuuucuuuuuuuuugagauggagucucucucuguugcccaggcuggagcgcaguauaguggcacaaucuugacucacugcaaccucugccucccagguucaagcgauucucaugccucagccucccgcauagcugggauuacagguacccacgaccacgcccggcuaauuuuuguauuuuuaguagagacaugguuucaccauguuggccagacuggucuugaacuccugaccucaagugauccacccaccucccaccuuggcuucccaaagugcuaggauuacaggugugagauaccgugcucggcccugaauauucucuuucuugaugacagcaauaauuaacaucuauugagagcuuaauacacaucaggcacucuucuaagcagagaggcaauauggccugcuggacaacugcccaggcacuagggccagauugccaguguuugaauccugguucugccacuuauuagcugugugacccugggcauauucuuuuucuuuuuuuaagaaauggggucucacuauguugcccaggcuguucuugaacuccugggcucaagcaauccucucucccuggccuccuaaagugcuaggauuacaggcaugaggcaccacgcuuggcugauauucuuuaaccucuuuguaccucaauuuucucauguguaaaacagggauaaugauaugcccauuaguaaaauggggauaacaauaccuaguucacagagauauuguacagauuaaauauuauaugccugagguguaugauaagcucuaaauauuaguuucugauuuguucauagucccuuaucugccauuccaacauccaaaaugcucuaagggcagaaagcuucuuuuaacucuuuugguggcaaaaccugauuugaaaugaaacaaggcccuuucuggucuuuauugaaucucacuuauugcgaguguucauacauuuugcugcagaaauaugaacacagccgauuacagagcuuacuaagggguguuauguaacaucguauaugcaucauguuaccuuucugaaaugugaagaaauggaaauucugaaacacaucuggccccagggguuuuggguaagggcauguacaccuguacuguuauuuuuuuuuuuaaugggcauugacuuauuuaucccugaucaugccucugagaaguagguagucuuccugucauuaacuuauaaaugaggcagcggaggcacaaaugucuacguaccuuccacaggccacauguggcaaagccagcauuuggagccaggcagucagguuccaguugacuaagcauuucaccauuaggcuaaacggccccucacaccgacuauucccucucagcauguccuucaaagaacaggauccucccugucaccccauuacugcuuucuuuccugagagcaaacuggaaauaaacaugagcuuccuguucaauuauacaagucacaaagccaugaaguguccgauuagagaguccugucaccagagaccucacugaauuuguuuugcaggcaggcuuguuucagaaguccaaagaguucagagugacuccugguggcaaagacaggcaauuuuaccaguucuucuuucagcugcaacagaaccuaucagcugagugaaaggugacggugggcuuccagcuucaacagcacacagggcuuuguauuuuguuauuucucccacuugaccccucauaagaguucuaguaaucugccuugcuuagauauguuuacuucuuuccaucuccuucacuuagcaagcauuuggugagugcauacugugggccaggugcugcggauacagucgagaacgcaacagacaacaaucccugcuccagaggagcucacaucuuagcaggaaaggcagaugagaaaaaaggcaaacauguacaagagugcgucagauggugguaaggguuaugggaaaaaaaucaagcaggggagagcuguuacuuuuacauggagagucaggggagaguagucgccaaggaggggacaacugggcagagaccaaaaggaggugaaggaacugagcucgugaguaucugagagcagcaagccagguggaagcggcagccggugugaagggcccaaggcuggagagugccuggcaggugacauggggagaggaggcugacauggguucgggggagaggagggaggcagcgggagaggagaacagagugacgggggccagacugagccaggcuuuuucgggugcugucaggauguugagugagacaggagccacaagaggguugugaacagagggaugacaggcugugacugagauuucaacaggaucccccuggcgguugugagaagaacagacuguuggggcugaagaagccacugcgguagaugauggugguagcaguggggcuggcgagaaguagcuggggucuggagaaagccugaacacagaauaggacuugcugacagauagcaugcccgggggaggugagagaaggguccagggugagucuagguuuguggccuaaucacccacaaagacagcauuguggucagcugaggugggagccuugcaggagaguaaguuuugaggggggucacaccaguuuuggagauggucaguuucagaggccugucagacaucuacggguaugcuaugaauacauuuuaauaauuuaaaaaugcaagccaggcauacgauccuuaccgugggcugcacacucuuugaaucauuuaacucauugaauccucaaaccaccguuaaaggguggggauuaucauuucccccauuuuccacaugaggcaauggagguacagagaaguaaccugccccaagucacacagcuggaaguuggcagagccggaauucaaaaccuaagugguuuggcucuagugagcaaucgccuuacaccaccaguucuccaugaagagaaacagagaaggguaagauccuagagagugacaggaaugcuguuuuuacacaggguguacaaggaguucuuccccaaggaagugacaccuggccugaaggaggggagguagcaagccaggcugcccucugugggggagggccuucaggcggagcgaacggcguguacaaaggcucugaggcagccacccugaacuaucuaccguucccgagacaguuccaaccucugaggguaagcacgggcugcucuccccgcagggagagcucuucccucacuucauggacucaauuacacaaucaucgcauuccaggaagaauucauucuuccucugcgugaucaaaggugccaaauaaccugccugcccuugcaaaucuguucuucuuucugagucuucagccuuauguuccucugccccuguucuggcuauucuggcucaagguuacccugagcaaguuacucagccucucuuugcuuguuuccucaucuguaaaauggggauauuuuacucucaaagucaaauauucucaaaaguacaccuacccuccaaggcuucugugaggauuaacugugucaauucuguaaaauacuucuguaaaagacuugagggguugacuuuuuuuuuuguuuuuacaaguagcauuguuaggaacuucuuuuuuauacaugugccuuuguauaguauauuccaagcaccauaguguuuaacaaugaauauuuacugaaauaacacuacccaggugccagaaaaucaaaucacucuuagaaacaucuuuuaugccugugccuuuaggagaguguauuaugcacaccacagugguuauuuuuuggguuuuuuuucggagacggggaucucacuauguugcacaggcuggccuggaacuccugggcucaagugauccucccaccucagccucugugcccagcuauacaccacaguuuugugaacacauucuuucaaugcaacaacacaguccuuauucacauauacaacuagcacucuuagaaacagcuuuuauaccugugccuccauagagcauauuacauaccucaguuuugugaacauauccuuuugaaaaggaggaaaauccuuauucauauauaaacuggcauucuuagaaauaucuuugacacauguaucuuuuuguagugcauuccaggcaccaccgugugguaaacauccuuuggggguugguauuugaacagaaaagugccucugauguguggcagauacuccacagauauuagcuauuagcuagugugucauccuucucccccugccccugcaauccuauccuauguaucaccugcacuaucuggcucccaucaccugugugaccucaccuucuacccuuccccgcacucugcuccagccacacuggccgccuugauguuccuugaacauggcaggcaccaucccaccucagggccucugaacuggcacuuccuucugccugguaugcucuucccguagacauuaaggcucucuccgucucuaccgugaggcccuaauucaagagucaccuucccuaugccuaagauuucaaccacccccaauacucgauuccuaccugcccuauuucauuauuucuucucagcauuugucuauuaugcuaauuuuacuuauuuauuuuguucacauagucugucuccccagcuuggguuuuuuuuuuuuuuuuuuugagacagagucucgcucugucacccaugcuggagugcauggugcaaucuuggcucacugcaaccuccgccuccuggguucaagcaauucuccugccucagccucccaaguaacugggauuacaggcgcacgccgccacacccagcuaauuuuuuuguauuuuaguagagaugggguuucaccgugaugcccaggcuggucuugaacuccugagcucaggcaauccacccaccucagccucccaaagugcuaggauuacugguguuagccaccgugcccagccuccccaacuuuuaauaaaugucagcuccacaagcacaaauauuucgcccuguuucguuccuugccauauuccagcaccuagaagagugccugguacucacaaggggcucaguaaagguugguugcaggaacagucccaacuaauuagcucucauaucccuucuucuuccucaugugaccccuacacuggugucucaaauuaucuuuuucccauuuauucaugggauaaauucuuauugagcaucugcuguuuaccugguacauuuucaguugcuggagacauagcggugaaugagcagacaaaaacugaguccucaugggacucacauucuaaugaggagagacagacaacaaacaaguaacccacacagugugucagacagugauaaagggcaacgggacaaaucagggaccuggcuugagcccugcugggugugcagcuucagauggucagggagggguugacuuuuuuuguuuuuacaaguagcauuguuaggaacuucuuuuuuauacaugugccuuuguauaguauauucuaaguaccauggugugacaaucaaccuuuaaugaaauaacacuacccagguacaacaaaaucaaaucacucuuagaaacaucuuuuacgccugugccuuuaagagaguguauuacacacaccacagugguuguuuuuuggguuuuuuuuuuucagaaaaagggaucucgcuauauugcccaggcuggccuggaacuccugggcucaagcuauccucccaccucagccucccgaguagcugggacuauaagugcacaccccugugcccagcuacacaccacaguuuugugaacacauucuuucaaugcaacaacacaguccuuauucacauauacaacuagcacucuuagaaacagcuuuuauaccuaugccuuuacagagcauauuacguaccucagucuugugaacacauccuuuugaaaaggaggaaaacccuuacucauauauaaacuggcauucuuagaaacaucuuucauacauguaucuuuuuauacugcauuccacacaccacagugugguaaacauccuuuggggguugguauuugaacagagugcugaaaggaaccaugcagagaucugggggugguguucaaggcacaaagaacagccaaugcaaaggcccugaggcuggcccaugccugcuauguuugaggagcugugugguggaaccagugugguuggagcacaguaagggggugggaagguauaggcgguaaugcuagaaagguuacuuguuuuaccauuaauucacaguuaauauuuauuuacacuggaagggauucuaguucugaucccccauuucacaaaugaagaaaaaggcacagagaggaagugguuaaaucacucaucuaaggucacacagcugcugggauuggggggugggugggugcugagagaaggugaggaaugaagacugcucugcaggcagagggaacagcaagaacaaaagcuuggaggugagaacuaauuugguuuuuaaggacugaggccucacguggggugggaugagaucuaagaggggagccucaaaaauuauccuguguccugaguacuuccugggccaccuuugaguaaggaauuuaaccucccuauggcccaauucccucacuaccuaucucaugggguuguggugaggauuaaaggaacucauucauaugaaacacucugccugauauacggcaggugcucaauaaacgcuagcuccuauuggcauuacuaucaucacuggcgcuaauguauucacuuauuguagugaggcagaacgucuuugugguuacgagugugaccaggcugacccacuauuaagagguggaggacagggaaggccguacagugcuccaucacaaggaaaagaggaucagcacguucucuucugggaagggaaaaaaaaagagaaggaaauugaaaguacacggccgaucuucccccaauuacaaagcacuggacucacgggaggguaugcgggggacugugcaagcauacaggggugugggggaggaaggccaaugaacagauccacugcaaagggaggggugaugaggcucaucgucugaggggaaggggagcagaaaaccuuacagacuccugcaccacagugagaggagagaaaagccaucacacagacugauucaaagcagagagggaaaaggcuauggacugagcuacugaaaauagggagauguaaagcacuaaacuaacccacuauuaaaaaggagagaaccccaagcgcuagagcgacagucuacgaaaaagaggagacagggcaauggacugauagcuaaagggacgugaauccaaacaugaagacugauccacuauaaaaugguggugguggugguggggggggggggugguuuugaaaaaagccauggacugaugcauugggggacuggaggaggcaggaauacaaacucagguagacucacuguuaaagagggaugcggaggagugcggcgccacggauugauucgcuacgauguacaggaaggguggaauaaauaaggccacggacgggucuccugaaaguugaggcuaggagaaauccaaacacucagauacaccuacuauuaagggggcugaacacugucacaggcuagcucccuauaaguggggguggguggggggcggguggggguagggguagggggaaagccuauggacgaguccacccuaaguuggcguggggaaaaacauaagcacgcagaccgauccauuauacaacgggagggggagguuaggccacggucagauccacuauaagggacgaagggcuugagcaaugccacacgcagguccaccagccguggugguggcggcggggagucgaacaccagcaggccaccggccaagccacauccucugcgcgggggcgggaaggauacguggggucacggacugggcccuccacccuccaggcccagagcucaccuguguguagcguggcgguggcguuggcaauguuggcagcuccggggggcgggggcuccauacgcggccccaccgccccccaggccuggguuccgaggcggcgguggagguggugguggcgguggcggcggcagcaccuagaagccgccccugcguuucccuacagcucacgu

SEQ ID NO: 21333 - RNA, 15630 nt, Homo sapiens
acgugagcuguagggaaacgcaggggcggcuucuaggugcugccgccgccaccgccaccaccaccuccaccgccgccucggaacccaggccuggggggcgguggggccgcguauggagcccccgccccccggagcugccaacauugccaacgccaccgccacgcuacacacaggugagcucugggccuggaggguggagggcccaguccgugaccccacguauccuucccgcccccgcgcagaggauguggcuuggccgguggccugcugguguucgacuccccgccgccaccaccacggcugguggaccugcguguggcauugcucaagcccuucgucccuuauaguggaucugaccguggccuaaccucccccucccguuguauaauggaucggucugcgugcuuauguuuuuccccacgccaacuuaggguggacucguccauaggcuuucccccuaccccuacccccacccgccccccacccacccccacuuauagggagcuagccugugacaguguucagcccccuuaauaguagguguaucugaguguuuggauuucuccuagccucaacuuucaggagacccguccguggccuuauuuauuccacccuuccuguacaucguagcgaaucaauccguggcgccgcacuccuccgcaucccucuuuaacagugagucuaccugaguuuguauuccugccuccuccagucccccaaugcaucaguccauggcuuuuuucaaaaccaccccccccccccaccaccaccaccaccauuuuauaguggaucagucuucauguuuggauucacgucccuuuagcuaucaguccauugcccugucuccucuuuuucguagacugucgcucuagcgcuugggguucucuccuuuuuaauaguggguuaguuuagugcuuuacaucucccuauuuucaguagcucaguccauagccuuuucccucucugcuuugaaucagucugugugauggcuuuucucuccucucacuguggugcaggagucuguaagguuuucugcuccccuuccccucagacgaugagccucaucaccccucccuuugcaguggaucuguucauuggccuuccucccccacaccccuguaugcuugcacagucccccgcauacccucccgugaguccagugcuuuguaauugggggaagaucggccguguacuuucaauuuccuucucuuuuuuuuucccuucccagaagagaacgugcugauccucuuuuccuugugauggagcacuguacggccuucccuguccuccaccucuuaauagugggucagccuggucacacucguaaccacaaagacguucugccucacuacaauaagugaauacauuagcgccagugaugauaguaaugccaauaggagcuagcguuuauugagcaccugccguauaucaggcagaguguuucauaugaaugaguuccuuuaauccucaccacaaccccaugagauagguagugagggaauugggccauagggagguuaaauuccuuacucaaagguggcccaggaaguacucaggacacaggauaauuuuugaggcuccccucuuagaucucaucccaccccacgugaggccucaguccuuaaaaaccaaauuaguucucaccuccaagcuuuuguucuugcuguucccucugccugcagagcagucuucauuccucaccuucucucagcacccacccaccccccaaucccagcagcugugugaccuuagaugagugauuuaaccacuuccucucugugccuuuuucuucauuugugaaaugggggaucagaacuagaaucccuuccaguguaaauaaauauuaacugugaauuaaugguaaaacaaguaaccuuucuagcauuaccgccuauaccuucccacccccuuacugugcuccaaccacacugguuccaccacacagcuccucaaacauagcaggcaugggccagccucagggccuuugcauuggcuguucuuugugccuugaacaccacccccagaucucugcaugguuccuuucagcacucuguucaaauaccaacccccaaaggauguuuaccacacugugguguguggaaugcaguauaaaaagauacauguaugaaagauguuucuaagaaugccaguuuauauaugaguaaggguuuuccuccuuuucaaaaggauguguucacaagacugagguacguaauaugcucuguaaaggcauagguauaaaagcuguuucuaagagugcuaguuguauaugugaauaaggacuguguuguugcauugaaagaauguguucacaaaacugugguguguagcugggcacaggggugugcacuuauagucccagcuacucgggaggcugaggugggaggauagcuugagcccaggaguuccaggccagccugggcaauauagcgagaucccuuuuucugaaaaaaaaaaacccaaaaaacaaccacugugguguguguaauacacucucuuaaaggcacaggcguaaaagauguuucuaagagugauuugauuuuguuguaccuggguaguguuauuucauuaaagguugauugucacaccaugguacuuagaauauacuauacaaaggcacauguauaaaaaagaaguuccuaacaaugcuacuuguaaaaacaaaaaaagucaaccccucccugaccaucugaagcugcacacccagcagggcucaagccaggucccugauuugucccguugcccuuuaucacugucugacacacuguguggguuacuuguuuguugucugucucuccucauuagaaugugagucccaugaggacucaguuuuugucugcucauucaccgcuaugucuccagcaacugaaaauguaccagguaaacagcagaugcucaauaagaauuuaucccaugaauaaaugggaaaaagauaauuugagacaccaguguaggggucacaugaggaagaagaagggauaugagagcuaauuaguugggacuguuccugcaaccaaccuuuacugagccccuugugaguaccaggcacucuucuaggugcuggaauauggcaaggaacgaaacagggcgaaauauuugugcuuguggagcugacauuuauuaaaaguuggggaggcugggcacgguggcuaacaccaguaauccuagcacuuugggaggcugagguggguggauugccugagcucaggaguucaagaccagccugggcaucacggugaaaccccaucucuacuaaaauacaaaaaaauuagcuggguguggcggcgugcgccuguaaucccaguuacuugggaggcugaggcaggagaauugcuugaacccaggaggcggagguugcagugagccaagauugcaccaugcacuccagcaugggugacagagcgagacucugucucaaaaaaaaaaaaaaaaaaacccaagcuggggagacagacuaugugaacaaaauaaauaaguaaaauuagcauaauagacaaaugcugagaagaaauaaugaaauagggcagguaggaaucgaguauugggggugguugaaaucuuaggcauagggaaggugacucuugaauuagggccucacgguagagacggagagagccuuaaugucuacgggaagagcauaccaggcagaaggaagugccaguucagaggcccugaggugggauggugccugccauguucaaggaacaucaaggcggccaguguggcuggagcagagugcggggaaggguagaaggugaggucacacaggugaugggagccagauagugcaggugauacauaggauaggauugcaggggcagggggagaaggaugacacacuagcuaauagcuaauaucuguggaguaucugccacacaucagaggcacuuuucuguucaaauaccaacccccaaaggauguuuaccacacgguggugccuggaaugcacuacaaaaagauacaugugucaaagauauuucuaagaaugccaguuuauauaugaauaaggauuuuccuccuuuucaaaaggauauguucacaaaacugagguauguaauaugcucuauggaggcacagguauaaaagcuguuucuaagagugcuaguuguauaugugaauaaggacuguguuguugcauugaaagaauguguucacaaaacugugguguauagcugggcacagaggcugaggugggaggaucacuugagcccaggaguuccaggccagccugugcaacauagugagauccccgucuccgaaaaaaaacccaaaaaauaaccacuguggugugcauaauacacucuccuaaaggcacaggcauaaaagauguuucuaagagugauuugauuuucuggcaccuggguaguguuauuucaguaaauauucauuguuaaacacuauggugcuuggaauauacuauacaaaggcacauguauaaaaaagaaguuccuaacaaugcuacuuguaaaaacaaaaaaaaaagucaaccccucaagucuuuuacagaaguauuuuacagaauugacacaguuaauccucacagaagccuuggaggguagguguacuuuugagaauauuugacuuugagaguaaaauauccccauuuuacagaugaggaaacaagcaaagagaggcugaguaacuugcucaggguaaccuugagccagaauagccagaacaggggcagaggaacauaaggcugaagacucagaaagaagaacagauuugcaagggcaggcagguuauuuggcaccuuugaucacgcagaggaagaaugaauucuuccuggaaugcgaugauuguguaauugaguccaugaagugagggaagagcucucccugcggggagagcagcccgugcuuacccucagagguuggaacugucucgggaacgguagauaguucaggguggcugccucagagccuuuguacacgccguucgcuccgccugaaggcccucccccacagagggcagccuggcuugcuaccuccccuccuucaggccaggugucacuuccuuggggaagaacuccuuguacacccuguguaaaaacagcauuccugucacucucuaggaucuuacccuucucuguuucucuucauggagaacuggugguguaaggcgauugcucacuagagccaaaccacuuagguuuugaauuccggcucugccaacuuccagcugugugacuuggggcagguuacuucucuguaccuccauugccucauguggaaaaugggggaaaugauaauccccacccuuuaacggugguuugaggauucaaugaguuaaaugauucaaagagugugcagcccacgguaaggaucguaugccuggcuugcauuuuuaaauuauuaaaauguauucauagcauacccguagaugucugacaggccucugaaacugaccaucuccaaaacuggugugaccccccucaaaacuuacucuccugcaaggcucccaccucagcugaccacaaugcugucuuugugggugauuaggccacaaaccuagacucacccuggacccuucucucaccucccccgggcaugcuaucugucagcaaguccuauucuguguucaggcuuucuccagaccccagcuacuucucgccagccccacugcuaccaccaucaucuaccgcaguggcuucuucagccccaacagucuguucuucucacaaccgccagggggauccuguugaaaucucagucacagccugucaucccucuguucacaacccucuuguggcuccugucucacucaacauccugacagcacccgaaaaagccuggcucagucuggcccccgucacucuguucuccucucccgcugccucccuccucucccccgaacccaugucagccuccucuccccaugucaccugccaggcacucuccagccuugggcccuucacaccggcugccgcuuccaccuggcuugcugcucucagauacucacgagcucaguuccuucaccuccuuuuggucucugcccaguuguccccuccuuggcgacuacucuccccugacucuccauguaaaaguaacagcucuccccugcuugauuuuuuucccauaacccuuaccaccaucugacgcacucuuguacauguuugccuuuuuucucaucugccuuuccugcuaagaugugagcuccucuggagcagggauuguugucuguugcguucucgacuguauccgcagcaccuggcccacaguaugcacucaccaaaugcuugcuaagugaaggagauggaaagaaguaaacauaucuaagcaaggcagauuacuagaacucuuaugaggggucaagugggagaaauaacaaaauacaaagcccugugugcuguugaagcuggaagcccaccgucaccuuucacucagcugauagguucuguugcagcugaaagaagaacugguaaaauugccugucuuugccaccaggagucacucugaacucuuuggacuucugaaacaagccugccugcaaaacaaauucagugaggucucuggugacaggacucucuaaucggacacuucauggcuuugugacuuguauaauugaacaggaagcucauguuuauuuccaguuugcucucaggaaagaaagcaguaauggggugacagggaggauccuguucuuugaaggacaugcugagagggaauagucggugugaggggccguuuagccuaauggugaaaugcuuagucaacuggaaccugacugccuggcuccaaaugcuggcuuugccacauguggccuguggaagguacguagacauuugugccuccgcugccucauuuauaaguuaaugacaggaagacuaccuacuucucagaggcaugaucagggauaaauaagucaaugcccauuaaaaaaaaaaauaacaguacagguguacaugcccuuacccaaaaccccuggggccagauguguuucagaauuuccauuucuucacauuucagaaagguaacaugaugcauauacgauguuacauaacaccccuuaguaagcucuguaaucggcuguguucauauuucugcagcaaaauguaugaacacucgcaauaagugagauucaauaaagaccagaaagggccuuguuucauuucaaaucagguuuugccaccaaaagaguuaaaagaagcuuucugcccuuagagcauuuuggauguuggaauggcagauaagggacuaugaacaaaucagaaacuaauauuuagagcuuaucauacaccucaggcauauaauauuuaaucuguacaauaucucugugaacuagguauuguuauccccauuuuacuaaugggcauaucauuaucccuguuuuacacaugagaaaauugagguacaaagagguuaaagaauaucagccaagcguggugccucaugccuguaauccuagcacuuuaggaggccagggagagaggauugcuugagcccaggaguucaagaacagccugggcaacauagugagaccccauuucuuaaaaaaagaaaaagaauaugcccagggucacacagcuaauaaguggcagaaccaggauucaaacacuggcaaucuggcccuagugccugggcaguuguccagcaggccauauugccucucugcuuagaagagugccugauguguauuaagcucucaauagauguuaauuauugcugucaucaagaaagagaauauucagggccgagcacgguaucucacaccuguaauccuagcacuuugggaagccaaggugggagguggguggaucacuugaggucaggaguucaagaccagucuggccaacauggugaaaccaugucucuacuaaaaauacaaaaauuagccgggcguggucguggguaccuguaaucccagcuaugcgggaggcugaggcaugagaaucgcuugaaccugggaggcagagguugcagugagucaagauugugccacuauacugcgcuccagccugggcaacagagagagacuccaucucaaaaaaaaagaaaaaaaaaaaaagaacgagaacauucagggacaguaacaggacagagagaucaggcauucauucaguuuuaggacggcuucauaaaggaaaggaccuuugggcugggacuugaaagauaagaaagacugcuaggcgaaagaaggaagccccacguggagugagcagccuuugcaagggucuggcaaaaaaaaaaccuccugaaaaacuugacauugauaugguagaagauacagauaauauucaaaugaggaggauggaacuaguuuucuauucuugcuguaacaaauaaucacaaauuuagcugcuuaaaacaacacauuuguuaucuuacaguucuguaggucagaagucccacacuggucucagcugaaaucaagguauuggcaggguugcguuccuucuggaggcucuaggggaaaauccauuuccugcucauucaaguuguuggcagaauccaauuccuugagauuguaggacugaagucccuguuuccuuacugucugucagcugacagccauucccagcuuuaagaggcugcccacaguccuugauucugagccuccuuccuccaucuucaaagccaacaauggcagguugagucccucucacauuuugaaucuccccugccucuucugucaucacaucucugagcuaccuuucuuucuccaucaucugcuuuucagagcucauaugauuagauugaauuucaucaaauaauccagaaauaaucucccugucuuaggguuuguaaccuuaauuucaucugcaaaguuccuuucugcuauguaguguaaauaacauacagguuccgaggauuaggaugcggagcaggguuggcaucauuuggccuaccacagucugcccucugacccccacagauucacauuuguuucacauucaaaauacauucacaccauccuaagauacccaugaguuguaucccaucacagggagcaucccaagcaagacuggggagcuagaaguuagucugggaagguuuagggaaugaugguaggguuugaagacagagauggagaaaagaugacaaaaaaaggaauccuccucccgcugaccucugccccuccuauguccacagccucucaacucagcuguuugcucuccagguaccccugggauggcgugagcacucccccagcgauggacccaucugugacgcuguggcaguuucugcugcagcugcugagagagcaaggcaauggccacaucaucuccuggacuucacgggaugguggugaauucaagcugguggaugcagaggagguggcccggcugugggggcuacgcaagaacaagaccaacaugaauuacgacaagcucagccgggccuugcgguacuacuaugacaagguacagucucucagaccagggcuggaaccccccccugacauuuauaucagagauuuuauuuuguuuuaauugccauagcuaugacuuugaaagcaauguuaaaauuuaucaguuuuuaacccauccauugguacccuaagaccaguauugggccccuaaacacuaucucaccuacuuucuugucuuacugcuuuggcgaaaaccaccacugcauuauuaauacugacucuuucuacucccacucugagauccccaaagugaugcugcccugccaugcacaacguuucauuuuccugccguauuccuauagccaacaucuugaaaacacgguuaauaauggcugguccucauucuguccucugaaaccccuggaccagugcugggcuucccuaguuauuucauagucuucucuuauuccagaauauuucauauuccuagaaucaaaaccucccugacaguauuauaccaacuuuugcuuacuucguccucugggacucccaacauuuuuaacuaauuauuuucuucucuuauuccuuaagcuaaaaccucugaaacaacauguuuaaugccaacuuccacacacugucuucuuaaauucccagaggagcacuggucuaccccaauauuuauaucaauuguuuucauuaucuuauuccuacagcuaaaauuuaaaauuucccccauccugcccucucagacccccaggccacugcuggguuucuccuccccccaauauuuauaccaguuauuucauuuucuuaauccuucuacugaaauuucccaaacaauauucaugaauaucccuuuuuauuccucuuccgagaaacacaggcccacccugugacauaucugaccagcacuaagacuuccacagaaugcccuagugccuccacacucccagaacugcccuggucauaugcugcacacccuucauaguuuauggcauuuauuccauuuucauauuuuauuccuugagcucaacccuccagaacaauauuaguaaugaggcuaucucacucugcccucugggaacacuaggucaucucugagacccaccagaccugaaaaaccccaaacaugcucugugacccagcaaagccagccuugauauaggcccccucccaauauuuauaccaguauuuuuaauauucuugucuaauugcuguuaguuacuucauuuucuuaccauuuuagcuucaaccuccacagugguauuaauaaugaggccuccucacccucuccucugcagugaccuugcccuguuccacuucuguaucauuagcuucaaauaauccucuguauuaauaauucaucaccccauccaucuacauuaauuuacuuucuuccaacauuuauaucaguuacuucauuuucuugucuuauugcauuugcuagucuccaaaacuguguccugacagucacccacaaggccuggcccugugaaccucugguucuuggagccaggaagaagaccugcucccacaccuacugcccuucaugggccccauugugaagaggagcuacaguguggagggagugggaaaaucagauagacggaccuggagagugacaaagggaggcuuggaaagggguggaugggaaggggcuuaaagaaaaaauuauuguggagagaagagagaaaggggaggaacuggggagggauauagauaaggggaaucuggcgggagaggaaagagguagaaaccaaugggagaggaaaugggcugagagagaaacuuacagaggagggacgggaaagccggagaggagcaagugggaagaaagccacuaggagaagagaaaugccacuccaccccccuccuccccccugacacccugccuccagccugccccuuuccucuaaggcccucuguuccucuccucccuuccuagaacaucauccgcaaggugagcggccagaaguucgucuacaaguuuguguccuacccugaggucgcagggugcuccacugaggacugcccgccccagccagaggugucuguuaccuccaccaugccaaauguggccccugcugcuauacaugccgccccaggggacacugucucuggaaagccaggcacacccaagggugcaggaauggcaggcccaggcgguuuggcacgcagcagccggaacgaguacaugcgcucgggccucuauuccaccuucaccauccagucucugcagccgcagccacccccucauccucggccugcuguggugcuccccagugcagcuccugcaggggcagcagcgccccccucggggagcaggagcaccaguccaagccccuuggaggccugucuggaggcugaagaggccggcuugccucugcagguaaggacuggaauauagaaauucaguaagaggaggcaguaaagaggagggauguguaauccccggaugacgagggaggcugguagaagagacauagcugucccguuaaaggagauaaugguggaaggaagacauccucuuagaaggagggguggggcagagagcuacacaaauccugagacagaaaggggagaauacugugcuacaguuaguagcugccgaacauguaggugccuggaauauguuuaaugcacugguucucgcacucuagugcucaucagaaucaccuguaggucuuguuaaaccacagauugccaggcacacccccagaguuucugaauuuguggggcuggggaggggcccaauaauuugcauuuuuaacuuguuaccaaaugaggcagauauugcugguccagaggaagguaaauuuuugagaaccacuguuuuaaugaaugaggaugguaucccucagauuccuacccgcuucagguugucucaccccaaguccccugucccauaggaggaccugccccagaggaagcccuacuuccuugacgaaguccuauguccuguuggaggacuugcucugaugugcagucaugcccugaguaccaagugccaccuucccggggaaaucacuggguggcccacaggagaauccuguggucccaacaauccuuacacacccucuuugugccugcuccucuaccaggucauccugaccccgcccgaggccccaaaccugaaaucggaagagcuuaauguggagccggguuugggccgggcuuugcccccagaagugaaaguagaagggcccaaggaagaguuggaaguugcgggggagagaggguuugugccagaaaccaccaaggccgagccagaagucccuccacaggagggcgugccagcccggcugcccgcgguuguuauggacaccgcagggcaggcgggcggccaugcggcuuccagcccugagaucucccagccgcagaagggccggaagccccgggaccuagagcuuccacucagcccgagccugcuaggugggccgggacccgaacggaccccaggaucgggaaguggcuccggccuccaggcuccggggccggcgcugaccccaucccugcuuccuacgcauacauuggugagugccugcggagggguggggugugugggcgccagcaccaaugggauuggcauguggcgggugacugacaggaaucagaggagggugagugugguuguuccugaagaggguggagccuuugagugugauugacugggcugaugcuggcuggagggaugggguuugauuagugaagggcagggcuggggacuuuugugggugggaccgagggucuuucugugggacuguuucuagguugggguguggcuuaaggaaccugagcagggcuuuuuggucugggaugugcauaugggguuucaugggugggacaugaguuggaaguugacccugagcuguugggauggugacuugagagguuugagagcagcauuuggauagggucuuguggguggucuugaccaaugaggucucagcaacugagggugggcucucgggaguggggaguggggggugucugcagaguuugagagaucauaggcauggccuccaugguuaccaucuaggugugugcacuuuggggagugacccugggagugugagugggaaaucugugguggggccgggaccaagucccuuccagcaucccacaucuacuuucuacucacuugagcuccgaccacccucuccccacagaccccggugcugcugacacccagcucgcugccuccuagcauucacuucuggagcacccugagucccauugcgccccguagcccggccaagcucuccuuccagguaggauccucuuuccccguuuuggacagggugagagacccaagaauggcccccaucugugaccucucccucuuuuugcccccaguuuccauccaguggcagcgcccaggugcacaucccuucuaucagcguggauggccucucgacccccguggugcucuccccagggccccagaagccaugacuacuaccaccaccaccaccaccccuucuggggucacuccauccaugcucucuccagccagccaucucaaggagaaacauaguucaacugaaagacucaugcucugauuguggugggguggggauccuugggaagaauuacucccaagaguaacucucauuaucuccuccacagaaaacacacagcuuccacaacuucucuguuuucugucagucccccaguggccgcccuuacacgucuccuacuucaaugguaggggcgguuuauuuauuuauuuuuugaaggccacugggaggagccugaccuaaccuuuuagggugguuaggacaucucccccaccuccccacuuuuuuccccaagacaagacaaucgaggucuggcuugagaacgaccuuucuuucuuuauuucucagccugcccuuggggagaugagggagcccugucugcguuuuuggaugugaguagaagaguuaguuuguuuuguuuuauuauuccuggccauacucagggguccaggaagaauuuguaccauuuaauggguugggagucuuggccaaggaagaaucacacccuuggaauagaaauuuccaccuccccaaccuuucucucagacagcuuauccuuuucaaccaacuuuuuggccagggaggaaugucccuuuuguucuucccccugagaagccauuccuuugucugccaaccucccugggguccugccuguuuccucccaauggaggguuuuuuuggggggugguccccgucuggggggccccuccagccaguacuccaggucucccugucucucccccgcugccauuuugauaguauaaucuauuuuuaaauggggcuuuucaauaggggagagggagucaucucuuccuauauuugguggggugggugggaaggaagggauuugggggggaaucuuccugccgccucccccacuccaaguguuuauuuuugauaccaaacaugaauuuucaguucccucccucccagccccccaauuuccugcgggcggguacaaaggacccuuucaaugucccuggaguugggagggaggaaugggggacauaaagccuguccugucucuauucuaggcaagagagaguggguucaaaagacuccugggcucaccuguuagcgcuggcccagcccaggccuugggaccuggggguuggugauuugggggacagugcuacacucgucuccacuguuuguuuuacuuccccaaaauggaccuuuuuuuuuucuaaagagucccagagaauggggaauuguuccuguaaauauauauuuuucaaagugaugcuggaggcugcuggcacuuuuucucugauguugucaggacuagcugagcgugacacgcaugacuguguguggagggugugaggcagaggucgauugugagagaaacggugugauggcgugugugagaaacaauaguagggacugcauaucgguaaccaugugugugucagagacguggaaagcugugauugugugugagagugugcagaaguugugaccacagacuuuugauggugugucuaugugggaaauuguggcuguguuucagaaaauaacugagccuggaugaauagucaagguacuguacaagaaccugugaugguaugcacaaaauaaugucuacgagaagggaacggggacugcagcccugucacuguuugauggcgagcaagacagacugggugaccaaaaccacaugugagagacuacgugggcaugaaacuacaguagagguugucagggauuguggcaaagauuguguaggugacaaaccucacuguaggcgacucaacguuugagaaauagaugaugugcaaaacuguuuacuugaggc

SEQ ID NO: 21334 - RNA, 12922 nt, Homo sapiens
acacgcgcgcacacacacacgcacagagcucgcucgccucgagcgcacgaacguggacguucucuuuguguggagcccucaagggggguuggggccccgguucgguccgggggagauggcgcagcccauccugggccaugggagccugcagcccgccucggccgcuggccuggcgucccuggagcucgacucgucgcuggaccaguacgugcagauucgcaucuucaaaauaaucgugauuggggacuccaacgugggcaagaccugccugaccuuccgcuucugcggggguaccuucccagacaagacugaagccaccaucggcguggacuucagggagaagaccguggaaaucgagggcgagaagaucaaggugauccagggggucagguccaggaagggugggacccgggaggggaccucgcccgaggcauagcucuagcgguugucgucguccagcguccagcgcguggcgguuucgccucuugcugagccgaggacccucggcuccuccucaccccuuuucaccucucucagcggggccccguccccacuucacucaguuuuuuagggcgguugagaaugggguugcauucuuacccuuagccccugccugacagguccugccaggaaaagcauguuggauucccauccaugaccccuaccccgagcagcggcaccugugggcagagggaggcaggaggcaucuguggguccuagucucugggauggaucccaaagcacuuuacacauccugaugucucuucuacugcuugggugccgauaggcugcaaaaccccacuuuggcuaagccucaaggcguuagagggaaggaaaugauggaaauccauggagaaugaaaaagcugcuuuauuuuaaauugcaguuuauaguuaaaaaauuagggcugaguugagauggcgguggaguggggugguucuggcagaaagccaugagcccuuuuaaagaaauugaggcaggguccagcccuucguaauagacaaaacuuguuuuuuuguaacagccccccuggaaugauaucuucuuuacuugucuggggcaucuaauacaugaacugcuccuuauucauucuguugguauugucuucaggucuuuguaaaaaugcagugacuuaaccgagggccaggggaauguucaauccucccccuccaugaguuuauguaauaggcuaagugcaaauauucuugucugaccauuugugcucaccuuuaauucagaaaagguagaaaccugauaugacaggaauaugucaaugugcaggggauggcgggagggaggacauaacaagggcaacuucuugugucauggggagcagaggggggccucuauaaaggcacugggaucacugaagacaacuccucuaggcucacagcuggccuuuccuugagcguaugguuggaccuuagacagagucaggggugacaguaagccuccuucuugcuggucaaacugccaaagugaccacaaggccccuccucugagugacguggagagaagggcugaguaacugaugaaacugaugaaacacuugaaacugugcgagacuccugacuccuugauuauuaaaaugaacguguucuaaaaauggcuucagaaacuaggccaacucacuagaugucaggaagauggacagcucaguacugauaagggagagccccaggguaggaagauagaacauuauuuugaaaucgugaucuuuuuugccccuugcauuuuggaagggaagugcuacauuuccuuuuaaagucaaaggcgguaucugucucuguccuuuccuggggcuguugacauuugcuugguuaagacuuccucuagugugucuagcuucuuuaauguaaggcuauaagauucuagaauuucuaaaacaugacuuuguaauccaaaguagaaauaucuuuacagaugggcucuuaaaccucaaaaaccuaaugcucccauuugcuuaaaaucaagugcuacagugagccaaagaguucccuggauuuaaaaggugggaaauaaguccaucugaaauuuagauggaaaaaaugaaguguuugggaaucuaaagaaggagggaggaagaagcuagaaagugagggaugacagaugaacacgaguggaagagucaccacccaguggccuugaaggaauuuuuaaacuauuccuucucuucuaacaccccaguacuuagccaaacuggacuuuacagucucuggcaaagauuccagacuuuuucccagagggcagagccugugacagugugacucacuagaaacagagcucagcacaacaccacgugcagauaagugcuuaauacaggcuuuuuuggggaagaugauauuuucaaggggacaaagccuugugacacugcucauggaggaguccucugagggcagauuccaaaggagcucagaguggcgugugggaguggggagauggugacccugcuucuuguaaagcugcugcaaucucaggaccaugcuggcaggcgagagaccagcaugucugugggaagauggcagagccuggcggcuagcacgugaucuagauaagagaagauuuggccucgcacucuggcuagccugaaguuguucaaggaauacaugccaaagccaugcuuggagaugacugccaagggcuucguccuuugcgagagagagaaaaguccagugugacaguccgaggucuggccuagaccauggccagcaauagaaggcuuuugggcuguaacauaccagcccuuggaggagagugguagagaggucucagccagcucuucucagucuaagagcaaggguguggccucuucugggcugccugccugugucccgggguagcacauacaugaaccccugcuagggacaacugauuugguguaguuagagccacacuguaauuaauuaucaaggccaucccuaggguauugaagccccauuugcugucuccaaucauuauguuccccacccucaccccaucaaagcauuuacaauugaguccugaugaacucaauuguaugaacaucaagaaaagccuccaaugaguaggcaauaauaauaauaauaauaacaacuauguauugaauaagcaaagagcccaggcuaggcacuuuacaugcauuaucuuauuuacuccucacagcagcuuuaugaaaucagcaguauuguuaucauucccauuuuauagauaaggagacugaggcuaagagagaugaaauaacccaguggcacauggaucugagcuucagccuuugacucuugagcccaagcacuucgccaccucacuauccuaccuuuccuguuacagggccacgauuucaacccagauucagagaccaugcccuuuaccacugcauuucacucuacaggacaauauucaguccccuagauugggggaguuugacagggggagauagaaugccaggcagccagucuugcucuuucuucuaggccagggacuuaggguuauagcccaaggcccccaggagccuuucagaugucuccuucaauuuguauccaggacacacagaacucaacuggguuuacuuuuuuuuuuuuuuuuuuuuugagagggaguuucacucuuguugcccaagcuggagugcaauggcacgaucucagcucacugcaaccucggccuccuggguucaagcaguucuccugccucagccuccugaguagcugggauuauaggcaccugccaugaugcccagcuaauuuuuauauuuuuaguagagaugggguuucaccauguuagccaggcuggucucgaacuccugaccucaggugauccaccugccucgaccucccaaagugcugggauuacaggcgggagcccuggguuuacuuuuugcaccuugauuaucucaacucaggugugagaugcagaaaauguucagagauaaaagagauguuacagauucugugauccaguguccuccucuugcagauaggaaacugagacucagagagggaaagugacuugcccaagaucacacagggccaggccuagaacucaugucuccuaauucccuuucuggugcucuuuccacacaucaugcugccuggcacaaaauccucucuccagccuagcuccaugguccauccaacccacaaggccaccuaugacaagaauccagagggacaucauaagagauagcugacagucuuuccugacaucagccuaggaaggguggaggcaucccccagcccccaaaggaagaguggagcuucccuuaaugacuaugaugugucugucaccuacagauguagcuaaauuuauugagucugucuccuaaaugcauuggaaaaugccgaauagggguguguguguguguguagagagggaggguauguaguagaggggaggcuaagaaacuaauuuuugaaucauucuuuguauauuugcauggaagcuucacuucugucuauaauaguuugguuccucccacaggcugggcacucccugugccccagcccuggggacaagacaaacugcaggucagcuguggcuaugggcagguacagcucaggacugugaguuucuguuccucuacugaucacugggggaaaaaaaauaccuuccuguguuacauuaucaaguggauggaggcugagcuaaguguuccuuggaagcugccugcagucagaaugacaucauuucuuccuuagggcuucugagcuucuaucuucugccaguuaacuuaaugguuaauuauccaucaguguaaguuucucugucucccuugcugcuucuuucugugugugaguuucucuuugucucuguccuccuuugccauucucugugucagcuuuguguguggaucuuagaugcagaugggacaguccagcuaguugaaaacagguuucuuuuaaacuuuucccaucauccacuggggcaugcuccagagguuacagauguauuugucuccuuuuuuugcacuucuacccucccccaucggccuccaacaaaagcacauucaugccucaucuauagaaagaugccaguuaauguuuccuagggaaaagaaaucccccugucagcuaagagcacaugcaggggguugggggcuugcugaagcucgcccagaaaauaguucaaaagguuagauaucucuuuggcaguuccccaugcugugccccuccauccuccuccagcaccccaucaguucgggccugcccccggccacccauggcauguugccaguauuccucucuccacccccuccccacuggauggccuuuagcucugucucaccuucgagaagccaagcuuucugugauuuccaggaugagagaccaauggacccaaggaaccauaccaacaggagagggcuugauggccuuucugagaccagagcaacaacuaauauuugcagagugcuugacauuuuccaaaaguccuuucucauguguuauuucacuggaucaucccagcaaccauaggaggaucaaggucccauugcagagaugagaaaaacaaggcucaguucagggagguuaaaagacuugucuggcauuuacucagcuucugagcagaagagcugggaugcuugcugccuuuccaacagugcuugcucaaguuguugcccaucuagacuuaaugguggagguuucaggccaugaaagaagggagaguguauauuaggcacugggucacauacuuacaaggacuacuaauccucauagcaucccuaccugauuacuauuguuaucaucacuuuccagaugaggacacugaagucagagaaaguaacuuaccuaaggacaccuaacuuaucuaaggacaccuaacaagucauguacuaacaugacuugggccgagaucugcacccaaguugauuugacuccacuauaccccauuggccaucugacagaaacaaggaucugggguacauguauguggcuguggcuaagaggcagucuucacccccauccacuguauggauauggugcccacaggaaaggaggaaagggugagaggagaggcagcugcgaaagaggaaggagaugcuuucacugcuuggcaggggccagggguuuaugaagaugcugagaaaggaacaccuaacucucaaacaaaaugagaucacugcuagguaagguggcuugccagcacuuugggaggccgaggcaggaugauugcuugagcccaggagauccagaccagccugggcaacauaaggaggaccccaucucuaugaaauaaaaaaaauaugaaaauuaguugggugugcuggugcgugccuguagucccaguuacuccgaaggcugaagagggaggauugcuugcgccuaggagguugaggcugcagugagccaugauugcacugcugcacuccagccugggugacacaaugagaucuugucuggaaaagagagagagagagagagagaaagagaccaggcgugguggcucacaccuagagucccagcacuuugggaggcccaggugggcagaucacuugagccuaggaauuugagaccagccugggcaacauggggaaaccccaucucuacaaaaaauacaaaaauuagccgggugugguggugcaugccuguagucccagcuacucgggaggccaaggugggaggaucaccugagccuggggaaguugaggcugcaaugagccgagaucaugccacugcacuccaaccugggugacugagcgagaccaugucugauuuuuuaaaauuaauuaauuaauuuauuuauuuauuuuugagacagagucuugcucugucgcccaggcuggagugcaguggcgccaucucgacucacugcaagcuccgccucccagguucacgccauucuccugucucagccucccgaguagcugggacuacaggcguccaccaccacgcccagcuaauuuuuuguauuuuuuaguagagacaggguuucaccgcguuagccaggauggucucgaucuccugaccuugugauccaccugccucggccucccaaagugcugggauuacaggcgugagccaccgcgcccggcgauuuuuuuuuuuuuuuuaaugagaucauuucauguguuuagggagccugccugcugugaucuuccuuucugaugguucugaggccacaccacugguucuucuauuuucugcugcgagcagccugcuuccuggcuccccucucacgacagacacgucugcaaagaacucagggugggguuuacaaagagcuggaagggagcagugccugcaguuuaaauucggagccuccaaauaaaagcuucaaggcucccaauaguguuggaaagacagaggaggucuccagcagagagggcccuccuggcaguuccggcaauuugggcggcauacgcaauuaugaagccaaagaaaagccaaauggccaaccucacucagccucaaacaccucacacacucccacccguguuccugcuaguggcagguauuuuuagaguccugagcucaugguguuaaagcaucugccacaugccugagggcugguagggauucagacuucuucagaggcaaaaggcaagagugaagacuccugggggguggggggaguggggaucaggagccaagugguaaugauauuccugggcuaugccugcugucuuccuacugaccuccauuccuccuguggucugcucucccuuucuuccuguucggaacaccacggagagguggaagaaaugaaaauauuuucugucucuugcuugcagaagcaaaucagucuuugaggacuuauguuuuuucugugugaucacagucagacguucucucugaaauccccuuggcacauaucuaggaugccagacugcuuguaguuuuagugguucaggccaucacugccuuuugauaaugugucugcugcugauaaugaugaugaugacaaccucagugacgaguguggucugaugcagaaaaagacugcuuacagucuugcuggagagaugccaagagcacugacgagacaauuagaaaacauaaaucuauucaaaaugguaugaugcagacucaaagugcaacagagauuccuaagaaaagagaauugaagggaaguuggcgaagguuugaggaagaagccugaggcgugagcuuaaccuugaagaaugggugagauuuggauagggcaaugagggggcagcugauucuauaggggaggaguggacuagcaugacccaaaguacagaggagggaaucaaccagguguagcugaguaguuugaaaccagguugggaagggucaaauuauggcagacagaauuccacauguggaauccaugugaugccacauacaguagagggcugcagucguuuccugaagaggugaauggcaugcugauacaagcagggauugacuaaagcuagucagaaagccaguauucagagaucgggcacuggggcucacgccuguaaucccagcacuuucaggggcugaggcagguggaucggcagugauugggccucccaacaugcugggauuacaggagugagccacuauacucagacuccaauuuauuuuuauuuauuuauuuuuuauuuugagauggaguuuagcucuguugcccaggcuggagugcuguggcaccaucucggcucacugcaagcuccgucuuccgggcucaugccauucucuggccucagccucccgaguagcugggacuacaggcaccugccaccacacccagcuaauuuuuuuauauuuuuugguagagacgggguuuaacuguguuagccaguauggucucgaucuccugaucucgugauccgcccgccucagccucccaaaaugcugggauuacaggcgugagccacugcgcccuggccuccaauuuauuuuuaaguucacuuuuuuguuaccuaaggucaggaguuugagaccagccuggccaacacggcaaaaccccaucucuacuaaaaauacaaaaauuagccaggcgcaguggcacacgccuguuaucccagcuacuugggaggcugaggcaggagaaucgcuugaaccugggagguggagguugcagugagcugagauugcaccacugcacuccagccugggcaacagagcaacaguccaucucaaaaaaaaaaaaaaaaaaaaaaaaaaagcaagcaagcgagcaguguucaggagacccugcaauggaaacauccacaauccaaaauacuuugcucuaguccaggagugaggagaggagaggcuggccgagggccgagggacacagaaaucagaauagaagaaggguucaaucugaaggucuugccagaggaacuuggaagcugugucaauagagggagaugacggggagccuggacaaugaaaacugauauucggaaugaugacucuagggcccuguaaaaucuucacucagccgacagauucaauuauauuuacuagauuauacuuacugacugcuaacuccaaauaaaggcuauacuucguuuuaagagccauagcagucaauuaguggccauaaucaaauuuucuuugauaacugagaauuguauagggccuugggaccaucauucugagcaugaaucucccuuguccaagacguuggauauauaaagggaaauagauugggcugaauguauaucuccugggaguuaugucuuugcauauguuacagauagcagcuuuuucuucauaauuuggccuuuaucccaaaagcugagauacagaagaaaaauccagugaauuaaguuccuuuuacauaaccaaaaagugaacuuaaaaauaaauuggaggcugggcaugguggcucacgccuguaaucccagcacuuugggaggcucgaucauuugaggucaggaauucaagacuagccuggccaacauggugaaaccccaucucuacuaaaaauacaaaaauuagcugggcaugguggcgcacgacuguaaucccagcuccucagaaggcugaagugguagaaucucuugaacccaggauguggagguugcagugagcugagaucacaccacugcacuccagccugggcgacagaacaagacucucaucucaaaauaauaaauaaauaaauaaauagggcuugaaggugagauuuuaauacuaacuuuguuuucuuuaaaaaguuauucaggcuaguggcucaugccuguaaucccagcacauuuugaggccgaggcaggaggauugcuugaggccaagaguucgagacuagccuaggcaacauaacaagauucugucucuacaaaaaaaaaaaaaaaaaaauauauauauauauauauauauauacacauauauauaacauauauacacacaauauauauaacauauauauguaauauauauaacauauacacuauauauaacauauauguaauauauauaacauauauaugcauacuuguagaagaaaauauggaaaaauauuuaaaaagaagaaaauaaauaucacuauagucucauugcugauaaauaaccauuaauguucugauguguacacuuccagucugugcuuugcauauguuuauguuuaacguuucuuaaaaaaaacugggaccauagcauaugaaaacuuuugaggcugggcgugguggcucaugccuguaaucccagcucuuugggaagccgaggcaggcggaucaccugagaucgggaguucaagaccagccugaccaacauggagaaacuccgucucuacuaaaaauauaaaauuagccgggcgugguggcacaugccuguaaugccagcuacucaggagucugaggugggagaauugcuugaacccagguggcagagguugcagugagccgagaucgugccauuucacucuagccugggcaacaggaacgaaauucugucucaaaaaaaaaauaaaagaaaagaaaaaagaaaaauucuguauucugcauuuucacuuacuuguauuuugugagcguuucucuuacaauuuagucuuugaaaacauuauuuuuaauggcugcauaauaucccacuguacggauauauuuucauuuuuguuuauucuuuuugagacggagucucacuguguugcccaggcugaagugcaguggcccgaucucggcuuacugcaaccaccgccucccggguucaagcaauucuugugucucagccucccgaguagcugggacuauagguacacaccaccaggccuggcuaauuuuuuuuguauuucuaguagagaugggauuucaccauguuggccaggcuggucucgaacuccugaccucagaugauccaccugccucagccucccaaagugcugggauuacaggcaugagccacuguaccugaccccacuguauagacaugaacuuuagcuauuccuuuucugaugagcauuuagguuuuuccuguuuuaaaaaaauucucaguggcucaagccaguaaucccagcacuuugggaggcugaggcaggcggaucacgaggugaggagaucgagaccauccuggcuaacacagugaaaccccaucucuacuaaaaauacaaaaaauuauccaggcgugguggcgggcaccuguggucccagcuacuugggaggcugaggcaggagaauggcgugaaccugggaggcggagcuugcagugagccgagauggcgccacugcaccccagccugggugacagagcgagacacggucucaaaaaaaaaaauucuaaauaacacuguaagauauuaguacagaauuuugaccacaucccuauuucuuuuguauagauuucuggaagugagauuucagguccuaagaguuaugaacauuuuugagguucuugauaauauugccaaauugcucuccagaaaaguugaccaauuuacauccaguuuuucaacuaaaaaucuuaagauuuuuuucaacucaagauuuucaguuaacaaucuuaagaaaaacuugacaaauccugaaacuucucuuuaugcuuugauaaguccauucugcucaucugucaaagaaccacuuccugugucacggcuugucacuuuuuuuauuuuuuuugaaauggaguuuugcucuuuuugcccaggcuggagugcaauggcgugaucucggcucacugcaaccuccgacucccugguucaagcaauucucuugccucagccucccccguagcugggauuacaggcaugcaccaccaugcccggcuaauuuuguauuuuuaguagaguugagguuucuccauguuggucaggcuggucucaaauuccugaccucaggugaucugcccgccucagcuucccaaagugcugggauuauaggcgugagccaccgcacccguccugucacuucauuuuuauagugcuacagaaccauguuuucuccucucuguucauguucccuuuucugacuccaccuuuggguuuuuguaucuuccagguucaggugugggacacagcaggucaggaacguuuccgcaaaagcauggucgagcauuacuaccgcaacguacaugccguggucuucgucuaugacgucaccaagaugacaucuuucaccaaccucaaaauguggauccaagaaugcaaugggcaugcugugcccccacuaguccccaaagugcuugugggcaacaagugugacuugagggaacagauccaggugcccuccaacuuagcccugaaauuugcugaugcccacaacaugcucuuguuugagacaucggccaaggaccccaaagagagccagaacguggagucgauuuucaugugcuuggcuugccgauugaaggcccagaaaucccugcuguaucgugaugcugagaggcagcaggggaaggugcagaaacuggaguucccacaggaagcuaacaguaaaacuuccuguccuuguugaaaccaaacgauauaaauacaagauaaauuaucacuggaguuuuuucuuucccuuuuuucugugccugcauaaugcugacaccugcuuguuuccauacaaauugauaucaaaauaaaauuuguauagauu

SEQ ID NO: 21335 - RNA, 15054 nt, Homo sapiens
uuaauuuaauauuucaaaauuuaauuguauugcuuaauauugucugaaaucugggcugggcaugguggcucaccccuguaauccaagcacuuugggaggccaaggcaggaggguuguuuaaccccaggaguuugaggccagccugggcaacauagugagacccccccaaucucuacaaaaaaauggaaaaauuagcugggcgugguggcaagccucuguagucccaguuucucaagaggcuggggcaggaggaucacuugauccuagaaguucgagguugaagugagcuaugauugugccacugcacuccagccugagugacagagcaagauugccuccaaaaaaauauauugucugaaauauuuuauacauggacaauucccagugaacaaauuugucauuuggccacuuucugcauguagaucagguuauacauaucauucauuuucagccauugucuauaauuucuauaauauauaauauauaauuucuauaucauucucaguuuucccccaaaauaugccagaaugguaacuaaggaaacaggcgaaugaauguuuaacuuuguuuaaacauguacugcaauacacaugaucauuuugauaaaaaguaaugauuuucaguuuugagaaagauuuauaaguuagcaaauccagaacaugaagcaauacaccaaauaauuaaagaaaccaaccucaguaauacagaugucuauuuuauuaaaaaaguuacaaacagguggacugcagggucgucuuacaaaaugacaagaaugaaaucuauuggaaaaauuuuacuuuuacaaaucuuuauagguaauuguucaauguuuguacuuguuauuugagauuuuaccuuucacugauaaaguuacaguacauuagauccaugauaauagguuacauuauuuuauuugcagagcccuacugcagugauuugaacaacuccuaaauagaugccauaauaaagacaagacauauauugcauuuaauauuaauuuauuauccuaauaagcaacaugcaaucuauugaggaagcuaaaauaacuuuuggucccuuuucuuaaaaugugcuggagaaaccaccuuuaaaaucacuuuccccugauuccugcgauccuaagugaauucaagucaaauuugcugcugaggucaaugacaaugaacacuguaauuuugagagagagagagagagagagagagagagagagagagagagagagagagagagagaaacaagaacacaaucuacaggaaagaaacauuauaaaaaaaucaaaaucucuagaaaauuuaaaucaugaugaauuauuugauuccuuuagaauuucacaaagccacaaagcuaauaacaaugauccaugaucacuuaaccuacuuuuaaaugaguguuugguuuuaaguuugguauuaaagugcaaacuuaaauuaaguauucacuucaagcaguucauaaauaaggaacaauguuucaauugccucuaucuuuacaaucucaccauaaaauucaaaauuuaagaacaagaguucacuuugagggaauuugcucaggaaucaaaugcaacacgauuuaaaaaaaggaaaucaaaguuuagucaauuucuacucaguaauuaauggucaugcugacccauaaaucacaugaauguagauaccacuuuauuugaacaucacacacaauauaaauuuaaaauugccacacccuuucauaaaccaucacugcauauauuagagcuuuccuugacaaaguuauugagcucuuauuauagaucaaaaguauaguuuugguuuuguuuuauuuuauuuagaagcauguucaaaugacuaaagcugggcuccuaaaaucgagaacuuuggugcaguaggugagcugcaguuacuaacuucugcaaaugaaaagcacacaacuaaaaucaaauaaaaacccaacaauaaaauacugucaaacuuacacaauuuaaaaaucauugcuagaaaaagcccucauugucacgauguuaaaacugaaccaaaauauuacucugcauaaguuuccuuucugauucuacaccugcguuacuguuaaaauguucaaguauucagacaaaaauaugcugauuagguaaacaacauggaaggcaauggcuauuagaaagcacauuugcaaaaauaaaaaauagcccagagacuuggcgcuauucucccuccuguuacacagauuuugucucuaauacgaacaugcuucuugagaaauaacuaaaaagcaauugugauagugcaagaaaacuuuaacaaauauugcuuuaaacuauuauucagaaagacaaauauuaagaacuagaaaguguguaugauuuuauuugaauucaauuuuacaugugcagaagucuacuagaugucaauuacaagccugauaggcaaagaugagcuaucucuguuuagguauacaauuaauuuaccauggauacaauaucccuuuucaaaggcauugcuaaauaggucauaacuaaauuuagaacuucacagaaaggaaaauguuacugccgcaauucaaugcuguaaaugagauuaacacaugugaaaaccuaauggaacugaaugcuuaacucuucaacuaaaugcucuacagucaauuucaaauaucaauuguaaccuucagaacauguuaauuacaaaaaaaaaaaaaaaaaaacaaaacacaucacaaacugcacuugaagaaaagggauauuccauccauacagguaaaaugugaucuuuaguuucuuuuuacaacacugccacacguaaacaaagucucaaaguauuaaccaauaauuuuaaaggagaaagauuuuacaaauaggaugaagcacugguacgagguaauauacagaaguaaccauuuguuuaaggcucaauuuuuucuccauuauaacuuucuuuuaaaaggcauugaguagguaauacugaguuugaguauuuaauaaauacaagucgagaaacugauuaaagaaaucaauuaaaauauuaaaaauuaacccuuguauauuagccaucaauaagaacuuagaaagcuauaaaaggacugauugauaaagaauggauuuuaaacguaugguaaacgugcuaagcauuccuguuuaaggucgauggaucuugaaggccaaagaccuuaugcacuuaaauagauguauggcaacaugcuguaauagagacagguuuaccaaggcucaguucugcaacccagguuguaaaguucuccaaagcagcaucugugcaaauuuccucugaguuuuaucugcaauuaagauaaacaugucauaaaaauguagaaauacauaguuuaaaaagagaacacugacaacagaucuauauacacagagaagugguaacaagaauaacaaacuucaguuaaaguagaaaguuaauuuucccucguccugauaagucauuaaaaaaaaauagaaacacagaagugaugcauuggauauaauguacuuugugugugcgugugugugcguguguguagcuauucuagcuuauuucuauaauauuauuaugccuuguacuuguauuauacuuaugcaauauuaaaaauguccuuacugguuuaaaugaucuuacaguauaaaaguuguugcaaaugcugcuucuacuuugaacuugaucucuucacauuuuaacuggaaaugguauuguuaucaaaugcauguuaauuaugaguuaauuggcaguauguuagacuuuuccuaaauuuaguuuuuugagagauuaaaauaagaaaacgucauucaggccgggcacagugguucaugucuguaaucccagcacucuaggaggccaaggugggaggacugcagaaagaaaaaagaaaagaaaggaaaagaaaaaagaaaagagaagaaagagggagggagggaggaaggaaggaaggaaauucaaucaaggucuagauauugagcaccuacuaggugccuagguaaggucagaugcuaggugauagcagcaguucacauuuuccacuugggucugcccuuuuuuggggauguccucccaaccacgggaucuucuuuuaugacugggauuccucauucccugcucuuauagcguacagauuucugcccuuccagcuaauacuagggaaaaaaaaucuaucguucagacagauagagcguccuucaacugugcugaaucaccaaauagcuucuaggggaauagaguuauguuuguuuuugaacgcaugagauaaaaaauguuaucauaaagccagaaacaaaaguagaacagcaacuaugaaagaaugccaagggaaaccaguuuauaaucauuuaagggcucuaccaauguuuauaaaugcauaauuuuaauuucauuugacagcuacacuucuauuagugcucaaagagccugagauaaugcuuuauuagcagcuauaucauaaaaaugauuacuauuaaagaacaucacucugcucauuauugaaauucugcuaccuaaacacauuaggaaaaaauagaacaaaagucugccucuuuagaaauuauuauagaaacauucuuccaauuaaaagacauuuugcauuaaauuguuaauuaggacaccaguuauuuaagcuuuggcaaguccgguuuccucaucaucgaaaaagggauaaaaauacuuucuucacaggguuguuguaaauuuguuuuccauuuccaacuauguuauaaauuucuagacuaccaggauuguaauuuugauauccagacuaaggagcuuuauauuuuuuagccuagcuggaauuucuauaccuacuugaacacaacaguauuucauuauauaugcaguauuaugaauaaaaauuauucauuaugaauacuuuuuaguaauuuagaaagacuuccuucaauuaguuugaauuaaugaauuugcuauaaauuuucauuuccuuuuuuaaaucaaacaauuauaaagagguugggauuuucaaaaauaauuauuucucuuaaauauuaaagaccucuucaagcauucucuaaaaucaaauugagaaaguaguuauuauuuauuucuagccaaaauaaauauuaauaaucaaaucauuuuacuaaccauaaucuauauggaauaaaacaugauauauuaaucaccuccuacccucuaaaaaccuggguaacauuuggucuauccacauccacaggaugacaauacuccugugaaaucaagagauauagauaaauccugaguuaggcucuacaauauuaacauuaggcauaccuuuaagcaaacaaaguauuaauacuagcuacuuuucaagagaguaauaaauuauaauuaucugcaguaauaaauccugaaguaaaaugcuugcauuaaacaaaaacaacagucucuuucagguuagaauuucaaguguaaauguucuugcuccccagugacagcaaaauuuucaauauacuaacacuuucauuuacguaaaaauaaaucgcugaagguuuaaaagcagcuggucaaaucaguacuuuuuaacuugcaggauaucacauucaagcacguugcaaauguauaacuugcagcuuucaagauagaacacaaguuauccucgaccucacucucaaguuuccagcaagacacucaacaaaucuuaucucuggaagcuucuauucaaacucuuacuuaauuguuugguuuuacuuuuuagcuuuuuacuaaugcaauauuauaggaaaguacaaaaaaaaaaccacacacacacacacuaauccaaagcuuuugcucaggaaauuaugaaauaaauagggucucccaagucggguaaauugguauacgagaguaccaaacacagaacaaaaggaacaaagaucauuauuuaugucagccugaagaaaaaaaggggauucuugauucaagacuagcacaucauuucacauggcagcagaaugccugguauguuaacaaaggcuccugaaaggcuuagcaguuuaugaaugucuuuuuagcuuaacuggacuuaccuuaucuaaauacaaugguauuuacuagcauugucucucucucucucucacaaauacuaguguguaaucauaaucacuuuuaauuuuuuucuaguuuuagggauaugauauucuugggauuuaaccaaaauacuuuuuuugaaaaugaauuuccuuucauauuuaauuagcauuuuauuuacaaguuaaaaguuaguuguauuagcaaaacaucaggcugcaauuauaauuuuaauaaauuguuauuuuaauaaugauguuaauaaaucaucaaaagugcuauuuuaauaaaacauuaaauuauuuuaguaauaauuuuaauaaaacauuaaauuauuuuaauaauuuuaauaaaacauuaaaauuauuauuuuaauaauaauuuuaauuucagagacaggaucuugcucugucauccaggcuggagugcaguagugcaauuguggcuuacugcaaccuggaauuccugggcucaggggauccuccuaccccagccucuugaaccgcuaguacuacaggcacacaccaccauacccagcuaaguuuuuuauuuuuauuuuuuguagagucggggucucauuacauagcccaggcuggucucgaacuccuggccucaagugauccuuccaccucggcuucccaaagugcugggaugacagguaugagccacugcaucuggccucaggcuggaauuccucugauacagguuauguuuuuguuaaauaucuuuuguuuuguuucucuauccuaaugugcauaauacucaugaagcuuacuaggguuggagugggaggacuagaucuuuaaacguguucacugucacccauuaaacacagagagcaaaagcggaaccuauggcauagaauccuugaauggagguggaaucacacaugaaggaaagcaagcucacuaaauguuuauagugaacccaggguagaagggaugggauuagcuauauuucuuauguacuagaccuaaaaucucugaauguuuaaauuaauaugauuaguucaauucugagaucucacauauuauaaccaaguccagugauaauaaacaacagugugagcccaaugauacaauuccagcugcuagcuuugaauuagaccagauaaguuaguacuccccucaacucuaaauugcuuuuucugaauuugauguuucuaagauuggcuaauuaaaacuacuugggaguauguuuuugauuggauauguuuuucuaacagcugacaggacuuaaguuuuucuuacugauauuaucuucugaauuguagaauucuacugagaaguaaucccauggggagaaucuuuucuguaguauggcuagaacacuuccuugguggcaauucuccaacucuaugaugcaauuuuuguuaauucuacugauaguucauucuaagccagagagguaauggaguaaaacugaauggcucauaugcauuuuauuaugcaauaaaagccuaaucuugagguuaaaaggaagcaauuaaagagggaacagauauacaaagagucauucuaaucaccagacaccuccacauccagagcaggucuaacuaggcaccuguccacucucaagucucaaaccaugaaccaacccuaugaauucagugaaggucugggagaauuaggaguaguagaaagggcaaggugguuuuguuuuucccuuuuacccaagguucgcugagggccuuuaugguacauaccacccccaaagcaugcuucuucuuccauucaacuccucugcuccacuuugacucaccaugugaacuggaugacagaugagcauuuuaaauaagccauuuuccccauucaaagugauaugcaaauagagcagugggaaaaaaagaacuaucuaacaaaacuauaacuucuacaacagaauuccaccccagcauuuuacugauauuauuaauauuuaccuuguauaggaaauuuuaaguaugugaugugauuugaggauuuuucuccucacauuugcuaaacccccagcauaccauaaaaauuaaaaacuaaaauuaaaaguuaaaaaaauuaaaaaccauucugauucuauauuuuauuuuaaaaaacccugaaaauguuuaucaauuccacuguauuuaggaauaguaagucuagcuagacuaaaaugauguucaaauagaguuuagucuuucaguagccuuuguuagcaucccaggcauucugcugccauguaaaaugacgugcuagucuugaaccaagaaucucccuuuuucuucaggcugaaauauauaaugaacuggggcugacauaaauaaugaucuuuguccuuucaguuugcuucccuguguuugguacucuuaugcaccauuuacucuaguugggagaaccuguuccacaguacacugagaaaaaugguauaaaaucuuacaggagaccuucaaaccacagugaauaacaccuuuucccccauuuucuuucuuuaucacuuucaucaauacuggacugacauaaaggaauccuugaaaaaucaucuuuaaaauauucuauuugccaaaaggauauaucaaacugucacauuuaagagacaccuuuacugcacuucccccuuacuauuagggaaucaacagaauauuuuaggauaugauuaugcuccuucuuggcauucuuucuguuugaaggucaacacugacaccccccaccccuaccaccaguccccucaaguccuauccaucuucaaagccugauucaaaugcuauugcucccaauaucucuaacucgguggcgcuuaaccaagggcaauuuuuguccccagggggcauuuggcaauuucuggagauauucuugucauaaugggggaugaggaagaugcuacugucaucuaguggguaaaagcuagggaugcuguuaaacaucugacaaugcacaggacagccccaaacagcaaagaucccagaauguuaagaaacucuguuccaguugguuguggucucuccuuucccugaacucccacaggacagugauuuacuucuuuuauaguacuaugagauuauuaacaaaacaucaauccuucucaacaaaaauauacccaaacagugaacugccaauaauuuauaccagcacagaagagcuaugauauagugaaugaaaccagaacagggugacaaugcugacccggguuuccauuauacugcugccauacagcaaaagaagucccuucaaagcacuugaucauacgcuccucagaucaguaaagaaaucaggaugauggcagcguauaaggaaucugguuaugcuuccaaacuuacacuaaaguuacugccaaugggaggguaaaaggugaggaaacaauccugggagccacgcagauaaacagguguuaggcacgaggccugugacccaaauugaaagauguuaagacauaaaugugaggaauuaucagaagcaauucuuagagcauuaauaaauuuucccucucaguuaaaaacaaccaauuaacaacaauaacaguguuucugauuuacauccuauuauuucuaacuuggacaagguacucuucuaaauauuagcgacaaacauuucucaaaucaacuuuaccugucaaaguuugauauucaauuuagaucugggucugacagauuucaaagcuccaugacucaagcuauaggauucaaaauccaccaucuauuuucuucucuucuuagguaaauggugagcaaggacaaccacaaauuuuacuagccucagauuagagauucccauauaugggaaucaguucaauuuuauuugaugucagaaaaaaaaaaaaccugcauauagugcacuuuguucuaaaagaucuuggucagggaguuccccuuaauauuuuuagaaauucaguuuauuggauauuuuauuucaaggcuaauaucuucauuuauauauucugcuuacaaaaacaaacaaaaaccuacacagagaacuugacccacuacuauaaaaaugaauauagguauuaauaauuuccauuuuuaguauguuaauuaacaaaaaauacaaauauaguuggcuugagauacuaaaaaaaaucuauguacucauuccuguagguaacuaaauagguuaaaaauaauucagaucacaaaaaguuaccaaaugaaauaaacucagaaaugauucagaagaagagguucaaaaauagcuuuagaaauuauucaccugccaauuuggcugagagagcuggcucucuacauguaugagaccaauuuuauucaguuaaccuccuauagcugucuacacuaaugauggaaggaaaacugggaacauuucgugggaguugguuaauuuuuaaaaagaugauaaaacuaacacaaaauguguauagacacuuacguuaucugcccaguaagugucagguagaaaaauagagcaaaacaguaaagacacaaucaccacacagaacuuguucaauugugaagcuggcuuacaauuuaaggagagagauuacagcagcaagaauaugggacuugauccauaagccucuccccuccucaaaagacuauacugcaaguacaaugcuaucaaccaaacacaagcuggacuauggucugaaaagugacuuuauaaaauaauagauguagcuagacauaagaaaauaaaugaguuuucaucauauucugguaugcuaaaggcugaugagugaaagcauuuuaaauaaagcauuguugucauccuucauuuucaaagaugacacuaucugacaggagaccuugucugaaaagauaaauuagggaccguuagucuuuucuccggggagcauacacaaagccagacccuugauuaggaaucauugcuccaaucugaaaugccuguugccauuugcaacacugccuccuagacucgaggucagccuuggcucaggaagaucaauuucauuccugauacugucaggcuagucuggcauuugcugcgguuucucagucauucacaauauugguuguuuuaucuuauuaucuaaguguuacugucuaagugagacuauuugcucaauuacaaucuagacuaaaagaucauggcauaaauaaucuuguuuuaaaugcuucguaaguuuuacauaaucuuacuuuuaaaaaaguaugaguuuuaaaaaaaaacucauucauuaaaaaaaacuuguaaguuaucauuuaacucagugaaaggccugaagguuuguuacuguuccuauuaaucucauaauuuauuaaauugaauaaauuuuuuuaugcaugaaacuguuccuucuaacacaucacagauaauucaacuagauuaucuuuuggaccguauauuuauaaugaagucaggguacacuguggcacuauaauuuguuauuaucagaggucacuuaagucccucaaguguuagguacagaugaauuugcuuaaauaauuguacuguuaaucaagcacuuggugauuaguaaauuggugauuuuaauugcagcaauuugcuugcucaggacauaaaaacauaaaaguacagaaaauaccacaaaacuucugaaauuauuacucagugcucuccugugcauucuggaugcuaaaucagaagaacagggaaaaaguguauuaugguuuaacucaacccaaagaaauauuaccaauaaagcagagaaggaagaacaauaacucacuuaaaauccuggugaugggaauauaagcaauuucuuaucuccgcuuugcuuaucugcauuuaaaaaaauuuucuucauugaauguugacuauuuugugugauggaaaauguuauuuuaaaaauaaagaaauuuaaggcagugccauauguauuaacacuaaccagcuuuuuguuuuacuugaucaaaaaacaaaacacuaccugauucauacaguuccaucaaaaacuaaccugcucgguauggccaugauugagguuaucuucuuuacuggacgacacaaguuguacaacacugaucuugcuucuccggcagggaugaauaguucauuugccugacgaucucagcaaaaaguucauccaccauugauuuacuuuuugccgaugucuccaugaaaggacagccccauucuugagccagagcucugccuucugaagacauaaccucucuuucugguuccagauccacuuuauuuccuacuaggauuagugggacuuuuucauaucucuucacucugacaauuugaucucucauuggcuugauauccuauucaagcaaucacaaagagaaagaaaaacauuaugcuguuuguauaaccauaacagaaauauuacaguauuacaaaaagucauaccucagugaguauacaaagcugaauccaaaaugaaaucacaccuaaacagagaaaucgucaucauuuuguccacugaaguaagaacuagauaauuuccagagacccuaccugcuggguuugucaagaauauaaaacauggguugcacacuaaccuugacucauauaaucacuuuuacccacccccagucuauacugauuaaaaaagcaaguuuccaaaugauuaauccauucguacauaaggauguuuggccaucucccuaaaccugccugcuugucaucacuccuuguaacaccuguuauccuagcacaggauugcagcaucuaugcauuccuagccauguagcaagagggcuugagugaaaguguuuuaagugggaaaaaaaaccacuuuguaaugccuagaauaaaagaguuacaaccagauggauacacuuaaauguuuuauuuuaaauugaaugguaugcauuuauuccaguaaaaucaaacaccuuacaauacacuuaaauucacuagaaacuacuguaacagugagcaacuccugggaaggacagugcaaggggagucugggugggaagaagucauuuuuuuuuuuuuugccuguguuuguuuuuacuacuuguuuccccaugcguauuacuuuuuccaaguaguuacaacgaauuacaaaagauaagagcguuagcaauucuccaguagcaucaguuuugggaggugggggcaaguauugauuuaauacaauauuauagacuuaauuauaaaaaucaccauuuucgguaauauuucauaauuuuaaaaguuugccuuaaauagaaaauguaugcuuaauuggaagucauaguaaguacagaauauucacaugugggccuacggaaaagcaagggacuaugaaaaucuauaaaaauauaguuauuugauauuugcaucaauuugguuugauaauauaucaacucagauuucuagguuacgcuuauuucccauugucuuuauggaaacauaaguucagcugaaaauccaaacuuagggcauuugggcucaaaagaguuuacaccuccacugaaauaacggcacaguuuuucacucccaauucaugucuauaacacaaauggauauaacagaaaucuuaugaaacacccuucaaaagacucucagccuccagagaguaagcugauagaauaacaaaucuccugaggauccuuuagggaaaaaaugccugucaaacagcaccuucaguacuuugguacuuucugggggaaaaugcuuuuaugauacuauuguuugggaauuuaugccuacauaaaaugaauuuaguuuggucucaauagcuuugauuuauuuccccagaauuuaucaucuuaaaaaaaaaaaaucccugaaguuguucuaucagguuacugggaaaguucacuauaguacuuuaauuuaaaauacuaaagaaaguggaauuagcacauuguauuggcuaaagcacuuaaggucucuuaaguaagcuacauuaagugcauaccuuuaaaugcagaaaaaauauauccauuuccuaaaucaauggaggucaauauaaugggucaauaugagguuauucauuuucaagggauaaauagaaacauacauugcauauccuaaaauaacguuaaaccuucagucuguuucccagugaaggacaggacagauuuucuaagagauuggaccacauccaguuuggccacccagccggaguaagaaaucugcacuuguucaguguucccagacccacguauuuucuguaaauacaggcaauguuaccagaaacaauuuggaucaacugcagaaaaagagucauuccugauuuuuguugguuauuaauucuagguacuagucuuuucuauuaguaacuuuucuuccuacuacacgccccaaguaauuaaguaaaaugccuagaaggcaggucuugaguucuucgucuugcaacacuaagauuuaugaaucuaguugagaaacuugagagagaaggggagggcggcgggaggggguguuggggggugggaggggaaggugugggugggacagacacagaggacuuaucugugcaacagauaaucggcuccaaauaauuuuuucaaagugcucuauuuacccgagauuauuuguuagauguuuugucguguaaguuaaucaauacuuguugaauugagcaagcaacuucagaagguuauauuccaggcgaaauauacacagacugacauuucuuuuucacuuuucuuucacuuaaaaauagcuuuaaaauauuuguugacgcuuguuacuuuuuacuacgcucuauagaaacaacccgauagucuuccauggcaggaguaaccucaaaaaugcgucaugucuaacuuucaaaagcaaagcacagucauuaaugcacgguucaagcaacccagaagucgaugucggauuaccacacccccuucuaacaaauuacaagacuugguuugguuaccugaaaagacuguugauuaaccaggcuauaaaccaggaugaaaccuuggccguuuuugauguagagaucucucauggaggcaaacugcucaguuccugcgguguccagaauuuccagcacggagggggaagaguccacuucgaucucuuugcgguagaaaucuucaaugguggggucauauuucucaaugaaagucccagugacaaacugcacaguaagggcagauuugccaaccccuccacucccuaacaccacuaccuuguauucccucaugagucucaccuucaccaacuccuaccagagggggggaaagaucaccccgcuagcuguggcgcggcuagacgaggcggaaggugggcggaaaucugcgaacuggggaggagagugc

SEQ ID NO: 21336 - RNA, 6248 nt, Homo sapiens
ucacauaaucaaucauuuuacuaaauacaagcauauuuucauucacauacagcuaaauaaagcauuuuucacauuucauuacagugcacaacaaagugaggaaaaguauacaguacauuuuauucugaaauaugagacaaucuaauccaacaugcaguuguggucuuuguuacaaguuaguuuaucuuuucuuuaccuauguaguaaaauagcuucuaaagcuuuauccuuaguauuauauuaacaccugauucuuuucacacuuauuuucuaaaacccacuuauugcagugacaaugguacugaauucuacuaaaaugauuuuuaaauuuucuagaacuuauuuaagcaauuaagcucagccaccucugcuggauuuaugcugaauauuuuuaaaccugccagaaaaugccaggagugggaauacuguacauauaauaaauuuuagugaagaaaauuguagggaaguuuuguuucuuuccuuuuuugaacugacagaauccagucgacucucauuuacccacuggauaaucuugcuuucagaaucuucuaaacauaauucaguauagcaguugaugaaauuuuguguuaaugaaauuugccauguuuuguuugucuuuuacaaccacgaagguggcaauuuaauuaccccaccuaagccagcucuugugaaaugaauauagagaagaugaucaguucacuuguaguuaaugcugugaacugauccaaagugguuugcucauccaacuuggggcacagguggcagaauagucuuccauaauuuucaugauuugguuucuuuauucuggcuaaagcaaauucccaaaguuucagauucggucacauucauacugaaguucaauauuauaucucaaagcgauuugccauucuuaggccuuccuaucacgauggauaugagaaaccugacucuagucagaauaguuuuuuuuuuuaauugugaaaaguauggcuuuugccuagcugaacuggcuacaauccaaaaaguaauuuaaagcaucaccucucuucaagaaaauaauggaaacuucaagccagccauuccaauuugcugaugcaguuagcuguuuguucaccugagaauuaagggcugacucucuuggguagacaggaacucaguguacguauauggcagacagguggccaaggucauuuugggguggguauuuuaucccuaucccacuccgcauugcuguacgugguuccuuucaauaaaaauccacugugucucagugauaagaacacuuauagcccacacaguucuaaugucuuuuuaguugugcaauuauucacuuguuuaaagcccucuugucaauaaugccugaaugggcuuuaccuuugauuccuucccauguucccucaggauuauagcugaguuguaaucaauaaggaaaacauauccuaacauguagagaacauuuauuuauagucauaucucuucccaaguaaacaaauucauaaucauuuauucaucugacagcaguaugaugcagugaaaagagcuaggagucacgaguccuugacccuggccaagugauuuucauggcucuuaguuuacuauucuguaaaauggggcaaaaaccucguaggccuguuaugaugaucaaauaaguagcccaaguaacuguaagcuguuuguaaggguuacagugccuccuguucagcaggagagaguguuugccucagggcucuuuucagaggcagucacuguguugucacugucacgugccugaagaagcaagcagacuguuuacuuccagauugcaggugccaaggcauugaaaccccaggcauggucaaaggaaaaaggggguauggcauuuggguuauagugucucuuuccuaguuauaggguaauuugcaugggacaauuuguuucauacagcugguaauucuaucacaaggguguucauuuucugaaaugugcuaauaacugugucgauugccuuccuuuccauagucacaucauuuuuacuugaacaccagaccuuuuggucuguguuccucauuuuacagaaagcuguuaaaagcuaauugguaccuuuuaaccaaacccagcaaacaccuuuggugcaggguauucucacggaauaaguagagcucauaaucuuuguuuaguuaugcuaauuguccccauugugaaacuuuuuuccccuuuauguauuucuuuauguucauggccuauaagugagcucaaauaccaaggaacaguuguccugucuguagguauguuuuccugggacuuagcuuccuaaaccccaggccuuuaacaugugguccacaaagggcucauggagcagccacugccuagcaugggccacaaaacagugccuggccuggcccaugucagcaauucagucccuuggucacagcacucaggcacccccauccacccgcacacgagucugucagagucccccugagagggaggcucacuugguauccaaauggagguugaguucucaucaguuacacaaagauucuauuuauuucucuuacuuuucaguucaaguaggagagcauguuuuggaaauaaaagaacugacuagcacaaacaucuccucucugauuugacaaccucuucugaagagugaaccacauuugguacaaauccacucuucaccccuucccagcccuccuggauuguaaucuccccccuuuuaaccagcucauauaugucucuugucaggucugugaaggcuuucuccacauuaauggcaucucgggcugacguuucaauguacuucaugccguaugcagcagccaguuucucggccucguggcgagucacuugccucuguguauccaggucacacuugugacccaccagaacaaauacaauuugguagggcugaacguguacuuuggucucuucuaaccacucauggacauucuggaaggaccugcgguugguaaugucaaauaagagaagaccaccuacugaguuccuguaguaggcgcgagugauggaucuaaaacacaagaaagaaguaaagaguaaaggcugugcccaaacuucugcaugucaaugaacucaguauauucaaguguuccugguuagugacacaguccuuuaauaaaaaugauuuucuuuuuuuuuaaaaaaacaaaggaauacaaauggcauuccauacuacuacuaauaugugaguuuccaauugggccaaacuuugagaugggcaucuucuagaaacgaauguucaugaacuuuuaggcauuuuccauggauucagcacuggagagugacccugggacauaacugaguucuauuucuugccuucagguaaaacuacaacuaacucucccaccccccaaaucugaauaacugacagagacuuccuuuucugcaaaauaggauacccaagucacaguguuaccaugaggcaaaaugaaacaauggauauuaaaguguucugugacguggagaguucauuacaaaugcuagcaguugaaacaggauuuuuaaaacauagaaaugaauuuaugauaguuaacaaaauauuuaaaguagguaucuugcuacuccauuuuuuccauuuaucauuaccauguuuuuuucucuuuccauuauuauuauuguuuauuauuauuauuauuauuauuauuagcuaacagggauccucaaucucuucugugaggagaaacacaauuuuauuuuuuauuuucaaggccugugggaaugggaaaaagagagauggcgaaggguucaggcaaagugccucucagcccuguuuccugacacauuucagagaggccaacucaacucaggagccaucagaagaaacuucacauguuuuaacuucuugacuugaggaaccucauuauaaauauacauuauggcacuuugcuuacaguguauuaaagcuuauuacaggguauggaccuauuugucucugcagucacuugcuuuagacuacugugauuuuuuuuaccuaugucuauuuuuagguuuucugucuccucagauaaagaagauagacaacgaaggacucaauagcuuagagaaaauggcucaauguuagcagaacaagcauuguccagggaccuacaguccaagcuagaugaugguaaaaguaaaacuuacaaaugacuuuaagucuccaaaaucaggcaaaucagcccuggggacugaaagcauuucucgucucuuagguuugaagauucauggagaaugguagauuuaccagaaaauuuagacaugaacaaacaaagguuuugauuugugagaagguugauucaagaaaucaacaagcaagcuguagaucacugucaaaacucuggaauauauuauuacauuaauuguuugugaguacuuagcaaagaaagugacaaaggccuucuaagcauggacauaaggcuacauaaaccuuaaauucuucccuacauuaaaaaaucuuaaauaaugugaaaagacagaugauaaacuaggaauauaucuuacaacauacaugacaggaaaggguuaauauucuuaaucuauaaaguacucuuacaaguccauauugcccaauaaauaaauaagcaguggauaugaacaggcuguucauauagaaagaaauuccaacaaacacauaaaagauaccuuucuuugcuuaggagaaaugcaaucgcaaguucaaagugaaccuguacaaggauauuuuccacagugguguuuguggaaguggggagcuggagguaacuuaaguuuguaauuauuucuucuccuuaccccucuucaauuacccaaccaguaucuucuaugcuuaguuaguuuucaauagauaaaugaguaaaugaucauaaacuugggcuauugaguuuucuugaucugguuccugcugcucuacuuuaguucaaauuguucucugcaaaguuuucuguguacacucugcucccucucacuucugucuuuauucaugcuguuuccuaucccugggcguuuccugucuuugcuuaggcagucauacucauccggucucaucuucuccaguuaaccuuuccuccucuguguucauacauauaauuacaaauaauacaugcuacaauagaaaagcaaaggguucugagugaaaguaaacauauucauugauuauucaaugaauucauugauugaaauuaagcauguucauuuugugccaaguguuacaguagggagugggcauacaaauaugagcaagacacacuuucguaauugcugauuaucuauuucccucaacuauguuagcacagaaguuccaagaaugaaggggcuuugucuguuuagauuacauggcauccccuugugugagucuccucacacuguuuucccaggaacaagcccagagucuggcacauaguagaugaucacugaaugugugcugguugcaagaaggaaucaaucguaucuauuucauguuagaacauauguuagcauauauaugugcacacacacagauguggaaauaaaacauaauacacauguauuuauguauuuaaaucucugucaguuauguuaggaugaccugggaacguuuuugaaaguauguaacauagggacugagauugaugaauuacagauacagagaucaauuccagcuaguuuauuagccaccaaagggcagguugguggaguuguggugcaagcaauauguguuauugaccggccuucccugccagggcgcuucuuuccuugcacuaaacuccggguuagccgaaggugggcuucggcagaauccucaagacccuugguguugcccuccuggaccgcaccuagaaccaggaaguccucucuccccagaggcggugcaaaccccgaagacccucccacugcuugcgggcccggacugcgcucccaccugaaccucucuugacccgcgguaucccagaucuggagcuugaugcguuuuccuggcucgaucuccaccaagcgggagaaaaaauccacccccacgguggggucagaaaccugggcaaagcgacccucggugaagcggcggaucaggcaggacuugcccacuguggaauccccgaugacaaugagccggaacugguacagccagauggccuccauggccgcggcucugcaggucuccuuggcccggaccggggacggcgggagggggcgccccgccgacgccucagagagcgcggcucggcaggaucuagcucagccgcgagcgcaucgcuggccugggagcccgaagcuggguaggcccaggcgccgggagagcggagggauggaugcugcgcucgcaaaggugaugaaauggc

SEQ ID NO: 21337 - RNA, 6248 nt, Homo sapiens
gccauuucaucaccuuugcgagcgcagcauccaucccuccgcucucccggcgccugggccuacccagcuucgggcucccaggccagcgaugcgcucgcggcugagcuagauccugccgagccgcgcucucugaggcgucggcggggcgcccccucccgccguccccgguccgggccaaggagaccugcagagccgcggccauggaggccaucuggcuguaccaguuccggcucauugucaucggggauuccacagugggcaaguccugccugauccgccgcuucaccgagggucgcuuugcccagguuucugaccccaccguggggguggauuuuuucucccgcuugguggagaucgagccaggaaaacgcaucaagcuccagaucugggauaccgcgggucaagagagguucaggugggagcgcaguccgggcccgcaagcagugggagggucuucgggguuugcaccgccucuggggagagaggacuuccugguucuaggugcgguccaggagggcaacaccaagggucuugaggauucugccgaagcccaccuucggcuaacccggaguuuagugcaaggaaagaagcgcccuggcagggaaggccggucaauaacacauauugcuugcaccacaacuccaccaaccugcccuuugguggcuaauaaacuagcuggaauugaucucuguaucuguaauucaucaaucucagucccuauguuacauacuuucaaaaacguucccaggucauccuaacauaacugacagagauuuaaauacauaaauacauguguauuauguuuuauuuccacaucugugugugugcacauauauaugcuaacauauguucuaacaugaaauagauacgauugauuccuucuugcaaccagcacacauucagugaucaucuacuaugugccagacucugggcuuguuccugggaaaacagugugaggagacucacacaaggggaugccauguaaucuaaacagacaaagccccuucauucuuggaacuucugugcuaacauaguugagggaaauagauaaucagcaauuacgaaagugugucuugcucauauuuguaugcccacucccuacuguaacacuuggcacaaaaugaacaugcuuaauuucaaucaaugaauucauugaauaaucaaugaauauguuuacuuucacucagaacccuuugcuuuucuauuguagcauguauuauuuguaauuauauguaugaacacagaggaggaaagguuaacuggagaagaugagaccggaugaguaugacugccuaagcaaagacaggaaacgcccagggauaggaaacagcaugaauaaagacagaagugagagggagcagaguguacacagaaaacuuugcagagaacaauuugaacuaaaguagagcagcaggaaccagaucaagaaaacucaauagcccaaguuuaugaucauuuacucauuuaucuauugaaaacuaacuaagcauagaagauacugguuggguaauugaagagggguaaggagaagaaauaauuacaaacuuaaguuaccuccagcuccccacuuccacaaacaccacuguggaaaauauccuuguacagguucacuuugaacuugcgauugcauuucuccuaagcaaagaaagguaucuuuuauguguuuguuggaauuucuuucuauaugaacagccuguucauauccacugcuuauuuauuuauugggcaauauggacuuguaagaguacuuuauagauuaagaauauuaacccuuuccugucauguauguuguaagauauauuccuaguuuaucaucugucuuuucacauuauuuaagauuuuuuaauguagggaagaauuuaagguuuauguagccuuauguccaugcuuagaaggccuuugucacuuucuuugcuaaguacucacaaacaauuaauguaauaauauauuccagaguuuugacagugaucuacagcuugcuuguugauuucuugaaucaaccuucucacaaaucaaaaccuuuguuuguucaugucuaaauuuucugguaaaucuaccauucuccaugaaucuucaaaccuaagagacgagaaaugcuuucaguccccagggcugauuugccugauuuuggagacuuaaagucauuuguaaguuuuacuuuuaccaucaucuagcuuggacuguaggucccuggacaaugcuuguucugcuaacauugagccauuuucucuaagcuauugaguccuucguugucuaucuucuuuaucugaggagacagaaaaccuaaaaauagacauagguaaaaaaaaucacaguagucuaaagcaagugacugcagagacaaauagguccauacccuguaauaagcuuuaauacacuguaagcaaagugccauaauguauauuuauaaugagguuccucaagucaagaaguuaaaacaugugaaguuucuucugauggcuccugaguugaguuggccucucugaaaugugucaggaaacagggcugagaggcacuuugccugaacccuucgccaucucucuuuuucccauucccacaggccuugaaaauaaaaaauaaaauuguguuucuccucacagaagagauugaggaucccuguuagcuaauaauaauaauaauaauaauaauaaacaauaauaauaauggaaagagaaaaaaacaugguaaugauaaauggaaaaaauggaguagcaagauaccuacuuuaaauauuuuguuaacuaucauaaauucauuucuauguuuuaaaaauccuguuucaacugcuagcauuuguaaugaacucuccacgucacagaacacuuuaauauccauuguuucauuuugccucaugguaacacugugacuuggguauccuauuuugcagaaaaggaagucucugucaguuauucagauuuggggggugggagaguuaguuguaguuuuaccugaaggcaagaaauagaacucaguuaugucccagggucacucuccagugcugaauccauggaaaaugccuaaaaguucaugaacauucguuucuagaagaugcccaucucaaaguuuggcccaauuggaaacucacauauuaguaguaguauggaaugccauuuguauuccuuuguuuuuuuaaaaaaaaagaaaaucauuuuuauuaaaggacugugucacuaaccaggaacacuugaauauacugaguucauugacaugcagaaguuugggcacagccuuuacucuuuacuucuuucuuguguuuuagauccaucacucgcgccuacuacaggaacucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugaaacgucagcccgagaugccauuaauguggagaaagccuucacagaccugacaagagacauauaugagcugguuaaaaggggggagauuacaauccaggagggcugggaaggggugaagaguggauuuguaccaaaugugguucacucuucagaagagguugucaaaucagagaggagauguuugugcuagucaguucuuuuauuuccaaaacaugcucuccuacuugaacugaaaaguaagagaaauaaauagaaucuuuguguaacugaugagaacucaaccuccauuuggauaccaagugagccucccucucagggggacucugacagacucgugugcggguggaugggggugccugagugcugugaccaagggacugaauugcugacaugggccaggccaggcacuguuuuguggcccaugcuaggcaguggcugcuccaugagcccuuuguggaccacauguuaaaggccugggguuuaggaagcuaagucccaggaaaacauaccuacagacaggacaacuguuccuugguauuugagcucacuuauaggccaugaacauaaagaaauacauaaaggggaaaaaaguuucacaauggggacaauuagcauaacuaaacaaagauuaugagcucuacuuauuccgugagaauacccugcaccaaagguguuugcuggguuugguuaaaagguaccaauuagcuuuuaacagcuuucuguaaaaugaggaacacagaccaaaaggucugguguucaaguaaaaaugaugugacuauggaaaggaaggcaaucgacacaguuauuagcacauuucagaaaaugaacacccuugugauagaauuaccagcuguaugaaacaaauugucccaugcaaauuacccuauaacuaggaaagagacacuauaacccaaaugccauacccccuuuuuccuuugaccaugccugggguuucaaugccuuggcaccugcaaucuggaaguaaacagucugcuugcuucuucaggcacgugacagugacaacacagugacugccucugaaaagagcccugaggcaaacacucucuccugcugaacaggaggcacuguaacccuuacaaacagcuuacaguuacuugggcuacuuauuugaucaucauaacaggccuacgagguuuuugccccauuuuacagaauaguaaacuaagagccaugaaaaucacuuggccagggucaaggacucgugacuccuagcucuuuucacugcaucauacugcugucagaugaauaaaugauuaugaauuuguuuacuugggaagagauaugacuauaaauaaauguucucuacauguuaggauauguuuuccuuauugauuacaacucagcuauaauccugagggaacaugggaaggaaucaaagguaaagcccauucaggcauuauugacaagagggcuuuaaacaagugaauaauugcacaacuaaaaagacauuagaacugugugggcuauaaguguucuuaucacugagacacaguggauuuuuauugaaaggaaccacguacagcaaugcggagugggauagggauaaaauacccaccccaaaaugaccuuggccaccugucugccauauacguacacugaguuccugucuacccaagagagucagcccuuaauucucaggugaacaaacagcuaacugcaucagcaaauuggaauggcuggcuugaaguuuccauuauuuucuugaagagaggugaugcuuuaaauuacuuuuuggauuguagccaguucagcuaggcaaaagccauacuuuucacaauuaaaaaaaaaaacuauucugacuagagucagguuucucauauccaucgugauaggaaggccuaagaauggcaaaucgcuuugagauauaauauugaacuucaguaugaaugugaccgaaucugaaacuuugggaauuugcuuuagccagaauaaagaaaccaaaucaugaaaauuauggaagacuauucugccaccugugccccaaguuggaugagcaaaccacuuuggaucaguucacagcauuaacuacaagugaacugaucaucuucucuauauucauuucacaagagcuggcuuaggugggguaauuaaauugccaccuucgugguuguaaaagacaaacaaaacauggcaaauuucauuaacacaaaauuucaucaacugcuauacugaauuauguuuagaagauucugaaagcaagauuauccaguggguaaaugagagucgacuggauucugucaguucaaaaaaggaaagaaacaaaacuucccuacaauuuucuucacuaaaauuuauuauauguacaguauucccacuccuggcauuuucuggcagguuuaaaaauauucagcauaaauccagcagagguggcugagcuuaauugcuuaaauaaguucuagaaaauuuaaaaaucauuuuaguagaauucaguaccauugucacugcaauaaguggguuuuagaaaauaagugugaaaagaaucagguguuaauauaauacuaaggauaaagcuuuagaagcuauuuuacuacauagguaaagaaaagauaaacuaacuuguaacaaagaccacaacugcauguuggauuagauugucucauauuucagaauaaaauguacuguauacuuuuccucacuuuguugugcacuguaaugaaaugugaaaaaugcuuuauuuagcuguaugugaaugaaaauaugcuuguauuuaguaaaaugauugauuauguga

SEQ ID NO: 21338 - RNA, 74919 nt, Homo sapiens
cucggcacugggcggcgcuggcuggcucccuggcugcggcuccucagucggcggcggcugcugcugccuguggcccgggcggcugggagaagcggaguguuggugagugacgcggcggagguguaguuugacgcgguguguuacgugggggagagaauaaaacuccagcgagauccgggccgugaacgaaagcagugacggaggagcuuguaccaccgguaagaggagcaggaggaggaggcaggagccagagagagccggggggacggaggggggacggggaggcgccggacacccgcgcuuggggccuuccccucgcaggaggggccgcgguaaagauggagccuccgcccgagccccacaacaucgccgccgcucgcagcgaacaaagaauaauggcggcggacuggagccagcggcggccggggcggcagcgacucugccugcagccagcggcggcgcucauggcggggggcggcgggcggcgggcggcgggcggggugggagccggcggccgggggugugugcgggcggccggccgcggcgagcuggcgcccgcguucccgccgccgccgccgggccgggcgcggagccgggaacccggagccgccccgggggaggccgcccgcucggcccggcgcugccccccgcgccgcucgcucguccggcccccgccgcccgccucgcccccggcccgacccggccgggccuccggggcagccgccgccuaggugccggugggggauggaggaggaagaaggcgacaguugagggcagaggaggugaaggugccugcugccuucccgguggcuucggugccugccaugcccgcuucgcaaggggaagagcugcaacgucugaccuacucuucucuccacucuuugugcaauaaaguucgaaacccaagguuuccucucgugcuguauuuuauucgugcccuuucccccccgcuccuacaccguugaggaaaugcugcuuucugcccuguguugcuuaguugagagaugagagcuugugcuuuuggggggaauuuuugacucccucaccccuuugcuuuuuuuuuuuuuuuaaagucagucauggaaaugcaugcuuuuugggagaaagggugcuaagaaaaacauuuauaauaacuuuuuaaacuguugggaucuuauaaaagggaagcugguguuugaaaacaguuucgguuuuaacccuuuuuaauaagguaaucaucacuugagaucuaucauucugaaacacuucguuggaacgaguaucagccgauguacucuuguuuuacaucauuucgcggggugcaaccuugccaaccgcguuugggucaucuggaucuccccucacccuccgucccacucccccuaccauauuucccacgaauuucugugugaacuuuaaugagagauugauuuaauacuacuacuaaaaauagacauuaaaguauccauuauuugucucaugcaguagguaacccccgucuugagauugacaauuuaagccacaagcuguauuuuuucuucgccuguugggaaaagaggacagcagaaaagucauugacacauuaaaaauuaaaagacaguuuuugaaggacgugcgguaugaccuauuuaaguuuguaauaccaucucaaguuauaauucuaaccucagcuggcgucuaacuucugaagguuuaguagaagauacuuuugauugcugccuauugaaaucuuuuacauuuauggcucauuucgugauuuaaaaguaaagccccgaacaguuauuuuagguggugcaaaagacgaacaaguuuguuuuaaaaauacuugucugucacuguaugauugcauugugauugauacguacaaaccuucugguuaagaacaaauauugauuggcagcagaagcacugucuuauuuuucuguauucuagucacuuuuccaaaacgugcuuugcuguauugcuucucuuuaaaagaccacauuggcaauuugucauuuccaagaaaauuaagaagaggcaauaaaggcagguuuucuauaaagauuggggaaaugauuuuauuuccgagcacugaaaaaauuauaguauugauaaugguagcuuaccauuuuuccuuuauguuguuccgcaagccacuaucaguagaguagaauuuuuuuucuuguuaagaauauaagucgggcgcgguggcugaggccuguaaucccagcacuuggggggucgaggcgggcggaucacuugaggucaggagugcaagaccagccuggccaacaugaugaaaccccaucucuacuaaaaauacaaaaauuagccgggugugguggcacgcgccuguaaucccagcuacucggggggcugggguugcagugaauugagaucgugccaugcacuucagccugggcgacacagcaagacuccgucucaaagaaaaaaaaaaaaaagaaagaauauaugacucuucauuugugagauuuuuaaaaaauuguucacugauggccgagugcgguggcucacaucuguaaucccagcacuuugggaagccgaggcaggcggcucacgaggucaagagaucgagaccauccuggcuaacauggugaaaccccgucucuacuaaaaauacaaaaauuagcugggugucguggcgcgugcuuguaaucccagcuacuaggguagcugaggcaggagaaucucuugagcccaggagguggagauugcagugagccgagaucgcgccacugcccuccagccuggugacagcgagaccccaucucaaaaaaaaaaaaguuuacugauaaguucuuucuuuagucuugcccgagagauauuuuaaauuguauuuuuuauuuuuauuuuuauuuauuuguuuuuuugagacggaguuuggcccuuauugcccaggcuggagugcagugggcuggucucggcucacucacugcaagcuccgccucccggguucaagcaauucuccugccccagccccccgaguagcugggauuacaggugugagccaccgcgcccggccuguuuuauuauuuauacauucauaauuugugauucuuagcaauuccaggugaaacuucaaacuuguauucauuaauacuugaacauucaccuggaacauguuacuaaauuguacuucugcacuguuccagccauggauaaaaauuacagcuggaucugcuugaaucuuuuuuuuuuuuucaugaacaccuacauuuagaaagcuaauaaauuacuugacagaguuugcuugaagaauguuaaaagaacacuucuuugggaauuuaaaacuuaaguguuaccuguuuugaaugauuuuuuuuuuguuuacauaaagagccugaagaaacuuagacaccugauccauaaaaauggcaccuuuuucuacuuucugaaacucauauucuugauuaggucucauuauuagaaauuuuggguucuucauagagaaguagcuuuauuucucucucauucuaagacauuugguuuuguuuguuuggauacaguaugguuaugggguuauaguaaaaccaaguaugucuuccucacguguuuuuaaauucuacuuuuuauaacagaaaauuauuuuuaaccuaaugcuuacaauauauuaccgaaauuuauaauuucauuuauuccauaaauagcuuaucagauaugaguuacauaaacuuguuuacagccagcuugugacauaguuuugcaaauaucuugauauaugguguaacuuugauggcuucuuuauugaauagagcucaaaucuaaauuuaagaauguaaugagaugucaagauggaaaaaugcaggauuuuuuuuuuucuuacccauguguaaacucaucuguacugcaguaucacuugagacagcaguuuaugguaauucaaauauuuauuuggcacucacugugacagagaauguaguugaaagagcaugagguuuggaaucauaggccuaggucugaauccaagcauugccacugcuauccuguacccacccuaaaggaauuuuguguccugaaggaaguuucuuaaucuuucucagccucaguuuccuuauauguaaaauuagaauacuacuacuuauuucauaagauugcgagauaaacauaaaguaccuuagggcuacaacuaaugauagcuagucccuuaagcuuuauuuuaacuuccuaccugugggcccuuaggcaaguuaucuuaacuucuuaauaccucacuuuccuuucugaucaguguagaacaacuaccucagaauuguggggguuaacuauaaaguaauacauacuaagucccaggcauugugcaagugucaagugcucaaguguugacaaggcuuuuuucuuuuguuuuaauuuuuuuuugagacggagucuugcucuguugcccaggauggugugcagugaugcagucucagcucacggcaaccucugcuuccuggauucaagugauucuccugccucagccucccuaguagcuggaacuacaggcaugcaccaccacgcccggcuaauuuuuguguuuuuaguagagacaggguuucaccauguuggucaggcuggucuugaaugccugggauuauaggcgugagccaccacgcccagcuggucuguuacuuuuuaaauuauuuauuauuacuauauguaauacagugggucagaagcuacaacaaauccaaagaugaauuacgcugucuuaucucuacccucaggaacuguuggggacacagugacuaaggcaaaauaugugucaaaagaaagcagucaaaggaaaaagggaucaccuuuggugaagugaggaguauauuuuuuauauuucuaauuugguuuuuugaauaaguaauucauucacaugaucuauaauucaaaacauaauaacagcaaaaugcccuacauucucuugcccuauuaccuaaguguuagcaauuuuuuauuuguccuuuaagagguguuuuaugcaaacacgagcaaauauguauguacagucucccccuuuuuguacaaaugguagcauacuagguauacgcucuccuauaucaugcuuuacccccaccacuuaauauggcuuagcaauuuuguaucagcacauaaagagcuucuucauuuuuuaacauacaauuggaagcauuuuauuauguaaguagacuguauuaaccaguuagugagcugcuuuuauucuuaggucuuauauuaccuuuuaaacuaagggaaacugccaucuugccuuuauuucuuuaaaugaaaaacuuucuauuugaaugaaaaauaaauaguuugugacaggaaauuguuauuuaaagucccucauuuccuguuuaacuccaguuuuuaaaaguuuuaguaaaaugaucaaaauguacaugaggaggcaagcaagccagguuaagaguuaacucacaaggugaauuuaacucuuuuguugagguucuuacaguucugaacagacuacuucuuucaauuauuauuuuggcccaaaagguuuuuauagcuuucuuucuuaaugagaaagaacauuucauauaguccgguguuuuuuuggguuuuuuuuaacagacagcucaugggauauuauuacccaguaaggcugauuacuauacuagauuucucccugcauucauuuauuuuuuacauacuuguuaacuuaccuugacgauuuucuaguauuucuuaauguaauuaugugaguuuuauauuuuguaccuaaauuuaaaaauagugagauucaccuauaugauugcugagaugauaaacuuuacugcauagaugauuuuuuuacccccguggggaaaccuuuggucaaccaguuggaccaaguaauacguauuucagccaaagcacaaaaugcguuucacuaccuuuuuuuuuuccucuagcuuuucgaaacagcauugagcuacaauacuuuuuuauuuauuuauuuauuuauuuauuuuuauuuauuuauuuuuuugaggcaagguuuggcucuaucacccaggcuggagugcaguggcacacacuuggcucacugcaaccucuguuuccuggcucaagccauccucccauuucagcuuccugagugagugggacaacaggcgcgcaccaccaggcccggcuaauuuuuuguagagacagaguuucgccauguugcccaggcuggucucaaacucaugagcucaagccauccaccugccucagccucccaaagaguugggauuacaagcgugagccaccaugcccgaaugcuguaguacauuuuaaauauacaugcuguuuguauuuaucuuuaaaauguacacacuaugacuuuuuugaguugauuaaacucagaaagugauuaauaauauagcagcaagggcacaaaucucuuuccagaaaacaucauuaaguaaagcugucaugggccagucgcgguggcugacgccugugugaucccagcacuuugggaggcugagguagguggaucaccugaggucaggaguucgagaccagccuggccaacauggugaaaccccgucucuacuaaaaauacaaaaauuagcugggcaugggggcaggcgccugcaaucccagcuacucaggaggcugaggcaggauaaucacuuggaccuggaaggcagagguugcagugagcugagauugcaccauugcacgccaggcugggcgacaagagcgaaacucugucuuaagaaaaaaacaaaagcugucaugguauauuucguuuuuuguauucccaaguugguguuuaugcguugaucauauauacaaaguuuuuaauguaagaauauuguuuugagguuuuacuaauauuugauuuaaaauauuacuaugugcuauuuggccaggcgugguggcucacgucuguaaucccggcacuuugggaggucgaggcgggcggaucacuugaggccaggaguuugagaccagccuggccaagauggugaaaccccaucucuacuaaaaauagaagaauuaucuggguauaguuguauacgccuguagucccagcugcuugggaggcugaggcaggagaauugcuugagcccuggaaguggagguugcagugagccaguaucaccccacugaacuccacucugggugacagagcaagaugccaucucauaaauaaaauauuacugugugcuauuuguaccugcuaaaugauuaaaauguuuacaaagugcuuuguuguuguuguuguuguugagacggagucuuucucuguugccaggcuggagugcaguggugcgaucucagcucacugcaaccuccgccuccuggguuaaagcgauuccccugccucagccucccaaguagcugggauuacaggcgccugccaccaugcccagcuaaagagacaggguuucaccauguuggccaggauggucucgaucuccuugaccucgugauccacccaccucugccucccaaaguggugggauuacaggcgugagccacugcgccuggccuacaaagugcuugucuuuacauauuuggggaugggggugggguagaucauugaaaucuguaaaggcagaacguuuuuuaucuggaacauaucuguagacuaacagaguuaaaugauuucccacagugucauggaaucaucaguggauugccucuugggguggaggcaaagaucauuaaagcagcaaacugauaaugugaacgugguuguuuuuucucugccaauuaaauauaugcuaguuuagucauuauagaagagccagaugcuggucagcuuguugaaguuguaaguagaaggugugguuuuaucacaucuguaaauguagguuuuugagacaaaacuuaaauaagaauagacguuaguuuuuauucacauucagaaugucugacuccccuuaauauauacacacucuugucuuaucuacuggguuuuuuuguuguuguuuuuuguuuugccuuuucucucucucuuuuuaagcucugccagacaaggcccuaugaagauagguuuuacagguugagaaucuuuuaucugaaauucuugggaccagaaguauuuccaguuuuggguuuuuucagauuuuagaauauuugcauauacauacauaaugagcuaucuuggggaugggacccaagucuaaacaugaaauuuguuucauauacacauuauacacauagccugaagguaauuuuauacaaaauuuuuaauaauuuugugcaugaaacaguuuugacugugaacuguuacaugaggucaggugugggaauuuuucauggcaucaugucagugcucaaaaaguuugagauuuuggauguuuuauuagggaugcuuacccuguauuauauuuugcccagauguuuccucauuugucuucuaggcuaccagaaagauguuagcuuagaaaaacguauucuggcguuuauuccaacagaugagaaggcaguuucuccagugaugaauaauuaccuauaauuuaauacgugcauuauacaucuccagugaugaaaaaucacuguguauuaaaaaauucuugaagcuagguacauaaucucaacuccuaaaaaagaaaauaaacaguaguacuccuugaugaacuuacagaugcuaaguugccuuuucuuagaguugaaauaaggugauaaaggaguuuaccgugagacuagcugugugaacaaagaugaaaaacacccuuucaguuuucuuccucuuggaugauucuaggaucucuaaaaaauaaucuuaaaaggggcgagguuuugagaggaugaggucuaaggaauugauggugaguuuuuucugaaagaagagaagugacauuugauuagauaagaaaggguuaaaagggaaguuauuaauaaaauaguuuaggaguagaguggaucugaaaguugacuuauaccaaugaugauagaaugugucuuuucccaaagguuagugcaucuucucugaaaugaagacguuucuuucaucaauuuuaagugaauuucuaaggaucugguuaucuacuugugaguuuuugguuguaacuguaugacaguacagauguaacuaaaaauguuuguaauuuacccaagguuaaauaaccauuauuuuugagggcuguuaucccuguugguauaaguaaguaguuggcaguaggggacacagaaauaccuuguuuuucaccacugaagugaaaauuacagauuauucugaauuauuuguacucuuuuuuuuuuuuuuugagaggaaucucgcucugucucccagccuggaaugcaguggugugaucucggcucacugcaaccuccgccuccuggguuccagcgauucugcugccccagccucccaaguagcugggauuacaagcaugugccaccauaccuggcuaauuuuuuuuuuuuuuuuuuguauuuuuaguagagacaggauuucaccauguuggccaagcuggucucgaacuccugaccuuaugugaucugccugccucagccuccgauuacaggcaugaaccaccgcccccagcccuauuuguacucuuaaaggggagucauuuucuuauaauaaguaucaguaguagcucuauuguuugcugugaucaauggugacaccuugacuuuauguauugccauuuaucaaucauuuauucagugaagauuuauugaccauugacuuuauuaugguuggugaaauaaucgcaagaaaauuuauucaguuagguauuuauaaaaauaccuagguauuaaaugaagauuguucuaguugauauaagcaauaaagccugacuauauggcuccuacccucaagaaucuuacgguauaguagggaugaugaaauaguguaagaaugauuuauaugugccagaguacaugacagaguuuuuacugucuugaagagcuacagaguucagaagagaaggggcuuagugaggaaaaguuuugugggagaaguagaauucaaguugaauacuaaagaacuucaguaaguacagauaaaauggaguguauucuaggcaguggaauggacaaaaaaaugaaaacauggacauauaaugaacuugacauacucauaaauuggugaagaaaguauuagauuauagaucuacauuuugaggaaugcugaguaugaggcagggagcuuugaguuucauguaagagaagguaagauauaaacaggaauacaaugauaaauugggcugaaauguagauuuccugacucccaauucuucuccuuaguguagacagagauauacagucaugcacuguauaagaacguuuuggugaaugacagauugcauauacaacagugguccugugcuaguguaagcaaaccuauuaagaacuucagauagguccuucaggagguauuccagaagaaggcauuguuaccauaggagaugacagcuccaugcaugugauugccccuugaagacauuccagugggacacguuguggagguggaaggcugugauguugacaaucuugacccuguguaggccuaggcuaacgugugaaugucuuuuuaacaaaaaauuuuaaaaaguggccgggaaugguggcucacgccuguaauccuagcacuuggggaggcugagucaggcggguugcuugagcccaggaguuucaagcagccugggcaaaauggcgaaauccugucucuacagagaauacaaaaauuaauuaacugggcuugguggugcaugccuguaaucccugcuacucacgaggccaaggcaggagaacccaagaggcagagauugcagugagcugauacugugccacugcacuccagccugggugacauagugagacccugugucaaaaaaauaaaguuuaacaaaaaaguuuaaaaaguaaaaaaaaaaaaaaaaaaaaaaaaaaaaggaaaaaaccuuagauucuuuuauugcuuuacuuuauuacuaaauuugcuuucacuuaaaaacccuuuagagaaaaaauauuuuuauacagcuguacaauuuauuuguguuuuaagcuauguguuauuacaaaagaguugacaaguuaaaaaaacuaaaaagcauaugaaguuacaguaagcuacgguuaauguauuacugaugaaagaaaauuuuguuuauauaaauuuaguguagccuggaugggcacaguggcucacaccuguaaucccagcacuuugggaggccaaggcagguggauuaccugagguuagaaguucgagaccagccuggccaacauggugaaacccuguuccuacuaaaagugcaaaaauuagccaggugugguggcaggcgcccguaaucccagcuacucaggaggcugaggcaggagaauagcuugaacccacagguggagcaugcagugagccgagaucgugccacugcacuccagccugggugacaagagcaagacuccaucucaaaaaaaaaaaaauuagccuaaguauacagugccuuugaagucuacaauaguguacaguaauguuguaggccuucacauuucucacacugauucacccagaccaacuucuaguccugcaagcuccguuugugauaagcacccuguacagauguaccauuuuuuaucuuuuauauuuuauaucuuuuauuuuuacuguaccuuuucuauguuuggauauguuucgauaacaaauacuuaccguuguguuacauuuccccacaguguucaguacaauaccaugcuguauggguuuguagccuauacuauguagccuugguacauaguaggcuauaccaucuagguuuuguuuucuaaccuaauuaacuaaugaugcauuucucagaacauauuaccaucaagugacacaugacuguauauguauuacaguuaaaaauuggacaucauagauucuuuuuuaaacagcuuuauugaaauauaauucacauacucuacaauacacccauuugguguguacaguucagugguuuucaguauauucacaaaguugugcaucuauuaccaccaucaguuuaggacauuuucauuaucccuaaaagaaaucuacacaucuccucucagccaucaccucuuaaucuccccauaccugcagcccuaggcaaccaccuaucaccuuugugucucuauagguuugcuuauucugggacauuguguauaaguggaaucauauagcauaauguccauugugaugagcugccuuuagcauaauguuuucaagguuuauucauguuguaguauguaucaguauucauuuuuauugccauaauaguccauuuuauggauauagaacauuuuauuugugaguucacggacauuggacuuuuugauuauuaugaaaaugcugccauaaacauucauuuauguugacuugccuucauuucucugaguauauacucaggaauggaauuuuaugguaacuguguuuaaccauuuaaggaacugccgggcuguuuuccaaucugcugcaccaccagcaguguauuaggguucaaauuuucccccaucuucacuaacacuuguuaucaucuguuuuuugggguuuuggguuuuuguuuuuguuuuuuuguuuauuucaauuauagccauucuacugagugcaaagagguagcucaguuugguuuugauuuguauuucccucacgacuaaugauaucaagcugcuuuucaugugcugauuuggccauuuguauaucuucuuugggaaaauuucuguucagaucuuuugcacauuuuaaaauucgguuggcuuuuuguuguaauaguuguuuauuauucuagauacaaaucucuugucagauacaugauuuacaaaaauuuucuccuguggguugucuucacuuucuugauggugucucuugaagcacaaaaguuuuuaauuuuuaugauuuccgguucaucuaauuuuucuuuucuuguuuguguuuugguguuauauuguguauaucauaaauucuuguuuauuauaaacauuuaaaaaauaucucugaucucugugaaggcccaggcaaacaagauaccauuauuuaaugaaaaauaacugaagcuacuaauguguauuuggaguuauaauccaccuaccucaggccuucccuuuauucuguguccauauccuucaguuuguagugacagaugaaagaagcaaagaugaaaaucgagaaauaauuuugagugaaacauuuuaauuugaagcacaguugucccuugguaucgauggggaauugguuccaggaccccuucagguaccaaauccacggaugcuugagucccuuauauaaagugguauaguauuugcauguaaucgacaaauauccucccauauacuuuaaaucaucucuagauuacuuauaauaccuuauacagugccugcccaucacuugacucuuauggguucagcauaggagucagcaugcagcaaauucaagcuuuacuucugggacuuggggauuuuuuucccccaaauaucuuugaucugcaguugguugaauccacagaugcugaaucuuuggauacagaggcccaguuguaacuaugauccaagaauuuguuauuuauuaugagagaauuuauuauaaugacugcgaugguaguuuauaacuuauaaacucuaccauauuugggaaauucacaguuacaaacauuuaccuaugaagggggagugaguagucauuccuucauuuuuuacaaauaagcugagucguggagaauuuaagugauguguguagaaacucacaguaaguaaggcguagucuucaucacucuuguaguacugcauuaucucuuuguaaaguuuucaggguuucuguuuuauuaaugguuauuaauuuuauuuauuuauuuauuuauuuauuuuugagauggagucugucaccaggcugaagugcaguggugcuaucuuggcucacugcagccucugccuccuggguucaagugauucuccugccucagccuaccgaguaacugggacuacaggugcaugccaccacacccagcuaauuuuuuuguauuuuuaguagagacaggguuucaccauguuggucaggaugguaucgauuucuugaccuugugaucugcccaccucagccucccagagugcuggggauuacaggcgugagccacggcgcccagccaaaauuuguuuuuuuguuuguuuguuuguuuuuugagacgaggucucgcuguguugugcaggcuggagugcaguggcaccaucucagcucacugcaagcucugccuccuggguucaugccauucuccugcuucagccuccugaguagcugggacuacaggggcccgccaccacgccuggcuaauuuuuuguauuuuuaguagagacagaguuucacuguggucucgaucuucugaccucaugaucugcccgccuuggccucccaaagugcugggauuacaggcgugagccacugcccggccaaaauuuuucuuuuuaagcaauauuaguuuaggcuuguaaguagcucacuuaggguaaauauucuagccaagaucaugaaaaaauacauugauuucauuauguucuuaaucagaucugcaucagauuaccauaaauaggcagcuauucuuucuuuuuuuccacaguucauuguauuccuaccauuuccaaauagaaguuuaugguuuuaaauuacugauguuaaguacuuguuuggaaggaauuuauaguuaaacuaguuauaauaauuuauaccugucaagcucuuucauauauaguacauauuuuaucucucauuaguuucuguaagcucuugagagaaagguucuuuuuuauuuccaccuuuuaaguucagggguacaugugcaggaugugcagguuuguuacauagguaaucgugugccauggugguuugcugcacacaucaucccaucacccagguauuaagcccagcauucaccagcuguucuuccugaugcucuuccuccucccacccccaacccucugacaggccccaguguguguuguccccccaaccaccgauguguccauguguucucaucauguaccucccacuuacaaaugagaacaugcgguauuugguuuucuguuccuguauuaguuugcugaggauaaaggccuccagcuccaucuauguucaugcaaaggacaugaucuuguucuuuauggcugcauaguauuucaugguguguauguaccacauuuucuuuagucugucauugaugggcauuuagguugauugcaugucuucgcuauugugaauagugcugcaguuaacauaugcgugcauguauuguuauaauagaaugauuuauauuccuuuggguauauauccaguaaggggauugcugggucaaaugguauuucugccucuagguuuuugagguauugccacacugucuuccacaaugguugaacuaacaccaccaacaauguagaagcauuccagagaaagguucuuuuauuuuuguuuuguuuuguucgagacagucucacucuguugcccagacuggagugcaguggcaugaucucggcucacugcaaccucugucuccuggguucaagugauucuccugccucagccuccugaguagcugggacuccagucaugugccaccaugcccggcuaauuuuuguauuuuuaguagagaugagguuucacuauguuggccagcuggucacgaacuucucaccucaagugauccacccgccuuggccucccaaagugcugggauuacagacgugagccacuccgccuggccuaauuccagagaaagguucuuauauguuuuaugcuauagucccauaguaugggacuacuacuauguaguaauuuucaguucugcugaaaaugcuguagucguuacuacguaguaggcgcagaauauuuguuuaaugagugauucucuauuaaagggucauaaauuugaaagguaaagguuaagaacaauuucucuuuagaguuguacagauuaaaggaagugaacuuuuuuuuuuuuuuuuugugagauggaguuucgcucuuucugcccaggcuagagugcaauggcgcaaucucggcucacugcaaccucugccuccuagguucaagcgauucuccugccucagccucccgaguagcugggauuacaggcgugcgccaccacgccuggcuaauuuuguauuuuuuuaguagagacaagguuucuccauguuggccaggcuggucuugaacucccgaccucaggugaucugcccgccuuggccucccaaagucuugggauuacaggcaugagccaccgcaccuggccaaacauauuuuucuuuaacugaggaaauuagauucauuguccaaagcuuaaaaggaagauuuucuacuuugaguuuuuauuaacucugauacuuuacuaugacaguacuuccagccucugagacaugagaaauagcgugagauuguaguaaucaaaaugaccuuaccagaaaucaccaccagguuggugaaaaacaguacaucuacacagaaggauggacuugauguugauucuuucaagauuaaagaugaagaugcccgaacuugaagcaagucuuuuaucaaaaccguacauaaagcaaaacacacuguaugauacuguaaugguggacacauaucauuacgcauuuaucuguagaaugugcaacaccaagagugaaccguaagauuaaaaaagaaacaacaacaauaggcugggcgcaguggcucaugcugguaaucccaacacuuugagaggcugaggugggcggaucaccugaggucaggaguuugagaccagccuggccaacguugugaaaccccaucucuacuaaaaauaaaaaaauuagcuggcugugguggcgggugccuguaaucccagcuacuugggagacugaggcaagagaaccgcuugaaccugggaagcggagguugcagugagcugagaucaugccacucacugcauuccagcuugggggacagugagacccuauaucaaaaaaaaaacaaaaaacaacaaaaacaaaucaaagccuguacauaaaguauguacuguugccugcaugccauuugucaguuuuaaagauuaaccauggucaguuuuuaaauguaguccaguauauccuugguaccuuugaguucuugggcuuuuuccuuugcuguuugacuaguaagcaaaauguaauaaaaguaauuagcauauugcauaauaguccacauaguuccauucccaaauauuacagagaacuccucauuuuuuguaauauuggaggcuguuauaacccugaagucuugaacauuccuuacaaaucucuugacaucuuuuguucuccaucugugaaguuagcuaacaccagaauuccuguauuaugacuccucccauaacaugugcugucucaccucaagaaaacugaauuuucacucuuccauguccaauuuguaaauaauucaccaagaauaacauuucaaaauuuaguucaaaauaacagauguuacuucauaaacuuauuuaaaaaacacuuggacauucaucucccauuuggauguagugauuuugacguaaucacuuugauuuucuuaaguaaauguaaguaggcuauacauauuuaacuucggggcauaguaacuuuuggguacuuacaguuucagcauugagcuaguuuacgaagcagaacuaacauuugaagacagcuucauucuuuagucaacauaaaaauuguuuuugucaaaguaacuguauguaggaaguaugugauccuuuuuuucuuaaaaaaaugagcuccaaauagccauuuaguaacacuucauguauagagguuucugugagaucaauucuuccaaguguucaaaguguaaaaagcugugaaacacccauuaaguggguguuuggaaugaaaggggaauggaaagagaugagauaaaaauauuaucuaaaauauugcauagucguggcugcugcuuugcuaagcaacacugucucuugguggucacauacaugaagacuuguuucaaauucaugaguauagucuuaccugaaggaaaacaaggcaaguaaacuuugcaaauacuuaauuucaaacaaacaaacaaaaaacuuuaagaaagcacuacagcuuucuuguugaaaggcgcuauagaguuagucacauauucugagauggcugucaaaccaugcaauauguuucuauauaucagaugauuuuuuuuuuuuuaaauugagauggagucucauucaccgugucacccaggaaggagugcaguggugcaaucucgacucacuacaacccccaccucccggguacagcauucuugugcuucagccuccugaguagcugggauuacaggugcacaccaccacgcccagcuaauuuuuguauuuuuaguagagacgggguuucacaauguuggccaggcagaucgcaaacugccucaaguaaucugcccgccuaggccucccaaagcgcagggauuacaggugugagccacugcaucuggcuggcauuauuucuaacacacuucuguuaaauacuuccuucaagaacaauaucuuugucauagaauaugcuacauuuuuuaaaaacaaauuuauuuaucaaggauggcauucaaauacccugguaauuacaaaacugcaaugauaaaauacaaaauauugaacuuaaacaguuucucugagcuaaauccaauaaauaaaucagggaauuuguuuucuuaaauaauauugaaaagauuccuggggccaggcccgguggcucacaccuguaaucccagcacuuugggaggcugaugcggguagaucaccuaaggucaggaguuugagaccagcguggccaacauggugaaacccugucucuacuaaaaauacaaaaauuagccaggugugguggugcacaucuguaaucccagcuacuugagaggcugaggcaggagaaucacuugaaccggggaggcagauguugcagugagccgagaucacuccauugcacuccagccugggcaaugagcaaaacucuguccccgccugccucccccgcucccccccaaaaagauuccuuuuugcuauuuauugcccuguuuuugaugacuaugguggugguuggguuauuuugguauuuacuauuaauacaguuuauaaaaguaaacaaauuuucaagcuugcuuuuauuuuugucauauaaguaauuuaaaucuuaucaaauucagaucacagaguuaacuucauguauaacuuuucuugcuuuguaauaucuagauuggaggcugaaauaaggauuuguucucuguuaaaagcagaaagaccuugguaggagcacagggaaaacucagcuugauaaagauaccaauuuauuuucauuuaucacauugucugcucugacuuguucccuuaaaauauuuauaaccuuuguuacagugugaucagucuaaucuaaaguuuauucaguugagguugaucuauguugaggaguguguguacauauauacauacauguauaugcauaugacauuugaauaugcuuuuuugccugucugguuucaaugaaagugugcuauauuuaacaccaauagacuauuauuagcaucagaaaccuggagcauugcuaaguuuccaguauugauuagauaacagcucaguucugccagguuggacauaugguaaagauaaaugacaaguauuuuaagguuaacccucccccgcuuaaaaaaaaaaggugcaggaaaaaaaguaggggaaaacaguagacagugcacccuaguuauugauucuuggaaagcuaaaaucuaucguguagcaccugaacauuauaacacuuuagaaaauuaagacauuugaaggauguaagaauguaucagcaaggcuuuggcuggggugcaguggcucacgccuguagucccaacacuuuaggagcccaaagcaggcagaucacaaggucaggaaaucgagaccguccuggcuaacacgaugaaacacaaaaaaauuagacgagcucacaccuguagucccaacacuuugggagccgaggugggcagaucacaaggucaggagaucgagaccauccuggcuaacauggugaaaccccaucucuacuaaaaauacaaaaaaauuggcacacaccuguagucccagcuacucgggaggcugaggcaggagaacugcuugaacccaaggggcggggguugcagugagcugagauugugccaccacacuccagccugggcgaaagagcgagacuccaucucaaaaaaaaaaaaaagagagaaaagaauguauuagcaaggcuuucaaacaguuacccuaaaaacuaaauacaggcacaacauaacuguguagacauaauuauguaucacauguagguacuuauagauauauuuaugcagaguauuuuuaguuaacauaucugacugugacaacaaaauagucauuuaguuugaaaaucaugugcccaaauauguguuuugcugugguuacccuggagacuuuggaguucugccaugugauuuccuuaaaucccuggaauuuuugauugcugagaauucaggaggaguugcccacuuguuagugugcagggaaauguguuuuucucauuucuaguugaggucauucuuuuuuuuuuuuuuuuuuuaaaccauagcauguguuccauuaguuaugaauguauuauuucuuuagagucaaaauucacaacucauuucuuugaauauuaucucugauccuagaugggaucaaaauugcccuagauuuaggaguuuuaaaaguuuacuagguuguggggaagauggguuuauuuuucauaaacuugaacuagaauguugacgauuauaaggacugggacacuuccuaaaggucaaaauauuuuaaggcgaaaguauguauucuuuccuuuugccuaaugauugaaagaaaaagugguaauaugcgcuugcuuucuauuaugagcuuuaauuuguaauuugaugaagauuuuuguuaacuugcuauagguagucagguaaggaaacaguggugccagaauuugucccugauucaguauaguucugugcaggucuugaguagaugaauuuaaaugcuacuuuauuaguaagaguuagauggucagccuuguacugagaaccuccaaccuucuucccagcuuuauuuuucuacacgcuucccaucaucugacuuacguguuuuacuuguuuacuagaauguaagcuacauacaagcagaguuuuuaaaauuuuuauucuguucauugcuuuauucugaguggcuauuaucguuuaccuuuuuuccuuguuuucuaugcaaagucucuuaucagccacuacuugcucauuuccauacagggcuauaguucaacccuuugcugauaccauuuuucuuauagaaaaaguucuuccaaaacuuaucaauacuguauucaucauuaaugccucuuuggaauucucucauucuccugacuauugcugaacauagucucuucuuuuaaaugcugaggaagcacucauuugacacuuugcugagauguuuaccuaaacuacauuuuaaacuuuuuaauuacuacuguuuuuacuguggaaaggggugugaaaguguuacagcccuuuacuauugggaaaucuaaucagauaaauuucgugaggcuaggauggaaaggaaaaacuuuacaaguuaagcaaagggacuguuaauuaacuguuuaauaacucuaacgacaguuaugaccagagcaacauaauagauaaaagacaaucuccacuaagagccuucauuggguaauaguaugacuuguaguuuuuuuaaaaaaugcuaauaaucucagguuguauuacagucucaugguuauacagauggaugggaauaucucuauuugccuaggaucaagaggcuaggugaccucuuacucaaugggucguucuuuguuauauguauuaguauauaguaaaaggaaauacuuccuuuaccauaaauguuauuuuauuacguggccauguaauuauggucucagcuccuaggaucagaggauuuaaacuuagaagacauuuuucggcugggcacagugacucaacaccugcaaucccagcacuuugggaggcugaggugggcggaucaggaggucaggagaucgagaccauccuggcugacacagugaagccccaucucuacuaaaaauauaaaaaauuagcuggcaugguggcgggugccuguagucccagcuacucaggaggcugaggcaagaggauugcuugaaccugggaggcggagguugcagugagccgagaucgagccauugcacuccagccugggcaacaagagcgaaacuccgucucaaaaaaaaaaaaaaaaaaaaaaaaauuaagaaggcuauccucuacccuaaaaaggauugguaggcugcuugaaugaaaugauaauaaaacaccaguuguuuaaauggggcuccuauacacacuuuguuuuaaaaagaaauaucgaguuguggagggaagaggaugaaaaacauuuugaguaugucuuuguaacuaaaauuuacuuggauucacuaauggcuuuguuccuuuauuguaauggaguaauauuuucuaaaacaaaaaguuguaaugguguucuauaccuuaaaugucaaaaaagauuaaguagucucaauguguuguaaauaaaaaugaaagaaauggucaaucugugcauuagauuguguuuaaucaaaugguaggguaaaacuacgcauaccagaugacagcauagcuuuaaaaauguggcuuggaauaaagucuuucaaaaaugguuguguauacccugucuacaaaggagguaugauacauuuguauuuaucuuuauucuagauaaaaugaugguuuacagggggagaaaaugaagaaaaaauugugaaugucuuuuuuuuuuuuuuuugguaagacagucuugcucugucacccaggcugcagugcaguggcgcgaucucggcuuacuacaaccuccgccucccggguucaagcaauucuccugccucagccucccaaauaucccaaguagcugggauuacaggcaccugccaccacgcccagcuaauuuuuuguauuuuuaguagagaccggguuucaccguguuggccaagcugaucucgaacuccugaucucaggugauccacccgccucggccuccccaagugcugggauuacaggcaugagccaccgcgcccggcugugaaugucugcucuuaauacuuugacucauuacugucauugaguguauucauuuguuuauuuuauuuuauuguuauugaaacuaguuuuuuguuuuuauaugccauuuucuucaagaugaaaauuacggauaacuuacagguagacuuuuuuuuuuuuuuuuuuuuuuuugagauggagugucacucugacaccgaggcuggagugcaguggcaccauguuggcucacugcaacuucugucuccuggguucaagcaauucuccugccucagccucccgaguaucugggauuacaggugcccacugccacacccggcuaguuuuuauguuuuuaguagagaugagguuucaccauguugaccaggcuggucuugaacuccugaccucaggcgauccacccgcuuuggccuccuaaagugcugggauuacaggcgugagccaucgcgccgggcccagguaaacuuuuguuguuguuguuuguuacauuugaugucuuucuuauuuugaguuuaaaagaccacaguuugcaaaauauaacucagugaauuaaucaguuauuauuugauaauuugauuauuugauaauaaccagaguuauuugauaauuuuuaaguuuucuuauaauuuagaaauacagggugaauaggcaaaauguaaacaaaaaugguaauuucauauaaaaaaguaucugguguuuaaaaaacuuuguaugcaucucaaaaucaugauuaaaguauaguuuuggcuuauuaaaguguuauauaugucuucugauauuaaaauuuguuuuaauuauccaaguaauccugaauccauucucaugggaagaaagauacuuaagucaauauuaaaauacugaaauaugugaagaguuaaaggugaaagucauucuguacaguucuacaaaauucuguuucucuguucagagcuacugcuuauaguuuaguguuuaaucuugcacaccuuuugcaugcauaaaccuuuacaacaauuuguuuuacuuuuuuaaaaaaauaaauggggcucuauuuuacaaugugucaauauauuaauuuuuuuucaugguuacaauuuuguaaugguucucuuaaugauggauaauuguuuucagggguuuuuuugcuaugauuuaaaaaauuuuacagugaauacuguugagcuacaucucuggauauuacuaucgauuauauggucagugcacuuguggcuuuaugaauauuuuaaauaauguagucaagucuguugaucuuuuuccuugucaucuguguuuuguggauuuugguauuuccaaacuauauucauuucuacagaguuauuuucauuuccauuuuuugaacugucacuuguaaaacacuuucuuuuuauagaaccuuaugagugauagcaagauguauuaguauguaauacauugugauggaguguaaugaucacaaggaucagugacaguuuugaugaccaauuucagaguuauaaaauaaaugaaauauauucuggaaaagucaugggcuuuuuguguuguuuguggaaucacuaaagguagucccucacuauuaacaaauuuguuuugacacauaauaugugaggcacugaauuauaauaggcacuagaaacauugccuauuuuccugaauccuuuagacaggauugcuuccccaguuaccagagauuucucuaaccuugauuuacaguagcuacugcugguaggaauugcucuccacuccacuuuugcugccauccaguguuacauuacccuacaaauauacuaagugcuuagcaaagcagaguccaaauguaagaucaauuuuugucuuacccagaauuuuacaauuaaaauauauaaauaaaagauuucucuguguguggauguauguguacaguauaguguugcaugcuauacauggggugagguaucagaaugcuuuuucaguguuuggcaccucuaauuuggcucuguggccauuuauuccaccuuucuaccuugaaauuccacaacuugggcucuugaaauuaccugguauggugcaaugcacguguauucucagcuacuccagaggcugaggcgggaggaucacuugagcccaggaguuugagguugagauugagaugaacugugagaacaugcuacugcacuccagucugggcaacagagcaagaccucaucucuaaaaaauuuugggcuugaaacgggcugauuuuguccuaccacuaguaaucacuuuuagaaguagcuuacaauugcuguuucuuccuucuuauggggggaaauacccuuauaggagguauuaugaagccaauaucuaauaaacucugucaucauuagcucacuuccacucuucugccaucucucuguaccugauuaguauaguuuugaaaaauuauaauuuugcuaccacugcaccucuccuuguuaguaggggagauuuauguaagagaagaaucuuuuauuucuagacaagguaauaucccauugggaagaaacagccaagggagaagaaauguuuuuuucuucuuugaagggacuagaacuuuuauagcucagcaaauuugaauaaguuugaugguaauucagcuacauuauauuuuagcuagauuucugaguucauuugguaaccuaaccaccacauauauaccuauuuauaacuugaaauuugccuuuaaagucacgaaagcacaaagcacuguggugcuuguaacacucuuccauauuauuauagguaacuaaaugaccauggaaucuggagccgagaaccagcagaguggagaugcagcuguaacagaagcugaaaaccaacaaaugacaguucaagcccagccacagauugccacauuagcccagguauaaaauacauggagagauuccaguuugugucucuuccuagaggaauacguuuccaagagaauuuaguuguuauuacauagauauacauagaaugagcagagauacucuuacaauaucaaaauuccuauuuacuuaguauuagaguauauuuagaaaugauaguauuaauucaauaacaguaaaauguauuauuaaacaauaauacaguauuuuuagugaaaugauccagaaauaauuacauuuuaaacuuauggguaaauggugcucucagauaagggaagaaaaccuuggcuauguaugacaacugcuuuuuuuauuuuuuuaauaugacacagauuuauuuuuuaacagugggaaugcagauaauaugaaagccuaaguuuauauaacuaaacuaaaaauuaggauaagcaaauaaauugacauguaaggaaauuuuaaggaugauagcaguuuuuguuuccuguauauuuuaaauauaauuucugauucuuucauuucaucuuucucuuuaacauccuaucuuuaagaauauuuucucucauucuuauguuuuuguuugcaugcauucuccucaacuauuuuauuaacagcuguuuacauagauaggaaugagaaaggugguuaacuuaaaaaacaaauagcagauacagaccugcuagguaauagugugauaccgucucuuucagaugaagguucccaggagaauauaauccuagcagaagcucugauauauguagcuucaguuucuccaagaguuuaaaaguuccuagagaagucaccuagcaagaaugaaucaugggaaauagaggacucaccacacuugggugucuggcugagguagugugagccagauacuggauuuccagcaagaauauagucagaaggagugagcuguucuguguuuucuccuaagaccaccaggguuuaccuccagccuucaggaauaagacaaagccaaauacaucuaauguacucauacgaggcaggcugcaggauugaaggggagagagccaggacuuccaucaauauagggucaacagauaagaaucugggcucaucuguauauuuugcccuuuagaaagaggaagacacaaugcuaggccgggcgcuguggcucacgccuauaauccaaacacuuuaggaggcugaggcgagcgaaucacuugaggucaggaguucaagacgagccuggccaacauggugaaaccccaucucuacuaaaaauacaaaaauuaaccaggcgugguagcacacaccuguaaauccagcgaccuuagaaggcugagggaggagaauugcuuaaguccgggaggcagagguugcagugaacugagauugcgccacugcauuccagccggggugacagaacaagauucccucucaaaaaaaaaaagaagaugcaaugccagcaggcuucuuuaugaugauagcccuuaacacaucuuaucucuggagucacacuauuuuguccagucugguuguccccagaguaggcuguauugugucauccugggaauuccuuucucccuacuuccauuuucucacaguuuguguuuuugauaugguaaagcauguuuuucagugguuuuaugagaaagaaagguuggcugaguaaagauagcauguuauaaaaauugaauguaugggccgggugugauggcucacaccuauaauccccacacuuugggaggccgaggcaggcggaucacgagguuaggagauugagaccauccuggcuaacacagugaagcccgucucuacuaaaaauacaaaaaaauuagcugggugugguuaugggcuccuguagucccagcuacucgggaggcugaggcaggagaaugucaugaacccgagaccgcaccacugcacuccagccugggugacagagcgagacuccaucucaaaaaguaaauaaauacaaauaaaaauugaauguacaugugccuuaacaucuagaagauguacaacaaaaauauuaaaagugauuagcuaugggugauaggaauauaaaggguuuuuauuuuauuuuuuauaucuguauuuuauaaauuuauaaugagaggagccauuauauaaaauuauuaguguagaaaagggauuauucauugaguuagcuagguauauuuucccuagagaagacucaggaaagagaacauaguaauugcuucaaauauuacaagagcauuuauauggaauugagaugagauacucugaauaagguuaugguucucaaacuucaguguacgggaaaguaugauuggguuccuguuagaguugacuuuacagaguauccugugugacucuaaugaagcuauuccauggaccacauuuugagaaucaaauaaaacuaagcaagauuuauaguggccagagagaaagugauuaauaaguaaggacuuuauuacuauccagagauggaagcuucugguuuuacccuauaugccaaagacacugucuuuauagggaucuuccccccaggcuucacagucacauauuucgcugccugcuaaaauaaacaucucuacaaauucagaugucagaguaguuucaucaucuuccauuacaaccccagucacccaaaagccuauccuuacuucuugcauucucuuuuucaauuaaggacagucugccaauucucuuucagacaugaaacauugggucaucugcaguuccucucucaccucuuuuaacuauucauaaagcccuuucuggacugcuuccaaauuuucauaaaaucacuucccucguucccaucucuacuacuacuaacugcccucuuuuuggccuucaucaucuuuccuuaacuacuucaugggcuuucuucguuggucuccccaccaccaguuuucccccugaaauauauaucuuucacacugccacuaaagugauuuuuuuuuuuuuuuuuugagauggaguuuuguucuuauugcccaggcuggagugcaauggcgcgaucucggcucacugcaaccucugcccccuggguuuaagcaguucugcuucagccucccaaguagcugggauuacaggcaccugccaccauaccuggcuaauuuuuuguauuuuuaguagagaugggguuucaccauguuggccaggcuggucucgaacucuagaccucagaugauccacccgccucggccucccaaagugcugggauuacaggcgugagccacauugcccggccuaaagugaucuaucuaaaagcaaacaucaccaugguauucaggaguucaaaagcccuucaguggcuucugcaauacccucaggauaaaaugcaguuucucugaggugacauaauacaggcuuuuugugacuagcacaucuagccccaccugccucuguuguuuucucucucccuacuucauacaucauacaguaacacacuuaugugcaccauuggugcugagcugcugguuaucccacucugccaugugugcuguuucucuuugcuuuugccacuacuccacucugugcuugaaauucugugacucuucccuguaaguaauaauaacaagucuaacuuuuuucuuuuguuuuaaauucacauucuucccugauagccuccccuucucuuagguuggguagaguaauucucaguguguccauuuuucuuuuagcaaaccucauuacuaaacugaauuguauugugucucuuuuccccauuccuucgcauacauacccccaauaauuuauuugaggucagagaccccuaucuuucucacuuuuguaguuucaguucuaacauuauuccuggaacauagguccccaauaacuguuuccugauuuagcaaauaaaauuccuauccuugaauguguucaagcauaggagcaauaaauaacaucugauagacauguaugauuuaaggacccuuuuaaccuggguauugacucauuaaaacugccuuaguucuagacuuaguaggucagguuugcuuaugcuugagagcaguuagauuuuagaacgugacuuauuuaacaugauauucuuuagaauuuuauguuucuucaaggauaguauaucuguugaccuugggugaacacuuaaucucauugagcaguuauuuguguuuuuaaaaauggagauccuuaucacccagucuucaguuucuucaaauagcaaaaucagaaauuggaaaugaaagcaggugggaaaauguaaagugccauacaaauaaagugauaucucauguucagagagucuguauuacauauuugguauaacaugggaauaguuuuuaauuuuuugucacuugggaagagcugaaaaggauagggguauaguuuuugguguuuuuuauaguguuuuuucuuaaagaauauuaaauuuagucauuacuuucauaucagugaaauacauaucuagcaaaaaggucacguuuuugcuucuaaaaaguuauuucauauugaacaugaguacugccaaagagugucugggaugauaauucuuuucuguguucaacaccauagguaucuaugccagcagcucaugcaacaucaucugcucccaccguaacucuaguacagcugcccaaugggcagacaguucaaguccauggagucauucaggcggcccagccaucaguuauucagucuccacaaguccaaacaguucagguauguguauaaaaaguucugcaucuauuuuaauaacuuuuguuuauagccauaucucucuccuuucacuaguuaugaaaauaaggacacaucuaguucaguuuauuuuauucacaguauaggaauaugcugcaucuguauagucaccuuauguauaggaacauauauacagaagaacaaacauaaaagaaaaugacuaauuucuuaagcugcagaggaaaaagaauugauuggggaaaauaaugaaguacaugagauaaaguggaaguguuugggagaaacuguaggacugaaguaccucagucgaggaaaauugagaugcaaaaauaguaacuaauuuucuaaaucugcaauuggagaaaaauauacccuugaucaaaaauuaauaaccuuaccuaagauauuauuugaccuuagagauuacauaaagcauuuguaaaaucagcugugcuuaggguuuucaguuacaguguguaacuuugaaauaauauauucagagguuacaucuuaagggucaggaauuauacuaugcauguuaucuaauucuuuggagagaucuuuccuuuggguuugauccacagguaauaaaggcacuguagaccuuugaaggugacuacucuguuuaacuguagggaaccgagagcaguauagaucauugcaauugagcuuauugaaaaaaaagacuugaacguucauucaaguaggccauaaccccagccucccauuucauauuuuuugcuucacagucuuccuguaaggacuuaaaaagacuuuucuccggaacacaggugaguccuagguccuagauuuggagagaacuauuauuagaaaggaaggugagaaauuauucuuuaugucuuuguccuuuuccucuauaaacauggaauuucaacacuugaacaaaaaccucagagaucuucugggucuaggccauacuuguuaccuccccagcccuuagucuguugcuuaauucuguuuaacauuucuccccucuuccuaaugguaguccagcauuuacuugaacacuuucagagaaaggaagcucaaucuccugagguaaccuguuuacaauuaggagugauugcuaaaauauucuucucugugaugauccaaaauauaucuuccuaaaacuuuuaccuagugaucccggguaaacacagguucuauucucggaaacuagauuagcaagucuaauuccuguucuauuggacugcuuccucuuccccaucccccgcacccuuccuauuuuuaagaaaauuuccagacuaaacaaacuauuuuucuuuagccauuuauuagaugguauaacucuguuuccucuucaccauccugguuguuuucuucugggugagcgcuguuauguuuucuuuacauauaguaaccagaacugauuaauauuuguagaggggagaagugcugucuuuguccuggaagcauucuauuaauguccucaguagaauuugucagccauuuuauacuauugagucaucgaacuucuauuaaccaccucuacuucauucugucuuugugcuuuugguucacuuugacacuuaagugggagcgugggggaggagaaguaauguuuuugugugaaaucaucaguuggaucaauuuccauaagacacugggaauggcauuuguuaacaaguaaaagauaguguugugcauguaaagaucuaagaacuugauauuucuaugaaaucacaaugacugagcaauaguccuuugccuuaguuuuuauuccauugagugcuaccuuaccauuguccauacugugccauuacuaauucccuaaccauaugcuccucuuaguaauagugagaaaacuugauuugcuagugaggagaccuagauuccagacccaguuuggacauuaauaagucaaauggccuugggcacaucuaccuuucucuuuuucacuuauagaagaucuuucuauaaagaacacaaaaauuacuuaaguuacagccacaaaauuugcuaagauuacuguuuuuuauuguaauauguguuauuguugauuguauucuugauuuuaaucuuuauucuggggcaacauaauuuggacaugaagauuuuauggccauuaaguauagaaauauucucuuuuuuuuauuugcuuguauucaucuuuaaggaacacauuuguccauuaagguccauuaaggugagcuguacuucuaauuuaagaguguguauuuauaaaagaaaaguuggacuuauugaacccuggauucuacaaauagagauacaaauauaauauuuuuuucuuuaaaaggccuaaacuauagaauaucuauuuuaauaguuaucuuagccaguuaauggugauuaguguuaacaacuaggaaauaguuuuuaucaaaagagaugaucaaacaaggagaggaucuucuagaugggagaccucauuaauauuccagaauaaaguuuccaaaauauacaagguacaguucucuuguugugagaauagauuauuacuuuaaauuaucauucauuccuacaacaaauguuuauuggugacaugcuaugucacuguucugcuugcuauaaaagacagcaaugagcaaauaauacuucucuguucucaagaagaucacauuuuaaugaaaagagacagacuaugaaaaaauaaauugugucagguuaggagaauuaacgagagagaugaauaaagccaggggaaagggauggagaaugauguggagggaaggguguucuacuuuauguaaugugcucagggaacacagcacagaccagaaggcaaugaaggaggcuaaggcaugcagaucgaaagguuuggaagugaggguauacuugggauaucaaggaauaacagaaagguauggcuggaauagaguaagugaggagggaagugauuggagaugcaauuuacaacguaaguuugucuccuuuaaaaugucaaaucuacguauuuuaaaacccuaggaauagaacuuuguaaauuguucaggagucuuccggaguuucagcagguauugaacuuauuucuuaaaaauacaaaauuguaaccccuuccuauuaacauggaauaaacugacuuagagccagggagaugaaaauaauaaacuagauaaaucucauugaaagcuugcauaauugguagaugcaaaugaaaaugauuauuuaguaagcauaccucaaaugcaccuaguuuuguuaucuacaugaaguuuucuuuuucaaugccagcaguuguuaaaucacauuucagaaaacccaagcuuagaaucugacuucuaaaugacuguuauaaaguguuaaaugaggucagacuccguggcucauuccuguaaucccagcacuuugggaggcugaggcgggcggaucacuugagcucaggaguucgagaucagccuggccaacauggcaaaacgccaucucuacuaaaaaugcaaaaauuagccaggcguggugguaggcaccuauagucccagcuacucgggaggcuaaggcacgagaaucacuugaacccuggagacggagguugcggugaaccaaaaucaugcugcuguacuccagccugagugacagagugagacucugucucaaaaaauaaaaguguuaaaugauuuuuaaugaagcauauuaugucauucucacuauccugaaaaauaauauuauuuaucuuuaagaaauauauaaauuuuuaauauuuaugcuuaucauaucucuuuaagaacucuuguuuuauaauacgaauacuuaaaauuuagaaauaagaaaaauguaugccuguguaaaauuuuucuuauuuauaagagauacaugcagaucaaaagaguuggaagaucauugaucuagacuuucaguaagcuucuugauccaaugaguaaaacacuguaucuaaggccaggugcaguggccuauaaucccagcccaggcaggaggauugcuuaaagccaggaguucaagaccagccugggcaacauagcaagacccugucucuacaaaaaaauuaaaaauuagcugggagugguagugcaugccugcaaucccagcuaacucaggagguugagucuggaggaucccuugagcccaugaguuugaggcugcagugggcugugaucgcaccacugcacuccagccucggugagugagugagauccugucucuuaaaaaaaaaaaaucuuaaaaaaaaaauauauauccaaaccaugagucucaacucuaccgagggauaguacuuaaguuuccaaaggaccauauauagguuuaggaaacaucgaauauuaccauuguuuugauugguucuaguuacuuuauaguuuauuuuaaaauuucaaauaaucgaaacgggguccuccaccuuuccaauauaaacagguaguauggguuuuaaauaaaccaaaguugagaaauacagaccuaaaacuuuauaucuacaagugguaguuuagcuuuuugaaaauuucuugacuuacaaguggccaaaauuaaagaccuauuuaaggaauucagaaagaaguuaauaagugauaggagaugagaauaaaaggaagggguuccaucauuggaaugugaugaugauacgugauguuuauaauugggauauaauuuuucauaugauguuuuuauucuguuauuuauaaaaauagauuuuugacaugauuuuuauugaucucaguuauguggguccaguauguuuuuuuuuuuuuaacaucaguuuuagguucacagcaaaauugagaggaagcuacagagauuaccuguauacucccuccccaacuccauggauagcuuccccuguucuuaacauccucccccagaacgguacauuuauguuauaauuugaugacccuacauuaacacaucauaauuacccagaguccauaguuuacauuaaacuucauucuuggcuugguauauucuguggcaguauuuuuauuauugauuaagugauagaucagggacuccauaggaauuagcuucauggcuuacuucucuucagaugguauucccaaagaggaaguguuguguuuauuucaguggucugaauucucuuuacauuuacaaaguugcaagcacuaaauagugauaaguuaauuccuucugugugaauugacaaaaucuuacaggucagagaaaggcaaccuuuuuuuuuuuuuucauuaagggccauagauccagaguuagaaaaaaaaaggacacagauuaaaaaacaacauuaauuuguuucauuucaaaacuauccuguggguaguuuauauggcauguuuuaauguuguuguuuuagugaguuccaacuuggaagggggguguucccuaaucacuauauguccuuaagagaagcauguaaggauggggcauaugagagucaagcaguggacacagaaagagccacagaggagcuaagugaauucugaguggcguauuaaugaagggaaacaacacuugucacaguacuaucaacuuugaguucagucuuguuauuccuugaauuucugauccuuuccucaggccuuuucauagcuccugaucuucuguaugugagaaaguuugugcagagacucuugugugugggcuaguuacagcagcuacugauuaacgugaaacuuuucugugugcuucuuuggcaguaauuacagcauuauuauucugcugagaaucacagacuaaauucagcauuacucaucuuuuuaucugucauuugugaauucauuauauguugccuauugauuuuuaggucuuucagauuguacuuagacuuuaaaguguuuggauggggcaaauuacuucauuauaaauauauuuuacuacaaguuacuaacuuuaccugguuucauuuuaaaugagcaugcauaucacaaagcccuguaaaaugaaugcccacuugggagaacuguuaggcucagaccacacauagaguacgcuuggaauuucucaaguacuucugaauauguuuucuuacugccauugccauacguuuugacguggagcugaccuacauagacccuuuugucuugguuaaguauaauucuuacucugaccgcauaaugugccccuaguucaggaaagagcauaacguuucugcugauuagagaaacuugggcaguguaaauuugacaaucaagcauacuuagguaagugaacucuucuagucuagaaaaggugugaaaaugccacugguugcugcuucugacaaaccugguuugagacuauaacagucugguuugagacuggaaccaccaggauuuugaugcugguaaggaugucuaaaauggagguuaaugacaguggcuccacuacuuccuagcuuugugacucgggugaguuacuucuuugugccuuaguucuuccaucuauggaauggauauaauaguauaguacccaucuggcgccuacauuacugugaguauuaaguaauguaguauauguaaaugcauuagcauaacaccuggcacauaggcaucuguaaauucuaguuucuaucauuaauaucccauguaaauuuuuuauucacuuaucuucauuacuuuucagucuagguauucuuaucagaaaagcauaguucuuuaccuugaauuuuuacuuaaaagugauuauagaaugcuaacuuugaaacauguuaggaguuuuuccuaacuugcuaggaacaacugucagggaugucaugauggaucgccagucuuacuguacaacuguaaauauauucauaaguguuuauacaguuaaauaauaauauuuguauagucacuauauagacuuaggaccaaauauuuagccauccauuuuauccuuuauaucagaaaccuuauuuuaguugguaguuuuguuccaacagauguaagaaaaaacugauaaguaauacugaugcauucaggauugauuacauggaguccugaaaaaaaaauuaaacugcagcuauuuuagguucucuaacuucaucguaguuuauaggguaaguaaagggaaggggaaagugauuggugugguugucucccauaagaacugauuuuuuucuacugaagcauguauaaaguuuauauaugacuuuuuauauuuguuuaauaaaaauuuuacaggaacuaaauuugauuaucaauaugaaguuuuucuuuaauuucagauuucaacuauugcagaaagugaagauucacaggagucaguggauaguguaacugauucccaaaagcgaagggaaauucuuucaaggaggccuuccuacagguauggaauuuaauaguuagaaucaaagauguggaggaagucuuagguaguugcagauaaagagaugucagaagaccaguuaguuguucacgucaguuccuuauagauuacuuuucuucaucuugaguuauuugucucaaauaaaguggaagcuuauccuacagaauaagaagagcacuuguuacucucaccaguccuaauuuuuuuuuuuucuguuucuguuucuguagacugugcuggcugucuuucuguuaaaaguuuggaauacaguugauaagguuauagcauuuuuuaguuauaagccaacucugaggcucuguuauuuaucuacuuaguaacacauugcaaaccauuuuuuaugccaugguacuuaacagauagcuauuaauuuaauaauugucucagggagaugcuuuacuaacauccccuaauuuuagcaguagcuuacuguaauuuuuguguucaguuauagauguugccuaguccaugccuugccuccaaggugaaccaaaaccauuuuuuaauguaaaaauuagcuccacauuaaauaucuucaggaagggcaguuccauaaaucuugauaaguuuacuucagcauugaagaaacuucagacucauaauuaucuuccuuguuaguguaaauuauuuuuuauauauuccuauuuuucaaagggaugguuuuuuccccccgcuuggcuauuaaacuaacccuuuucucuguccuuacaauuaaauuaagaauccuaagugacuagcaauaaauagauuuugaggucuaagaaauuuuauauuaccaguuuauguuauauguauuuauauucauaauuuauuuuaaguauagcuaguguuagauuuuaacuuugaaguauaucuccuguuaguauauaacacauuugauccugaagcaaauccaaccaaauacuacuaguaaaguaauuacacagguaaauauaaaagccaggauuauuauaguuuugguuuguaacuccuuuuuuuccuaugugauuggaaagacaaaggcauagaacaauaacuauaaauuuaugugacuaagcacaugauauaugaagaugucauuuuugacaauagcauaaagggacagaguuuauaacuaguuuguuacaaauuuaagauaucaaaaauuacuuggguuaggguuuuuagggguuuuuucccaccuuucagugugauuauguuauucauuugaaauaugguaugguuccuuuguuuuuggguuccauuuuagaguuucuccacccauccuuguugaucuuuauuuuuuuuucuaguaagugaaacauuuaacacuguaccaaaagucagaauugcacaaaaaaaguauacucaguagugccuccccauuccuucugucguuuucauuucuuuccuacccauccccaguaaauagcuaaaaccauuacucucucguuuauccauccugauuuuuuuccuugaacaaaugagcagauacaugucuguuuucauauuucccuuuuuuccuuacacaaaagauaugcuguauccauuauuuggauguaccauaguugauucaaccacuugccuuuauaugggcauauagauuguuuccaguauuuuuuuuccuuuuuauuuguuuuucuauuuuagaccuuggauauauggcuccaguauuuugcaguuacaaacagugccaaugggaauaaucuuaagcgaguuuauuuuaauauuguuggaauuggggugaauuccuggaaaugggauugaggcacgaacacccauauuuccuuaaauaucaacaauuccuuauaucgggauugugccaguuuuauacucccagcagcaauguaugagagugugguguuuuuuguuuuuguuuuuguuuuuuuuguagcuuugcuaacagauuuuguuaacacuuuuuuguuucccaaucugagaagugagaauuuaaaaaucagguuuugaucuuuuuucccuuuaguugauuguugacuuuuuacuuuccgacuuuguguauguguucuuugagaugcaaaagauuuuuuuuaauguagucagucuuauuauuacccuuaauugcacccuuccuuacauugagguuaaagauaauacaucuuuuuuuuuguuuuuguacauauuuggguuccuuuugacaucuagaucaaucccugacccaugaagaguuuauucauguaauuuauauauuuuaaacuucugcuggcugggugcaguggcucacaccuguaaucccagcacuucgggaggccaaggcggguggaucacaugaggucaggaguucgagaccauccuggccaacauggugaaaccccaucuacuaaaaauaccaaaaaaauuagccaggcgugguggcaggcgcccguagucccaccuacucuggaggcuguugcagaauugcuugaacccgggaggcggagguugcagugaaccaagaucgcgccacugcacuccagccuggcgacagagcaagacuccaucucaaaaaaaaaaaaaaaaaaaaaaccuucuguccuaagcacuagcagcuuucugugaguuuucucaucuuuaacuauauuuguauuuagccaguaaauuguacuuauauuuuuaauuauucuaguuuucuaauuuuguaggaaaauuuugaaugacuuaucuucugaugcaccaggagugccaaggauugaagaagagaagucugaagaggagacuucagcaccugccaucaccacuguaacggugccaacuccaauuuaccaaacuagcaguggacaguauagugaguaauagacaauuucuguuucuauugugaggagaaaaaagugaggagaaaaagcuaauaguugcauucucuucagagaaaccaauacaagugccaagucuucucaguuuugcugccauuauuauauuuccuuuacucuucacuaugcaaaggucuguaaugguaguauuuucuuuucuucagagaguuuuaguuaggauuagucaaguguauaaaccuuuuagauguccuuuuguuuuugugcagaugcauggaaagucugaaguuuuugaaccacuaauugagacccuagguuugaggccucauguguugagagaacauaaguuuuuuagauuaaaaaaaaucauuccuugaauauaucucgguauucauuuuaauaguuugucuugccuucugaaaguagcauuuuaaugucuucguauuuaauaauguuucaaguggggauaagcauggcuugguugagucagcacauucaauuauuccuuuucauaugaaagauaguaauauacuuuuuggcccacauaaagcaaaaauugcucuuacaaaauuauuuaaaaguuuucauuucuaugaugucucugucuggcacuuaggucugucuucuuaucuuucaccaaaaucuguuauaagacacuuuugaauuuuauuuuguuugaucaaaagcauuugugugaaugguacuuuuuucucuuuuucccuuuuuuuuuuuugccucucaaagugcuuuauucauucagugauuuuuuucauuuguauuuguuuauuaaaccuggugcugcccauuuauacccuuuuccccacccaccuuaguuucaaauuaaauguacacauugaaacuucuuuacugagauaguuuccuaaucccugagggaaucuguaucagaaauaugcauaaaaguuugaggccaggcacaguggcucaugccuguauucccagcacuuugggaagccaaaguggaaggaucacuugagccauccaggaguuuaagaccccaucccuauuuauaaaaauaauuuaaaaauuaagaaauaugcaugaaaguuugacccccauguuauuuuuuaguuccaguucaacuuuguuuugcguaacucuaauuugcauucccaucuguauuaaagacaaguucucaaguagcaaacuuuuuaacucugccaaggcugaaacuuuugagacuaaguagaaggaaggcauuuuugacuaagguuuuuauccacugugcucaauuagcuuagucaucuuuuuucuucuuaagaucuuuguggcagauauaaaguacaacucuuuaccuacaauucuguacguguauguguauuaucaguugaagccucauaccagaugcuuuuaguuauucaagauauguguucgaagacauugauacaugauguuuauuuuucuucuacuucagcauaccugagggauacaacauacuccugucaguaacagauucacuguuacagagauucucacuugaacuaggaagcaugcucuuuaggaaagaggccuaucagaaucuaaaaaggggaaaugaagguuagaaaaguaccagcacccccauagauguuuaauuugguacacucgucuccuccagcagcugaaaauugcuaguuuuaagagauugagccaggcgccguggcucucgccuguaaucccagcacgcugggaggccaaggugguggaucaugaggucaggaguucaagaccagccugcccaacauggugaaacccugccuccacuaaaaauacaaaaauuagccgggcauaguggcggacgccuguaaucccagcuacucgggaggcugagacaggagaauugcuugaacccaggaggcggagcuggcagugagcugagaucacaccacugcacuccagccuggguggcagagcaagauuccgucucaaaaaaaaaaaaaaaaaagagagauuaauacuuugaaauuuuuaaagcuuuguucauuauuuuuauccuguguccucucuguauauguacacauggcuuuggcuuugauggaacugauuuaacauuauauucuugauuuucauuaagagcaauauaauaaauacauauacagcaacauuuauauuucuuaacuuauaaaaugaacauaugguugucagaauucaccauagauauauaaacacacauaguuauauauuuuguuuaauagcugcauuguguuucacuguguaaauacagcacuuauuuaaacauucuccugcugaugaacauuuaggacauuucuauuguuucaaacagugcuacauaaauauccuaagaguggaauuaucgaccauccuggcuaacacggugaaaacccgucucuacuaaaaauacaaaaaauuagccgagcgagguggcgggcaccuguagucccagcuacucgggaggcugaggcaggagaauggugugaacccagagggcggagccugcagugagccgagauagcgccacugcauuccagccugggcaacagcgagacuccaucucaaaaaaaaaaaaaagaguggaauuaucaaauuaaagcauauccuccgcaaguacccuuccagguggaggcaugaauuuccacuccuuccuuaaauugguuauuuuauuaaauucaugcuguuacuagauuuaucuguuacuuauuaguucagugucccagauaguaaaaucuuauuagugauucugcucuuagauagaaaauguguaucugucauuuugaacuugaauuuuuuuguuucaguaaauaaaacuaugacucaugauguuucccucuuuauucuggcaacucagauucuuagcuaacuuucuguuuaauuguauucuuuucuuagucuagauuuucuucuacaauuguuuuauauaacuaaggauacauccguuacuugacuucugucuuuuuauuuuuguuuuaaugaauuguguuuuauugaaagcuaucucaaaucuuuuuggaauaauaaaguguauacauaaacauuauagagaaaaacuguguucaguaggauuagacuucaguuuccaaaguauuuucauauacaugaccucauuugauauuuacaacaauuguacuuaguggcuagaacccagaugcuuuuguuuuuagagaagagagaacagaaucaaauaacaguuuagugauggcugggcacaguggcucacgucugugaucccaacacuuggggaggccaaagugggaggacugcuugaggccaggaguucaagaucagccugggcaacauagcaaaacccugucucuacaaaaaaaugucuuuagaaaauuaguagggccugauguccugugcuagcuacuugggaggcugaggcaggaggaucacuugagcccaccaguuggaggcuacagugagcugugaucuugccacugcacuccagccuggaagacagaacaagacccugucucaaaagaaaaaaauuaaaacaaaaaacuguucagugauggaacucaaacuacaacccagucuugucauauaugguuuacuauuucuuucuucuucccaccuugaauucacugcucuguagccaagaagaaagugguauguuaaauacaguaggauucacucauuaacucuaaaugagaaauugugauuuguuucuguuaaccuucugauucuuucaaguaaucaugcaaaauuaaucuuagaauaguucuuacucauuuuucucccugccuaagauaaguaaaacuucugggauuagcuaaacuagauccaguguauaugccagcauuuuaauuuucacaagugucauuuugcuaaacuaaucacacuguagccauuaacucuucuuacuucuugaugaggcaguaaucaauuuuccauguacagaugucucaggauguuauuucccauagcugguggauaacugaucccaaacuaauucccuucuaauggacaguaacaugcuuaaucagacauguugacuuuccugcauuguuuacuuuuuucuuacucaguuaaaaucaguuuuguaguuuuauaugugauauugugauuuuugguccuucucuuucugaaaagcuugaccccuacagggagaauugucuagagaggauauugccaccuaucuaaaaaugcuucuuccaaauaaaucaucuaauuuuuaaauuaaauuuuucuauguacuguagcauaaaggugauuuaguuuuucauaaagugaaauaucuacuaguaugagcaaaaguugacugauuuauuguuuaacaaaugaaugacagguguggcuaauuagggcauaaacaacaaaggguucuauaugagaaugcuuggauauguauuaaauaauuuagaaaugacaguuaaaguuuuuuuucuaaaugaugaucuugagcucugauuuuaaaauuccaugagagacuguugauaauuaaguuccauaggauauuucaguuguuucauugaguggauuagauaccauuaaagaauuucuacaagaguuagggaauacaaugcacugaugaacugcuuuauuaguuauauguuaaaacaaccauuuauugggugccuauuucauggcugccacugugcuaaguguaugaaaguauauaagaaaauuccuacucuccagaaauuuauuuacuagugggacaaguauuaauacauuaugcaguuaaugcuaaaauaaaagaaaggaucacagaguggaaccucuucagaaccaaauaacuucagaaggaauuuaacauuuuuccacuuaaaaaaauuguuaacaggcauuauuauuauaaauuagaaugcaguucauagagugcauuucuauuguagaaguugaauauggguuuccugaggagcaaguuacuugaauauauuagacccuucuuggugauguuauuugcuguaacuucuccuagauuauuuuacaaauuauucuacauuggauguaauguuuuaaaagucuuauaugguauuaaacuuguaacaauaaaauccauuggcuuuuaguugccauuacccagggaggagcaauacagcuggcuaacaaugguaccgaugggguacagggccugcaaacauuaaccaugaccaaugcagcagccacucagccggguacuaccauucuacaguaugcacagaccacugauggacagcagaucuuagugcccagcaaccaaguuguuguucaagguaagggaauucagaauucacaggugugguaaauucuucaaaauacuaaaauuuuauaaacucacagaaaaaguaaguaucauauugcaaaccaccauucaaauguaguuaacauuucuucaauauugauaguauuuuucaugaacucuuccauuauuccaauuggaccaaaaugucauggcauaaaaacaacuauuuucaguuuuuaaaauauugcaucuaccuuuaacaucuuuugggguagaagaaacaggauagguuagaaggaaagaccaggaaaucaggaguuagaaaagauggauucuguaucuaacugcauggaucugcuaugaggccuugaguaaaagucagcugcucugagccucaggaaaguguuuuguuuuuuguuguuguuguuuuuguuuuuucaucuguaaaauaagaguugcacugaaucucuggaaacaaucuucagaaguucaggauucuguuucucugcuuccccccccccccccaaaagaaauuuaaaucuucugagaucaucaguuuuuauuauuauuauuauuauuuuuuucuagagacauggucucacuguguugcccaggcuagucuugaacuccgggccucaagcaauccuccuuucucaggcucccaaaguguugggaugccucugcacuugacucaguuuuuguuucaaaugaaaacauuauauuccacaggaucuuauaccaauaugcaaaucugcugcucuuuagagaaaaaguaguuguuaaauucucgacaaauuauagaaguugcuuuuuuuggcuuuuuuuuuuuuuuuuuuaguuuuuuuuuucuguuuauuucaggaaucuuuauggauagcaguuaaccauuuuucuuuggauuuguuugaauauuucaagaauauaguuaaugccagguuagaaauuugcugauugaggaaauaauaauaaauuuguuucugaaaauauuuuuauaaauaauaaugcauuuugccuguguuagguaaugacaguuguauccuuucaccauggauaauugaauaauccugaaacaccaacuggagagagucauaacuuauuuaaagagcccuaauguuuacagaauauauucuguuauuaaacgaguauuugaaaaagauacuauuuugcuuauugaugagaguaaaacaccuuuucacuuuacaugcagguacucaaaaauuguaaagcaggaugucagugaauuugaauucugaacgucaguuugaagaugguaacauguuuaguauauaaaucuuuuccacucaaaccauacauuuuaauugauauuaauaauuaauaugaauaauuuuauaaagaccuucaaauuuuuuuaaguaacauuagguuccuuauuaggagagcauauuauuacgcuguuuuuagaagcaguuugacaaauagugauuguguuuguuuuuacaaauggugaaucaguuagaaaaauaaaacuucaguuuauuuagccauuaucauuuacauuaaaacaauauguuuuucaaauaauauaauuggcaucaagugauacacuuuuucauacuuuuaguuuuguuuuaauucaaaauuuauaauaguugaccauaaugcuuuaucuucuuuuucauuuugcuauuuuaugaaaaaucauggucguuuuuaugucguggcaagagucuacuugaaauuuuuuaauaugaauuuaccaauaucaaaggaagacacugaggacuauacucuaucuaggaagaucauccaagcugugccccacuuaccuuuuagacuuaagguugguaagcauguuaacaacagaauagaacugcauucaaaugaaaaauaaaauguaagauccagcggacauagguuacuguaauaaauacauuacauugggaauuauuucuuaguaguggcgcgaagagugcugauucuuucaacgcuuuagccagaaucaucuuuucuuuuuuguuucccuuuuaguccaaaauacaugcuuagauugaugauugauacacauaauugaaucaaguugcaauguuucugucuuacaccaugcucacuguuuuuuucagcugccucuggagacguacaaacauaccagauucgcacagcacccacuagcacuauugccccuggaguuguuauggcauccuccccagcacuuccuacacagccugcugaagaagcagcacgaaagagagagguccgucuaaugaagaacagguacaaauacugcauuuacuuagauuguuauguguuaagugugucuucacauucugcuggauguguaucuuuacaucuacugguaauaggaucuuugcauugaauuuuuuuuuuccagcagaauuaauggaucuugcuaaauuuucuuuauuuaauaagcugcacuuauaagauagcuguaugauuaugggucaaucuuugaucguggaguaguuuucuuucaugcaguuuccccacaggagauuuaaugcacaacuucccuaugucugcacuccaaccaguuagccagguuauuuaaaaaugguuucuuuucauguauaguauuguucaagaagaucaagaguuucauauauguauauuaacuguguguuaaauuuuaucuauauuaaauuuacuugauauaaaguaaauguaugguggccaguucauguuuuaaugaauaauaucuuuacucaaaauaauaacauuuuaacaccuaaagauucuucaaaaauauguuaauucuaagaauaccauguuacggacaaaaaucuuaaaauauagucuucaaaaaaauacuacauucaaaaucugugaaauguugguaaagcaauucucagaaaguaacuuuauugcuguaaaugauuuugccgucaaaaacaauaaaaauaaguuacuaaauauugguuuagaacuuucauauagaagugaccgagacaaacaaaagaaaaugaaaauaagguuauguaaagguuuaaaaaguuugaaauuagugaaaguaucucacuguucaucccaggauacuucaaacacugauaaagugaaagaagcagggcuuccaaguccuagcccuaucccuccauuuugggagaagguauuaaccuucuguaccucaguuuuguaaaaugggauuccagcacacacccaaaguauuguuguaagagucaaguaagagaauccuuugaaagcacuuuguaacuguagugcucuguugaaauggguuugugugugugugugcaauuucacagcucagaucagcuuuuuuguuccuaaaauauucuuagcugucacaauguuaguaaauuauaucuaaacucugagaaauggcagagauuuuucugggauauuagaaaaagaguuggaaacaagccaagugacuuuuuuuuuuucucccgagaugaagucuugcucugucacccaggcaggagugcaauggugcaaucucagcucacugcagccuccaccuccuggguucaagcaauucuccugccucaaccucccgaguagcugggauuacaggugcccaccaccacgccuggcuaauuuuuguauuaguagagacaugauuucacuauuuuggccaggcuggucucgaacucuugaccuugugauccacccuccucggacuuccaaagugcugggauuacagguaugagccauggugcccagcccucaagugacuuuuauuugugcuccauccaucugugauuuugaguauuuaaguuuuacuaaagagaagcauaaaagcugcauucauaauucaaauauauuuuaaaauauaaauuaaaaucuguaaauaaaaauuaaaauauuuucaguuuuuaaaaauguuuauaaggaaaccuuuaacuuaaaauuagaagcaagucugaucaagaagucucaagcacaggcugaguaguaauauuuaagacaacacugcuuacuaaagaaaagaguucaaagcaaacauaggagcagaaucaaaaaauaaauccuuuugauuauaaaaaacaacagaaggacuucuguuuaugucuauguaguuuggcuguguggaacaaaauguuuacccccguugacuggcagaccaaauuuccuuuuuguucuauuuauuuuucuuucagauuuaugaccacugccaccaacaaguuaggaacagggcacacauaacuacaguuccuaccaggcuuugcuugccugagaucuucagggaaacuacccgacuuaccauggacucuuucauaacauuacuuugcuuagauauaguuacccuacucuuuaaaaaggaaacuucucauugauucugccauaguuccuuuuccccuuuguuaccagauuacugcugcuuuuacuuuuucagccuccauucacuggaaucuggcuucuaugacuagcauaccgcucauaugucuauaaaaagguacaaauucccucccacuuggcaaaucuaguauuuucuuucauuuaauuuuaacucuauggaguauuugacacuuucgacuucucauuacucuaaacucuuccuuggcuuacuucaccugguuuucuggcuacuuuucaaauuuuuccuuugaaccuucauccauacccauguauuucaggcauuacuuuauaugcugauacuucuuaauucuguauauucuggcuuugaccuuucugccgagugcuauuuauuaagcuccaguauauauuauuuuauuaauucuaccuacagugagguagaagcuuauccccacuuuagaggaggagaagguaaauaucagaaaauucaaauauuuugccaaaggucacacacuuuaugagauuaguagaacugaaauuugaacccauaucuggcaccaaaaccuguaaacaugcuacuucacugauuccaguaugcagccaucuucugcugugccucucaaaccagagcacauggcaguaugcuagggauguguagccuaaggaggugaacguggagugcuuuccuugaauguucauuuugcuaaaauauuugagagaaauaaaccuuauuuuuaagguaaaauaagaguuuuaaaagaaauuuauaccagcagugguuuugcugcacccccagagucuccauauuugguuuccucuucuaguguggcuauuucaguggaaaaguuaagagaagcacacuccuaagcaugcucacuaggaugaauuucccuuaugcacaucaaacacagccuaucuuaaaguuugauaggaaaagauuguaauccaaaaaauucaucacuauccaaauugccauuuauuucaagaugaagguaagugguaaacauucuaaaagaaaguguagacagcucuucuguuaauuuguguugcuacaguaacaaccacgaaucucagugucuuaaaauuucuuccucacuucuguuacauuuuggcagcugcaggucaguugcuguggcucuccuucaugugcccaucugggucuaggauccugggcuagauagagcagcacgucuuugagaaaagggcaaugcuuuugaaagcauuugcuugauuuuggugaacguuacaucuacucgugaucuguuagccacagcacaggcaaggacaagcccaaagucaguggagugggaaugaacucuuccuacaggaaguggagagugaaaaauugugaaaguaauacaaucuaucaccuuugccuuuauguaacuuuacauuguagggggauuuuaaaagcagauucccuaaaggcagaaguaacaaaggaaaagguuaaauggauuugaccauauaaaacuauaaacccccuauuuaggaaaguaaaagauaaaguagcaaacauuuuaacaaauaaugucagaagacuaaugaguugagggauauaaauaggcagauucuuagaaaauggauaggguaaaaaauuugaaaaauucuaaaaaaauuaaaauguauuugauaugaauuaaaauauauccauucaacuauauacaacuagccauuaagaguaaauaaagguguauuuuuauuaagaugggaagauguucucggacaaaagcagguuaccaaagaguauuuacauuacuaucagguuuuuuaaauuuauuauuacacaaguaaaacauguucauuauaaguaaauuaagaaacauuaccuaaaaauugaauuacuucuaauuucaccaucuaaaauguuaacauucuaaagucaguuuuuuuacucaaaccaguacaaagguaaauauacauuuuuaauauauuuuuaaguaauuuuaaacuuacaaaggaguuuuaaaaauacagaguuccggauacccuucauccagcuuucucuaaucuuaguauauuacauaaccaggguacauuuaucaaaaauaaaaguacauugguauaauaccauuaacugaauuauacauuuuauuuccccaguuuuuuuacuuacauaauccaguuuggguaccauaucgcauuuaauuauagucuccuucagucugugaaaguuuguuuccuugucuuugauggccuuguaacuuuugaagaguagugaucuguuuucuuuuagaauaucccucaguuugcauuuguccaguguuuucuauggauagauugagauaauagguuuuggggaggaauuccacagagguauagugugccuuucucauaacaucacauccgggagcacauacauaauuggcgauauuaacuuugaucacuugguuaaagugcuguccaggugucuccacuguugagcuaccauuuuucucuuuguccagcccauauucaaggggaggagaauuaaauuccaccuccuaaaagggagaauaugaaagaaauuuguggucauauguuaaaaccaccacaguaauuagguguauuuuagaagaaguacuuggaggcuaugcagauauauucuuuucucuuuaaaguuuugcccaccaguuuuagaauucaucaguaaaucuugucuacaguaauuauuacuauuugcuauucuaaugggaauuuuguauaucuccaucccuucuaauauauuuaacaacugaauucuauaaacaagauuuguuucuucuccacauuauuuauuuuaucaauacagacacauacuuugggaguuauaauccaauacuauuguuauuuauuauguuguucauauuguucuagcuuuggcuacugggaucuuuuauaagugucuucuguguccuuuugacaugccccauuuuuuucuuuuuaagcacaucuuuacuuucugagacuacaagauuguccagguucucaucuuguguuuucccuucccuagccuuggaaugagcuguuuuuccaaugaucucuaguuccuuuauuagaaaaugguggccaauauggugaaacccucucucuacuaaaaagagaaaauuuagccggggugguggugcacgcuuguaaucccagcuacucaggcggcugaggcagaagaauugugcgaaccugggagguggaaguugcagugagcugagauggcacuacuacuccagccugagugacagagugagacucugucucaaaaaaacaaacaaacaaacaaaaaaaaauauauauauauacauacacacacacauacaccuucauauaugcacacauucuuauuucuguaucuuuauauauaguuggcucuguuuuccauagcccacauucaagaaaaaaaguaacaauauaacaauuuuuuaaauaauacaaauaaaaaaguaaccuaguauaacaacuauuuacauaguauuuacauuguauuaaauauuauaaguaaucuagaggugauuuuaaguauauagggggauucauauagguuauaugcaaauauaaugccauuuuauauaagggacuugagcaucuguggauuuugauacucaugagaguuccugggaccaaucccccacagauacugagggacaacuauauacuuaaauaggaauacacacuaacauaucugacucuaagcuuuaaccacguggcucauuuuagacuucucuuugccuguuuguaacuucuuucuccgacagaaacuuggcuuauauguuuguuuaaaucuacuauacauacagaaaacuuguaagaauugauaauauguaccauugugagaaacaggauuaccaguuacagugcaguauuuauauacacuucuuuuuguuuuuggccuaauaguauuuagcaaaagugcuguuuucuaaaguuacuucacucugcuccuuucuccaccccuuucaaugagguuauaucauaugauuguaguacaguuagauuugucacaaucuucagucugggauuuucugacaucccuaaguuuuuauccuuaaauuugcauauacauaaguucacucuuugugcuguauaguuuuauggguuuugauagaugcagugucauguaucugucaccacaaugccauauggaacaauuauacuaguuaacuaacaguuauauaauacuaaguauucucuuauaucccuuugaagucagcuucccccacgcccugaaaaccaaugaacuguuuucuacccuuauaguucugccuauuccauaaucucuuauaaaugguaucuuaaauuauaauuuguagccuuuuagaucugguuccuucaucuagcaaaaugcauuuaagauuuauugauuuuguugcaugaaucaguaguugggacuuaucccagauaauuccauuuuauagauauacugugcuuuguuuauucacuuugaauuucaucccaguuauuuccaguuuuagagaaauaaaguuacuaucaacacauaaagguuuuuauaugaacuuuccauuaacaugaguaaauaucuaggaguaggcugguugcaugaaauguaacuaacuguauauuuaacuuuuuaaauaaacuguccaauuguuuuccaaaauggcuguaccauuuuauauucccaccaggaauguaugagaguucaguugcuuuguauccuugccaaaacuugacauugucagguuuauuguuugucccccagcucuagaacugguauaauggauaucuuaugguuuuaacuugcacuucacuagugacuuuuuuuuuuugagacggagucucccucugucaugucacccaggcuggagugcaguggcaccaugucggcucacuguaaccucugccuccuggguucaagagauucucgugccucagccucccugaguagucaggauuacaggcaccugccaccacgucugauuuuuuguauuuuuaguagagacaggguuucgccauguuggccaggcugguuuugaacuccugaccucagaugauccacccaccucggccucccaaaaugcugggauuacaggugugagcuacugugcccagccuucauuagugacuuuuaugugauuugcuaucuauauguuuucuuugaugaaaugucuauuuagaucuuuuagucauuucuauuguuuguuuucuuuuguuuucagagaccuuuuuuccaaauccuuugucagagcaaguauuuucuuucagucugcagcuuuuucuuuaauuuucuuaacauuaucuaucuuuugcagagcaaaagguugccauuuugaugaggcccauuuuaucaguuguguccuuuuguacaucaugcuugugguauuuaugaauuuucugccuggauaggcccagcccacuuacacacgucuaggagccuauggacaggcccauugguguccacauacaucaucuagggugccugaggauugguugguccugcccaccagcacccacugucuggaaucaugaaggccagcucgcucucacuaucacauuggccacccagaggccugcagauaggccugccuggccugcugccaccguaaaggccuuuguguccacauaccagccaaccugauguccccauccucagcaaagcuuuaucacagccuccacugacaaccgaagccuaagccacugaagaaaucauagaugccaugagagaaucauagauaccaccauugaugacaguaaaagaaaucauacagagacaacacaucugaacccaccuagaaucaaauccagagcacccuacccagcuaacacuacagcuacaucuacaguaaaagucuuucucuacaaaagccaguccauaaaauuggauaaagcagcaguugcacagauaucaagauaaggacacaagaaacauaaaauacugaggaaacacgauaccuccaaaggaacacaauaauuuuccacuaacagaucucaaagaaccagguaaucaauaaaaugccugaaaaggaauugaaaauaaugaucuuaagaaaacucagcaagaaacaacagaacacagauagacaauacaaauaaaucaggaaaacaauucaugaucugaaugagaaauuaaagagguaaauaguuaaagaaacaaauucuggaacugaagaauuuaauaaauaaaaaacagucgagcagaaagaauuucugaacuuuaagagagaggucuuuuaaaauaacccagucaaacacacacuaaaaaggaugaagaaagccuacauaggacaucauaaagcaaacaaauauuucaauuuugggagugccacaaggagaaaauauaggaaaaggcauagaaaaccuauuuaacaaaauaaucacugaagaccucccaugucuugagagagagauauauauccagauacaggaaggucauauguacuaaaacaguuuauccaaaaaggccuuucuaagacacacuauuuucaaacucaaaagucaaaaacaaagaaaaaauucuuauggaaccaaaaacagcccaaauagccaaagcauuccugaacuaaaagaacaacauggaaggcaucacacuaccugacuucaaaauauacuacaaagcuauaguaaccaaaacauaguauugauauaaaaacacauagaccaguggaacagaauaaagaacacagaauaaaucuacuuauuuacagcaaaugugccaagaacauacauuggggaaaggacacucucuucaaucaaugguauugggaaaccuggauaucugugugcagagaaugaaacuagauaccuaucaccauacccaaaaauccacuccaaguggauuaaauacuuaaacauaagaccccaaacucuuagacuacuagaagaaaacaugggggaaaugcuuccugacauuagacuuggcaaaaacuucauggcuaagacuccaaaagcacaagcaacaaaaagaaaaauaguuaaguggaaauauuaaacuaaaaagcuucugaacagcaaaggaaacagagugaagagacaaccugcagaaugggaggaauauuuacaaacuguucaucugacaagggacugauaaccaggauauauaaggaacucaaccgaacaggaaaacaaacaaaaauccuauuaaaaaguggacaaaaggucugaauagacauuucucaaaagaagacauacaaauggccaagaaauauauuugaaaagcucaacauuacuaauugucagauuaaaaccacaaugaaguaucauuagauagaaugguuauuaucaaaaagacaagaaguaacaaacugaugaggaugcagagaaaggugaacucuuccucuuuguguuaggaaguaucauuaguuagaauggcuauaaucaaaaagacaagaaguaaacacugaugaugcagagaaaggugaacucuuucuaacucuuuguguuagaauugucucaguguugaugagaauguacauuaaugcagccauuacggaaaacgguguggagguuucucaaaaaaacuaaaagggccaggcgugguggcucacgccuguaaucccagcacuuugggaggccaaggcggguggaucacaaggucaggagaucgagaccauccuggcuaacacggugaaacuccuucuuuacuaaaaauccaaaaauucagccaggcaugguggcgggugccuguagucccagcuacucgggaggcugaggcaggagaauggcgugaacccggaaggcagagcuugcagugagccgagaucgcaccaccgcacuacagccugggugacggaacgagacuccaucucaaaaaaaaaaaaaaggaaaaagaaaaaaacacacaaaaaauaaaagaaccacuauaugaucuagcaauccuacuacuggguaucuauucaaaagaaaggaaaccaguauugcaucacuucacaguagcuaagauagggaaucaaccuaaauauccaucaacauaugaauggauaaagaaaauugcaguauauauacacagugguauacugucaagccacuaaaaagaaugaaaauacaucauuuguggccauguggaugaacuugggggacauuauggguuaugcaaaauaacucaaacauggaaagauaaauaccacauguucucacucaugugggagcuaaaaauuuuuugagcuuauggaaguagagaguaaaauuguggguauuagagccugggaagggaaggugagauagggagcauggggagagguugguuaauggacacaaacuuacaucuagguugguagaaugauuucugguguucuguagcaccauagggugaauaugguuaaauacaacuuguguauuuucacaaagcuagaagugaggauuuugaauguucacaacccaacaaaaugauaaguuugaggugauggauaugcuaguuaccauaauuugaucauuacauacuguauacacauauuagaauauuacugcaucucauaaaugucuacaguuauuuuaugucaacuaaaaauaaaaaggaaaaaagaauucuuugccuaaaucaauaucacacagacuucguuuuccucuaaaaguguuauguuuuauguuagaguuuuauauuuagaucuauaauucccuccugaguuuacuuuuguauaaggugugaggaugugucgagauccauuuuuuuauauaggaacauccauuuguuccagaccauuuguugaaaagacuauucuuucucuauugaauugcccuugcucuuuuuuucaaaaauuaauugaccauauuugugugagucuguuucuuggauaucuuuccauugaucuuugugucuguccuuuagccaauaccauguugccuugaguucuguauaauaagucuugaauuugauaaugugaguccuccaacuuuguucuuaaaauuguuuggcuauucugguuccuuugcacuuuaauguauauuuuauaauccgcuuguugaugucuacggaaagugugcuagaauuuuaguuaggauuguguugugucuauagaucaaauugugaagaagucacaucuuagcaauacuuaguuuuugauuccaugaacacaauauaaucuaaucagcacauagauccuguacauaucuuacuggauuuauacccaaguaugaacuguuuucugguuuuuuuuuuuuuuguguguggggguggggggacaugugcuauuugaaaugguauauucaauuguucauugcugguauauggaaauaaaauuggcuucuguauauuuaccuuuuauccuaugaccauucuaaauuuacuuauuaguucuaggagcuuugucgggggggguguagauucuuugggauucucuacacaaauuaucaugucaccuacaaauauggacaguuuuaauuauuucuaaucugcaugccuuuuaauuuuuuuuccuuauugcaaugucuaggacuugugcuaugauguugaauaggaguggugagagaggacaucuuugcccuauucuugaucuuaggggguguauuaguuuucuauugcugcaugucacaaacugccacaaacuuacuggcuuaaacaacacaaauguauuguuuuccaguucuauaagaucagaggccuucauuggaucucacugggcuaaaaugaaggugucagcaggacugcauuccuuccuggagguucuaggugaaaauguguuucuuugccauuucuagcuucuagaggccacccacauuuuuugccucauggcccccuuucuccaucuucaacauaguguuaucucuguuccccuucugcagucacauuuucuucugcuuuccuguucuacuuuuaagaaugcuugugguuuaacugggcccacucaaguaacccaagauaauuuuccuauuuuaaggucagcuaauuaacaaccuuaauuccaucugcaaccuaauuccccuuugccauauaagguaacauacucacacacugcagagauuaguacauggacaccuuugggggaccuuaaguaauguaauagcuguagggucucuguaaaaagcucuucauuacauuuuuuuaaaaacucucuuugauuuuuaguuucugagaguuuucaucauaaauuguuguuuaaucuugucaaaugcuuuuccagaaucuacugaggugaucguguuguuucucuuauuuggucuguuauuagagugaauuacauucauacuccaauuuugagauaugcaugcauuccugggaugaacccccaauuggucaugaaguaucauuuauacauugcuggauucaauuugcuaauauuuuguugaggauuuuuaugucuacguuuauggcuaauaugggauuuuaguuucuuugccgugaguuuguuauuaggguaaugcugaccuuauaaaugagguggaagucuucccuucccuucucuuuuucuggaagagauuauaauauuuguauuauuuaagccuuauaugguugguagaauuugccagugaacccacauaggccuggaguuuucuauuuugagaaguuuuuuuuuuuuuuuuuuuuuuuuaauagauacgggaucauucagacuauuucuucuucagugaguuuuggaaguuuguguuuuuaagacauugguccauuucuucaaaguuaucaaauucaugaccauagaguuguuuguaguguuaguuuauuauucuuuuacuguaugggaugucaguagggauguccccccgcuucauuccuaauauuguuaauuuuugucuuuccucucucucuguauucgccaccccuaccccagccacccuccuuuuuuuuuaagucuggcuaaagguuuaucaauuuuguugauuguuuuuaagcaaccaaaauucuuaguuucauuaguuuucuccuuagaauuguauugauuuguacucugaucuuuguuauuuucuccugcuugcuuugguuuuuuuaguuguucucuuucuaguuucuuuuuucauuaacuguaaauuuuuuccuauuaauauauaccuuugucuuauuucaguuucuaagaaaacuucugcagguaucuaguuucuuaagacaauaguuggaucaguuuggcaaaucuuuuguaaagggccagauaguaaauauuucaggcuuugcagaccaaaugaucugucacaacuacucaacucugccguuguaauaccaaagcagcgauggauaauacugacuguguuccaguaaaacuuuauuuacaaaaacaagcagggaagcaaaguuuggcaacccuugauauaaauaauugauuuaagcccuuuuuuucuaacauaaguauuuaaggcuguaaauuuccauuuuagcauugguuuagcugugucccacaaauuuuggguugucauuuuuauuugcauucaguuuaaaaauuuuuuuauuuccuuugagacuucuuuuuugaccuauagacuuagaaauguuuaauauucaauuuccaaauaaucgaggaucuucccagguguuuuauggcccaagaacauacuuuguauuauuuuuauucucuuaaauuaucaaguaucauaucaaugucagauagguguaguugauuaugucauucagguguacuguaucauuuuuaauuuucuacuuauucugucaucucugagacucuacuuagucuaucaucacugacaggagaguguauuaaggcauucaucccuuuguucauuucuccuuucaguucuauuagcuuuugccucauacaggagaauuacaucuuccauuuagaauuaugucuucuuagaggauagaccucuuuauuauuauauaaugucuuucuuuaucccugacaauauuccuucuucagaagaaugcuuugucugauacuaauaaaacuaccccaguugguuuguuuuguuuuuguuuguugagacagaaucuugcucuguugcccaggcuggagugcaauggcaguggcacaaucuuggcucacugcaaccuccaccucccugauucaagugauucucgugccucagcuuccaaaauagcuaggauuacaggugugcgccaccacacccagcuaauuuuuguauuuuuaguagagacgggguuucgccauguuggccaggcuggucucaaacuccugaccucaaguuauccgcucaccucagccucccaaagugcugggauuacaggcgugaaccaccauucccagccuccuuuugauuaguauuugcauaauauauauccuucuccauccuuuuucuucucuguuuauauuugaagugggauucuuguagauggcauauacuuaggucuuccuuuuuuacugagcuacaugccuuuuaaaugguuuagaucagggauuggcaaacuauggcacaaguagaaauuuuuaauuuuacauuuauauauuuaauuuucaauugucuucauuuccuuauauaaauccauguuuuaaucuauuauauuucugccucaaaaacucuuuuuuacauuucuuagaaaauagaucuucuggcaaugaauucccucuaguuuuguuugaaaaaguuuauuucaucaucauauuugaaagauauuuuugcuggguauagaauucuggguuuaucauuuuuuucuuugaagugacagacuuuaaagaugucacuuaaggcugagguaggcggaucacaaggucuggaguuugagaccauccuggccaacauggugaaacccucucucuacuaaaaauacaaaaaaugagcugggcgugguggcacacgccuguagucccagcuacucgggaggcugaggcaggaaaaucacuuaaacccgggaggcagagguugcaguagcccagaucacgccacugcacuccagccuggcaacagagcaagacuccaucucaaaaaauaaaaaaagaugucacuuuuuuucuuaugauuuaaaugguuucugacaagaaaucuguguguauauaaugcuccuuuucuuccucugccucugauuugcagcaauucaaauauaauaugccuagggauuuucccucucuucccuccuuccucccccauccccaccauauuuaucuuauucuucuugugucuguggcuuggugucugucauuaauuuuagaaaauucuuggccaggugcaguggcucacgcauguaaucccagcacuuugggagaccaaggcaggcggaucacgaggucaggagauugagaacauccuggccaacauggugaaaccccgucucuacuaaaauacaaaaaauuagcuggccaugguggcgcaugccuguagucccagcugaggcugaggcaagggaauugcuugaaccugggagguggagguugcagugaguccagauugcaccacugcacuccagccuggcgacagagcaagacuccaucucaaaaaagaaaagaaaauucucagauauacuuucuucaaauauuuuuccguccuguccucccucuucuucugagauuacaguuauaaauauguuaggauguuggagacggucacacagcuuuuuguuguucugucuucaaguucacugauuguuuccucagcugugucaguuuuacuuaccagaacaucaaacauauucuuuaucuccauuuccauuugauuccuuuucauaauuuccaugccacugcugaaauaacccaucugaucuuacauguuauccaccauuccuauuagagccuuuaacauguuagucauacuuaaaauuuguaucaaggcugggugcgguggcucaugccuguaaucccagcacuuugggaggcugaggcaggaggauagcuugagcccaggaauucaagaccuguuuggaaaacauaggaagacacugucucuacaaaaaauaauaaaauaaauuagcugggcaugguggugcaugccuauggucccagcugcuggggagguugaggcaggaagaucacuugagccugggaggucaaggcugcagugagcccucauugugccacugcacuccagccugggcagcagagcaagaccccaucucaaaaaugaaaaauagaagcaaaugcuacuuuuuucugaauugauaguuacaugaggaugaagacaucaauggaauuacaauguacugccauuuggaguuaccuaaaaauaauaauagcuaacacaucuucaacaugcuaggcacuauauugugugcuuuacauauauuaacucauuugauccucacaaacuuuuuuuuuuuuuuuuuuuugagacggaaacaccuaucacccaggcuggagugcaguggcgcuaucuuggcucacugcaaucucugccuccuggguucaagcgauuuuccuaccucagccucccaaguagcugggauuacaggcaccugccaccauccccagcuaauuuuuguauuuuuaguagagacagaguuucgccauguuggccaggcuggucucaaacuccuggccucaagugaucugccugccucagccucccaaagcgcugggaccugggauuacaggggugagccaccacaccagcccucacaaaccuuuugagguagaaaauauuaccauguccuuuuuuacagucaggaaauuaagguuaaguaauaagauuguggcccuugaccacacagagcuaaaaaagaauuuacugguuuagauugagcagcuugcuaaagaauaauuuuuaauuauuuuuaaucuguguuagauuuuuuuaaauaauuucauuuuuaauugugguaaaaaauauaacaaaauugaccaucuuaaugaguuuuaaguauucaguucagucauguuaaguacauucauauuguggugcaguagauuuccagaacuuguucaucuugcaaaauugaaacucuguacccgguaaacaacaacuccccauuuccucguucccccagccccuggcagccacuaauguaaguccuguuucuaugaauuugauugacuuuagaugccucauaagagaaauuacacaauauuugucuuuuugagacuagcuugugucagcauaaugcccucaagguucaucuacguuuuggcaugcagagggccuuccuaaggcugaauaauauuaauauuacauuguauguauauaccacauuuugcuuaccacucaucugcugauggacauuugggcugcuuccaccucuuggcuauugugaauaaugcugcaaugaacaugaguguucagauaucucuucaauacccugauuucaguucuuuuggaucuguagcaaaaagugggauugcuggaucauaugguaaauuuuguucuuaauuuuuugaggaaccuccauuccauuuuccauagcagcugcaccauuuuacauuccuaccaacaguacacaagaguuccaguuuccucacauccucaucaacaauggguauuuucugcugguggugguuuuuugauaguagccauccuaaugguugugaggugauaccuagugguuuugauuugcauuucccuagugauuagugauguugagcaucuuuuuuuuuuuuuuuuuuuuucugagauggaggcucgcucuguugccuagguagagugccguggugcaaucucggcuuacugcaaccucugccucccggguuuaagugauucuccugccucagccuccugaguagcugggacuacaggcacccaccaccauaccuggcuaauuuuuguauuuuuaauagagauggaguuucaccauguuggccaggcuggucuugaacuccugaccucaugauccacccgccucugccucccaaagugcugggauuacaggcaugagccaccgcacccagccuauauugagcaucuuuuuauaggccauuuauauaucucuggagaaaucucuguucaagucccuaugcccauuuuuuaaauuggguuauuuugcuguugaguucaaaaguucuuuauauauucuagauuuuuuuuuucccuuucuuuugagacagcaucuugcugucucccaagcugugguauaguggcaugaucauggcucacugcagccucgaccucccggccuccaaccucagcuuccugaguagcugagacuacacgcacacaccaccuaacuaauuuuuaauugagacagguucuugguuugucacccagguuggaaugcagguggcaggaucacggcucacugcaaccuaagaccuccugggcuuaagcaguccucccaccucagcuuccugagcagcugggacuacaggcaugugccaccacacuuggcuaaauuuuuaaaaauuuuuuuuuagagacagggucuuaauauauugcccaggcuguucuugaacacauggguucaagagauucucccaccucagccucccaaagugcugggauuauaggcgugagccauacaccuugccuauucuagaucuuaaccccuuagcagauauaugauuugcagauauuucuucucauucuguagguugccuuuucacuauuuauugucuuucgaugugcagaaguuuuuuaguuggauauaguccuauuugucuauuuuugcuuuuguuaccucugcuuuugguguuguauuuaagauauuacugccaaauccaaugucagagaguguuuucuucuagaaguuuuauaguuuuaggucuuacgguuaggucuuugaucuauuuugaguuaauauuuguguacaacauaaggugcggcccaaccucacucuuuugcauguggauauccagguuucccagcaccauuuguugaagagacuguuagauuuuuuuaaaugcccugaaaugauuaguuuguaagauuuucuauuuaaaggauuguuacacauugaaauuuagcuuuaauguuuucuuaguuauugauauggauagaauuucaaguuuugcaggaauuaugcagaauauuuuaauuaauaguaagauguaauuuuuaaguggucauuuaggucuuguuuguuuauggaguuguuuuuuuguuuguuucuuugagacggagucucacucuugucacucaggcuggagugcaguggcgcaaucucagcuuacugcagccucugccucccagguucaagcgaugcccauggcucagccuuccaaguagcugggacuacaggcaugugccgccacaccccgcuaauuuuuguguuuauaguagagagggguuucaucauguuggccaggcugaucuuggacuccugaccucaggugaucucccugccuuggcccccgaaagugcugggauuacaggcgugagccgccacgccuggccagauuaaaauuuuaauauaagguaauuuccaaguaauucuguauaucuuuuccaaugcuuaauauauacuaaaauguugguugcugugagcuauuucuuuaaaaaagaaaaaaaaaagguaauccaaaauaaauauguggaaaucauuugcauaauuuuucccguccucuuuugcuuguagggaagcagcucgagagugucguagaaagaagaaagaauaugugaaauguuuagaaaacagaguggcagugcuugaaaaucaaaacaagacauugauugaggagcuaaaagcacuuaaggaccuuuacugccacaaaucagauuaauuugggauuuaaauuuucaccuguuaagguggaaaauggacuggcuuggccacaaccugaaagacaaaauaaacauuuuauuuucuaaacauuucuuuuuuucuaugcgcaaaacugccugaaagcaacuacagaauuucauucauuugugcuuuugcauuaaacugugaauguuccaacaccugccuccacuucuccccucaagaaauuuucaacgccaggaaucaugaagagacuucugcuuuucaacccccacccuccucaagaaguaauaauuuguuuacuuguaaauugaugggagaaaugaggaaaagaaaaucuuuuuaaaaaugauuucaagguuugugcugagcuccuugauugccuuagggacagaauuaccccagccucuugagcugaaguaaugugugggccgcaugcauaaaguaaguaaggugcaaugaagaaguguugauugccaaauugacauguugucacauucucauugugaauuauguaaaguuguuaagagacauacccucuaaaaaagaacuuuagcaugguauugaaggaauuagaaaugaauuuggagugcuuuuuauguauguugucuucuucaauacugaaaauuuguccuugguucuuaaaagcauucuguacuaauacagcucuuccauagggcaguuguugcuucuuaauucaguucuguauguguucaacauuuuugaauacauuaaaagaaguaaccaacugaacgacaaagcaugguauuugaauuuuaaauuaaagcaaaguaaauaaaaguacaaagcauauuuuaguuaguacuaaauucuuaguaaaaugcugaucaguaaaccaaucccuugaguuauauaacaagauuuuuaaauaaauguuauuguccucaccuucaaaaauauuuauauugucacucauuuacguaaaaagauauuucuaauuuacuguugcccauugcacuuacauaccaccaccaagaaagccuucaagaugucaaauaaagcaaagugauauauauuuguuuaugaaauguuacauguagaaaaauacugauuuuaaauauuuuccauauuaacaauuuaacagagaaucucuagugaauuuuuuaaaugaaagaaguuguaaggauauaaaaaguacaguguuagaugugcacaaggaaaguuauuuucagacauauuugaaugacugcuguacugcaauauuuggauugucauucuuacaaaacauuuuuuuguucucuuguaaaaagaguaguuauuaguucugcuuuagcuuuccaauaugcuguauagccuuugucauuuuauaauuuuaauuccugauuaaaacagucuguauuuguguauaucauacauuguuuucaauaccacuuuuaauuguuacucauuuuauucacuaagcucgauaaaucuaacaguuacucuuaaaaaaaaaaaaaaaagacuaagguggauuuuaaaaauuggaaacugacauaauguuagguuauaauuucucauuuggagccgggcgcaguggcucacgccuguaaucccagcacuuugggaggccaagguggguggaucaccuguggucaagaguucaagaccagccuggccaucauggugaaaccccaucucuacuaaaaauacaaaaauuagccaggcgugguggcuggcgccuguaaucccagcuacucaggagguugaggcagcagaauugcuugaacccaggaggcagaggguugcagugagccgagauagcaccauugcacuccagccugggcgacuccaucucaaaaaauaaaaauaaaaaaaaugucucauuugggaaggaaauuccuuuuaaaaaagaguugagacacuuagaaaacuaauguuuuauauuuagucaagaguuauuuaagaaagucaagcuuguuuaacaacaaaauaugaagauuuaaguguuaauugcuggauccauuuuaaaauaagauuuuaauuaacauuuguaaaugguauauuuucguuuguaacaaaccauugucuuuuuucaaggaugaacagaguuuaugaaggagcaucauucuaagaauuaagugauguagucuuuauguuuggacaguucaccagauucucaagaaggcuuucaaacaacuauaaaguuugauguuuguccugcugagcuaauggggaaaguuauagcauaaaaauuguguaaccgcauagauaugucauuuuuaaaaacugguuuaacagaaaucaagcaaagucacaaauauguucacaaguuggaauuauuuauugagucaaaaugucgaaucgaacauuuugaaugaaguaaguguuauaaaugaaaaauugccugauguuuagcaguuuguauucucuaaagcuuuuuuucaaaaguucaggcuuucuacuuacugggaaguuggugguccucuuagucccugauaaaucaaggcaaucacauucaugugagcuggaugaauuuauaaguuauaaagaccuuauccuucauaccuugaggaugauugcacugguuuugaagucaguugcuuaaugaugaggugagaaauguauccuguugcuaaaucugucuuagacccuuggugaaacuugaagauuucaguuuauaaagauaaaaucaagcaucuuuugugcaguuuucuuuuuuuaaugcaagaaugguggggagguuuguuuguaagcaugaaacuuugagaaucuuuauuaagaaaaugacauaauuuuuaaaaaccuuguagccaagaacauauguggccacauuaccaguaauaaauguuuuucucuuuauauuggccaaaagggaauaaaaaugucaucauaggaauuuguacauaugcuacugauuugccuagaaaauagcaaguuugauauugcucacuuugcaaauauagggccauguggcacuuuuaucuauaggacagauuaauaaaaaugaaguggggagggguuuauuuuugauauauuacucuuaugaguuuucaagcuuugauaauguuuaacugaaaaguggcuuagaaagggcuagauccaauguguucauuauuaaauaauugcuaucagauacaauuuuaaguucauucuuuuucaaacucaaguaccauauuggcaaccauaauauugucauaggugcucucuucauuuagauauucuugggggggguggcauuuguauaauauauguguacauauauauauauauauauauauauacauacaguauauaaucuaaagcucugagagcucuuaagucaggaaugcugaguauuauaguauauugaggucagaugaaauuuuacauuuuuguguguucuguugcauuccuucugguaguuucuaugacugcauuacuccagcacucaugauugauuuuaucuucuaauuuucuuccaaguauuuuauuuuuuauuaguuuucuuuggcuugauacuuuuaaauauguuacuagucacuugaaagccucucccccaaaaguauuugguuuguaugcuuugucuguggcagcuauaacagugguaagaacauuuugaagauagcuuuuuaaaggaaccacugauuuuuucaaaaaucauccugggggaggaauuuuggcauuucauuugagcagggauuuugucagaaaauguguuuugaugguaggucagcagcagugcuagucucugaaagcacaauaccagucaggcagccuaucccaucagaugucaucuggcugaaguuuaucucugucucucaggauaaaucccuguaggacaaaucccuacuaucauuucuaccuuuuggggugacauguggaaucauacaaaggcuuaggaagaaauacguuuguuuaaaccaggaugcuuuacuuacuugaagugacuucaaucuagauuucuuuuaauauuuaacaaauuuuuaauucuaugaucagccacagucagcuauuaccauaaauuggucucuguuuauuuugaagaucacggcugcuucauuuugcaggauuaaguagggcuaauguaucuuaaaguuaagaucuugaauuaaagugaguuuuagaaauaguguuacauaccuuuucaguuguuuucaagaggcuuuauuuuuguugccuuuguagcccugaaagcuguugguauauuuuuucccucauggacccaauagaaaaguuguauauuuauuuggauuauauuuacauucuguccuuuguaaauguuugguguaacuugcacuuuuuuaaaugacccaguuuggguauuagcaacuuaagaaauucccucaucaaguaauucucaacuuuuuagucuuucuccucucuucaaaucaugugacuuuuuaaauggaaguuuuucauugauuaaaauauuuuagcaccuaaaagcuagccuuaaaaacagcuguaaaagaaaaacaucaggaaauuagauaugacuagcccaguuaauuaaaagacgggcucaaaccuuguuuuauucuuuuucaucuuggaugaagauugaagggaaaauaacucaagugcauaauauuuauuuucaauuuuuaaugagacuuuauccucaucacaacauuaauacuguacauaguaugccaaaauauccauuaauuugucuagaauaguacaagacuuuuuaaagcaauuguccucacagagaccacauguaauauacugaaauauguucauuuuuaauggcuuuguuaacaucaaagaaaugcugccuaaauuugauuucagaugaggaaggagaaaguaaagugugcauaguaaggcuguaggugaagaguugugagauaaauaguucacucaguuguacaaagcacaacuagaacuuuuuguugggaggcuuacauacaucuugaauauucuuaauguaauaauguugacuauuaaguuggcuacacagucacuguauguacuaggaacugguuuccuugacauucuagaaucaauggcuaggagaggcauuaaucuuugaggggcugaacauaucaugaagcugagucaguauggaaaauuuucaaauaaacagggugcugaaguuccaucugucucaucugcuuaugauaaguucuuauugauuagugaauguagcuuaagccuuuguauguguccucagggggcagaccgacuuuaagagggaccagauaacguuugaauggagggauuauauuucagguguuuuagcuugaaauuuauuuuuuaaaaaaagaaaaauuuaaaaaauauauaaauaaaauagaacaaagccggugaugcaaguugauauuauaaacaggcaguuuuagcacagaaagaaaauacugaccugucugcauucugguacggugggugcaggucccagcuggguaugacaugauacauuuuuaauuauucucaccagcaaguaaaaggaaaaugaacaaucuuuuggaauugucuuugaaaaggaucaaagaguaggaaauucacauuugaccuaacauuacuugccuauagaaguauggcauuuccaagcuuuugucugaggagcaucucagagaagugagaguaaaucugaguuagcuuaaaaauugguagggaggaagaaaaucucugcaaauaaugauuuuauguuuguuggccaagugaaaugaucuaucauuguguuugggagguuuuauuuucuuauguuuuuaaaauugguaaaugcuuuauagauguauuuuuauccaagugccacuccaauuuguguauguaauaaaauuauuuauauuaaaagugggaaauaauugucaacauuuuuuuugaguauagauuuauuagggguggcaaagaagagugcuaguuagcaguuuuccauguaaaguuguccuugacugauuuguccacaugucaguuguaacucccccacucccugcaaaaggaauuauuucuaacccagauguaucacuugaaacuuuuuagaagcaaaauaaucagggaaguuccuagaaagguguuuggcuuuuugguuuuugaggguugggguaaagaagacuucccccacaacugucagcacaaaacaggguauugauuuuuaacucugauguuucuauuggaguugaauacuaaauaaauaacuauaaugagggaaauacauuucuaauaaaauucccuacauucuagaaacaucccuguuuuaauuuuuuuaucuaaaucuuuuugugcuuuauguguaaagaaaaaaauguacugaguuacaaugcauuuuauuaacacuauguacauaauagcugcuuuguguucagaauaguagcaguugcuuuguauauuaaagugauccuugugaauuugugaaauauugucauaaagugcuuuuucuuacuguaaucuuugugguaucaacugucauaaugcucuuuuuacacaaacauuuaugugcagucacauaaacaugcuuuuaaaaacucuguaagucucuuuuuuggggaugggaucucuauauuuuguuggguuuuuuuugcuaguagugugaagccauguuuuauuggacuuaaaguuacaauauauuacaagcuuguguuggaaggcagcaaaacuaauucagacaacaacaugucuucaguuacuggaucccuaauuuucaggacaaaaccuguuuuucaauaagauugaacagugccuauuuguggauuuggagauguuacugucaagaugacuaauggagacauacgaccagcugugucugaugucauaaaacacguguucacugaaaggacaauaagacuauauaccuucucagguccccuugcaauucuaaaacucugugaucauauaaauuggaaggaaaggggaggggauaugguuaaucuuugcuuaagcuguaagaauaaaaaaguuaucuccuauacuauuaacuucugaaauaaguucugagacgagacaucugaaaauaagcagcugcauuauuuguauguuucuucacugccaagauguguucaagccugcuauaccugccauuguauuggaaggcuuaaugaauuucauuuauuuucugcaacaacgauuacagaauuuauugcacaaaaugagacauuuugagagugauauuaauuacaugagggacaauaggcaugaacuaggauuguucuaagcaaaucggaaucgggucacccugccacguucaggugcuuggaccuucaggaaaagauugcccaucuugucauuugaccaggcacugaagugacaagaccauccuugagaagucacauccaaagauaaaauucugauccauuucuaguuuuaguguuucgccacugaagacuuaacauaugucuuuuacacucagguugcaaaacacaggcccaagacaaacuuaacuucucccccaaaucuuccuuccgcugguuuuuccaucucguaaguggugccacuauccaucuguuaaauuguuuaggggaaaccuagaaaagcacuaccuuaaucaguguuauccuucuucuuaacugugcguccuaauuucuccacaucuuucuuaagugcagugaccaaaccggaugagaauucuaacacgggccugacaucaaauggaaaggaaggauaauguccaggaguuggaauguuauccuuguuuuuaauuaagaugcaauucacauaaauuaacuuuuuaagugaacaauuaagugguaguacauccacaaugguguacaaccaccacuucuaucuagcuccaaaacauucucaucacuccaaaaguaaagucccguuacucuccauuuucuccucccaccgcccuugucccuggcaaccaccaaucugcuuccuguuucuuuggauuuacauccggguauuucaugugagacucauacacugug

SEQ ID NO: 21339 - RNA, 83186 nt, Homo sapiens
guauauggaaacacaaauaacuuuaaugauuugugguaaaaaagaaggaagcuugaaucuaugauugaaaaauaaaaaauaauuacauguauaucuacacagaaaguacaaucacaaguuucaagagcuuaacacaaacuaacugcugucaaauauuuaacaaaagcaaagaugaaacugcuuaacagucagggaaaaacaacaaaaagaagggaggggugauaaaccaagaaaaugaaugacaaaaacuaagagaccucauaggugucuuuacaaucaggaauucagaugcaaggaacagacacaaaccugucuaaaaugugaccuaugaggcaacagaaagugacuuaaagucuguuauaaauaaaaaaugacaaccaaaauccuagagagucuuaaauuauuuaauccagacauuaucuaacgccucggauuuuuguuuggugcuaugguguucauuuucuaucagaaugaaaugugggacaaaugcauuacugguuguagagaguguuucagagcuaauucacccagcaaggucagggucaaaagguuauuauuuuguucauauauuucuugauaugaaaaaacaacaugucaaagaaagaauuaaagcaaaauguguuuucaaaugauaaacagaaucucaaacuuucaaguaagugcaucuuaagauguugaugaacuucagagauucucacuauuuuaaaacuagggauauucuauucugguaguuaucaaacuguccucuuuuguucaugaggaaccaaacuggcaagucucucagugucuccuuccccaagucuuuaauuuuauaaguauauucaaugucuaggaaggaauuauuaaagaauucugcuucuuaaaaaaauguuucaaaauaaucuaauguauccuugucgauucaugaaugagagcacccagagcagaguaaccuccccacaucuggccacucucaggugguauccugcccacucacuaaggccuugccuauuugauauuaguaagcccuccccauaccuacuucuauacuuacuguauggccuuuuguaugaucuggaaaaaaucuguuguaaaucaaguaaucaccaacuucugccuccaugccaaccuaaaaacuuuaaaaaaaaccuuuuccuuuuacaaaggaagaaauuaagaccuucaaaauuauuuuacaaauaccaacaagguuuaccagaagaagacugcuucuuaauuuaaaguaaugacguuggacugacaauuugcuagacuggucagaccuuuuaaaaaauacuaacauuaaaauguguuagagaaaaugcucuaaguauauauacacauguaguagauaaacagaguuacaaauugauaguuacaagcaaauguacagaauaaaaauauguaccaugagccuaguguugauuuuuaccacacacacaaaaaaaccaauguuaaugauuaaaucacaauuuccugaugauauacaagauaaaaaacagggaugaaaguguagaaacacacaacaaaguaaauuauuaagaaaagaaaugaacacaauauaggauaaagacaauugcagauaggagaauuuaacaccuaugguggcacauuuagaccaaauacucuuuuuucaauaaagccaaaauaaauuguuugauaauauucuguuuacuaaaaaaaaaaaaaaaaaaaaggcaaguuuuuucacugguggcagguauggagaauauuaaaagacucaaacaguaaugauaccacuugucuauuuaaccaagauucugguguccucauuaaucuuugauacccaauaaucugaauagaaagacaugauaaaucaaaaacaugccaauuuuaaaaagaaaaaccuuuaaaagcaaucccagcuucuaaaugguaaacauaacaugaauuccuaaucuggcauuagacuuuuuuuuuuuuuuugauucaaagacaaauaugaaugacucuaccuauuuguaaaaaugugaacauuaaaaacaguacaaugacugggcucucacaaaccgugcaaauucaauuugaaauguucaucugguauaauauucagcugucaagaggaagcaacucaaaggacaucacacagucuauaaaccagcucgaaggagccuuccagacuuugcccugccgaacccucucugggugauaauuacacaaaucuucauagaugauauacugugugcagaagcgcugaucagaaucgggucucgcaugguaugcgacuguauugauggucugagucacgucacugucuggcuugggcuuucuacugaggaucuggcccccaccugcagugacgagcuuaauaagguuguccuuuggaugguguuugaagguuccccacaaauagaaguagcauccaucaaacagcuuuggcaacugaaauaaugagaaaacauuuguuaaaggcagaucaaaauacuguauucaaaaacacuguauaugaaugaggaaaauaaaaauacaaguugaauaucccuuaccugaaacauuuggaggagaagcauuucagauucauaaauuuuuuggguuuuggaaaauuugcauauacaugagguaucuuaaggaugaggcucaagccuaaacacaaaauucguuuguuucuuguacaccuuaugcacauagccugaaguaauuuuauacaauaucuucaguaauuuugugcaugaaacaaaauuuugacuguguucugaccgugaccugucacaugaggucagguguggaauuuuccacuuguggcaucaugucaaagcucaaaaaguuuuggauuuuggagcauuuuagauguuggauuaggaaugcuccaucuguaacaauuaugagcagcuaagaagcuacuuaaugaggugcugggacaaguuauauuucaagcauacuaacuggaucaagaaaaauacuuaggcaaauaggggcuuccuauuuacaauuuuuucccuaagauucagucaccaucucgguuccuuuucacucuucuaaaauuuuagauaugcuugguauaaagaaaaaaacaaacuauucaucaaacuuuuuucaucaggauguuuaugcuuauuuggugggacuuaaagccuccacaacuccuagcuuauuugaaauaggcuucagagacaccaggcuaaacauuauuaaauuacaagaguaacaucuuuuccguggacuuuuauccaauucugcccauccacauucagguccuuacauauuaccaaccuaaggucuccagggcagccaccaugggggugugcccuccaggguuccagaaauguauucacggggcacaaaagauuuuugugcugaggcuagggauccaauuagcuaugaaacauacuuccguaugcucguuggaaauaaaaaaaguuucauaauucccuucuauggaaauuuucuuugugacuucuaauauacuuauauaauaucaacaggauaaugcgauauuauccauuaaagcuacaauauguggccauagagacauaugguaacuaaauccaagcagcagcuguaagucuucuuucaagcuacuuccuguaucugagauuuaccucagauucugaaagguuuauggcaauguucaagaugccaaaaauccauuaacaguaugaaauuauuaccuucuggauuuuacugcucaucgugaucaucuuucagaaucaagugcuugaaauaagcacaauuaaaauuuuaaucagucaccuguagcuguugaaagggcagaaguucuuccugauggugauaauaauaguaugucauaauaagaacaaugaaaguuguauuaaaagaaaaauaccagcuguucucuguugagccugcuucugcguggaccuucaggaauuucauacuuuucuuccuguucacauacuuuucuucguagacaugcuuuuaccccugacaaaaacacaagaauuaaagcaaacuaaguaucaagugagcacuauaucucucucauuaaaaucaagcaauuuaccuaagugguuuuucuucuucauggcaguuuuuaaguauuauucuaaaaugcaaacagaaaucuuacuuaugccaaaacaaaauguaauacaacugguuuucccauauaaagaaaauauuuuaaaaaacucuuucuuuggaggauuaagccauaaguuaguacugaacacuaacuguaauuuuaaucuccuuucugaaaaaccuaagccaggauacuauuucaaagacaaaaauaaaagucuacauuuccacucauagcaauuacccaaaauuaaggugaauaaaaaguccaugacacaauaaccuaaacugagcacuuaccaucuauacugcucauuuugacaguuauaugucuaaucgucuguuaaacuguaagugauuugacaugaaggaaugugcuuuagucuacagcaccaagcucagcuagccacacaacagggguucaacagcgcuuccuaaaauaaacaagcagagcuugggauagguuuggcaugugacagguacacaacugagguugcuagucuagagaugauuugauugggcuuugcaggaaaaaaaaaagcauucuuuugauggcuugaguaagucuguucacagcuucagguuaaaaagcaaaagcaauagagacagcucagccuggcacuguuuagagucauuccacugcuuggcaccuggguggggaaucccuaaguagggccacuggcuggcagccaguaccaauugucucgcuaggcucuagaaaugaaaggaacccuugggauucccaggaccaaucaugaaggacauggucagcuucagcuagagacaacaucuuggauaaugccuguuuaccaccaagcgagggaacugauggcauguauauauauuuaucaugcuucuguucugauggcauauaacuaaacuaaauuugagauuugcaguugaaggacuuggcuaucccaauuacuuguucuggaagcuuccuugccuauggaaauaaaaaaugaaaacaauguuuuucaccgggcuucuguggauaaaaugcaagaagcauucuaaaaacuagauacuacaaugaauuaucuucaucauaaaaacaaacccuccauacaauuuccuauuugucuuugagguuguuuugcucaauacuucauuuuaucacugaggguaggaaccauauauuauucaccuaugcguucuucagaauuucauacacuuucccauagaacaggaguuuaauagcagaggguaucgggaaaguuggaacaauaacucagguauccccuucacugucuaguguuguuaacauaaaggaacaaaaguuuuuaaaaauucacuauggacacagcauugacagauuguauccacaucaauaaaaauaaguaauuauauagcaccuguaagaguucagaguuacacauaguuuugaauaucaaacuguuacauccuguuaucacuugauaucuaauggcuuaaaaugaucagaaaaaaaucuauggcugcauaaacauauacuuuauauugaggauuagacauauauguuggauauacuacaguguuuuggaaaccucuugaaaaaugcuagugauaaaguuuuguccagcugaucccuacuuacuucaacaguaaauugauuccaacacaggagcagaaccacuacucggcauguaaacugcauaugccugcaaaagggcuccuuucuugacuaaaggguggcuaagaaccaacaguuaaucugcuacccagaacuguccugcgauugcaucuaauauaaauuaagauucaguuguguaugaguaaaaugucuuuugaccuaugaugauuuuuuuuucuuuuuuuuuuuuuucugagacagagucuugcacugucacccagguuggggcgcaguggcgcaaucucggcucacugcaagcuccgccuccuggguucacaccuuucuccugccucagccucccaaguagcugggacuacaggcgcccgccaccaugucuggcuaauuuuuuguacuuuuaguagagacaggcuuucaucgcguuagccaggauggucucgaucuccugaccucgugaucugcacaccucagccucccaaagugcugggauuacaggcgugaaccaccacaccuugcugaccuauaaugauuaucuugagagcaaaaacuuauacuggagaagaaaaagaaaugcaauguuuuccaagagugaguaaugguccacuuuagacuaacucagacuuuauggcauaaucgguuuuaaacuuucuucuuuauuaccccacacugacacaauaacaaaacuucaacuguuuccaggagccacaucugcagaauuuggaguaagcgacagaacugaaaaaacugguacuuucugagggaaaaaaaauguguuugaguccucuuuauaaaauguuuuauuuauucuaaucuuguaacuugaauuuugaaaauaccuagaaucaaauaacuuacgagguagaaaagacccugaagagcuaguccuaccuucuuguuuuaaagaucugcacagucaagugcagaaacauaaagugacuugcuaagaucacuaauagcaaaguuaaagugaaccacuuccuaaagcaacagacuuccacuucggcgcucuuccuauaucauauuuauaggccaaguaucccuuaucugaaguguuugaaaccacaaguguuuuaaaauucaauuuuguuuuggauuuuggaauauuugcacguacauaauuagguauaucuuggcaacaagacccaagucuaaaaaagaaauucauuuauguuucauauacgcuuuauacagauaaagcauauaugaagauaauuuuauauacuaucuuuaauaauuuugugcauaaaguugugucugcguuuagacugugagccaucauguuaggucguguguguugugcuggcacucaaauaguuuaguauuuuacagcauuuuggauuuucagauuaggaaugcucaaacuguguuaaacaccuaucauguacaagagaagucauaaucucuucccuaagaagaaaauuccugcuguuuccugucacuuuauuucaauaaucuaauccugaacuuucauuaauauuguaugcucuaucucagagugcuuaauuuuaaaugaaauuuuauugcuuuauuuuccucugucaacaagcaauccacuaucaaauuuaauuuuucaagcacauuuaaaauuacauccauguuuuaaagauauuaaggaugccacugagauaaucucaaucaugguauaucuaauaacaagaaaacucccuacucuuguccagaaauccuaagaacuucacauuacguaaacuucuguuacaaagucagugaaagaaaaaagguuaauagcuuauacauagacaaacaugagaagauucguuuuucagauucagcuuuucccucuuuuccuacuuaaaauggcuaaccuuucaaagaauaacaaaugugggagcagauuugcuugccagaaagauaauaaaauauucuuuuauauuuugcauguauuucaauguuaaaagcaaagauaauagguuuuuugaauaaaauguuugaaugcaaaguuguuucugaaaauaauggaggaccaauauauuuuaaauauuaaaaaaauaugcuggaaguauuaaugauuuacauguauuagugaagugguauucaaaaauacuaauaaagcaggaaauaauacacagccagaguuuuagccauuuauagcucuuguuaaacaaauacgaaaucacaauauuaaauauggaaagaaaaaguagaacaucauuaagaaaauauggaauaaguuguuccauuguuacuucucuggguuuaaauugaguagaaccugaguagaauuuauuugauuguauauaaguuuauuuuacaccuguaaauacuaucagacagaacucucuucuuauaaauuaauagagaaccaugagagcaguaucauuuuauaaaaacuaugaaugcuauguuaccuaauauucauccaaugagcaaaauacuuuacuauagauugaacguguacauugugcagugcucugaaaacuuuaauuuuuccacaaucuagaauaaaauacucauaaaucauaaggccuaaccaauccaaugcuaaaaaucacacaccaauauuuucuggucaaaggagaaaaagaaaauucuuaaaauaccaauuuauucuauucuguuuucuuuuuacuuuucuaacuuuaaaugaccaaggacacaacuguuuguucuaagaaaagauccugaucaaaauuacugugauaacagcuaccaaaaguacuuguauccuuccccaaauccagcaagaguaguauagucaaugcucauuaucuacaguaguuauguucuauaaagaugcuaugaacaccgauuagugaauaaugaaacacugcuguuaaaggaaauacaggguuacauuucugugggccuguggcuccagcauuuccaucaacugaucaauacuuaacuuuguuuuauguauguuucuguuuauacacauuauuuauuguauacuguugacucauuaagauuaaacuuagggccagcaguacuacaauuaaggccuuaacaaagcuuauccuacacaguauuuaauauuuucccugaaaggcacaucaccaucuucuugagcuuagacucacaaaacagcacuucagcacuguauuaugaggccauuuuaaauaauaaaaucagcaacaaaaacacaaaaaugcaaaaaacauggcaucaacagacugugaaagggccacuuguuuacagcgugagagcugaaaagaggagguaaaguaucaccuuguuugaccucagcuggggacacacuuguuugucaacuaaaguucuucacuacucuguacaugucuacaaaagcacugugaguauugauuuggggauuacaagaaaaauuuuagcaaguaagaaaacucacaaacacagaauccacaaacaaugaggauuuacuguuuauuacuuccaauucaggggagggaacugaaaugcuaagaagucaacuugcuuaaagcugaaugcagccauuaaguggcagaaugggaauuugaaccuaaaucugcuuaguuuucuaaaggcuguguauuucacacugaaauauaacuuagugguacacaagauaaaccuuggguauuaucuuagcaugaugugaauaugucaaaugcuuaaaagcugcuuaaauugaguguucuaagauguuguuuauuauaaaaaggucagaagacuaacaacugaauacuccaucucuccaaaagcagagguuugucaagacgcugagucuuuccugaauugggucauuaaugcaaauucaaauucaacacucacacucaggacgucuaugauuacccaucaugucaaucuuaauuuguuaguuuuaucuguguuuuauuuggcucucagaucucucucccccauuuuuuuaauaugaaagucauauucacccaagguugcuaagcugaauuuccgaaucuuauaauuuuaaauuaucauaaaugugcuuugaaaauuguuuacauauaauaaaaauuauacucuaaaaaaggcauaaauuuuaauaaccacucacugaauuaaaaaccuuucuaauaaagguaauauaaauauuaauuuuauuauacauugaaaaugagacucaaaauucuugacugggucaaaauaccauacuagaagcacugccagugugcuggaauuaugucauauauuguuucuauauuaaaaaucaaauaaaaaaccaucaggaauccagugaaaugguuaacucaaauucacuauuuuauaugugauuuuuuuauuuuccucauuacguaagcagguauuccccuucccaaaucuccuucccaaugguacuuacagaguauucauaauuguaucuuuaacugcauaugguggcacagaaagccaaggacugaacauucuuaugauaucuacuguaucgaaugaauggcuaaugucuaauugcagaauuaaguaggcugugcuugugccagcugcuucuccauuuuauggguuuauuugacugauuauuuacaagaaacacauuaaaauggcaucuauuccuccugaaaacaugcuggcauuagucaaucaacagaauuuaaccuuaauagauacuacaguccaguaaguauggcaucaaaaaaaugagauggcagauaccaacagagcagcaugguacuuccaugagaaggagccaguguaagucuuaauucauuaaauauucuguuucaugggaguuauguaguaaguuucuguaaaguaaagcaaauccaaugcucuaguuacaaugauugaguuaaacaaauacauuucucuaauaugcuuuuacuccaagcaacaauuugcagaauccugugucaccuaagacuaacuaaggaagaaugaaaguagcucuuuuucuuuuccugaaaagaaaggauguuuccaggucuacaacuacauuugaaggguggcaaaguguuuuguuaaaguugcuguuauagcauagaaaaucucuagaauuuuuucaaagcugggagugacaacuacuucaaggauugcgacucaaaugccuacaaaagccagguagauuacauaaaugugugaagaaccuggugugaggugguaggaagcuauggagacuguaacaaacaucaugccuaaauauauaaaaauuaauuauguuagacaaaaccagacacuguauuuccuucagcccucagaguccucagccugccgauuugaaacuuuugaugcuuugucuaaucaaccucuuuuauagauaaggaaacuuaagucccaagagauuuaaguggcuuucucagugacauaacugagaugagaacugaaauauccuccaugucacagaucaaguuuuuuuguucaucuuuauuuuuaguuggaucaaugugcuuacucaauccgacaugcuaagguugccacugucuaacuuguuaucugaaacugugaguuucagaaugaugaccuacuccggagacaauaccacaguuacaaauucauaucaacuuccuacugaaccuuuuuuuaagacaaaucaauugaguugauuuacugaaaaguaaauaagaaugaaaugcuuuaaaauaaacuuucagcaauucaaauggugauacauuaucaaugcacuggaagaaucuaccagccaaacauuacuuaauuaacccaagccuaaauaaugacuaacauuuuaagguuuuauuuacugaauaaaaguuaagcaaucugcagcaagaauucuuaaccuauuuuccauuuaaaacacaguuacauuuuaagauuuaaacuauuuuauauuuguaauaaacaguuaauaaaguccauaauuauuccaucaguuuaguagaaagaugaacucuucuacuuccuuuugaagaaaaaaaaagcaaaaauacaaauauaagaccacauuuuaguuagcuuucuuggcuaauaauuuccuuacuaaaauuaccuugcaugaguaaguuuacguaaacauaacuuuugcauaugccagaaugauacauacuugaaaaugugucaagccacuaaccuuauaaaauguaugcuuuauuucaucuuuguuacuuuucauauguuccuuuauaguugaagguuuugacugaagcuaucacuucgcagaaacaaacggaugaacuacuuagcuauuacaacuagagauucuuuuagcccagguguauuccugaucauguucuccauuucauguaagcuuuccuuuuuuccugagaucuuauuaauuuuuuacauauagguaagcagccccauuucuaaaguacugauuaacccaaagucauuaagguagcucugucuaccuuagcaaagccuggaauuuuugcauaauaaugacgcuuaugaauuccagggcuacaacacuuuucuauaaagaaacuuguacuguacagaagguauuuuuuuauucuaaauugcuaauaaccacucucuccuccuaccucauaaaagcauauacaucaguagauguauauuucuguuuuagcugcauggaccacugaugauggucaugguuuuauauuaagcuuacauuuccuauaauaaaaaaagauaacacaaaugcaaggaaauuaaaaaaaggagggguguuccugaauccacaguuauacaaaaaugaugagagaauacaaugaagauggaagaaaacuucaaaauggagaucuguuaaauguccaaaggaggagacgauuauuaacucugcauggaaagccauacuuagaauuuucucacucuucaaaucccagaguaguaaacagauccacauuuuaaagaauuuuuaggccagaccugguggcucgcacuuguaaugcuagcacucugggagggugaagcaggaagaccgcuugaaacaaggaguucaagaacagccugggcaacaaagugagaucucugccucaacuaaaaagaaaaaaaaaauuagccaggcaugguggugagugccuguaguuccagcuacucaggaggcugaagcaggaggaucacuugaacccaggaguucauggcugcaaagagcuaugauugcaccacugcaguccagccugugugacagagugagggaggggaaaaaaggguuguuauuauucuggaauuaauggcuauuuguaacugaaauagcuaugggaaucagaauuaaccacuuuuagucaauacaaaauauccuaaaaaaaaaaaauuaaaauacagaaucaaacaucacuauucuauaugaaaacaaauguucuacuacaguaugucauuagaucuaaacuaaagauguuuaaauuagggaugugugucacucaagauaacaguauguaaguaaaauaaaaauuaaagaauuuccuuugauucuauuaaaaaucaacacccagauuguaaaagcaaaacaaguguuuugcaaaugauuauauuuuagacuuuuuagucgaguaaacuauaacagcacuaaacuuuaguaaaaagggacaucacaauaggcagccuacaacaaugacaaaaaugaaaaaacaguagcauacuaucacugcaauuuuuggaaaacuuaaguaaaagaacagagaaaugaguuugaaauuugaaacuuccauagcgaaaagugaaaggacaaugaaauaaaggcugaaaauauaaaauaaaggcuaaauguuuccauuuaagauuugagauaucucauuaaauacugucgacagucauuaaauucuggcuccauauaaauaucauuuagcaauuauuuauuuuugacauuuuaguaaaaauucuggcuaucagcauauuuauauguagaaauauauuucuucacauuacaagauguguaauuugcuauuuuacuuaaugcauugagaagcagguuaaauucuauugcaaaaauauauuauuauaucauaaauuuuucuuagacaaaacuuggguaucaauucuaagaccuuguauuaugcauaauaauaucaaaauaucaaaauagucuaucucuuguauuaugaauaauaucaaaauugucugucucuauauagguaugguuaaaaaccgaacacagucuaacguccaaaaauucuccuaauuauuagaaaacucaugcucaguguucuuuugaagucauauauuaaaaguucaaauuuuuauguaaaaaauucuguucugauuaggacaaucaccauauucaaauguauuugcuggguauccauuaaacagguauaaaagaccuguuguaucagaugggaggaauaaauacaugcagguucuaauuucccuaauuaagaccaaagcccuucccuauccaauuaaucguuagaaaagugaaaauacuuccaauuauuauuacaacuugaaaauuucaacguauuaauuuauuccuagagaacuuaaauuugaucuaacaggcacacacuauuuuuaaaacuguuauaaacaaauaguccucuucaguaacccaccaauuuacugcucuuugauuauuuuuuuacccacaugcaugcauacauuuauauauuguugaaagugaagauauaauuuugauguguuuaaaauuuaaacaauucuauuuuucauaaucuuuuagucuuaauauuuaucauauuaaaaauaugcauuuuuuccagagaguaucuucaggcauuucagaauuuuccuaaucuuucauauguagguuauauucucuacuucuugcuguuagaaguaacacugcaaauacuuuuucuuucaucuguauuucuugcguaggguaaauucucagaacugggacuauuagaucaaaggauguuauuuuuuuuuauucuuagacaaucuuugguggaagccuucugucagcauaaaguugccuaaucaaucuuaauuuauacgaauguuuuuuuuuaaauaauuagcaaagucuguauagaauaaaaguugcauuuaauuuuaaaauuccauaguacucucaguauccauuuaaagaagccaacuuguuagaauuuguuugaaaagaauuaauguguuagccugauuaugagguuauuuauuaaaugaugauguaaugauugucuucuaggguccaucucuccucagcuaaaacaaaaaugaaaaaacacucaauuuagcccuuccccaucucacagacauaaauccaguguaaaaugucuggcacauuccuucaguaauucccuuagguacuggggaauuuuacaacuucuacagcugcaauuuuauuuaaacuuagaugagaguggggaagagggaaagauuauuaaagaaaagaugacagccaucuguucuccccuucauaaugagauaagaaaagaagauguagaauuaaauuuauuuuagaaaaaaaggcuaagauacaaaaaaauuuugaaagcaguguacuaaaagaauaggucaguagaaaacauuuuaucuuggccuaguuugcaucuuuaggauacaguuucaucuuauucauacucuaugagauucguaagaugacuuauuuauauaccuucuauucuuucauucuuaucaccucuuuaaugccaaaaucaaccuuguaugaggguggugcuaauggccugugagaaauuagcacccagacuaggacuaaaguagagucucccucaccauuuugauguugaaggagggacuuuucuuaucuauagcuccuauuucuguaaaauauaaaauaaguaucauucuguaaaauaucuguaaaagaaauauaagauagacuggauggucuguaaaauuauggcuuagucucagaauccucaugcuaaguucauuaauuauggcacuguaagauacucuguauaaacaauguaggaaaauaagagauauuaaccaauuaagacagaacacuucaacagaaaacuucucauaguuaaauuuggacccaauggauccaaaucuuuuguauaauucuuuuuguuaaaugguuuaguuuauaaaauguguugauuaucuauagagaaaauuacaaauaaaauucuacuugaaucuauuugguuuaugagaaaucccaugaaaaguuaauaugaaaguuuccuaauaguuaauccugaaguuuugucuaccagcaaguuaauggacagacucaaacaugagaccuaguuuuaaaaagucauaaaucuuuaaaauuaauuuugaaagcuuugguccaccuaucaucuuuuaauaugaaugguuuucaaauaguuuuaaauagcucugaaacauuuuuaaaaaucaaacugagccaggugcagugaugugcacccguaguaccagcuacucagaaggcugaagcuggaggauugcuugagugacaccucaucucuuaaaaaacaaacaaagaaucaaacugagaugcuugacacugagaacaguauagaaacuaugagaaauauauauuaggaaagaacuauuugaagguucuugccuucuuuuuguaaacccagugacuauuuaaaggaaguaucucaaacuuugaaucuguuucucuuuguacucuauauuagaaaauaugacgauaugaacuucaguaagggauuccauccauccuuuauccuaaaagaaccauugauauuagaggauguuauucacuacugucagaaucaccaaauagcacacuauuaaguuaguccgaguccaucagugguucuauaaaaacgacacggccaagauauuaaagugacaaaacccacauuucccaaagaaggcauauuuuauggaaauaaaucauguagccuguauauguaaccaaaugccacuucagcauauucacaagaacuagacucaaaaguuaagugguaaaugucuuaacauucaaaauuucguauggcuucuuuauuacugcgaccuuacuaugaugaaaaucuauuucuccuuauaaccacuggaaagguuucuggcacagguuugauacaaaagcaucccuaaucaugaaaccauuuuaaaugaauuuuuuaaacacugaggcucaauaagacuuucacagauuuaaaaggaaaaagaaaguucaaaacuaagugagacaaauuaguccaauuacuuauacuucucaaacucaucauaacuaggagggacuaauuaauagggauugaugagaacagauggaguggcauugcuagucacagccucuuagcuggaucagacugcauugguugagacaagcaucacaaaaaaagaagugguagcuguauuugaaaaugacaugaauaccaauugaugaaaggaaacuguuuuacaaaccaaaucaacuucuaacuacagauuaaauuaauaacauaauuaagaucuugauaaaucaggcauucuaccauaaaaccuucaaagcacaaagccauaaaaccauuuuuauaaacuaauuuuaauccaucaguugcuucauaaagaguuucaauaaauauacccacuguucuuucuuaacaucuuauuuaaaaauaauuauagucacaggaaguuucaaaggaauguacagagaugucccacguacuuuuccuucaguguccaauguuaacaucuaacaccgcuauaacauaauaccaacaaauugaguucaauacgauccauagagcuuauucagauuucacuaguuauuuauuuuuuuuugagauggaguuucacucuguugcccaggcuggagugcaguggcgccaucucggcucacugcaaccuccaccucccggggucaagugauucuccugccucagccucccaaguggcugggauuacaggcaugugccaccacgccuggcucauuuuucuauuuuuaguacagaaggggguuugccauguuggccuggcuggucugccugccucggucgcccaaagugcuaagauuacaggcaugagcuaccgugccuggccugauuucacugguuauaaaugcacuuguuugcauaauuuuaucucagguagucuuguguuacauggccaccacuaacaucaagauacgcaacuguauugcuccccacauuccuccucuguaaccacuaaucuuuuguaacuacuaaucuuuuguaaacaauuaauaaacaaaaaaaggucaauccacuguucuauguuagccauaguaucaaaaguagauauguuaacuauuaaggaguagaaaauaaucguguaugagcuuucuuuucauuuuaagucccaagagaauccaaguagaaauguaaaugagugacagcagggaaggugacaggcagcucugaaggugaugguggguugacuaucagcaagaagaggggaacagguauacauuuucaguggagguugagauagcugguauagugacuccaacuaaaguaguaaaaggcagucaauuucccaacagcuuccuaaaaauacuggauuaaauuaacuaagaccaaaaggguguuaugcagguaaucauaaaggaaaagcaauaaauugcuuucauuucacagacaugucaugcaguauauuuaaaacauguguuauuaaauucaauauaucauuuaacaguaacaugaaucgcuuaggcuuaaaaguauacuauguacuccauuuacuuuucauugaaauaguugguauuguaggaaaaaagacuuuaaaaccagaacauauguauauacauuuacuaaggacaucuaaaugacaccauaaauaugagaagcuuuuucuuuuuuucuuuuuuuugagacagagucucauucuguugcccaggcuggagugcaguggcaccaucuuggcucacugcaagcuccaccucccagguucacgccauucuccugccuuagccucccaaguagcugggacuacaggcgcccgccaccacgcccggcuaauuuuuuuguauuuuuaguagagacagggcuucaccguguuagccaggaugaucucgaucuccuggccuugugauccgcccaccugggccucccaaagugcugggauuacaggcuugagccaccacgcccagccagaagcuuuuccaaaaugcagugacuaaccagagguaagaaaauuaacaucaaguuccuuaaucacaggcauuaauaaccaugaaaaacaaaacuagucuaauucauuucuuaauucucucaaauccaacacuuacauucaaauuuuagaauccagcauccauugagaaucccaagcauacacuucaagguacuuugaacugcaucaccaggaacaacaacaugaguuacuaaaauacaaaaaaagcaguaagagaaagaaagauacaagccaaaguauuucuuuggccugcuucuuauaacucaucuauauuuuguaagcuuauaucugaaucuucaaaggcaacaauuuuuacacuuaaguguaagacuacuucuauuuaguaucuaguucucuaaccuggccaucaauaugaaaaaucagaucauaaaccauauaucuuaaagccauauuggcaaacacaaauuuuuauuuucaaauuacagcuaagggauuaugacauuacacugcacaacaauuuauuugucacuagcaaaagucacaaauuugcucuucugaaauacugucuuguccuaaaauauaugcaaaccuuuaaacuuuacauuuccuaacuacguuguugucuauaaguaguuuauuacugaaaaaaaauuuagauguauuacaagaugcaaaguauacagccaucucccaaugguuaaaacauauguaaauuaucaaagguaguucuccaaaaggaucaucuauuuaacauuuuuucuaccccaccucccaaaauucaaaauccucaccuguacugucaaacucaguauauuuuuuagccuuaagaauuacugcaagcucacugagcauuuucuguuguucugaagacagcccacugccuauaaguacaagagguccaucccuacgcugcccaguguucaucuguuaauauaaaaggagauaccaguguuaaaaacauuagacgacuagacaaagacauuaaacagacuguuacuugauauaagcuugaauuucauuacuuaguuuacucuaauaauuuucaauuauuuccauugaaucuacacccagaaccuuuuaaauaaauuuuuucucuuuauuuuucccucaagaaaaugucaauugugauagcucucuauacccagggcaucucauuucuucaauuuuaaauugggucucucuaggguuuuacuucauucagucaccaguaagucuuuuucuuuucccaaguaacuuaaaauauccacuuaaaaucagcaauucccuauuccaccuccacuaacuugucccaauagaguuaaaaucaaacuuguuuaguuuaaacugagauuaucugaaaaaucaaagaaugccaaggcuucuagaacagugcugaccucaaagauagaaaacaaauuagcaucaaaauaguaaccccucaaaacuaggaaaagauaaaaacagacaaguuaauucaaaacuuaggagaucagauccauaaauaguaagaaguccauauagcucacgacuaagaaagaagugcuguaacaaagacuaauaguuucacuuuaaaaucuagacuuagaauucacagaagacaaaaaagacaaaaauaaagagaagguaagaguggacagcauuaaagcugagaagugaaagacuccaggaaacaauauauguccauauauauauauauuuccauaaaaguguuuguaaaugacagaauucagcacuuaaaaguucagcucaucuuuccuagucacuaaauuguaagaugauguaaccacaucuaaccuaaacgcuauaaacccuccucacauagaccuaaaaccauuaaaaacccuagaagaaaacguaggcaauaccauucaggacauaggcaugggcaaggacuucaugucuaaaacaccaaaagcaauggcaacaaaagccaaaauugacaaaugggaucucauuaaacuaaagagcuucugcacagcaaaagaaacuaccaucagagugaacaggcaaccuacagaaugggagaaaauuuuugcaaccuacucaucugacaaagggcuaauauccaggaucuacaaugaacucaaacaaauuuacaagaaaaaaacaaacaaccccaucaacaagugggcgaaggauaugaacagacacuucucaaaagaagacauuuaugcagccaaaaaacacaugaaaaaaugcucaucaucacuggccaucagagaaaugcaaaucaaaaccacagugagauaccaucucacacuaguuagaauggcuaucauuaaaaagucaggaaacaacagguguuggagaggauguggagaaauaggaacacuuuuacacuguuagugggacuguaaacuaguucaaccuuuguggaagucaguguggcgauuccucagggaucuagaacuggaaauaccauuugacccagccaucccauuacuggguauauacccaaaggauuauaaaucgugcugcuauaaagacacaugcacacguauguuuacugcggcacuauucacaauagcaaagacuuggaaccaacccaaauguccaacaacgauagacuggauuaagaaaauguggcacauauauaccauggaauacuaugcagccauaaaaaaggaugaguucauguccuuuguagggacauggaugaaacuggaaaccaucauucucagcaaacuauugcaaggauaaaaaaccaaacaccgcauguucucacucauaggugggaauugaacaaugagaacacauggacacaggaaggggaacaucacacucuggggacuguugugggguggggggaggggggagggauagcauuaggagauauaccuaaugcuaaaugacgaguuaaugggugcagcacaccaacaugacacauguauacauauguaacaaaccugcacguugugcacauguacccuaaaacuuaaaguauaauaauaauaaaauaaaauaaaauaaaauaaaaaauaaaaaaauuaaaaaaggaaaauauucaguguacuuuauggauuguucaauuacucuuugauaauauuuaaaaacacuacaguauuucaaaaauucuuaaguuacacaaauaccauaaaaauagcucuaaacagaacacauuacuucucaauuuauauaacuccacuucagcuacauuaguucucugcacaaaacacaagagugaaaaagauaucauuucuaaauauagcauaugauacuauuucuaccaacccaaggaaagcaccaaagugggucaaguauuuuccuaucauacuuuuaaaaauuugcauaaaaaauagaaacuggcacuaauuucucacaguuaaagagugcuauaauaaaacauaaagcaaacagcugccaaagccacaugucugauuuggggugagguggcaugggggcuggggauuugacuugaauaagcauaggucucugacccaugaggcucaaaagagguacaaaaaacaccccaaagguuuaauacccugauuuuauagagauuagauacuauguucauuagcauuaaauucaaaggaauaauuaaauaggguacuuuuucuuagauaaaaucauuaguuuuucuuaaguucaucaaaaaugggguuaaaaaaucuagaaaaaaaauuaaaaagguaaacaugcugcuuaaaaugaaucacaaacagagaagucucaaaaugaaugaaugauaaggaguuuuuuaaauuuuuaaaagauuagagguugcuucucaaagcagauuuccaacagccacuaaauuuuacuuaaaacauaaaaauucuaaagagaaaggagagaaauucaaaccccuuccuuuagggaagcagugagcugcuucccuaaagcagcucacuggagaucacugauuuaaaggguucccaaugacgcuaccaagcacuugugcuuguuucagaggcaaguauguaucauaaagaauacucuaauguuccuucaugcauucagcacacacugaacacucaguaugugccaaacacuguucucaaugcuagggcuacuauaguaaacagaagagccagccccugcccucacacaguuuauauucuaguugagaggggaaaacaacacaagaaaauaaaaauacauuacaucaaaugagaaauaguaugguacaacacaccaggggaaggggguuagacagcacugggagguugcuauuuacugugcaguggcacagagcccucucugcuaagacgaugcuagagcugggucugaagggugugaggaagcuggccaugggaacaucuaguuccuggaaaaaaaaaaaaaaacuaaacaaguggugcugcacaccugaaaugagaguauguuugguggacucaagacacaguaaggcagcccaugugacugaaaaagagugagugaagaagagacugguaguggcugggggaagguauauuccagagguuccaucuuuaaggacugcacauuaagaaacuacccuuuaaaccugaaggacuugauauuaucuuuuccuuagccaaguaccaaccauuaagacaguaaauaguaaaacucaaaaggccaugucuacaugacaugcccaaaguauaggucucuuccauguaauaaaaacccuccuuuucugaaaggcacugccacccccagacuccaagaauaccauaaagauaucuuuauucuugacacauuuaaaguaaucauuuuccagcuuuuacauaaaaggaacaucagcaaaggacaacuugguuaugcuaugcucugucagacuucaaguacaaaugaagaaaacaagucaauuuauaguugcugaguacggugggacugaauugaguaccgaccuaaguuuuaagaaaugugaguuuuaacugguccauuaauaaagaaaaaaacaaccuuuuuuuuuuuuuaauggcugguuaacccuggggcaaaucauagccucuuuaggucucacuuuucucauuuguaaagugagaaaauuaaacugcugauuucuagcuucucuuccaauucauuaccaaaacuauaguuuggaacagauuuauaaggcugaagucuaaagcagaagacauaggguuuucaagauaugaaagcaacuagcucaugaaagcaucuaugagaguaucaaacuguagcuaccuuaggcuaccuccuuaucuuaaacaauggcaucuacuacuacucuugugaaugauccuugaccucagcuccucccuuucuguuacuuucccccaucugagcaguacugggaucuggugagucuaccaacucucucuaaaacucuucuucuucucuccauccccacauaacuaccaucuauaauuccaguccucagcauuucaaaccuggucuccacuacugcagccucccaaucagccuucagucucuuccuacucccagcuagccugcagacaguccuauuucaguuauaaacacacugaagguacccuauuaagucuaaacucguaucagggaauuuaaggcuuuucacaaucuggucccaaccuaacccuuuacccugaaucccucuuaaacacacgucauacuccucucacaguaaaugcuauaguuucucaaauuccuaagguccuuuaugccuccuugucucugagcagcuguuccuuagauuugggcugccauucucacuuuguacaccugacugcaguggggaauguuggcuguuacacucaaaaucuauugcucacuuccuccacacuaacagaagcccaguuuuguucagguagccccccuuucaaagacugacccuaaccuccagccccaggaggggcugucaaaaucaauuucugacaauaagacacaggggaaguccacggaaaggcuucagggaaagacuuuagugucucuuuuucaguuggccacugucauaucuagaauuguggcaaucauucgacaaccauuaaaggaaacuucuuagugaggacaaaucccccaaacugaggauggcaagguaaagagauacaaagaauuugguuccuugaugcaaccacuaagugcuaaauuaagcaaaugcagagcuauccugcauugggauuaauucuauauaaaguaauaaauugucuucaagcauuugagaaaagguuuucuguuacuggcagccaacagcauucuauuagacacucugcuaaaauguuuacccugaaagacuuaggacaccuuucucugugaaauucuguguguguguguguguguguguguguguguguguguguauauauauauauauauauauauauauauauauauuuuuuuuuuuuuuuuuuuuuuuuuugagacagucuuguucuguuacccaggauggaaugcaguggccugaucucggcucacugcaaccuuuacuucccggguucaaucaauuaucgugccucagucucccuaguagcugggacuacagacgcauaccgccacacucagcuaauuuuuguauuuuucauagagaugggaugggguuucaccauguugaccaagcaggucucagacuccugaccucaagugauccacccgccccagccucccaaagugcugggauuacaggugcgauccacugcaccuggccuuucugugaaauuuuuccugacaucuccuguaguuucuacuuacuuugauucuacuguauauuuuuauagcuuauuuuacaaauuuauuacaauguacaguaaaaguuuuuauaucugaaaucccugcuaagcuauggguuccuaagaaacaggcauucuuuccacuuuaucucuagcuuguaccucucuccuaagcuccagacuuucauauccaauuaucuauucgauaucuccauuucauguuuuacagacaucaaauuggcacauagaacuauugauuuccuucuccauggcaacaaauggcauuaccaucuauuucccugcuaaggucauacuuauuccauucuuuucccacacuucauauguaaucuauccgaaagucccguuuugaugcucgcuagucuccagcaauaacaaacuucuuucuaaccuuccaacauaccagccucauucacugaagggccuauacacuguguccuccagauagucaccuggcagccuccucacuucaacauucaggcuucaauucaaaucagugcuuuaaggcuccacucugugacccuagcuaaagcaauggccuugcagaagcccacuaccuccacccaacgacacucuacaacaucuucgaaacacucaugucuaagugucugaaauuauuuuauuuauauuaguucaauauuuacaguuugucucuuuccuaccucucaccagaugguaagcuccucccugagaauaagaguucuaccagucauauucauuguuuuaugaaugcugccuaaaauacagagugggcucaauaaguauuucuagauggucguacugugauuaugucuuugaauccacaguagcuaauacucaggaagugcucaauaauuguuuggugaauguaagcaauuggucaaauggaaauuuuucuauuauguuccuuucauaaccaauuuuaauaaaauauauaaaugucccaaagcuaaauccauacuuacuacugagcaguggcuagcugaggaugauucauucuucucugguagcagcaauagcgauuucauacuuucaucaucuguauaaucgacaggccgcagaccaaauauauuacugguaaaauaagugcagauguguuuaaguaagucaaaugugugacucgacucaauuuuucaacauccuuaauaauauacaauuuuaacuaaaauaaauuacucagaacucauauuaggcagaagaaucuagaaucaaaagcugcugaacucaaaggagaaaugauguaaaauuucaguuugacaucagauuauagggauuguuuuuacugaauauaguauuaugaauuuuucacaacuguauucugcauucuuauucauauuaaaauauggcuucauaaucaccaaucacuauaagugacagacuuucaaaugccaauaaaaaucauuuacuauagcuauuauaggccauauagucuuuauaaaccaauaaaaaauuagauaaauucacaggacagggauuuuguucuacuagaaggaaaauuaugccacauaacaaacaguuuaauaauauaguuaacaggguacuuuaaaaauuaauuuaaacaugugugcauacaauaaccuauaauaaucacaaccaucgcagaacaaaguauuauggcucagagagauacaaacuucucagcauguacuaauucacaagucacagaauguuacgcuggaagagauuuuagagaucccaguuugauccuguucaagauaagaaaaaaaagagagaagaacaaguuccaauggcuuaacuaaggucauauucuccuuguucaauuucacugaaauuaaauauugcccagccuaaagucuuucaauuauaaguaacuuguuaaaacuaaaggacuucugucuacuauucuguuuccuuacauaugguuucagaauaugauuuaaauacacuauaccauggcaagaaguuuucaaaaugagcaauucuuuuauagucuucuauguuuuuuuuaaagauuaugcuauauucauauaauggccacagaaguccaugugaaaauccaaugcaguaaaugggacaugaaguuauaaacaugguauaauacuaauucuguaaauuguaucaaauguauagaaaaagaucuggaaggaaacagagagaaacauuaggggaagugaaagguagaaaaaugccaauuccguuugaugcugcagagagagaucauguagaugagggauauaagcaucuacugaguucacagacaaggucacuaaugaccuuggugaaaacuguuuugauggcagagugggaaaagaaagcuaauguauuagaauaagaaaugaaccacagcaaauguuucucuaaugacugcaauucgugacuaucagguccaauugcuuucuucuuuggacaguccuggguaaacacugacaaguuuguauucugacucuucuuuauguccaaguccaacaaccuuccucuggcaacagucuuucuccagccaagauauaauacagcggauugcauuucagcuuuauaauuuaaaacaaagugacacaugucacaguauacauuuacagcagacaaucucaggguauuuuaaaagaaacucauccacuauucuugauacuuccuaauucauucucuaaauuauuaugcucauauaccaacuacacaaucuccucacccacauaugcuauacauaugacaaucaaaaaauagaaaucugaguugaagaaccaauguucuaggucuuaaaccaccaagugcaaaaaugaauaaacaaaacaacaacaacauauaauggccacauuauaugccauccaaaaaaaaaaaucauaacugcauagccaugauugcaccaugguacuccagccugagcaagagauacuguuucaacaaaaaaagaaaaaaugagaaaaaaaaaaauccaugcauacacuaggacuuuuugacagagacaaacauagaccuuacaccucaaaaaaauaaaaucuaagagcccaaucaagugcacuuuaaugcacagcaacugaaucacauuagcauaguuauuuuacacauauuugaaaaaaagugcaugaugacaacaugaaaaacuguucaagugcuucucaaaguaccaccaucagcuagggaggaauauaaaccaaaaaucagccaguaaaacauggucuaagccaguaagaugauuuuacaaagugacuaccagaguuccaauuuacauuuaggauccuuacuauacaaagcuuacuaugucauauggucuuaaaacaugugguuucucugcuuggauuauggauggcuucugcucacacacaauucacuaaacucuuagcccuccuguaacgcuaaugaacugaauggcacauuacaagugcuacagauggaaagauaaucaguuuaccucaguccugcaucaugggaaauagagccuauuaaauccagucauguugcuucugcuuugucaugaaccauuaaaauuuggaaguagauguaaguuuacaugugggacguucaaagaccauagcaagagaagauggggcauguguaagauuucuuauuauuugggcacaauaaugugugcuuucuucccacugauguauuuuaacagacuaacacuuuaguuagagaauuagugugaaaaaucaauuuaaaauacacagagguggauuuuauucccauuguaaaacuaauagguacuacauacaggaaaaguuauguugaaauguaucucaggaacuauuaacaugacuuauuacuaaauagagaagucagugauaaauacauuauucuucaucacuauacaagggaagaagacucuuuuuuagauuuacuacaucauggacucaaaacagacaucaauaacuugauuugauauuuauuagaauggguuacuggggaagcuuauaaaauggcuuuuucuaaauacacuuaaauauaguaaauucucucuuuucuagcaugauuuaaccuaaaguuuuaccaaacuagguguuuuggagggacacauaagacuuagaaaaacacuguccuugccuauaauccuacugaggauaaacguucauucaacaaacagguaucaaacugauaaaguauaaacccaaacaaguaaugaggugaaauagaagauaagauuuaaauggccuugaucccaggacuagaaacuggaauauggugguuaacuguuaaggggccguguagggaauaagcaacaugauuacugaaauggaugcaacugauggaagaaagcuuucuaucaaaccuucuaggcacugugugcucauguguagaaaccaaacacaguaugaaaaaccaaugaaaaaaucagauauaaagcaaugaacauuacagacacaaagcguauguugcugugaaaauggaaaggcacaugugucuacuagcuaaaugacaugggucaaugcaacaccaaaauauuuaaaacuauuuuggaauauaugaaaaugucgagaucuuaacugcugaauuuacaucuaguacacgacaguauauuaauaucuuuuacauguaccacuuucgacagucaguucuuuuaaugccuuaucaacggacagucgcgaauucagugaauugaaaaugauuauauguagauaauauacuuuaccuauacugauaagguuucuauuuguguccccgcccaaaucucaugucaaauuauaauucccaaugcuggagguggggccuggugggaagugacuggaucaugggggcggauuuccuccuugcuguucuugugauagugauugaguccucaccagaucugguuguuuaaaaggguguagcacuaaugaccaggaaaaugcaaaucaaaaccauauugauaccaccuuacuccugcaagaaugggcauaauuaaaaaauaaaaaaauaacagauguuggcauagaugugguaaacagggaacacuucuacacuguugguggaaauguaaacuaguacaaccacuauggaaaacaguggagauuccuuaaagaacuaaaaguagagcuaccauuugauccagcaaucccacuacugggugucuacccagaggaaaagaagucaugauaugaaaaagauacaugcacaugcauguuuauagcagcacaauuugcaacugcaaaaauguggaaccaacccaaaugcccaucaaucaaugaguggauaaagaaacugugguguauauauacaauagaauaccacucagccauaaaaaugaaugaacuaauggcauucacagcaaccuggaugggacuggagacuauuauucuaggugacguaacucaggagggaaaaucaaacauuguauguucucauucauaaguggaagcuaagcuauggggaugcaaaggcauaagaaugacacaacagacuucacggacucaaggggaaaaggugggaagguggugaaggauaaaagacuacaaacuggguucaguguguacugcucgggugauggguacaccacaaucucacaaaucaccacuaaaaaacuuacuuguguaaccaaauaccacuuguucccaaaaaccuauggaaauaaaaaaauuauaauaaauaaauaaauuaaaaggcugcagcaccuccucgccucuuccuccugcucugaccacguaagaugugccugcuuccccuucaucucccaccaugacuguaaguuuccugaggcccuuccuguauagccuggggagccaugagccaauuaaaccucuuuuccuuauaaauuacccagucucagguguuucacagcaguaugaaaagggacuaauacauauacugaauccuaaaaauucaaaggcucuaauuuuuuuucuguuccuugacaacacaguacacuggcagauuucaccaguuuuuuuuuuuucuaauguacucuugcgcuauuccuuuaccuaugauuuuaaaucauaauguggaaaauaugcuuuauaaaaucuuuaaagauaugacuggagauuuuacauuuuaaaaucuugaacagacaauccagguguucaugugucauugcuuuuugcuaucuaaaauguaguaugaaauacuggaugauuuguuacugauguugauagaaccuaugugaaaauggauauauguauuaauauacauaaugcaugauauauauauugcauauaucagaaguagcaauaaucguuuauuuauuuaacacacauggaaugaauauauuuguauaaacaaguagggggaaaagucacaaacucuguuuugcaauuaguuuggaaaauagucaucauucagcaaauacuuugaaaaaaauguaccaacaacuuuuggcacuauagaaacaauguccucacagaacucagaggaggaaagcagagaggcacacagaaaagguuuugcagucugguaaagcuccccagaccugaaaggguaaggaagaaaagcggguacacaaacagaauaagaauauccuagcagacagaaaagugugugaaggacuuuaagugagauagcacuuagaacuuuuuagaaccaccaaaaaaaaggaaaaaaggggguaaagggagagugagagaaagagagggaauguaccacaggaauaugagguacucucgaacuguaagcuauggucagauuauauaagaacaaagaggagguguuaaagaguuggacuuccucccaaaggcaauaagaaacccugaacagcuuccuaaaucauuguaagcaggagggauggcaucaacguagcaugguaguuaagaguugggguuaccgaauaagacugccugaacuuacauuucagcccugccacucaaaagucuuaugacuuuacacgaauuacuuaaaucccgugccuguuuccucauuuauaagauggaaauaauaacacuaucuauuuuacaggauuguugccagaaucaaaugaauacaucaaaagcauuuaaaacaguaccuagcauauaugaacagcucaauaacugccauuauauuacuguauuggauuugcauuuuuggaagacagauacagaaugaagauaagggcacaaaauaaguuaugucuggagcauuaaccucauaucuucauuuuccccaauuuuaugauacaauugaugcauguuuuucaugauaaucuggaaguuuacuaagggaaaguauagaauuaugucuucuuaacaacauucuaagaguagauuuucauuuucccauguggcacuaucuaaagaguaugaaccacauaacucugaaaauccuuuuccuaacuaggaauccuucugauccugaagaugaggaaaaggaaguacuuaugaaagggcuaaacugugguguucaauguuucaguuuugucccaaaggccacauucaggaugcaguauaaccuuuuaauauccuuuuccccucaguaauaauauggcagacaccugccuacaauggugaucugaauucauuacaccacuaauaaaagagagaaaggagagaugggcaaauuuaaacuuguacuugcauguacagaccauccaaacugcaaaaacauaugcaaaaaggcauuuuuacuaauacuaaaucuaucacgcaugacaggauaccaagagaguucaugaaugaaacccuucaugaauaacuacaaaacugcaaacauauagauuuaauuuuucaagucacuuugcuugcuauggagcaggauaaagcagaguaauucaaacuagcaacauggguuuuuaaagcuauaaaacauaaauuaucucuggcaauuaauuuuuuaaaauuaaccuagggcagugggacaauuaauagguccaaugguccauguaauauuuucuacuucagaauucaacauccuuccaaggaaaacuguuaauggcagaucaaguaccacauucuaaaauccuacauauccauuaaaaauaaaaaaaaagaagcacauguuauucgccacacacucaaaaugguucucaugugaccguaagagcugugguucuagcuucacacugggauguacagagggcaguggggaagacagauuaccaaugauguuuugaacaguuauaaauacucccagacaacaaagauuauaaaucuuuuuuucaugaucuaggguuaaaacagaacugacuuucuuauuguuuuagcucacaaaagguacuuuuuuuaugcaaaaaaaaauuaaggguuaaaugacuuaauacuguuauuuaaaugcaagacauauaaaaacaguaaguugccagaauauuagaguuaaaucaaaacaaaagagaaaguaugaaguagauauaugacuuuccacuguacauucgaauccuccauaauuauaaagauuuagggcccaaaaacauugcaguaggaaaauuaauaaagaacacagccucuaugggaaaaaauaggauugggagacuucacuggugaacuauaaaagcucauuuaauuuaaaauuaaauagugaagauggcaaauaaagaguaucauugacuuuaaauucauaccacaauaugguuaauucuuagcuauuuugccuugccuuauaagguuucaagauuucccuccaccaauauucaauaggacgcuuuuaaauucacuuggcuuugcagcagauaauacuccauucuuuuuccuaugucuagucuuccacacacauucaaugucuaacuuauaugacugaguugguuacuguccccacuuccugggcuacaaaaaaagcucucaguuaucuuuauauuuuauaugucacuacugaaaagguacuucuuaagccuggucuccaauauuuaaagucacaucuuacuuagcaccauucaugauacauuauuauuauuauuugagaccgagucucgcucugucccccagguuggagggugguggcacgaucucggcuuacugcaaccuccgcuucccagguucaagcgauucuugugccucagccucccgaguagcugggacuacaggcacacgccgccacacccggcuaauuuuuguauuuuuaguagagaugggguuucaccauguuggcuaggcuagucucgaacuccugaccucaagugauccacccgccucggccucccaaaguguugggauuacaggcaugaggcacugcgccaggcccauaacuuauuaauaaugccagaacauguaucaggauaaaaccuggauuacuuagcccucuuauacaagccuuccucucucccagugacauccgagacuaacucuauggcuggauuuugucuuaguuuuucuucucucuccuagggcugcauuacaaaaauauuuacucuucuaauucaaacuaauauucuuacaguaacaggaaaguuauaaaguuaaucaaaaucacagccucagauaaaacgucaaaauagguaaaaguuuuacaguucacagggacuuuuuucuuuuuuuuuuuuuuagauggagucucgcucugucgcccaggcuggagugcaguggugcggucucggcucacugcaaccuccgccucccggguucacaccauucuccugccucagccucccgaguagcugggacuacaggcgcccaccaccacgcccagcuaauuuuuuguauuuuuaguagagacgggguuucaccguguuagccagaauggucucgaucuccugaccucgggauccacccgccuuggcuucucaauccacagggacuuuuuaaggaugaacuugaugggauaaaaaaaaaaaguccauuuucucuuuagugucuguauuuuauuaugaauacacuggucuaucagagugauuacuacuaauaacaaaacuagagagaucuccaaaaauuauauaauaugugaguuaucaaaauagauacuguuaugcuaaguuggcagggggcaggauauuuccagaagacauucuauucauguuccagagaagaggaaagguaaaaagaaaaaaaaaaaaagcauucugauuacuuuuuagaaacuaugaguauaauuuugguaucaaaauccgaggcaaaaaaaugaaagauaaaaaucacaaaucacucuaacuuauaaucauaaaugcaaaauuccuaaaacccuagcaaauucauguaaaauuuguguuuaaaugaugcacaacaccaagucaagguuaucccaggaauacaagcauuauuuaauauuuuuaaauguauuaacaacaucaauagucaaaaaagcauaagcuuugggaggcugaggugggaggaucgcuugagcccuggaguucaagaccagcuugggcaacacagugagacccuaucucaaaaacaaaaacaaaaaaaguauaagaucaucucugcagaagcugaaaaucauucaauaaaauaaaauacagucuuguuagaaaauaauaaagggaagaaagcuuccacagggcaauaaagaacauuaaucuuuguauuuaauauggauauuaguauugacuauaacucuaugggucaguacuuuuuuaaaaaaggaagaacaaaacaagcaagccaacuaucaucauuauugcaucauucuggaagcacugacaaaugcaauaagaaauagaaguuaauaaaugauaauuagaucuuuagaauuagguguugacuggauagaaacguacuaaaucaacagcucuccuauauaucaagaauaacaaauuauauuuauuaacacaauauccaguuuacuagcaacaaauaaucaaauacuauacagguugagcauugcuaauccaaaaaucugaaauuugcaacgcuccaaaauuggaaacuuuuugagcaccaauaugacacaagcggaaaauuccaaacacaguacuuaaaaaaccauuuuaaugcauaaaauuguuuaaaauauuguauaaaauuaccuucaggcuauguguauaaaauguuuaugaaacacagauaaauuucacauuuagucuugagaaccaucccuaagacaucucauuacguauaugcaaauauuccaaaaucugaaagaaaucccaaauacuucugaucccaagcauuuugggcaagggauacucagucuauaacuagaauaaccucaauuaauagguauaugcauguguauaccuacauacauauauaugaaacagacuaaaaacuuuacuaagauauauauaacagaaugcuuaaacaaauggagacaugcagcuugguccugauuacuuuuuagaagcuaugagucuaacuuugauaucaaaaucuaccgacaagaagugaaagauaaaaucacaaaucacucuaacuuuuaaaaugcaaaauuccuaaacaaaaaccuagcaaacugauguauucauuuaaagaauaacacacgacauaaaguuuaucaaucgacuugauagaaaccaacuuuauuaauccacuguauauacuuaccaauuucaaucaacauccuaaucgguacuccacuagaaucuauguacguacccaacuucaaaacauccuaauaugguauuuuugaaacaguacaaaguaaaucaaacuucauuugaaagaauaaauuaauaaauauggcuaauucuccaccccaccccccucccaccacuacugucacuacuuugauuugacucucaucacuccuuuccuggauuacuggacaaaccucuuaacugaguucccuccccagugugaaggaggagguuuucaacuuaaaaucagcacucuguuuagcacacacagccuuucaaagacccugcccaucuucucuggccucucauccuccuccauccuuuuauuccacuuacaucacuaacggaaguuccuagaaugaaugaagaagcagucuggccuugaguaccuuagcacccauaucuuaucuuucucaaaaucccauccucccguucuauuuuuucaaaacucgaaguucuucuucuuccagaaagccuucugugacuuccucuggucuuacuuucagcccuagcugagacuuucauacuacugugagcaccgugcuaugaaggcauaccucacaccauucuauaaucagugcuuuaacagacuguucacuguucacuccuacuagaacagaagcaggcagacaacugaggggaugaugaggcaaaggagcaauggagggacuaugagaagacuuaagaagaaaggaaggcaucuaagagaaaacuucaaccuugaggucaugaagaacacagccaaaaugucuaugcuagagcuaaaggaggccacuuagaaauuuacaguaagcaaaaaggacuuuacuucuucaaucagccaaaguagcaaacccuaaagagggucagacagaaugguguuugcccuugcugguucuuacccuucuuccaugggaagaguucaggccugguuauugagaaaagaguuccagcaagaguaagagauacaguaagcagagacagaaaaaguuuguuugccaacucagauuccagaauuugagauguuaaugguuuauaaggaguaagagcuucaggaagaaauagaagaguaguaagaaucccauagucuccaugcuccagacccccuucccaugaucuccuuaagaaauggaggaaagggcaggaauaaauuucaucuauucucaccuguuacuaccuaauucuagaagacagucucuagaacauugagacagcaugcacuuaaaagucaaggcuauaggaauuacuuuggguagccacaaucccacaaaaaguaacaugccauggaugccaauugggcaaaagcugccaggaaccaguucaaccaccuuagaaaaggcacagauaugggaaacuugguuuuagacaucuugucacacaguaaagguaguggcagaaggaggcaauucccauuuucaugucaucugaccuuuuaucaaaaaagaggaaaaaguauaccauaaucuucauucauucaaacacuaauucacucuacaaacaaauguggauacagacuacauuaggcacuuggcagaacuagggagggcagacaugaucccuggcccauacagcuuacagccucacgagaagggaggaaacaguaaguccuacgacuggggagaaguaccacaucaggaaagguggccaaaaggacaggauaacccaggugaaacccaaaugagaaacuggcuaccaaaaacaaauauucuagacaaugcaaagacauguacaaaggcuaggagguaaaagacccuacauauuuuaaggaaacaaaaauucagaaaagcuggugcaaaaaaugcuugaaggaaagggggaaaggagaagcugugaagaccgaugagaacagagaggaaaguagcaccagaccauccagggucuuauaaaccauauuuugggauuuaaccuuuauuuuaaaaacauuaagaggaagccacggaaggauuuuaagcaaauaaaugacuuggccagacucguguucuucugcaggugcucuggcugcaggauggagagugaauaaagaaaaguaaccugaaaaggaggagaacagucaggaaauuuguaaagccaaucagaugaacaacaaugacuacgacauguuuuuaagaggcaaaaaacacaggaaaaaaguaugaagaccaauagucuggaaaggaaauuuuuagaaacagccaccauacucuuguacccuaggauuaaaucugucccuucaucugcccuacuauccuuuauccaauaucaaucccaaccucuugggugaaauaaacccuacuucccaacugcccagcuguaucaaccagcuguccaacacaguagucacuggcacauaugguuaaaauaaaauacauuuuaaaauuuauuccuugguagcaauagcuaauuuucaaguguucaauaguaaaggugacuaguggcuacugaauguccagcauagauauaaacauuuccaccaccacagaaaggucuacuggacagugcugaggaacagauauaccuaaauuugccacuucacuagguaguccuacuuaaaccaacacugaaggcaccugugaaggcagacucacucacugucucaugccacuccuuguauauuaauaagcccucacagugcagugacgaaucaugguguacaaaccacaagacaggcucuguguuuuggcucauuaauccucacuaugcucugaagaaauagaaaugcagcaggcaucacccauguuuuauaggugaggacaccaaggcacagaaauuaaccugccugaagcuauacagucaguaauggagucacaaauaaaagcuagauucccuaacgcccugaccagugcuccauccauuaaaguagucauggcugauuuaagaacccuagaaugaaaacuagucaguuucaccugacccaagcaauaauuugcguuaccaaauagcuugcaacacauaugggagggucauaucgguuagguccuuacaaagaaauagguccauguauauggagacacacacaaacacgcacguguguacacacacacacacacacaaauaaaaaccggaagaauauacacauccccugaauuugccccaauuaucuuauaaccugugaugagagauaaaagagauuagacacauuuacugaaacuaacagcaccaagguaugguacauucuugcauuauuaauuugguuuucaauuauguuaaauaauuaccaauaaaaaauuacgaccuagaagcccugcauuuuauaauucuuauuugcaucuguuaccauugaaaacuuaauuuuuuugugcccuuuucaaaccuauagaagcaacaagggcagagacgcaauaccugcauuuucauuucaacuacuuaauuaacugaaaagaauaaaauacuacauagggagacaugaaccaaguuacagauuaaagauacaaaaucuacauacagcauuugcuugugacacucuugacaaugccaauuuuaaaauccagcugcuggcauucacuaaugcaucucuguguccugacacugcaaaaaguucacccagaaccucaugugaaugauguaaaaaauuuaagaaauaauucaacugccccggcccaauauuuaaauucuuauaugcuuuaccuguuguaauaguaaauacacagaaaaaauaaaaugggaaugaaauauuuaaaauaauuccaaacuauuaggaagcauacaaaauaauuauuucuacaauaacugcuuauuaaaguguaaaucaaucuacagaauauaaacacuaaguaaauuuuuccauuaaaugaaagcuuccaaaauugacaacuguuucugaauuaagaaaguaaaucucccccaaauaugucagcacaguuauccccauugcuauccauggggaauugguuccucaacccgugaugucaaaaugugccgcugcucaaguuucuuauaaaagauggcauaguauuuacuuguaaacuacacacauccucccguauacuuuaaaucaucuccagauuacuuguaauaccuaauaguaugaaaugcuguauaaauauuuauacuauauuguuuuaccuauauuacuuauuaucguaguguuauuuuuuuuccccuuuuuaaacuuuuauucuagguuuuuauuuaaguugugaagguuuguuauauagguaaacuuguguaacggggguguguuguacagauuauuucaccacccagguauugagccuaguaccuaauaguuacuuuuucugcuccucucccuccucccauccuccacacucaaguagacucuggugucuguuguucccuucuuuguguucaugaauucucaucauuuagcucucacuuauaagugagaacaugcgguauuugguuuucuguucaugcguuaguuuacuaaggauaauggccuccagcuccaucaugugcccacaaaaaaacaugaucucauucuuuuuuguaguugcauaguauuccaugguauauauguaacacauuuuuuuuauccgaucugucauugauauuucccaauuauuuuugaucugcaguuggcugaauccucaaguguagaacccaagaauaugaaggaccaacuguaucauaaaaagggcaugaaggcugauuaugagugcagaaugugaugaucacaucuaauuuuaguugugaaagugaagaaagccaucaacuugacuauuuuaaagucugcuuuaucacacaccuugauucaagaauauagguccauuuuaaaaauaauuuuuacguugaacuacuuacacagcauuucuggaggcuccauaggaaaguaacagcuugacuauauccacaugcccauucuuggcugcaucgugaaguggugagucauuuugauacccggugguguucaccaaugccuuaugcuggagcaauaauuccacuaccuucaggugcccaugauugcaagcuucaugcuaauuaaauuuuuugaaaaagaagugaaagaagugauaagaaagagcaauggaugauauuauaauaucacacuuuagaaaaauaaauguaaacgucaggcaguaaauuuauuguuaccuaaauacucaaaaacacuauaaguugcugacagagugaaaguuacuauuaauaaucuuucaaucaagaucuguguaacucauaaaaaaagaaaggcuauucucauuugagccuugggucaagcacuuuucuguuuuuuagaagaaaauguaguuuuaaaccaacgguagcuccuuaaauguucuacaauaaauguaacacauuaagaaaaaagucuacauauuuaauaacaagaugauacauaaaaucuguaccaguacauacacauaucaugcaacaaaguaaguauccgugaaggaaugcuuuuaagauaagcuauuugcugaaccuacaaauugcuguauggcugcuguuauugauaagagaaauaacacgaguaggaauacaaaaagagcuugcugaaugacagaaacggcaacaauggaguguucaaagaugccuuacauccaaaucuuuccuuaugucuaaugaacuauaaacaaugcuguauucuaauaaaucucuggcauucuauacuuuuuaaguacaucaauuucaauucauaauaagugauaucacacucaacaucuguaggucuauuuuuaggagaaaggaauccaaacuaggcacuaaacccucuaaaucacuaaccaaucuuuacuacaacuugccuuaguggcuuugaagaaaaaaauaaaauuaaccuuucuuugaaaagguuagccagccaguagaguccaaccagcaaagcgacugaucuagacuaaacucucccagcuuucuugcaccuagccuacugagagucuccuaauuucugggcugaauuucuaguuacaggaugaaggcauccacuucauuugcugacacuucuguggcugcauucaaaucucauguuuguccuaauguaauuggccuacauaccaauuguuuccaaguauuugugucauucuguuuccagauuaugcuucacacuuuuuuaguaauaauaagcaaagaccuuuaaaaauguuuaauguaagcaaagauuucuacugccuuauauaucuacaauuggauaggguauaagugaggcuaagauagacccucagugagaauuacuuccuugugaucacuuuccuauacucaguuccuccgaccucuuuuuguuccaagaaauuugguuccagugacaugcagugcuacagaauggagccugaugucagcuguagcuguuaccucuagacauuagcuaaauucugcaguacaguacaaauggauuccuaaaucuaaagguagucugucaaaagguaaccaauuucuugccugucacaaaugaaaagcuagaaggaaaguaaucauguucucauacuugaugaaaacauaaguucuucagacuaaaaagaguauauguggcagaggaugauauauagacaacuacauaacuauaaacuauaagaacuguaaaacacagaaagaaugagaauaaaaaccagacaacuaccaaugguguccauccagcauggucuuuaacauuuggaucacuuccauuuuguaaaagguauucaacagaagguaugucgcccuagaaaaaugaacaaaacggaaauuaaaaagcauuaaggaaagaaaggaaaauauugagcuuuuuuaaaugcugccuucuucaauauaaaguaaaacuuaaaucguuuucucuuaaggcuacuguucaugaguuaauaaauuauuaggccgggugugguggcucacgccuguaaucccaacacuuugagaggccaagguggguggaucaccugaggucaggaguuugagaccagccuggucaacauggugaaaccccgucucuacuaaaaauacaaaacuagucgggcaugguggugccagccuguaaucccagcuacuugggaggcugaggcaggagaaucacuugagcccaggaggcagagguugcagugagccaagaucaugucacugcacuccagccugggccacagagcaagacuccgucucaaaaaaacaaaacaaaaaagaaauugucugcguauaaauuauucugagauaucaagaaguacagucaugcuugaauauagacuacaaaaucuauuagaaagccauauucaaaauucauuucagguaccaaauaaaggacacuggccaaagaucaugugcucacaaugaaguuuuaaaagccauaauuucacuugugaaaaaaacaauuuuugagcauuuguaaauggcuucugaguauuguuuaaaacaaccaaaacuguuuagcccagaagacuacucagugaaaccaaaguuaaaaaacagccaaaaacugccauuuuauuggcaguuacuccauccuaauacauuuaguuuauauucaccuuauuuguucaacauuuucuaggaagcaacaguugcucuguuuaaaauggcaaaaaaagagaucaguacaaaccuauucaaaucagcccacagaauuagcauuaaauuuuuuaucccccugcuccccgcccaguucaagacuaaaaucaccacccauuaucaacuaauucaacuauacgaaauagagcuucuguaauguagccuuacaagucuuuucuaacaagugguuuucaauuucucuauuucucuauuccaguacucuggagagcuaugcaacaauguuauaacaguagcaacaguagcacacugaugcaauggagaaggcagaugaggaauaguaagaaauacaauaacuuuacuuuagaaaucacaaccucuuuuuaaaucagaugagcaagauccggggaauaagugaauuaaaaugaggcacaaggcaaggaaaauacucugaaggcagacaauauuaauucgacuuucauauuaagacaccgucaauuauuaaauagcauuaaaauugaagaccccuuccaguuuugaacuuucugugucuugugugucaugauccaacuaaauccuacuauaaaugaguagacuuuuaaggucacuuuaaagcugucuugaaguaagacaaaaaaaauagcuucccucugcugccagccuccagcgaagguagacuguggcaaaggaguucuggggaacuggucucagguagucugcccucccacucuucuuuuuuauuuuccuagaagugagagauaauaauccuccagcuaucuaauaccagggucucuuaaauuuggcccuucauguaauguggaaagaucugacaucuaucauuuauauuuaauuacauauuacguuuuaaguauccguuaacucuuaaagccuuuuuaaaaaucucuagcuguaauauaaaggauacugucccuuuguaaaacaaugucaggcuuuaggaagaaggaggcauuuaugcagcgggaugaagguaaaaauuuucuugaaauuacauuauuaucaccacucacugcaaauauaacuaaucaguucuuuuaggauaacagggcaggguacaguaccuaaguccaugacgauaaagcaaaaauaucuagcagagcauacucucaaaaaagaccaaauaaaaagcuauagacagaaguuacaugcauaacauuguguucaaugaguuucgugagugcuucuuuagugaauaaaucucuccccacccaaccccucucccaauacuuuuuucugaaauuuuuuuccucuguugguuugauaauguagaaaucacuaauucuccuaaauauaauauuugauuuuuuuuucuuuuuaaaaaauuuugcuggccagacgugguggcucacaccuguaaucccagcacuuugggaggcugaggcaggcaaaucaugaggucaggaguuugagaucagccuagccaacauggugaaaucccgucucuccuaaaaacacaaaaauuagccaggcauggugguacacgccuguaauccuagcuacucaggaggcugagacaggagaacugcuugaacccaggaggcggagguugcagugaguugagaucacaccacugcacuccagccugggcgacagagcgagacucuaccucagaaaaaaaaaaaaugcuuuuuauaucuaauugucucuguuucugugcucugggcuguuucucaaaucuucaguuuucuaaaaaaguaaauucucaugcaacauacauuuuuauauuccuaaauuaacaaaaugaccuuaaaugcucaaugggucuaaaaggauuguagguuucaaauuaauuaccccaguuucaggaaaaaaaaaaaaaaaaaaagcaacauuuucccagauuucuuaacagugcaaauucuacuucuagagcaaguuaucauguauuuagcaacuggagugcaauggcaugaucauagcucacuguaacuucaagcuccugggcccaagcaauucuccugccucagccucagcaguaugcuacugcuaggcauacaucaccaugcccagcuaauuuuuuuuauuguuuuguagagaugggggucucacuauguugcccaaacuaauggacucaagcaaucuccugccuuagcuuccaaaauuauugggauuacaggugugagccccugcaacuuuugcuuuauauucauaacgguuacaaaugaaugcaggaauaucugccaagauacaaauuuuuuuuuccaaaacaauccuguaacaagugagcagauaaacugccagaaccacacacauucccuaucuuuaacaugaaaguacucacacacaaaaaccuucucaaagauuuccccauucuaauucuacaugguaaugcaaaaaaaaaauauuaaagaagcuuaaaaaauaauauaaacacaauugugaaauggaagagucucaagggaauagucaaacagaaacggagugacaauuuaaagaauacaaguagacucucuuuuaagguuguuagacaguugcuauuuuucuuucaugucaccucuucauauuaucaaagugucuucuguuaacauucuccccaccccugaacuguauagcugauuagcaaacggcuugcuuuuuauaaccaaucugcuuucuccucucuaguacuugaaaguuuugucauauuuucaucuuucuacuucauguaaauguaaugucaugcgcauaaauaaaauuaugauaauuagauagagucuacaguaacuggaauagcuugaacugauaugaaguagccaggaaauaaauuaaguuuugauucuggcuucuuuaaauuacuuucaaguacucacuuuugggcuccucacaacuugaaagaauaauugaacuuuucuuaaaccacagcaaacauaauuuaucuaaggaaaguauuugccaaggcuuauuaaaaauuuuaaaugaauuugguauuuucaaguaauacacugaaggcugaaaauaagagugugugugugucccacugaaucuuuuauuccuaaucuuucaaucaaaggaaagauccuucacacauuuguacauacugcagauccacacauauuccaacaauauaaauuaacuuuccaaaaacacacacauaaaaacaaaacuuuuccuuauuauaaauguuagcucuucuaaaauaccauuaauaaacauauucauaaaaacaauacagaacguuacaauuaaguauaagacaaaugacuugccuagcaugguuaagccuuuccauguaaaugaaccgaccaggaaccaaagacuucccuucuuggcaauuagaugccauuaaaacaaacaaacaaaaaugaaccaacuggaaugaagcucuaaaauauguuaaauauuucuguagcuucuuagaauuuacugaauaaaauacaggcauaucucggagauacugucaguucaguuccaggucacugcgauaaagcaaauauugcaauaaaacaagucacacgaaucuucugguuucccagcacauauaaaaguuauaugugcacuauacuguagucuacuaagugugcaauagcauuauguuuuuuaaaaaaaaugaacagaccuuaauugaaaauaacuuuauugcuaaaaaauggugacaauuguuuugcugguggauggucuugccuugaugcugcuggcugcugacugagcaagcagguaguugcugaagguuugggugguugugacaguuucuuaaaucaggacaaugaaguaugccacauccacugacauuucaugaaagauuuaucuguagcaugugacgcuguuugguagcauuuuaucugcguagaacuucucccaagauuggagccaauccucucaaacccugcugcuguuuuaucaacuaagaugauauaauuuucuaaauccuuuguugucauuucaacaguguucacaacaucuucaccagaaguagauuccaucugcagaaaccacuuucuuucucaucuauaacaaacaacgccucauccauugaaguuugaucaugaggcugcagcaauucaguuacgucuucaggcuccacuucuaauucuaguuaucuugcuauuucuacuacaucuauaguuacuuucuccacuuaaguucugaaccucucaaagucauccaugaaaacuguaaucaacucuuuuccaaacuacuguuaauguuaacauuuggacauccucccaugaaucaucaaugauauuaauggcaucuagaauggugagucauuuccagaaucaucuguggaauacccaucuacaacagcuauagccuuacaaaaugcuuaaguaacaagacuugaaaguaaaguuacuccuugauccaugggcuacagaauugauguuuuguugggagacaugaaaacagcauuaauguccuuaucuucaucagaacacuugggugacuagguggcacugucaauuaguaauauuuugaauaucuuuccugaacaguaggucucaacagcaggcuuaaaauauuuagcaaaccaugcugucaagaugugcucccacccaggcuuuguuguucuaaaugguaaaugagcauuggcuuccacuucaagucaccagcugcauuagccccuaacaagaaagccuguccuuugaagccaggcauugacuucuccuuucuagcuaugaaagacacagauggcauauucuuccaacaaaaggcuguuucaacuucacugaaaucuguuguuuagugugccacucucauaauuaucuuggcuagaucuucuggauaaccugcugcaguuucuccaucagcaccugcuguuucaacuugcauuguuauauuauggagacagcuuuuuuccuucaacuucaugaaccaaccucugcuagcuuccaacuuuucuucugcagcuuccucaccucucucagucuucacagaauugaagagauuuaggaucuugcucuggaguaggguuuugcuuaaggaaaugugguugguuugaucaucuauccagaccauuccaacucuccucauaucggcaguaaggcgguuaugcuuucuucucaucucauuuguguauucaacaggguagcucuuuuaaauuacuuaaagaauuuuuucuuugcauucacaaauuggcuguuuggcaagagaccuagcuuuuggccuaucucaacuuucaacaugccuuccucacucaucauuucuagcuucuuauauaaaguaagagaugagugacucuuccuuccacuugaaaacucagaggacauuguaggguuguuaguuuaccuaaauucaauauucuugugucccaggaaacagggauucaaagggagagagaugggagaauuaucaguaagcagaauagucagaaaagacauuuaucaauuaaguuugccauguuacauggccaggguuuguggugccccaaagcaauuacaauaguuacaucaaagaucacugaucacaaaucaccguaacagauacaacaauagugaaaauaucugaaauauugugagaauuaccaaaaugugacacagagacacacugagcauaggcuguuggaaaaacagcacugacagacuugcucaaugcaggauugccaaaaaacacaaaaacaaaacucucugcgaagcauaaaaaagugaagugcaauuaaaugagguaugccuguaauuuaacagauaauucugauaaccuggucaauggcacaauaaguuacugguauuacaaaagcagacuuauacauauguggugagugacagaggagaaaaauagauacugacuccaggagguguuuuagaaauuaaacucuugaaaauaucacauaugccaaggcugcuuuuguuuccuuugcuaccuucucaugaagcuacuaugaaggauauauaauuucacacacaauauaacaugacugucuucaaguauaauaaacuacaaaguuaaacucuaaaugagacuccucacaagggaucuucucucucuccaggggaucuucaucaccuuuguuauguucuaagcauaccaugccuuguaaguugcauucaaaacauuaucuauuaugucuacaucacuaauaaaucauggcaugccagcuucaagccauucuucuauuccacaguaagucauugcuguggcauaaauuaugaguagucauugccauuuuaagaauuugugcuagagaacuugguagaagggugugggggaagaaaaggggaaggucaggauggcacaaauucucaagcaaagcugacauaauagaaaauaaaaaauuuucucuauauccuuaguauuuuguuuucuauuggguuggugcaaaaguaauugugguaauaaaucagaagaauaaacaaugaguaucuuaguuucuacuuacgcacaaagcuuucucauaaacucucccauucaugacacaguguucucaauagcaguuuaacauagcugaugcagacauucaaauaggaacaugaguuaugaagauauucaaauaggaagagggguauaaaaaagacuuacugauaggagagcagagaaaugauaauuuugauuucggucagauuacucuggcuguuacauagagaacugacugcaggaaauacaaagggaaauuaggaagcuacuucagugguguggucaaaaaauuacgaccuccaaaaauguccacacacgaauaauccccagaaccugugacuauguuaccuuacguggugaaagggacacugcaguguaauuaaguggacacaccuugagauggggagauuauuccgcauuucucaaguagcccaauuuaaucguaugaauucuuaaaagcagagggucuuucuggcuaugucagaaagauaagaugugagaaggacucaaucugcugcugcuggaugagaugaagaagaggaccacgaacuaaaggaaugugagagucucuagaaccuggaaacaacccucagcugaaaaccagcaagaaaucuggaucucagucuuaccacaagaauuaugaagucccugccaaccauccaagcaaaaaugaaaugggucuuuccuggaaccuccugaaaacagcugacaacaugauuuuagugugaugagacccauacuagacuucagguguacagaacuguaagaaaauuaauuugcauugcuuugaaucacuaacuuuguggaaguuuguuuuggcaccaauagaaaauuaaugcaagugguaggggcaagaaaagagaaguagcugccaguagggugguagcuauggaaagguuauggccaaugaugaugcccagagguaguuuggggcaagguauuauacgauguuuauuaauaauguuuccaagcucagaaaucaaucaguaaagcccuaccugcagugggggaagguaacuagugcaggagaacaaacuccugcuggguucucugcccucggugcauacaccaaggaugcucagcgcaaacaugugcucaaacuauagaaacugcaaguuuaccaacaugcuuaagaaacaauacaacgcaagucuaaacaacuuuaggccacuugaaauccuuuucugaaguagguggguacaaaacauaaauaaucaccaccaaaaaagaugcauuaucuuuugacagcacaaaaccugguccuuccccuuauuugcuuuggcugccuuaaaggucaccaaaacuaaauucacuccaguuguaguaacucuuuccucuuuaccaacuccuuguuccauuuuauaguagcuuuaacuuuagagccacuucaaauccuuuucugaagcaggugggugcaaaauauaaauaagauagcagaauugcaauauguguacacauagauuuauucauucuuggcugcaaaugagaaaauuaggauaggaaugaaaugaaaacuguuucuaaaaagauuggccagguaugguggcucaugccuguaaucccaagacuuugggaggccgaggacauaucaccugaggugaggaguucgagaccagccuggccaacauggugaaacuccgucucuacuaaaaauauaaaaaguagccuggcaugauggcaggugccuguaaucccagcuacucgggaagcugaagcagaaggauugcuugaacccaggaggcggagguugcagugagcugagauugugccacugcacuccagccugggugacagggcaagacucugucccccgccccuccccccacccccaaaaaagaaaaaaauauauaaauauauuuauauaagcaaaucugauuuuaaggauauauuuauuaaaauaaagcuaaggcgagaggcauacauucaacucauaaaaaaauuuaaaaggacacuauuaauuggugauuuuaaaaacaauaaaaauuaacuuuuaaaaaauguaccauaacauaaucugacaacuggugacaauaauugcauuuaauaauuaaguucaaggaaauaaaaauggauuuaauaauuccggcaaaacucuaagcaaacugacaaaacucauaugaaguaaucuugaacguauuaauagagaaaauucaccaagacaggagcaugccaucauuuuauccugacuuaauauucuauuacaguuucuucacaugccuagaccaagaguaggcaaacuauagccuaugggccagucacccaauuuuguacguaaguuuuauuaguuugcauauugccuguggcuacuuuugcacuaagaaggcagagcugaaccgcuaugauagagauuucauggccugcaaagcugaaaacauuuacucuaacugcaccuuuaagaaagaacuuacaaaacucuggccuagacccuagggauccucauuaauaaagauaaauuauucuuaugguuagaagaaaaagucgccaccaauauaaguaaaugcuugccugauaguccaaaaauuucccagaaagcaaaauauauaaauuacuauguauuagccagcaaaaugaacaaaaauaaucauuacacuagcuacuuaugucuauaacuuuguuuacaauagcuuauauguacauauaauauacauauauauaacagagaugacaaaaaaugucuaauuuuguuaagucaggcuuugcaaaaaucaaacuaaaacacaaccagagccaagugcaaaaauucaacauguccaaaggauauguggucauguuguaaggucccugccucacugguaucagaaauagaguacagucaucccucaguaucugugggggauugguuccagaaucccagcagauaccaaaauccagauuccucauauaaaaugauguauuugcaaauaaccuacagagauccuccaguauacuuuaaaucaucucuaaauuacuuauaacaccuaauacaauauaaaugcuauguagauaguuguuauacgauauuuuuuaauuugcauuuuuuuauugcguauuguuauuggcuuuucucccaaauauuuuugauucgcaguugguugaacccauaaacauagaaugcacagauacacagagcugacuguauuccucauuaaucuggaagaaaagcaaggaaaacaaaccagcagcagcugggauaagcucaguuuaugcuauucccuuucuccacacagaaauacaggaaucuuuggaccacacucaaugucuacuccauguucuucucaaauguuuuauguugcccaccagccucauguuuguggaccuccaagugguuccucccaggugucccaaaguucucuacccauccagaagaccaaaggauuuccugggugaauugacuacguacagucgcugagacugcauaaaagcuauccuaauuuaguacuaaggucuaccauaucauacuuuccuaacauuugcaugaaaucacagagcaaagcuuauaaagcuauggugccuacugcucuauuucacauguaguguuugugucaguuucaaagauuaaccacugccaaguguucagaaaacaggccagguuccauaaaacgcugccacaucucagguguugaggcaauaauuaaagagaaugaacgucaaugaacaggucaguaaaaggaacagcugauuguaggguaaaaagcagcuccuuuguggugaacuggaggagccauuucugauagucaaaugucccggucauuggagaaauguacagaccacaucuuucaaccuuccaaauuuugguugaauuuggaugguaaauaugggcuuuuuuacuaaguaaacauuguugccuguaauaacuuagcaauugucuacauucauaaagcaugaagacagguaaacaaaaugauaaaaacugaagguaaaauagacaaaagcaaaagcacuuggcaaaauaaaagccgaaauauucaaauauugguuuucuccuacaagaucaugcgcccagacucaggggccacugcuccaacugaaguagagaugcucucccuaugaaucuggcuucucugguucagaggaaguaucaugucugugaaagguuaauuauccuaguaauccuaugccauuuuucaaaaacugcaaagaaauugcuuuauaguuggccucauucugagaugguauuucagaguaagcauccuaccuuaauagaagcaauauggagcaaagucucuccucuaugauuucuuuucacagccauauugggcaacagcuucauugcugagggacuagacaucacucgccuguaacuugaacuacuuaauguagaaggugguguaccuggugaaagacuaaugaauucaucggacauguuacuguuuuuccucccugauguaccaccaacuuuacguuugcaugaagguggugaagaacauucaggcaaugguauauuuucugagggcaccguuugcuuaacaaaaucuccacuggugcucagaaugcugguucuacaucucuuagaaaugggacuggaaagucuauugugauggccacguuuuccauuauuuucuaauggcaaagauuucuuagauguaagauaauuuuugcagaccuucucaggagucacuacuucauuccugcucuuagugucuggagacucuauuugcucagccaaugguaaagagacuucaguuaaacuuccaaaacauucagauucugucaaggagccacuugcuaguaagucuauuucaccauuuaucugaggacuggagauaacagaugguuggcuacagaaggauaccagcuuuugcuuagauuccucuuuggagucaaauucaccaucuucuuuuucugccucuaaauuccauuuuugguugauuucagcuaaaguuuucuuuuuuugcuuuuuuccagaucuugcagaagccuuuuuagcccucucagaaacaucugcaggaggacuuggggaaacaaauucauaugagucuugcugagcacuugcaucuuuuuuuauugcaggcuggguuugcacugaagcuuuacucacaacauaucugacuuucuuacuucgagggcuaaaccacauuuuaauugaauucuucuuguuuccugcaucauuaaacaaacuuuuccuagguuuaucuucuuucaaaucugacagaaaaaaagaaaaagaaaucuguuacaugaaauuuauugcucccacauggagcucccgaagaauuuuguuuacaguuccccuaaaguguaucaucuuuuaauuauguacuucuuucucagcuccuagagugugaacucuuugauagcagauauucacucauucaauacuuacugaauccgacuuugugccauauccuagagacugaagauauagcagagaacaaaacaugaaacuuauauuccaaauauaguacccaaaaaaacccauaaaauacaaaucuaacagaauguauaaguucuguuugcuaagaauuacaaaauacuuauuaaagaauucuacacaaauggagagauauaccauguucaugaacuauaacaauauuguuaagaugccaauuguuccaaacagauuuacagauauaacaaaucccaauguaauuuccaguaggcuuguuuguaaaacucgacaagcaauuauaaaauuuacacggaaaaagaaagguacaauuugaaaggcaaaagacuuagaacaaccaacauaauacugaagaaccaaguuggaggacucauacuauaugacuucaaaacguaucucugacaaaaugaauaaaggggauuaaagacaauagucaugacccuuuagguaucaucuaauauuaacgucaagcuguauaaccaaagauuaguaagaauaaaugaacaauaacuacauauucaaacauaaucucuuaagcaaaauaaacuacauacacauuauauguuuucacuuacaucaaauauaaaacagucaaaacugauuuaauguguuaagucagaauaguaguugguuaccccuacagggaaaaguagugacugaaagggagcacaagaggggcuuccagaguauuguuuuuguucugggugaguucaguuugugcaaauucauuaaacuauaugguuagaaaauauauauuuuuucuacauauauauauauaaaauacuuuuuaaaaauuugaaaaauauagauuuauaaucaagaauuaaaacacaaagauuccauugaggguagacagaauauacaaagauucagcagaguuuuuaaaaagaaaaaaaauugucucuauguacacaaagugccagauuuugugagagauacucuucuuuacacucaccugcuacuuuaauuaaggucaucaaggaaggcaucaaggagaaguugauuuuugagcugagauguaaaugauguaaaggaaacaguccuguggaucucacauccaaugcagaaaagggauauaauguuuuauauuguagaauuaccacucugacugccauguggaggaggaacuuuggaaagaaaagaguagaaacaauagccaauuauguggcuaucauccaagaggaaauauauuggcucugacaaguguuacaguaauagaaaugguaaaaagcauucuaaaagaucacaaguuaccuagaccaagaggcaagagcaagaugauaaaauguucaaaagcccaauagcagagagcauacaaaguuguuccuccauauuaucaggggacugguucgagaacucccuuggauaccaaaauacccacacacucaauuccuguacucacuccuggagaagcagaguguagaaaaagucagcccucuguauacuuggguuuugcauuccaugaauacuguauuuuccaucugcauuugaccaaaaaaaaucuguauauaaguggacccaugcagcucaagccuauguuauucaaggggcaacuguaguaaguuuaaggaauuaaaggauggccaguauaccucacuuacagagaccacggaagaaagugauuuuuaaagaaaauguggcacauauacaccauggaauacuaugcagccauaaaaaagaaugacuucauguccuuugcagggacauggauaaugcuggaagccaucauucucagcaaacuaacacaggaacagaaaaccaaaaaccacaucuucucacuuauaaguggaaguuaaacaaugggaagacauggacacagggaggagaacaucacacaccagggccugucaggggguugggggcaaggggagugagagcauuaggacaaauaccuaaugcaugugggucuuaaaaccuagaagacggguugauaggugcggcaaaccauugugacauagauauauagaccaauggaacagaacaaagcccucagaaauaaugccacacaucuacaaccaucugauuuuugacaaaccuaacaaaacaagcaauggggaaaggauucccuauuuaauaaaugauguugggaaaacuggcuagccauaugcagaaaacugaaacuggaccccuuccuuacaccuuauauaaaaauuaacucaacauggauuaaagacuuaaacauaagaccuaaaaccauaaaaaugcuagaagaaaaucuaggcaauaccauucaggacaugggcaugggcaaagacuucaagacuaaaacaauguccugaagucuuuuacugcaauggcaguaaaagccaaaauugacaaaugggaucuaauuaaacuaaagaccuucugcacagcaaaagaaacuaucaucagagugaagaggcaaccuacagaaugggagaaaaauuuuugcaaucuauacaucugacaaaggacuaauauccagaaucuacaaagaacuuaaacaaauuuacaagaaaaaaucaaccccaucaaaaagugggcgaaggauauaaacagauacuucucaaaagaagacauuuauguggccaacaaacacgaaaaaaaagcucaucaucaucauuagacaaaugcaaaucaaaaccacaaugagauaucaucucacgccaguuagaauggcgaucauuaaaaagucauggaaacaacagaugcuggagaggauguggagaaauagaaacacauuuacacuguugguggggguguaaauuaguucaaccauuguggaagacaguguggcaauuccucaaggaucuaggaccagaaauaccauuugacccagcaaucucauuacuggguauauacccaaaggauuauaaaucauucuacuauaaagacacaugcacauguauguuuauuguagcacuguucacaauagcaaagacuuggaaccaacccaaaugcccaucaaugacagacuggauaaagaaaauguggcacauauacaccauggaauacuauacacccauaaaaagaaugaguucauguacuuugcagggacauggaugaagcuggaaaccaucauucucagcaaacuaacacaggaacagaaaacccaacacugcauguucucacucauaagugggaggugaacaaugagaacacauggacagagggaggggaacaucacacaccggggccuguccgauggagcggggucaggggagggauagcauuaggagaaauaccuaauguacaugacagguugaugggugcagcaaaccaccacggcauguguaaaccuauguaacaaaccugcauguucugcacauguaucccagaaauuauaguuaaaaaaaaaaaaaagaaagaaagccauuuguucuuuccauagaagccuuuucuucccucuaccucuuccccuuaauuuagguuuauaaacucccauuuuuaccuguuuggagagucacauuuuucugugaacucacaaguauauucauaaauaaaaaucuauuuuuucucuugcuaauuguuuuacaguuuaauucacaggccuccauacaaugaaccuaagaguguagaggaaaaguuuuucuucauugacaaaucauacaagucauccacuuuucugauuuugacgaucaacuaccuucaaguugucuuauguuguuuuugucuuugggauauucauuuucuucaagaaaaaaaaauugccuuaaaauucucucccaccccaugacaacauagguaaaaucaacccagcucagcccagcacaguggugagcacaugaauagacaguacucaguaaguacuagugaauaaauuauuugauaucucuuaaaucuuuccaaauguuuacguaagagauguuagaauuaauuuuaagagcuagaagaaaacuugaaaauaauuuagucuaauucuuucauuuuaacaaugaaggacuaaaguuaaaacaaaaagaaggaaggaguccccuaacucccaaucuggcacucuaucucuccacacaaacuggauuagcaaaagguaauuucaggcccagaaaaaaaaagaaagaaagaaagaaaaagaagaacauuagaaacggaggaaaguuggaaaaauaacaauaaucugauaagauuaaaaacaguaauuaacaaaugauuucaugcugccugacaaacauucuccuaauuaacacagacaaucuccucugaccaaccaggcuucuuacaauauguuuuguuauuccuauuuuaaaaagaaagagaagagagagagagacagagaaaaagagagaaaaagaaacuacccaaauuuuguuuuccuccuuaagucacucuucauucaaaucgaaaagaacucugcauaaaacuuuaccuacauuacagaaccaaagaaaacuuuuaauggaauggaguucuaaaccuaagguacuuuaagaagaaaaccaguggccacuagucuuauuccuaagggauauaacaucuaccauauaggaaauaaacaucugauguuacaagguguucaauaacauuuucaaauggugauuauuacugagaacuuuuaauacuuaagagauacaacauuauuuucauuuucuuacguuuuggggaauaaauuucuuuucaacauucucaugucuuuauuagcaaaagaaaaguacaucaucuauuauuuuuuauuuccuuuuagucauuuuuuauccacauagaacagcuuguuuuauuguuuuaccagcuuaaaauuauuaauacaccagaagauuguuaaugaucaucucaauucuuucaaguucaaaauugcuucuucugccuauucuuucaccucauauuucuugaguacaaaaguccuaucuucaaaaauauauuuaccugguaaaagaaccuuaaacagguaagaagaaaugggaaacaggcuuugaaaaauaaaauaauuaguacuuaacucuagaaauuucagacauggucccucucuagcaaaagaguaaagauuuucuacuccaaaguguaccaucacuuccugcagaugaaauggaagcacuacacugaaaagacaguaaaaugauaaaccuacugaaggcaggaguauguauaugaauaagggcagauucuccuacauaaacuuuuaaauaucauagcugaacaugaccugguccacaaaguguuauuaagacaggaucuuggaaaguaucagaaugacguauccauucacauagagacuuuaugucuagauucaacaagguauuuucuuugcagugguaaguagauuucaaaaccaagucacuucugauauaaucucaagucuauaggaaaggucaaaaugaaauguuaccaggauuacuuuucaagaaagacucaggauuacaaagucauaaagguuaauccucugauagucuguaauaacuuguauuugauuuuuuuuuaauuauuuuaaacacagaugacauuuucaauuaaaaccauguucaaacccugagguucucaauuuuugaaaaacuuuaaaaauguagaauugagcuuuuaaaggaaaauuaaggcuuauauauagcagcaacauacucaacugacuaaaaaaccucaauauaaaaagaagaaauuucauacucagguguacauauuuccuaccuuauaaaugaguaaaugaagauaauauacucaauguaauugauaugaacacaauuuuacuauucaucugguaauaauaacuuuacucaaaagauuuuaauuauguaucuugcauaacuaagcaaggagcacaacaaagaugacuguauauucugaauuuuauuagauauucugaauaucuaagauaauauucuaagauaaaacuguaaaaagcaaaacacuauugcuggaacauaaaucacauuauuaacagcuaccaacaauuuuuaugggugaaugcuucucagcaugauaaaucaacauauucauuucaugaagaaaaauacugguccuuccucugcacagaaaauuccuuaaugauaauauuuaaaagaauuccauucucugaauuucagaguacaucacaaaauauugaguaacagagaugcauguguuacuaaggagcugcuuggccaaguuuuuucuuacaauuuaauaaucaacuauagaaaaaagaggcaauuagaaaaugugauuuagcuaucauuaaucuacaucaaaggauuauaaucauguacacugugugccuuucaaguuauucucuauuauagguuucacaacagaaguugagaaaucucuuugacgaaccagucccuuauuaaaaaucaaaggaaaguccuuugcuaccaucugugcaacauuaacgccuucacugaagaaugauuauuuuguaagcuaggaagcauuuaguacuauuuaagaaaaacaacagcaacacagcuauucaaacauucaucuuccucuauuauaaaaaagucauagcauauaugaaacacuauguaaucguuacagaaagacgagcaucucucucuaaagcagaaaauagaaaaggaaauuguaauacuauaaaagcauaaucaaaguauuuuuuuuuuaaugucaccaacaccgacauguuucacagaaccugaccagcaccugcaaggucugacuuaauaugauaggguugaagagaaaauaaaaacuuuuaaauuuaacuccauuaguaaaaagaagaucauguuauaaaggauaagguaaaauuauccauaaaugguugucagcaaaauuugacaaucuccucuuuaaaguacacugaaccaagaaaaaucuguucaaguauuuagaagcucauuuuagaaaguauuacuacaaauuaggcuucuuuaucuccaguauaccauacacuauguccaugauuugacaaguucuuccuaauugcccaccuuaauuacaguaauuauauauauuauaguaaaugcaaguaacaagguucauuugaaagauaaauugugaacuacaggguuuuuaaaagagaaaaugugagagauguucaccauuccacuuaauucaucaucuucuacacaugaccauuuaacagaaucauacaauuuuggagagacagcuuaggaaucacuuaaucuaauacccuuauccuaaugagaucauuuuccaaucuccuuacuauuauaaagaagaccaacugucauuuguccccaacuaucaguuccugguauauaguuuaccuucuaaccuuuuaguucuagaaguacuuacuagauaaucaauuaccacaaagguacugcguaaaauacacugaauagacaaacuauaaagaaacaaagggaaauguuccagaaaaaaaucucaaaugcccuucaaggcuaguuuguuuugggaagaauuugggaugaaaaguugggggucuauacaacuuauauuaaaguagaaaaagcucuacaccauggaauuuagagaucuggacagaagguuauaauucaguauguuuauacucuaaauuuauugucauuuccuaucaaaguagcaaagaaagauacuaccauuauaauuuuuuaagaaggucuaugaaugcauagauguuaucauuaugaaaugaaauuauuuaaaccaaauucuaagaauguauuuuaaaauuauuuuaauuaggucaggcacaauuagcucaugccuguaaaucccagcacuuugggaggucgaggugggagaaucauuuaagccaggaguucaggaccagccugggcaacacagcaagacccuaucacccuaucucuucuaaaaaaaaaaaaaauuaauuggcaggguaugugguggugagugccuguagucguagcuacuugggaggcugaagugggaggaucucuugaacccaggaguucaaggcuucagugagccaugauggccccaaugcacuccauccugggcaacagagcaagacacugucugucucaaaauaaauaaauaaauaauuuuaauuaaguuuagucucuagcauauaaauuagcacugccaauuuuuauccaacucaauucaacaaacauaaugaauaccuacacuucgaaccaaaaaguuguguaaaauagaaaaacaguaagaaauuuacaacacaacugcccuguguagccuggguccucaguuuccuuaccuacagaauaacgggauuaaagaugaccuucguguuccuaaauuucugauuauguguuaucuaaacagggaacuucaacucaguuuaauauaaguaacguugagggcgcagugcuuaagucugguaaggacuaaaauaauuauuccuaauuauaauaaggaaaacaaacauaaaauggccuuugggaaauuaaucaguagaauuaucucuccaaucuccaacucuacuuagaugagaaagaccgcauucuuaaaggccucagaaacuuguucuaaacucaauuuuccuaaauaucuuuaaugaugaaauaugaagaaagcauuucauauuccauaguccucaaaauauaaaugauucaaacaucacuagcuagaauaaaauuucuggaaaggagucuaucuuacucuuuuuugcaccccuaugguaugccauaacugacaacgguaaauccaucaaggguuacccugcucuccauuuaucaucauuaaaaauguuauauuguuauaaauuguguuccucccccaccaaaauucacauguugagguccuaaccccccaguaacuuagaaugugacuuuacuuggaaauaaggucauugcagauguaacuagcuaaaaugaagcgauacuggaguaggguggacucccaacgcaauaugacuccuguccuuuaaaaagggggagauuugacacaaacaaggagaaaaccauguuaacauaaugauggccaucuacaagacaaggagacuggccuaaaacagguucugucucacagaccucaacaaagaaccaaccuugcauacacuuucaucucagacuuccagugucuggaauugugagacaauaaauaucuguuguuuaagccacucaguuugugauacuuuguuacagcaguucuagcaaaugaauacauuacuauacagcaacuggugaagaaccaaaucaaaauaucaucauagccacaaaucccaaaguagcacuccaaauuucagugcaaagccaauaauccuaacagaccacacacuccuaagaaucuaacaaaagucacuuucacacaaacaugaacaguuuucauacugcacaauuaacucaagaagcucacugaucccuuacccacuucaacucugaacacugccaaaggugcaugggcccuugauuaagaaccccugcacugacccucgguaucuauguggggagagaaagguagaucacacaccaaucucuuuuaacuagaaaauaaacauugucaguacugucuuuaaauaagaagaguucagaugaacuaaugacagaauuuuucuucaguguguucuuaaaaagguuuacaacuacaauaucauuuuuaaaaaacggcaacuuuuaaaaauguguguguauaguuacaucugaaaguaagaaaaacuucugcacuacagcacauuuuaucauaaaagaauggaguugaauacaaugacgcagauaacuagcugaaggaaaauuuuaauagguauaaagugauuuaaguucuaauucuuaaaaauauggaccugugguaagacucaaaguuuuugccacauuuauuuauuuuguauaaucaacuucaucuuuagcugacaauaagacaucauggcaggauucuaagaacaaaagauuuaaaaauagaaaucuaacaauuuuauaugagcauuaucaaucauccauggcauccugccagucaagaacacguucuucuacaaacacacacuaaaauagcaugaucuggucaauaaaaagacaacucuaauauccaauuaugaagauacaaaacauuuuacuuucuuuccacaguuaauuaguucucagcagaaagcacaauggaaagauacacaguuaauacacagagucuaaggacaauuuaaaaaacguuaacccccacuuaaauagaaaagaaaaugaauauuagauuucugcucuuucaaaaugugcucaucuaauuaauucagucuagaaaagugauccauggaaaaaugucguauucuaucuugggaaaguguauuuaagugaguuaagugcuauuaaggccaaaaucacuauuccauauauauucugcagaaguuaucauaaauguaaaaagcaggcaauguaaagcagcaaaaaaguuccuggauuuacagucagaaaugggcuuuauuucuccagcuucuaguacuaacuacacaugcggcuguaggcaagguuauuucaccucucuggaccuugauuucucaacuauaaaauaaggggguuagacuuuaauuaucucuaugguucccgucauuucucaaaaugaucuuccaaaaaaccaccgggugugucacaugcauguaccagggaggcugagguggggggaaucccuugagugcaggaguucaaguccggcuuggacaacauagagagacucaauggcuauuuaaaaaaaaaaaaaaaaaaccuacagauuuuaaaaucugaaauacguauuccagaacuccagauagauguuuuauauacuuuaugaauaugaauucaucaguuuuuaacugaugaauuuaacuaagagagauagggauaguucuuaccugacagcucauugucauguagcaaauuucgaagcuuacuacaaaguugaaucaugcuguccaguugucuauuuaucuucaagucuuguauccaggccgggguguaacacacuggacauccaguuccaaugcagucacuuacacaauuacuuuaaaauaauuaaaaaaaaaaaaaaaagcaacccauucagcagaauuuaauuccaaaaacuaaacaguuugaacagaaauaaauggagcagagguuauucuaacauacaauggucaauuguaauauccuuguugaauacuguuuuaaagaguaaaauacauacaucaaaucuaagguugcucauguaauuugcuaugaagagacuuuacuuagccugauuauuagucugcauaauuuucccuacaaauaaaucuguagcuucuaaagguuacagagauguaacagaaagauagaaugccuaaugcauaguagucgugcauccuaacuuuuucuaucuuaacauugcaugaaaauacccaaaacuacugcagacacugggaaagaccuucuguuuuguuuugggacuaguaucucaaggcuuuaaaguagcuuuugggaaaagaucuuugacuuuuucagacaauuuuaaaaccuguagacucaauuaccuggguuaucuaaggacuaaaguuucagaguuagaagaguuuuucuaauuuugggguuuauagaccuuuugcaaaucugaugaaaaucuauacauacucauguaaaaagagggauucacgaucccccccacaagcccaucugugaauuccagaauaagaauucuauaaaucuccuccuucauuggccucaccagauggguuccaguaggacugaguaaguaauguaacaguugaaaagccacaucuuccccaagcaccacaggacauuccuugucacaggacccaauccucuguaggcagagaggauucuuacucaauaugaacuauccucaaacaaaaccuaugccauuucuaauucuuguauccuuggcuucuagcaugauuucugacagaauguaacucaaaaaaaauuguaaaaugaaucuguaacccauaccagagcuggaagagacuuuugggaccaucuaauucaaaaaaugucacuggggucaauaaaugucaacuuucuuuagcaaaggaucuucuguacauuuguuugcuaguaguuaagaacucuaacuuggaaccccaacacaaaaaaauauguaaaacugauuacucaugcaauuuaaaucauuugugcaauacuuaauuaucaguaaaauacaaucugaaaucaacucaucaagaacuaccaccucauuuuuggaugaagaaaaugagauccaguuauuuaaguuacuuguccagcacugcacuaguacucagaucagacuaguauuuuauauuucuauaacauuuuauaaacuauucccaaauuauuuuauauacauuaauuuggaauucugaaaaaaaugucauuuuucgguggaccuguauagcucagugaguauuucucaaaugacccgugugugaugucauaaaaucaugcugaguaacagauaaauucaaaguacuagauaaaccaaugaaauuucauguaacagaguauaaaaauuuauugauauaguuucagauuccacacugugaugaaccuaaagaaaacagcacuuguuggccaggcauggugauucauuccuguaaucucagcacuuugggaggccgagacaagagaaucgcuugagcccaggaguucaagaccaucaugggcaacauggcaaaaccuugucucuacaaaaaacuacaaaaauuagccaggcgugguggggugcaccuguagucucagcuacucagaaagugagauuggaugaucacccaagccaagaaguugaggcuguagugagccaugaucgcgccacugcacuccagccugggugacagagugagacucuugucuucacaaaaaaauaaaaauaaaaaagcacuugucaaguuuugguguaguauuaaagaagaauagccacaauuaucuaaaaaagcuacugaaaauacuucaauacuucuuccaacuacaauuauguauaaagccagauuuucuucaaucaaaaaaguaucacaauagacugaauauauaaguugagaauguagcuguuuuccauucagcaagacagagauuugcaaaaauguacaacagugccacucuauuuuuuucuuugauuuguuaaaauuguuauuuuuccuuacaaaguguuauuuguguuuguauuaauggguuuauuauuuuuaaauuaauuuuuuuaaaaagucucaguuuuguacgguaaaugcaugaacacacaaaagcucuuuaugguucucaauucugaagaaugcucaaaauguuugagcaccccugccacaugucuuaaauuguaucuuagagaguagaugaauuaccuuuaucaguugaacugagcuaugucaaaucauuuuaaaaccucauugcugagcaguuuuaacucaaaaucugcaugaauaaaaacagcuaccauaauuuuuggcaucauauaaucaaaacaaaucaaaacugcacugaaugaauucuuuccuacguucaugucauauacacauaaucauuuucucuuuuaagauguucucgugucucaaaccuuugauugguuguuuuaagucacagaguccuuuagaaucugauuaaacguauggaucccccaccccaccacacacacaaaccaacuuugcauaaaaugucauggaguucauuaugcucuagcagcuuugugacugaccuauuguauacagugagcaaacccaucaucugucagcugaaacaaaauacaucugcuugcuacagaguggggacagggagugggcaucauuucguaagcagauccaugggaggcguuuuggaggcagugacauuucagcugauauauaacugguaaaaaguaagccucacagaaaucuggcauaaguacauuucacguggaagaaauagcaagugccaaaguccuggggcgggagugaauuugguguauugaaugagcuaaaaggagaagugcuggaacagugugagccagagguaaaugacguccaagaggaagacagguucuaggucccauacaggguuuugcagaccagagggcagagcuuggauuuuauuuuaacugcaauaggaacccacuaaagaguuuaagcaggguaaugauauggauauuaucgugauuuuucaaagaucacugucaagaauguagaaaaugaggaaggggugaugaugccaaaaagggaagaccagcuaugaaccuaucacaauaguaugagcagagauaauacaaugauggcuuggaacaaacuauaaacuguagaaaauucagaaaaaagguggaaaaauucaagauucaggacacauuuugaggcagaacugacagaacuuagcgaugugggauaagcaaccuagcaguaacugguaccauuuacugugaugaagauuacccaggcaggaaaaggcugaagaggaggaugaucaagaggucagcucugaacacaccaacuuuaaaaugccuuuucuuucaucauccaaacagacguaucugguaggcaacagguuccaucuccuaccccccauccuccugcuggauaucccucguauaacagaucuguuuuuccaggaacaaaauugggacccaaaacauagcugccucccagacaaccuuagcccuugaaguaauacacaagguuauuuucauauaugcucaaauuuccgaauguauuuguucaugucagacaguaacauacucauaacuggaaauaauuaaaagauuaauucaaaggagacuauauuuucccugucucauaggcaauuaaacuaagacacuuaaucucucaacugauuucuccugaacaagaaauaagagauaaaaaucuaaucuucugaccuguaagccagggccaucacauggauauaauuucacaauaacuguuaugcacugaauugugucccccaaaaagauguuugagucuucaccccucaguuacugugaaugugaccuaauuuggaaaaagaggcucuagacgaucaaguuaagaugagaacauuagggugagcccuuaauauaagugguauucguaugaaaagaggaaauuugacacagagagaagcaagcacucaaggaagaaugccagguguacaugaaagcaaagaccagagugauacaucuccaagucaaggaacagcaaagauugcuaggggaaaggcaaggagcagauucucccucacagcccacagaaggaaccaacccugucaucaucuugaucuuagacuccuagccuacagaacuagagagacaauacauuucuguuguucuaagccacccaguuuuugguucuuuguuauggcagccuuaggaaacuaauauaauaacuguaagaccuauacuuucacaauuuugagucuagauucaaaauuuaacuggaaaauuuaaaaacaucuauuugaauuauauaaaaggcauuaauuuuuuuccuccaauuuggcaaagcugucuacuaagcuuuguaacuuggacaagucauccucuuugagcuuugguuuucuuauuuguaaauuaagacacaguuuuaaagaucaaacuaagauaauguacaauagguuacuuugcagacuuugaaaguuacacaaacaucaaguaccauuauuaucaacaagauuacaugauuguuaucuaguaaaaaauacaguuguacuauauacaucaaaccguaauuacuuaccuacagaagaugugcucacauccuccuaaacacacaggcucucucagaauguuaguacuguuugaagaaauuaaaacaaucaagauuugagucauuguuagauaaacaucucacacccaauauuucauccaaggcccaacacuaccauauuucucacuuucucaaagcagaagguauuaaggaugcauucauuugaaaggcuguuacucccugguuaaauauuguaccauaacauaccugaugauuuuaaauaguaaccaccaaacuggguacaaguuguaauacauuuuaaaauguauuuucuagaaaguuggagaaaggaacaauuuuguucaaguaucucuaaaccucuuaaggcaaaaccaacuacuggcugcuucuuucaacuacuaagguguaucuuccccuuaugauucaaaguguagaccauauaccucaaaaugugucccacacguagaaugaccauauaacguaucauccaaaugagaaaacuucugagagugaagaggagugauaauugaauaggaugcugggacaacaggaauaaaccaggacugccccagacaaaccaggauaucuagucauuuugaccguaagaauccaagguuucccaauuaaaaaaaacauguguuucuuacuacuguaaaguagccaucaauuuuucacagauauauugugaaaaaugcagccauucuuucaguucacagaaaguuaauuguucuuuaagcaaauguaaacagaaaucaucagauuagcagugugucugcagauagaaugaaguucccugcagugagugagcaaagagacacagaaacaaaauauuucuaauacuguccaucaaaauaccugcuacauuuguuaauccuaacaaaguaaugauacuaauaaauacacaccaagacauuauacucaauggauguaauguacccagagaaguaaagccuuuuaaaugaugagcacuuuuucugcuugguuuauuauacuaacucuaaaaccuuuagauauuuacaccauuauuauuaaauuaccucuguacacauaccacguaucaauaaaaacaauucuucacauuucuugaaagauugaaaguaucacacugcacaucuuaauagauaugaacauucaagugaaauugagauuuucagaaagauugcgaaaaacaguacacacccacaauguuauucucaagauacugaaaauggugcucacugacguuacaaaaccuauuacuuuuuaaaaacucaccaugucugauuuuuguaucacaguauguaaaacguacagauaaaaauaugacuugugacucugccaauaaacaugaucucuuuuaacauucauacugugucuauaauuuuuguuauuugaccuagcaaaccuaaccuccuuuuccccaucaaguguacugaauucuauuucguggcaagcuccuccuaucauaauauccuuccuuuaccucuuuuauuacaucgcccuggccaaaccuccaccuucagguugcucucuaccuugaaagaaguccauucaguuuccuagcaccuuggauucccuauccagcccaggccagaguuaacuauuuccaagccaccuucaccacuaccuaauugugcugaccucuuagacacucauggaugccaaucuauaaugcuagauaggccccagagucuacuucuucccugcccacucaggcugcgaauaaccacuauuaaaaaaagaaaaaaaaaaaaaaaaaaggaaagaaagaugaauaaacuucucucuauaaauucauuugguagcaaccggguacugaggcucaugccuguaauccuagcacuuugggaggccgaggugagaggaucacuugaggccaggagcuugacuggccugggcaacauggugaaacccugucucuacuaaaaauacaaaaauuagccaggugugguggugcaugucuguaaugccaacaacuugggaggcugaggcacaagaaucacuugaaccuggaagguggagguugcacugagccaagauugagccacugcacuccagacugggugacagagcgagacccuguaucaaaaauaaauaaauaaaauuuuaaaaauauaaaaauuagccaggcaugguagugcacgccuguaaucccaggaacuggggaggcugaggcacaagaaucacuugaacccaggaggcacagguugaggugagccgagauuacaccccugcacuccagccugagugacagagccagacucugucucaaaaauauuaaaauaaaauaaaauaaagacauaaaauuuauuugguagccucuucauguuuguaucucuaccaaaguaauguauucaauauucuauaaauaaacaaacaaaugaauagauggcuauucaaaacaaucucuaugcuuccucaucucauuaacuuuacuggaacuuaaugguguaaguuuuuuaacaccuaaauacauuuuuaucucuucaccagucaucuuacccuuccuagagucuaagaggaaaauucgaucuccuuuagucacucuuccuaaaaugugcuacucuaccuauaguucccauaucuuuucugccucccaaagcacuagauauucauaauacuugccuuucuucucucauuugcaucuacacaugaacagguaaucucuccuuugacacagaaaaaacacaguuuugaucauaccucccauucuaccuucugcuccaucucuucccuuucuugaacagauaaaaguucuuaaaugagugcuccauaccagcuacucccaucuccucaccuuccuagcuuuaacucccuccacucugcugaaacuguucuccaaagcauuuuugguccccuucucucugaccacucugggaaacagcacugaccucaucuucuuuccugaaaccuuuccuuccaccgcauuuuaauauuuuuauacacauugaucugccuauuucagcauuuccuuagcugcuuuuccuaccucuccauguaggcauacccccaggaugcaguccguagccuuccggcuuucucuggcaauacuugacucaacgccuugauucuguuucucaacuuuaaauuuccuuccuaagaugacugaacucuuuagcuauaguucuuaaccuucacucuagcaauaaggugcuaucacauauuaguaaugauuuaacaugugggaauaauugaucaguuguacuaauuauucuaauuagugaguuagaauauauauuuguguugcuguuaacggauaaggaaagauaauggaaaugugaaugagaaguaugugcacuuguguguauugggggagggaacaagaaggaagugugugagccaagcugagagagaagggagugccaaauucaguggcacaugccugcaaucccagcuacucaggaggcugaggcaggaggaaagcuugagcccaagaguucagggcuauagugugccaugaucgugccugugaauagccacugcgcuccagccuggacaacacaacaagaacauguaucuuuagaaaaacuuuuuuaaaaaauuauuacaacuaggagauaccuaucaagaauauaaaugcauccaacuuuaacucagcuauuccacugccaggaauuuguccuucagcaacacuagauacuugcaaaaaugaaacuuucaaacaucaaagauaucuagacaagauucuaaaaccuuccagagauuuaagaaauaauaaaauuaaaugucauacuuuuuuuaaaaaaaggaaucaggauagcauaagacuucucaaggguaauaagagaugcuacagaacuguggaacgaggccuucaaaauaauucuugacaauuauuuuguacuuugaauucuacauccacuaacuuccacugucaaaguuaacaguaguaagaaaauucaucuuugagaauaguuaggaaguuaauaacaucuaaaauggaaaaaaaaauaaauagcaauauaaacauauuuggaaauguagagguacaugcuuguaaaacuaaaaaaaagacaaaagauguuucugaugcauagaacucaggggugaugaaggaugaagcaaagaauguuuucauuaauagucuguccuauugacucugucaacuacguucauguauaacuuuauuuaaaaacauuuuaaauguaaaggcacaugacaucaguaucacuccagcacugcuuguuacagcaaaagaccacaaacaaccuaaauguuuccaauaaggaaaugguuaaaugaaucaugcaacaacuacaugguguuuaguaucugcuuaucugaggcaguacaaugcuuauaugaacauagaaccucuugaaggauacacaagaaacugauaauuauaaguuacugaagaagauucacacuuaucugucguucauuuaacaaauacugaauggccauauacuguguuauuuuaauucuuuucacacacuguuuaccauuaaaaaaaaauuuacuauuaaaaaguucuucacaaucuguaacaccuaagccaugcaaccuuuucucucauugcuccucaacaaaaacucugcuguggucaggccagugucucuuacaacuauuauuagccuauguccaucucuuggauuucagccuccagccaucacuucugcaaaauucaugccauguaacaucuaaagaacaaaguugacuguguuccacucuuuucuaagggucuuauaaucuggccaauuaauuacauaaaccaaauuaauaugacuuaaaagauguacaaaaugcucuaaaguuacaaagaagagagcaucuaguugggguucugggauucaauguugaaaaccaaauauuuggcggggggggggguuguuuuuguuuuuuuuaaaacaagaucuugcucugucgcccaggcuggaguacaguggcaugaucacagcucacugagcuuugaacuccugagcugaagaaauccucccaucucagccucccacauagcugagacuacaggugcacaccaccauaccuggcuaauuuuuuguagaggugggguuuugccauguugcccaggcuugaaaacuaaauauuuuguacagaugaucccugacucacaaugguucgacucacaauuuuuuagcuuuauuauccugcaaauguaauacacauucaauagaaaucacacuuugaauuuugaucuuuucccaggcuagcaauaugcaguacaaugcugggccacagcaggaagucauucuguuuuucacuuuuaguaugguauucaauaaauuacaugagcuauuaaacacuuuauuauaaaauaggcuuuguguuagaugauuuaacccaacugggcuaauguuaguguucugggcauguuuaagguaggcugggcuaugcuaugauguuugguaggguauguauauuaaauauauuuuugacauacaauauuuuaaacuuacuauggguugauccagacauaaccccaucucaaguucaggagcaucuguauuuuaacuuccugauuuucuauuucucuugucuugaaauuagacuccagcccuaagacaagagaucuuaacuuucauuuuuucugagcuccccaacccaccauuaccuaccuagcauggugcuagauuaacugcaggauuucaauaaguucuuagugaaugaaccaaauggaagccuauauacaaaaaugcauuuguauuaacaauuccauuuuauccuuacccuauuuucuguuugauauacauauauauuagauagaaaaaauccaaacaaauaagagaagacauuugcaugguaacaggauuucuguaccuugaaaauucagcuacucuacuuuuuccccaucuacagucauacuucuguaacuuuacauguaguugauuuagaaagaucaguguggggaaaagcaagagagaucagauuguuacugugucuguauagaaagaaguagacauaggagacuccauuuuauucuguacuaagaaaaauucuucugccuugagauucuguuaaucuaugacccuacccccaacccggugcucucugaaacaugugcugugucaaacucaggguuaaauggauuaaggguugugcaagaugugcuuuguuaaacagaugcuugaaggcagcuugcuccuuaagagucaucaccacucccuaaucucaaguacccagggacacaaacacugcggaaggaccccugccuaggaaagccagguauuguccaagguuucuccccaugugauagucugaaauauggccuugugggaagggaaagaccugaccgucccccagcccgacacccguaaagggucugugcugaggaggauuaguauaagaggaaggcaagccucuugcaguugagacaagaggaaggcaucugucuccugcccgucccugggcaauggaaugucucaguauaaaacccgauuguagguuccaucuacugagauagggaaaaaccgccuuagggcuggaggugggacgugcgggcagcaauacugcuuuguaaagcauugagauguuucuguguaugcauaucuaaaagcacaguacuuaauccuuuaccuugucuauguugcaaagaccuuuguucacguguuugucugcugacccucuccccacuauugucuugugacccugacacaucccccucucggagaaacacccaugaaugaucaauaaauacuaagggaacucagaggcuggcgggauccuccauaugcugaacgcugguucccuggguccccuuauuucuuucucuauacuuuguaucugugucuuuuucuuuuccaagucucucguuccaccuuacgagaaacacccacagguguggaggggcaacccaccccuucagaucagugcugucagaggauaacuuagggaagaauuaaguagugagaacaauuuuuuuuaaaguucuuacugauacaaaauuuucuucgaaaagaaaaaaaggaagguaaauccaucugagaugauaauaccaaggcagaucuauuucuuaauagaauggcuccccuguaucuccaugaaauaucaacugcuauuuaauauuaggcaagacagcucccaaagugcucuuacauuuuaaagaauccucaagguaauuuuaacguguggaccaacauguugaacaucuaaaugugcaggcucaccaagccaauuaaacaauuuuucuuguguuuaucuuuagaagaauaaaguguuuaacaaguaaaguauauggauaaugacauggaaccuauaggggauucuuagcaauucauguaaauuaacuagaucuucugguauuaccacuugcaaaggcccuucaaaugugauccuaccuuaaccuaaguucuuucauacaucaauuuaacauacacuaagaaacuaugugucuggcauuguggcuacaaacgugaaccuaguuuuacuaaauauauaacugaaggagacagacaucacucaaaauauuccauaaauaaauaaaucucacaaauaaauucuaacuuggaagauacgauacaagcugaacaccaaugauuugugccuuuucuguauguauguuaaacuucauccaguggacacaaauaacuaugaaaucugcaaacuggagagaacuuuacaaaucaacgaguccauuuuccucauuuuauagaugaggaaccagaguccaggaaagcuauacaaauugcucucuuuaggaaguuaacuauauaaaccaacugaguauucuguuguuaggcuacuaucacugauuugacccugucuuaacucucuguucaccugacccagucccccuuuacccuacaauucuuuauagcuaguuauuugcaaauaacacccaucaccccagcucccugcaaccuggcuccauuuuaaaaaucuauucgcaucucggccuggugugguggcucacgccuguaauccuagcacuuuaggaggccaagaagugcggaucacaaggucaggaguucgagaccagccugagcaacauggugaaaccccgugucuacuaaaaauacaaaaauuagccggguuugguggcgcucaccuguaaucccagcuacucaggaggcugaggcaggagaaucacuugaaccuggcaggcggagguugcagugagccgagaucacaccaccgcacuccagccugggugacagagggagacuccgucucagaaaaaagaaaaucuauucauauuucaauuuaaaagcccaugaagcuuccuuccacuggcccuacccaaguacucuucucagcacuaugucgaccugcacgacaauuuacccugaacuuguauuuauuuuaucccuuauaauuaagcauacacuccuuaaaggcagaaguagaaaaugcaucaccuuaucaccccuuacacagugucucagugauuucucguuauucuaaugaauaaccagugccagggagaaaucauuccauuuggggaucacugcucugugagaaugccucugaacauucaaaacucaugaagaaaggcaaaagcugaacccggagucagagaaccuauccuuuauuucacaaauauucauauaguauuuaguacauaacagacacagcucaaggcaucuuaugaauauccacucauuuugugcagaugaagaaaaggaagcauaaaaagauaaaauaaccuaaauaauggagccaggauuugaacccagggaaucuaacuccagauuccacacauuuaacaucuacacuaugcugccucaaaguaugagagaauacaaaauuaagcuugaucaucuccuaaacaagaacucagaaaaaaaaaaauaccuaucauaaagguuaaaagauuacuuucuaacuuuucauaaaaaguugauuaaaaaggcccacguuacaauugucauagaugucuaaucccacucucacccucaaaaauaugccaagagguaccuauuaauucacaaaacaguguuauaugacaccuggggcuucuacacugcagcuccuauuaccauuuccugcuuccuuuaggaacacauuauuacugugcuuucugccagccucucaaauaauauggucuuccugucucauuuuuccaaauccuuaaauagcuucuuucugguugugaggcuugguccuaauauaaaugucacaucuggccucuugaacacuuucaucggcuucaccuugaagccagauucauguuaaaggucaagaaaggaugcccgguuauguaccaauccacccucaccagcaaguaaugcuugcugcaaaacagauccaugugcaacacaaggcagaugucagcugcaagcugaaugugaggguaaucgggguaaucacuagcccacuggguagaacucugaaacucuguaaaaggacauacugacacaauuucaaauaauaugacacugcuuugaauggaggguagcaaauggaagaagcagaccauucugaguugcuccuugccggcaaugucaggaggcuaccagggcaaaggcagagguaggaacaaugcuuuuccuccuugaguaaggugcagcuggccaugcuuuuuucacuauagauagugccaaaguugcagagacaccuacagaggaaagcaaaaucauuucuaaacauuaaagcccauguaaagaccaggcaugguggcucacgccuguaaucccagcacuuugggaggcugaagugggcggaucacuugaggucaggaguuggagaccagccuggccaacaugaugaaaccccgucucuaguaaaaauacaaaaauuagccgggcaugguggcaugcaccuguaguuccagcuacucaggaggcugaggcaagagaauugcuugaacccgggggaaggagguugcagugagcugaaaucaugccacugcacuccagcuugggugacagagugaaacuuugccuagggaaaaaaaaaaaaaaaaggcaccccaugugauauaaaauuguauaccaaaaaggauuuuuaaacuugagacauuaaguuuaucaagacuuuaucgacaguuuagcaacuauugccugugggccaaaccaagccagcagucuguuucuguacagcccuuaaggaaagaaugguuuuuacauuuuuaagagauguaaaaauaaauaagaacaaaaacuauuugcgggcagaaaggccuaaaauauuaauuaccuggcccuuuaccgaaaaaauuugcagaccccuacaugaaaacaugcagucuaagaguuaagauucaguucaucuauagagguucggauuaaaaaaaaaaaaaucaauagcauucaauagcauucuguagucaaaugggugagccaugcuaaaagucugggccugguuacugaugucuguuuacacuccguugccucuuacugucuacucacuucaguuagaaacuggaaaaauauuugguaggggauaaaaagugaaaccggcuuuguuauuuuucaggacaacauauauucauauauauuaucuauuuugucucucccaaaucauguagcaagcaaacaccacauucuuuuagauuaagacacacauuauuuaucauuuauucuaucacaaccaccaaacucaauacuuuacauacauguaaaauuucauuuuguuucuuccauaaaagcucccuaagagauggaauuuauugucugcuuuguucacuaacaaauccccaauacccagaauagggucuggcacuuuaugggugcucaauaaauuuaugauuauuaaugaauccucacaagaaaauaagcuaaucauuaguauuacucauauccggaaaaugagagaugaauaacuuggccuacucaauagugucaaagcuagaaccugaacucaggcauucugaccacagucuaagugaagcccgaugcuuccacauagguaugugccaagggaaugucuaacuuucguuggacuaucaaggugugaacuauaaugcuucuguuauugcaacuagcagugccaguuuuaaauuuccuauucucagaugacccaugugcuacaggaaaacaaacacacaacucaaaugucuucauguacucacuuaucugagugucacuuuucuaagaagugcaaugucauuuugucacagauauuaaaaguuuucgucaaagaaaauauaagugcaaaacucugacaguuaaguccuuuucauuuuuaaagaaaaaguuuggccgggcaccguggcucacgccuguaaucccagcacuuugggaggcagaggcgggcggaucacgaggucaggagacggagaccauccuggcuaacacggugaaaccccaucuguacuaaaaauacaaaaaauuagccgggcaugauggcgggcgccugcagucccagcuacuugggaggcugaagcaggagaauggcgugaacccgggaggcggagcuugcagugagacaagaucgugccacugcacuccagccugggcgacagagcgagacuccgucucaaaaaaggaaagaaaagaaaaaguuguguuacuuauacuuuaugcaacuagguaacuuaaguucugcaaguuagaaaucaaaggggaaaaaaguccaaaaaggauauaaacuuuugacagcuacaaauaacaaaaaaacugccagugaucuucauacagaaauacuuagcuguacacacagcaagugcucaauaaaaaugcuuuucagaagaaaugaaaaugagacaaaccuuucuuggguuuuacaaaccuucuugguuuguauacuagaaagagcuacacgaaaaaaagcaagaaguaacacucaugaaaaugucuuuggacggaaugaaaacccugagaggacucccauaaugugacagcaugaaggaaaacaauaaacagcaucacuaagagcggggacaccagacauacagucuuuugagcaaacuaagaaaaugagaaauuccgugccaucuucaaucuacaacuaugguagauauccgaugcuccaucccaucucacucgaaaaagcuggcacggagaaaaugucaaaaaggccaguuuaacuuagaguggcagcugcuucuaauuuagagggucuccggggcggcccgccagcccaauucgccacagcucccggaaagcagcgggguaauccagggccggguaaaaaaugcagaagccucagccccaccccagcccgauucaaacucuggaggcgcgaccgggaugaacauuuuuuuagccacaccuccagacgguucuucagcccgcugaaguucaaaaacuaccguuucaguuggauucagggcaaggggaggccgguaagucgcccaaaaauaaagugaaugagaagcagaaguuguuaauacuauaucccccggcaggugcuaaccgcacgccgacccgacugcagcgcgggaacggaaggaggaaacggaagauuugaaaagauucugccgcccccagaaacugugcgacccgugcccucgcagccacccccaagaagcuccgucuuuaccaacgcgagcagcgcagcagcuucuccaggcggucgagcgcggcgcgacugugggcccaggcaccgcgaccauccgguuccauggcgggcgcggaacgaggcucguucccggagcggauccucggcugccgguuccucggcugccgauuauccggcaucgucccgccuucggaugaaaggcuccucgcagagcgggaagcaaggaagccucgggaaaccacagggaagcugcaggccagcgacucgaaaccggccaagcucuucccgcgucugggacggcgggccgccagaggggcggggcgcgcggggaggggcggggcacggcggccgcaaugcucccaaaauagggacucgcagggcacaggggcggggccgcgagagccagccgcuggccgaguggg

SEQ ID NO: 21340 - RNA, 83186 nt, Homo sapiens
cccacucggccagcggcuggcucucgcggccccgccccugugcccugcgagucccuauuuugggagcauugcggccgccgugccccgccccuccccgcgcgccccgccccucuggcggcccgccgucccagacgcgggaagagcuuggccgguuucgagucgcuggccugcagcuucccugugguuucccgaggcuuccuugcuucccgcucugcgaggagccuuucauccgaaggcgggacgaugccggauaaucggcagccgaggaaccggcagccgaggauccgcuccgggaacgagccucguuccgcgcccgccauggaaccggauggucgcggugccugggcccacagucgcgccgcgcucgaccgccuggagaagcugcugcgcugcucgcguugguaaagacggagcuucuuggggguggcugcgagggcacgggucgcacaguuucugggggcggcagaaucuuuucaaaucuuccguuuccuccuuccguucccgcgcugcagucgggucggcgugcgguuagcaccugccgggggauauaguauuaacaacuucugcuucucauucacuuuauuuuugggcgacuuaccggccuccccuugcccugaauccaacugaaacgguaguuuuugaacuucagcgggcugaagaaccgucuggagguguggcuaaaaaaauguucaucccggucgcgccuccagaguuugaaucgggcugggguggggcugaggcuucugcauuuuuuacccggcccuggauuaccccgcugcuuuccgggagcuguggcgaauugggcuggcgggccgccccggagacccucuaaauuagaagcagcugccacucuaaguuaaacuggccuuuuugacauuuucuccgugccagcuuuuucgagugagaugggauggagcaucggauaucuaccauaguuguagauugaagauggcacggaauuucucauuuucuuaguuugcucaaaagacuguaugucugguguccccgcucuuagugaugcuguuuauuguuuuccuucaugcugucacauuaugggaguccucucaggguuuucauuccguccaaagacauuuucaugaguguuacuucuugcuuuuuuucguguagcucuuucuaguauacaaaccaagaagguuuguaaaacccaagaaagguuugucucauuuucauuucuucugaaaagcauuuuuauugagcacuugcuguguguacagcuaaguauuucuguaugaagaucacuggcaguuuuuuuguuauuuguagcugucaaaaguuuauauccuuuuuggacuuuuuuccccuuugauuucuaacuugcagaacuuaaguuaccuaguugcauaaaguauaaguaacacaacuuuuucuuuucuuuccuuuuuugagacggagucucgcucugucgcccaggcuggagugcaguggcacgaucuugucucacugcaagcuccgccucccggguucacgccauucuccugcuucagccucccaaguagcugggacugcaggcgcccgccaucaugcccggcuaauuuuuuguauuuuuaguacagaugggguuucaccguguuagccaggauggucuccgucuccugaccucgugauccgcccgccucugccucccaaagugcugggauuacaggcgugagccacggugcccggccaaacuuuuucuuuaaaaaugaaaaggacuuaacugucagaguuuugcacuuauauuuucuuugacgaaaacuuuuaauaucugugacaaaaugacauugcacuucuuagaaaagugacacucagauaagugaguacaugaagacauuugaguuguguguuuguuuuccuguagcacaugggucaucugagaauaggaaauuuaaaacuggcacugcuaguugcaauaacagaagcauuauaguucacaccuugauaguccaacgaaaguuagacauucccuuggcacauaccuauguggaagcaucgggcuucacuuagacuguggucagaaugccugaguucagguucuagcuuugacacuauugaguaggccaaguuauucaucucucauuuuccggauaugaguaauacuaaugauuagcuuauuuucuugugaggauucauuaauaaucauaaauuuauugagcacccauaaagugccagacccuauucuggguauuggggauuuguuagugaacaaagcagacaauaaauuccaucucuuagggagcuuuuauggaagaaacaaaaugaaauuuuacauguauguaaaguauugaguuuggugguugugauagaauaaaugauaaauaaugugugucuuaaucuaaaagaaugugguguuugcuugcuacaugauuugggagagacaaaauagauaauauauaugaauauauguuguccugaaaaauaacaaagccgguuucacuuuuuauccccuaccaaauauuuuuccaguuucuaacugaagugaguagacaguaagaggcaacggaguguaaacagacaucaguaaccaggcccagacuuuuagcauggcucacccauuugacuacagaaugcuauugaaugcuauugauuuuuuuuuuuuuaauccgaaccucuauagaugaacugaaucuuaacucuuagacugcauguuuucauguaggggucugcaaauuuuuucgguaaagggccagguaauuaauauuuuaggccuuucugcccgcaaauaguuuuuguucuuauuuauuuuuacaucucuuaaaaauguaaaaaccauucuuuccuuaagggcuguacagaaacagacugcuggcuugguuuggcccacaggcaauaguugcuaaacugucgauaaagucuugauaaacuuaaugucucaaguuuaaaaauccuuuuugguauacaauuuuauaucacauggggugccuuuuuuuuuuuuuuuucccuaggcaaaguuucacucugucacccaagcuggagugcaguggcaugauuucagcucacugcaaccuccuucccccggguucaagcaauucucuugccucagccuccugaguagcuggaacuacaggugcaugccaccaugcccggcuaauuuuuguauuuuuacuagagacgggguuucaucauguuggccaggcuggucuccaacuccugaccucaagugauccgcccacuucagccucccaaagugcugggauuacaggcgugagccaccaugccuggucuuuacaugggcuuuaauguuuagaaaugauuuugcuuuccucuguaggugucucugcaacuuuggcacuaucuauagugaaaaaagcauggccagcugcaccuuacucaaggaggaaaagcauuguuccuaccucugccuuugcccugguagccuccugacauugccggcaaggagcaacucagaauggucugcuucuuccauuugcuacccuccauucaaagcagugucauauuauuugaaauugugucaguauguccuuuuacagaguuucagaguucuacccagugggcuagugauuaccccgauuacccucacauucagcuugcagcugacaucugccuuguguugcacauggaucuguuuugcagcaagcauuacuugcuggugaggguggauugguacauaaccgggcauccuuucuugaccuuuaacaugaaucuggcuucaaggugaagccgaugaaaguguucaagaggccagaugugacauuuauauuaggaccaagccucacaaccagaaagaagcuauuuaaggauuuggaaaaaugagacaggaagaccauauuauuugagaggcuggcagaaagcacaguaauaauguguuccuaaaggaagcaggaaaugguaauaggagcugcaguguagaagccccaggugucauauaacacuguuuugugaauuaauagguaccucuuggcauauuuuugagggugagagugggauuagacaucuaugacaauuguaacgugggccuuuuuaaucaacuuuuuaugaaaaguuagaaaguaaucuuuuaaccuuuaugauagguauuuuuuuuuuucugaguucuuguuuaggagaugaucaagcuuaauuuuguauucucucauacuuugaggcagcauaguguagauguuaaauguguggaaucuggaguuagauucccuggguucaaauccuggcuccauuauuuagguuauuuuaucuuuuuaugcuuccuuuucuucaucugcacaaaaugaguggauauucauaagaugccuugagcugugucuguuauguacuaaauacuauaugaauauuugugaaauaaaggauagguucucugacuccggguucagcuuuugccuuucuucaugaguuuugaauguucagaggcauucucacagagcagugauccccaaauggaaugauuucucccuggcacugguuauucauuagaauaacgagaaaucacugagacacuguguaaggggugauaaggugaugcauuuucuacuucugccuuuaaggaguguaugcuuaauuauaagggauaaaauaaauacaaguucaggguaaauugucgugcaggucgacauagugcugagaagaguacuuggguagggccaguggaaggaagcuucaugggcuuuuaaauugaaauaugaauagauuuucuuuuuucugagacggagucucccucugucacccaggcuggagugcgguggugugaucucggcucacugcaaccuccgccugccagguucaagugauucuccugccucagccuccugaguagcugggauuacaggugagcgccaccaaacccggcuaauuuuuguauuuuuaguagacacgggguuucaccauguugcucaggcuggucucgaacuccugaccuugugauccgcacuucuuggccuccuaaagugcuaggauuacaggcgugagccaccacaccaggccgagaugcgaauagauuuuuaaaauggagccagguugcagggagcuggggugauggguguuauuugcaaauaacuagcuauaaagaauuguaggguaaagggggacugggucaggugaacagagaguuaagacagggucaaaucagugauaguagccuaacaacagaauacucaguugguuuauauaguuaacuuccuaaagagagcaauuuguauagcuuuccuggacucugguuccucaucuauaaaaugaggaaaauggacucguugauuuguaaaguucucuccaguuugcagauuucauaguuauuuguguccacuggaugaaguuuaacauacauacagaaaaggcacaaaucauugguguucagcuuguaucguaucuuccaaguuagaauuuauuugugagauuuauuuauuuauggaauauuuugagugaugucugucuccuucaguuauauauuuaguaaaacuagguucacguuuguagccacaaugccagacacauaguuucuuaguguauguuaaauugauguaugaaagaacuuagguuaagguaggaucacauuugaagggccuuugcaagugguaauaccagaagaucuaguuaauuuacaugaauugcuaagaauccccuauagguuccaugucauuauccauauacuuuacuuguuaaacacuuuauucuucuaaagauaaacacaagaaaaauuguuuaauuggcuuggugagccugcacauuuagauguucaacauguugguccacacguuaaaauuaccuugaggauucuuuaaaauguaagagcacuuugggagcugucuugccuaauauuaaauagcaguugauauuucauggagauacaggggagccauucuauuaagaaauagaucugccuugguauuaucaucucagauggauuuaccuuccuuuuuuucuuuucgaagaaaauuuuguaucaguaagaacuuuaaaaaaaauuguucucacuacuuaauucuucccuaaguuauccucugacagcacugaucugaagggguggguugccccuccacaccuguggguguuucucguaagguggaacgagagacuuggaaaagaaaaagacacagauacaaaguauagagaaagaaauaaggggacccagggaaccagcguucagcauauggaggaucccgccagccucugaguucccuuaguauuuauugaucauucauggguguuucuccgagagggggaugugucagggucacaagacaauaguggggagagggucagcagacaaacacgugaacaaaggucuuugcaacauagacaagguaaaggauuaaguacugugcuuuuagauaugcauacacagaaacaucucaaugcuuuacaaagcaguauugcugcccgcacgucccaccuccagcccuaaggcgguuuuucccuaucucaguagauggaaccuacaaucggguuuuauacugagacauuccauugcccagggacgggcaggagacagaugccuuccucuugucucaacugcaagaggcuugccuuccucuuauacuaauccuccucagcacagacccuuuacgggugucgggcugggggacggucaggucuuucccuucccacaaggccauauuucagacuaucacauggggagaaaccuuggacaauaccuggcuuuccuaggcagggguccuuccgcaguguuugugucccuggguacuugagauuagggaguggugaugacucuuaaggagcaagcugccuucaagcaucuguuuaacaaagcacaucuugcacaacccuuaauccauuuaacccugaguuugacacagcacauguuucagagagcaccggguuggggguagggucauagauuaacagaaucucaaggcagaagaauuuuucuuaguacagaauaaaauggagucuccuaugucuacuucuuucuauacagacacaguaacaaucugaucucucuugcuuuuccccacacugaucuuucuaaaucaacuacauguaaaguuacagaaguaugacuguagauggggaaaaaguagaguagcugaauuuucaagguacagaaauccuguuaccaugcaaaugucuucucuuauuuguuuggauuuuuucuaucuaauauauauguauaucaaacagaaaauaggguaaggauaaaauggaauuguuaauacaaaugcauuuuuguauauaggcuuccauuugguucauucacuaagaacuuauugaaauccugcaguuaaucuagcaccaugcuagguagguaaugguggguuggggagcucagaaaaaaugaaaguuaagaucucuugucuuagggcuggagucuaauuucaagacaagagaaauagaaaaucaggaaguuaaaauacagaugcuccugaacuugagaugggguuaugucuggaucaacccauaguaaguuuaaaauauuguaugucaaaaauauauuuaauauacauacccuaccaaacaucauagcauagcccagccuaccuuaaacaugcccagaacacuaacauuagcccaguuggguuaaaucaucuaacacaaagccuauuuuauaauaaaguguuuaauagcucauguaauuuauugaauaccauacuaaaagugaaaaacagaaugacuuccugcuguggcccagcauuguacugcauauugcuagccugggaaaagaucaaaauucaaagugugauuucuauugaauguguauuacauuugcaggauaauaaagcuaaaaaauugugagucgaaccauugugagucagggaucaucuguacaaaauauuuaguuuucaagccugggcaacauggcaaaaccccaccucuacaaaaaauuagccagguaugguggugugcaccuguagucucagcuaugugggaggcugagaugggaggauuucuucagcucaggaguucaaagcucagugagcugugaucaugccacuguacuccagccugggcgacagagcaagaucuuguuuuaaaaaaaacaaaaacaacccccccccccgccaaauauuugguuuucaacauugaaucccagaaccccaacuagaugcucucuucuuuguaacuuuagagcauuuuguacaucuuuuaagucauauuaauuugguuuauguaauuaauuggccagauuauaagacccuuagaaaagaguggaacacagucaacuuuguucuuuagauguuacauggcaugaauuuugcagaagugauggcuggaggcugaaauccaagagauggacauaggcuaauaauaguuguaagagacacuggccugaccacagcagaguuuuuguugaggagcaaugagagaaaagguugcauggcuuagguguuacagauugugaagaacuuuuuaauaguaaauuuuuuuuuaaugguaaacagugugugaaaagaauuaaaauaacacaguauauggccauucaguauuuguuaaaugaacgacagauaagugugaaucuucuucaguaacuuauaauuaucaguuucuuguguauccuucaagagguucuauguucauauaagcauuguacugccucagauaagcagauacuaaacaccauguaguuguugcaugauucauuuaaccauuuccuuauuggaaacauuuagguuguuuguggucuuuugcuguaacaagcagugcuggagugauacugaugucaugugccuuuacauuuaaaauguuuuuaaauaaaguuauacaugaacguaguugacagagucaauaggacagacuauuaaugaaaacauucuuugcuucauccuucaucaccccugaguucuaugcaucagaaacaucuuuugucuuuuuuuuaguuuuacaagcauguaccucuacauuuccaaauauguuuauauugcuauuuauuuuuuuuuccauuuuagauguuauuaacuuccuaacuauucucaaagaugaauuuucuuacuacuguuaacuuugacaguggaaguuaguggauguagaauucaaaguacaaaauaauugucaagaauuauuuugaaggccucguuccacaguucuguagcaucucuuauuacccuugagaagucuuaugcuauccugauuccuuuuuuuaaaaaaaguaugacauuuaauuuuauuauuucuuaaaucucuggaagguuuuagaaucuugucuagauaucuuugauguuugaaaguuucauuuuugcaaguaucuaguguugcugaaggacaaauuccuggcaguggaauagcugaguuaaaguuggaugcauuuauauucuugauagguaucuccuaguuguaauaauuuuuuaaaaaaguuuuucuaaagauacauguucuuguuguguuguccaggcuggagcgcaguggcuauucacaggcacgaucauggcacacuauagcccugaacucuugggcucaagcuuuccuccugccucagccuccugaguagcugggauugcaggcaugugccacugaauuuggcacucccuucucucucagcuuggcucacacacuuccuucuuguucccucccccaauacacacaagugcacauacuucucauucacauuuccauuaucuuuccuuauccguuaacagcaacacaaauauauauucuaacucacuaauuagaauaauuaguacaacugaucaauuauucccacauguuaaaucauuacuaauaugugauagcaccuuauugcuagagugaagguuaagaacuauagcuaaagaguucagucaucuuaggaaggaaauuuaaaguugagaaacagaaucaaggcguugagucaaguauugccagagaaagccggaaggcuacggacugcauccuggggguaugccuacauggagagguaggaaaagcagcuaaggaaaugcugaaauaggcagaucaauguguauaaaaauauuaaaaugcgguggaaggaaagguuucaggaaagaagaugaggucagugcuguuucccagaguggucagagagaaggggaccaaaaaugcuuuggagaacaguuucagcagaguggagggaguuaaagcuaggaaggugaggagaugggaguagcugguauggagcacucauuuaagaacuuuuaucuguucaagaaagggaagagauggagcagaagguagaaugggagguaugaucaaaacuguguuuuuucugugucaaaggagagauuaccuguucauguguagaugcaaaugagagaagaaaggcaaguauuaugaauaucuagugcuuugggaggcagaaaagauaugggaacuauagguagaguagcacauuuuaggaagagugacuaaaggagaucgaauuuuccucuuagacucuaggaaggguaagaugacuggugaagagauaaaaauguauuuagguguuaaaaaacuuacaccauuaaguuccaguaaaguuaaugagaugaggaagcauagagauuguuuugaauagccaucuauucauuuguuuguuuauuuauagaauauugaauacauuacuuugguagagauacaaacaugaagaggcuaccaaauaaauuuuaugucuuuauuuuauuuuauuuuaauauuuuugagacagagucuggcucugucacucaggcuggagugcagggguguaaucucggcucaccucaaccugugccuccuggguucaagugauucuugugccucagccuccccaguuccugggauuacaggcgugcacuaccaugccuggcuaauuuuuauauuuuuaaaauuuuauuuauuuauuuuugauacagggucucgcucugucacccagucuggagugcaguggcucaaucuuggcucagugcaaccuccaccuuccagguucaagugauucuugugccucagccucccaaguuguuggcauuacagacaugcaccaccacaccuggcuaauuuuuguauuuuuaguagagacaggguuucaccauguugcccaggccagucaagcuccuggccucaagugauccucucaccucggccucccaaagugcuaggauuacaggcaugagccucaguacccgguugcuaccaaaugaauuuauagagagaaguuuauucaucuuucuuuccuuuuuuuuuuuuuuuuuucuuuuuuuaauagugguuauucgcagccugagugggcagggaagaaguagacucuggggccuaucuagcauuauagauuggcauccaugagugucuaagaggucagcacaauuagguaguggugaagguggcuuggaaauaguuaacucuggccugggcuggauagggaauccaaggugcuaggaaacugaauggacuucuuucaagguagagagcaaccugaagguggagguuuggccagggcgauguaauaaaagagguaaaggaaggauauuaugauaggaggagcuugccacgaaauagaauucaguacacuugauggggaaaaggagguuagguuugcuaggucaaauaacaaaaauuauagacacaguaugaauguuaaaagagaucauguuuauuggcagagucacaagucauauuuuuaucuguacguuuuacauacugugauacaaaaaucagacauggugaguuuuuaaaaaguaauagguuuuguaacgucagugagcaccauuuucaguaucuugagaauaacauuguggguguguacuguuuuucgcaaucuuucugaaaaucucaauuucacuugaauguucauaucuauuaagaugugcagugugauacuuucaaucuuucaagaaaugugaagaauuguuuuuauugauacgugguauguguacagagguaauuuaauaauaaugguguaaauaucuaaagguuuuagaguuaguauaauaaaccaagcagaaaaagugcucaucauuuaaaaggcuuuacuucucuggguacauuacauccauugaguauaaugucuugguguguauuuauuaguaucauuacuuuguuaggauuaacaaauguagcagguauuuugauggacaguauuagaaauauuuuguuucugugucucuuugcucacucacugcagggaacuucauucuaucugcagacacacugcuaaucugaugauuucuguuuacauuugcuuaaagaacaauuaacuuucugugaacugaaagaauggcugcauuuuucacaauauaucugugaaaaauugauggcuacuuuacaguaguaagaaacacauguuuuuuuuaauugggaaaccuuggauucuuacggucaaaaugacuagauauccugguuugucuggggcaguccugguuuauuccuguugucccagcauccuauucaauuaucacuccucuucacucucagaaguuuucucauuuggaugauacguuauauggucauucuacgugugggacacauuuugagguauauggucuacacuuugaaucauaaggggaagauacaccuuaguaguugaaagaagcagccaguaguugguuuugccuuaagagguuuagagauacuugaacaaaauuguuccuuucuccaacuuucuagaaaauacauuuuaaaauguauuacaacuuguacccaguuuggugguuacuauuuaaaaucaucagguauguuaugguacaauauuuaaccagggaguaacagccuuucaaaugaaugcauccuuaauaccuucugcuuugagaaagugagaaauaugguaguguugggccuuggaugaaauauugggugugagauguuuaucuaacaaugacucaaaucuugauuguuuuaauuucuucaaacaguacuaacauucugagagagccuguguguuuaggaggaugugagcacaucuucuguagguaaguaauuacgguuugauguauauaguacaacuguauuuuuuacuagauaacaaucauguaaucuuguugauaauaaugguacuugauguuuguguaacuuucaaagucugcaaaguaaccuauuguacauuaucuuaguuugaucuuuaaaacugugucuuaauuuacaaauaagaaaaccaaagcucaaagaggaugacuuguccaaguuacaaagcuuaguagacagcuuugccaaauuggaggaaaaaaauuaaugccuuuuauauaauucaaauagauguuuuuaaauuuuccaguuaaauuuugaaucuagacucaaaauugugaaaguauaggucuuacaguuauuauauuaguuuccuaaggcugccauaacaaagaaccaaaaacuggguggcuuagaacaacagaaauguauugucucucuaguucuguaggcuaggagucuaagaucaagaugaugacaggguugguuccuucugugggcugugagggagaaucugcuccuugccuuuccccuagcaaucuuugcuguuccuugacuuggagauguaucacucuggucuuugcuuucauguacaccuggcauucuuccuugagugcuugcuucucucugugucaaauuuccucuuuucauacgaauaccacuuauauuaagggcucacccuaauguucucaucuuaacuugaucgucuagagccucuuuuuccaaauuaggucacauucacaguaacugaggggugaagacucaaacaucuuuuugggggacacaauucagugcauaacaguuauugugaaauuauauccaugugauggcccuggcuuacaggucagaagauuagauuuuuaucucuuauuucuuguucaggagaaaucaguugagagauuaagugucuuaguuuaauugccuaugagacagggaaaauauagucuccuuugaauuaaucuuuuaauuauuuccaguuaugaguauguuacugucugacaugaacaaauacauucggaaauuugagcauauaugaaaauaaccuuguguauuacuucaagggcuaagguugucugggaggcagcuauguuuugggucccaauuuuguuccuggaaaaacagaucuguuauacgagggauauccagcaggaggaugggggguaggagauggaaccuguugccuaccagauacgucuguuuggaugaugaaagaaaaggcauuuuaaaguugguguguucagagcugaccucuugaucauccuccucuucagccuuuuccugccuggguaaucuucaucacaguaaaugguaccaguuacugcuagguugcuuaucccacaucgcuaaguucugucaguucugccucaaaauguguccugaaucuugaauuuuuccaccuuuuuucugaauuuucuacaguuuauaguuuguuccaagccaucauuguauuaucucugcucauacuauugugauagguucauagcuggucuucccuuuuuggcaucaucaccccuuccucauuuucuacauucuugacagugaucuuugaaaaaucacgauaauauccauaucauuacccugcuuaaacucuuuaguggguuccuauugcaguuaaaauaaaauccaagcucugcccucuggucugcaaaacccuguaugggaccuagaaccugucuuccucuuggacgucauuuaccucuggcucacacuguuccagcacuucuccuuuuagcucauucaauacaccaaauucacucccgccccaggacuuuggcacuugcuauuucuuccacgugaaauguacuuaugccagauuucugugaggcuuacuuuuuaccaguuauauaucagcugaaaugucacugccuccaaaacgccucccauggaucugcuuacgaaaugaugcccacucccuguccccacucuguagcaagcagauguauuuuguuucagcugacagaugauggguuugcucacuguauacaauaggucagucacaaagcugcuagagcauaaugaacuccaugacauuuuaugcaaaguugguuugugugugugguggggugggggauccauacguuuaaucagauucuaaaggacucugugacuuaaaacaaccaaucaaagguuugagacacgagaacaucuuaaaagagaaaaugauuauguguauaugacaugaacguaggaaagaauucauucagugcaguuuugauuuguuuugauuauaugaugccaaaaauuaugguagcuguuuuuauucaugcagauuuugaguuaaaacugcucagcaaugagguuuuaaaaugauuugacauagcucaguucaacugauaaagguaauucaucuacucucuaagauacaauuuaagacauguggcaggggugcucaaacauuuugagcauucuucagaauugagaaccauaaagagcuuuuguguguucaugcauuuaccguacaaaacugagacuuuuuaaaaaaauuaauuuaaaaauaauaaacccauuaauacaaacacaaauaacacuuuguaaggaaaaauaacaauuuuaacaaaucaaagaaaaaaauagaguggcacuguuguacauuuuugcaaaucucugucuugcugaauggaaaacagcuacauucucaacuuauauauucagucuauugugauacuuuuuugauugaagaaaaucuggcuuuauacauaauuguaguuggaagaaguauugaaguauuuucaguagcuuuuuuagauaauuguggcuauucuucuuuaauacuacaccaaaacuugacaagugcuuuuuuauuuuuauuuuuuugugaagacaagagucucacucugucacccaggcuggagugcaguggcgcgaucauggcucacuacagccucaacuucuuggcuugggugaucauccaaucucacuuucugaguagcugagacuacaggugcaccccaccacgccuggcuaauuuuuguaguuuuuuguagagacaagguuuugccauguugcccaugauggucuugaacuccugggcucaagcgauucucuugucucggccucccaaagugcugagauuacaggaaugaaucaccaugccuggccaacaagugcuguuuucuuuagguucaucacaguguggaaucugaaacuauaucaauaaauuuuuauacucuguuacaugaaauuucauugguuuaucuaguacuuugaauuuaucuguuacucagcaugauuuuaugacaucacacacgggucauuugagaaauacucacugagcuauacagguccaccgaaaaaugacauuuuuuucagaauuccaaauuaauguauauaaaauaauuugggaauaguuuauaaaauguuauagaaauauaaaauacuagucugaucugaguacuagugcagugcuggacaaguaacuuaaauaacuggaucucauuuucuucauccaaaaaugaggugguaguucuugaugaguugauuucagauuguauuuuacugauaauuaaguauugcacaaaugauuuaaauugcaugaguaaucaguuuuacauauuuuuuuguguugggguuccaaguuagaguucuuaacuacuagcaaacaaauguacagaagauccuuugcuaaagaaaguugacauuuauugaccccagugacauuuuuugaauuagauggucccaaaagucucuuccagcucugguauggguuacagauucauuuuacaauuuuuuuugaguuacauucugucagaaaucaugcuagaagccaaggauacaagaauuagaaauggcauagguuuuguuugaggauaguucauauugaguaagaauccucucugccuacagaggauuggguccugugacaaggaauguccuguggugcuuggggaagauguggcuuuucaacuguuacauuacuuacucaguccuacuggaacccaucuggugaggccaaugaaggaggagauuuauagaauucuuauucuggaauucacagaugggcuugugggggggaucgugaaucccucuuuuuacaugaguauguauagauuuucaucagauuugcaaaaggucuauaaaccccaaaauuagaaaaacucuucuaacucugaaacuuuaguccuuagauaacccagguaauugagucuacagguuuuaaaauugucugaaaaagucaaagaucuuuucccaaaagcuacuuuaaagccuugagauacuagucccaaaacaaaacagaaggucuuucccagugucugcaguaguuuuggguauuuucaugcaauguuaagauagaaaaaguuaggaugcacgacuacuaugcauuaggcauucuaucuuucuguuacaucucuguaaccuuuagaagcuacagauuuauuuguagggaaaauuaugcagacuaauaaucaggcuaaguaaagucucuucauagcaaauuacaugagcaaccuuagauuugauguauguauuuuacucuuuaaaacaguauucaacaaggauauuacaauugaccauuguauguuagaauaaccucugcuccauuuauuucuguucaaacuguuuaguuuuuggaauuaaauucugcugaauggguugcuuuuuuuuuuuuuuuuaauuauuuuaaaguaauuguguaagugacugcauuggaacuggauguccaguguguuacaccccggccuggauacaagacuugaagauaaauagacaacuggacagcaugauucaacuuuguaguaagcuucgaaauuugcuacaugacaaugagcugucagguaagaacuaucccuaucucucuuaguuaaauucaucaguuaaaaacugaugaauucauauucauaaaguauauaaaacaucuaucuggaguucuggaauacguauuucagauuuuaaaaucuguagguuuuuuuuuuuuuuuuuuaaauagccauugagucucucuauguuguccaagccggacuugaacuccugcacucaagggauuccccccaccucagccucccugguacaugcaugugacacacccggugguuuuuuggaagaucauuuugagaaaugacgggaaccauagagauaauuaaagucuaacccccuuauuuuauaguugagaaaucaagguccagagaggugaaauaaccuugccuacagccgcauguguaguuaguacuagaagcuggagaaauaaagcccauuucugacuguaaauccaggaacuuuuuugcugcuuuacauugccugcuuuuuacauuuaugauaacuucugcagaauauauauggaauagugauuuuggccuuaauagcacuuaacucacuuaaauacacuuucccaagauagaauacgacauuuuuccauggaucacuuuucuagacugaauuaauuagaugagcacauuuugaaagagcagaaaucuaauauucauuuucuuuucuauuuaaguggggguuaacguuuuuuaaauuguccuuagacucuguguauuaacuguguaucuuuccauugugcuuucugcugagaacuaauuaacuguggaaagaaaguaaaauguuuuguaucuucauaauuggauauuagaguugucuuuuuauugaccagaucaugcuauuuuaguguguguuuguagaagaacguguucuugacuggcaggaugccauggaugauugauaaugcucauauaaaauuguuagauuucuauuuuuaaaucuuuuguucuuagaauccugccaugaugucuuauugucagcuaaagaugaaguugauuauacaaaauaaauaaauguggcaaaaacuuugagucuuaccacagguccauauuuuuaagaauuagaacuuaaaucacuuuauaccuauuaaaauuuuccuucagcuaguuaucugcgucauuguauucaacuccauucuuuuaugauaaaaugugcuguagugcagaaguuuuucuuacuuucagauguaacuauacacacacauuuuuaaaaguugccguuuuuuaaaaaugauauuguaguuguaaaccuuuuuaagaacacacugaagaaaaauucugucauuaguucaucugaacucuucuuauuuaaagacaguacugacaauguuuauuuucuaguuaaaagagauuggugugugaucuaccuuucucuccccacauagauaccgagggucagugcagggguucuuaaucaagggcccaugcaccuuuggcaguguucagaguugaaguggguaagggaucagugagcuucuugaguuaauugugcaguaugaaaacuguucauguuugugugaaagugacuuuuguuagauucuuaggaguguguggucuguuaggauuauuggcuuugcacugaaauuuggagugcuacuuugggauuuguggcuaugaugauauuuugauuugguucuucaccaguugcuguauaguaauguauucauuugcuagaacugcuguaacaaaguaucacaaacugaguggcuuaaacaacagauauuuauugucucacaauuccagacacuggaagucugagaugaaaguguaugcaagguugguucuuuguugaggucugugagacagaaccuguuuuaggccagucuccuugucuuguagauggccaucauuauguuaacaugguuuucuccuuguuugugucaaaucucccccuuuuuaaaggacaggagucauauugcguugggaguccacccuacuccaguaucgcuucauuuuagcuaguuacaucugcaaugaccuuauuuccaaguaaagucacauucuaaguuacugggggguuaggaccucaacaugugaauuuuggugggggaggaacacaauuuauaacaauauaacauuuuuaaugaugauaaauggagagcaggguaacccuugauggauuuaccguugucaguuauggcauaccauaggggugcaaaaaagaguaagauagacuccuuuccagaaauuuuauucuagcuagugauguuugaaucauuuauauuuugaggacuauggaauaugaaaugcuuucuucauauuucaucauuaaagauauuuaggaaaauugaguuuagaacaaguuucugaggccuuuaagaaugcggucuuucucaucuaaguagaguuggagauuggagagauaauucuacugauuaauuucccaaaggccauuuuauguuuguuuuccuuauuauaauuaggaauaauuauuuuaguccuuaccagacuuaagcacugcgcccucaacguuacuuauauuaaacugaguugaaguucccuguuuagauaacacauaaucagaaauuuaggaacacgaaggucaucuuuaaucccguuauucuguagguaaggaaacugaggacccaggcuacacagggcaguuguguuguaaauuucuuacuguuuuucuauuuuacacaacuuuuugguucgaaguguagguauucauuauguuuguugaauugaguuggauaaaaauuggcagugcuaauuuauaugcuagagacuaaacuuaauuaaaauuauuuauuuauuuauuuugagacagacagugucuugcucuguugcccaggauggagugcauuggggccaucauggcucacugaagccuugaacuccuggguucaagagauccucccacuucagccucccaaguagcuacgacuacaggcacucaccaccacauacccugccaauuaauuuuuuuuuuuuuuagaagagauagggugauagggucuugcuguguugcccaggcugguccugaacuccuggcuuaaaugauucucccaccucgaccucccaaagugcugggauuuacaggcaugagcuaauugugccugaccuaauuaaaauaauuuuaaaauacauucuuagaauuugguuuaaauaauuucauuucauaaugauaacaucuaugcauucauagaccuucuuaaaaaauuauaaugguaguaucuuucuuugcuacuuugauaggaaaugacaauaaauuuagaguauaaacauacugaauuauaaccuucuguccagaucucuaaauuccaugguguagagcuuuuucuacuuuaauauaaguuguauagacccccaacuuuucaucccaaauucuucccaaaacaaacuagccuugaagggcauuugagauuuuuuucuggaacauuucccuuuguuucuuuauaguuugucuauucaguguauuuuacgcaguaccuuugugguaauugauuaucuaguaaguacuucuagaacuaaaagguuagaagguaaacuauauaccaggaacugauaguuggggacaaaugacaguuggucuucuuuauaauaguaaggagauuggaaaaugaucucauuaggauaaggguauuagauuaagugauuccuaagcugucucuccaaaauuguaugauucuguuaaauggucauguguagaagaugaugaauuaaguggaauggugaacaucucucacauuuucucuuuuaaaaacccuguaguucacaauuuaucuuucaaaugaaccuuguuacuugcauuuacuauaauauauauaauuacuguaauuaaggugggcaauuaggaagaacuugucaaaucauggacauaguguaugguauacuggagauaaagaagccuaauuuguaguaauacuuucuaaaaugagcuucuaaauacuugaacagauuuuucuugguucaguguacuuuaaagaggagauugucaaauuuugcugacaaccauuuauggauaauuuuaccuuauccuuuauaacaugaucuucuuuuuacuaauggaguuaaauuuaaaaguuuuuauuuucucuucaacccuaucauauuaagucagaccuugcaggugcuggucagguucugugaaacaugucgguguuggugacauuaaaaaaaaaauacuuugauuaugcuuuuauaguauuacaauuuccuuuucuauuuucugcuuuagagagagaugcucgucuuucuguaacgauuacauaguguuucauauaugcuaugacuuuuuuauaauagaggaagaugaauguuugaauagcuguguugcuguuguuuuucuuaaauaguacuaaaugcuuccuagcuuacaaaauaaucauucuucagugaaggcguuaauguugcacagaugguagcaaaggacuuuccuuugauuuuuaauaagggacugguucgucaaagagauuucucaacuucuguugugaaaccuauaauagagaauaacuugaaaggcacacaguguacaugauuauaauccuuugauguagauuaaugauagcuaaaucacauuuucuaauugccucuuuuuucuauaguugauuauuaaauuguaagaaaaaacuuggccaagcagcuccuuaguaacacaugcaucucuguuacucaauauuuugugauguacucugaaauucagagaauggaauucuuuuaaauauuaucauuaaggaauuuucugugcagaggaaggaccaguauuuuucuucaugaaaugaauauguugauuuaucaugcugagaagcauucacccauaaaaauuguugguagcuguuaauaaugugauuuauguuccagcaauaguguuuugcuuuuuacaguuuuaucuuagaauauuaucuuagauauucagaauaucuaauaaaauucagaauauacagucaucuuuguugugcuccuugcuuaguuaugcaagauacauaauuaaaaucuuuugaguaaaguuauuauuaccagaugaauaguaaaauuguguucauaucaauuacauugaguauauuaucuucauuuacucauuuauaagguaggaaauauguacaccugaguaugaaauuucuucuuuuuauauugagguuuuuuagucaguugaguauguugcugcuauauauaagccuuaauuuuccuuuaaaagcucaauucuacauuuuuaaaguuuuucaaaaauugagaaccucaggguuugaacaugguuuuaauugaaaaugucaucuguguuuaaaauaauuaaaaaaaaaucaaauacaaguuauuacagacuaucagaggauuaaccuuuaugacuuuguaauccugagucuuucuugaaaaguaauccugguaacauuucauuuugaccuuuccuauagacuugagauuauaucagaagugacuugguuuugaaaucuacuuaccacugcaaagaaaauaccuuguugaaucuagacauaaagucucuaugugaauggauacgucauucugauacuuuccaagauccugucuuaauaacacuuuguggaccaggucauguucagcuaugauauuuaaaaguuuauguaggagaaucugcccuuauucauauacauacuccugccuucaguagguuuaucauuuuacugucuuuucaguguagugcuuccauuucaucugcaggaagugaugguacacuuuggaguagaaaaucuuuacucuuuugcuagagagggaccaugucugaaauuucuagaguuaaguacuaauuauuuuauuuuucaaagccuguuucccauuucuucuuaccuguuuaagguucuuuuaccagguaaauauauuuuugaagauaggacuuuuguacucaagaaauaugaggugaaagaauaggcagaagaagcaauuuugaacuugaaagaauugagaugaucauuaacaaucuucugguguauuaauaauuuuaagcugguaaaacaauaaaacaagcuguucuauguggauaaaaaaugacuaaaaggaaauaaaaaauaauagaugauguacuuuucuuuugcuaauaaagacaugagaauguugaaaagaaauuuauuccccaaaacguaagaaaaugaaaauaauguuguaucucuuaaguauuaaaaguucucaguaauaaucaccauuugaaaauguuauugaacaccuuguaacaucagauguuuauuuccuauaugguagauguuauaucccuuaggaauaagacuaguggccacugguuuucuucuuaaaguaccuuagguuuagaacuccauuccauuaaaaguuuucuuugguucuguaauguagguaaaguuuuaugcagaguucuuuucgauuugaaugaagagugacuuaaggaggaaaacaaaauuuggguaguuucuuuuucucucuuuuucucugucucucucucucuucucuuucuuuuuaaaauaggaauaacaaaacauauuguaagaagccugguuggucagaggagauugucuguguuaauuaggagaauguuugucaggcagcaugaaaucauuuguuaauuacuguuuuuaaucuuaucagauuauuguuauuuuuccaacuuuccuccguuucuaauguucuucuuuuucuuucuuucuuucuuuuuuuuucugggccugaaauuaccuuuugcuaauccaguuuguguggagagauagagugccagauugggaguuaggggacuccuuccuucuuuuuguuuuaacuuuaguccuucauuguuaaaaugaaagaauuagacuaaauuauuuucaaguuuucuucuagcucuuaaaauuaauucuaacaucucuuacguaaacauuuggaaagauuuaagagauaucaaauaauuuauucacuaguacuuacugaguacugucuauucaugugcucaccacugugcugggcugagcuggguugauuuuaccuauguugucauggggugggagagaauuuuaaggcaauuuuuuuuucuugaagaaaaugaauaucccaaagacaaaaacaacauaagacaacuugaagguaguugaucgucaaaaucagaaaaguggaugacuuguaugauuugucaaugaagaaaaacuuuuccucuacacucuuagguucauuguauggaggccugugaauuaaacuguaaaacaauuagcaagagaaaaaauagauuuuuauuuaugaauauacuugugaguucacagaaaaaugugacucuccaaacagguaaaaaugggaguuuauaaaccuaaauuaaggggaagagguagagggaagaaaaggcuucuauggaaagaacaaauggcuuucuuucuuuuuuuuuuuuuuaacuauaauuucugggauacaugugcagaacaugcagguuuguuacauagguuuacacaugccguggugguuugcugcacccaucaaccugucauguacauuagguauuucuccuaaugcuaucccuccccugaccccgcuccaucggacaggccccggugugugauguuccccucccucuguccauguguucucauuguucaccucccacuuaugagugagaacaugcaguguuggguuuucuguuccuguguuaguuugcugagaaugaugguuuccagcuucauccaugucccugcaaaguacaugaacucauucuuuuuauggguguauaguauuccaugguguauaugugccacauuuucuuuauccagucugucauugaugggcauuuggguugguuccaagucuuugcuauugugaacagugcuacaauaaacauacaugugcaugugucuuuauaguagaaugauuuauaauccuuuggguauauacccaguaaugagauugcugggucaaaugguauuucugguccuagauccuugaggaauugccacacugucuuccacaaugguugaacuaauuuacacccccaccaacaguguaaauguguuucuauuucuccacauccucuccagcaucuguuguuuccaugacuuuuuaaugaucgccauucuaacuggcgugagaugauaucucauugugguuuugauuugcauuugucuaaugaugaugaugagcuuuuuuuucguguuuguuggccacauaaaugucuucuuuugagaaguaucuguuuauauccuucgcccacuuuuugaugggguugauuuuuucuuguaaauuuguuuaaguucuuuguagauucuggauauuaguccuuugucagauguauagauugcaaaaauuuuucucccauucuguagguugccucuucacucugaugauaguuucuuuugcugugcagaaggucuuuaguuuaauuagaucccauuugucaauuuuggcuuuuacugccauugcaguaaaagacuucaggacauuguuuuagucuugaagucuuugcccaugcccauguccugaaugguauugccuagauuuucuucuagcauuuuuaugguuuuaggucuuauguuuaagucuuuaauccauguugaguuaauuuuuauauaagguguaaggaagggguccaguuucaguuuucugcauauggcuagccaguuuucccaacaucauuuauuaaauagggaauccuuuccccauugcuuguuuuguuagguuugucaaaaaucagaugguuguagauguguggcauuauuucugagggcuuuguucuguuccauuggucuauauaucuaugucacaaugguuugccgcaccuaucaacccgucuucuagguuuuaagacccacaugcauuagguauuuguccuaaugcucucacuccccuugcccccaacccccugacaggcccuggugugugauguucuccucccuguguccaugucuucccauuguuuaacuuccacuuauaagugagaagaugugguuuuugguuuucuguuccuguguuaguuugcugagaaugauggcuuccagcauuauccaugucccugcaaaggacaugaagucauucuuuuuuauggcugcauaguauuccaugguguauaugugccacauuuucuuuaaaaaucacuuucuuccguggucucuguaagugagguauacuggccauccuuuaauuccuuaaacuuacuacaguugccccuugaauaacauaggcuugagcugcauggguccacuuauauacagauuuuuuuuggucaaaugcagauggaaaauacaguauucauggaaugcaaaacccaaguauacagagggcugacuuuuucuacacucugcuucuccaggagugaguacaggaauugaguguguggguauuuugguauccaagggaguucucgaaccaguccccugauaauauggaggaacaacuuuguaugcucucugcuauugggcuuuugaacauuuuaucaucuugcucuugccucuuggucuagguaacuugugaucuuuuagaaugcuuuuuaccauuucuauuacuguaacacuugucagagccaauauauuuccucuuggaugauagccacauaauuggcuauuguuucuacucuuuucuuuccaaaguuccuccuccacauggcagucagagugguaauucuacaauauaaaacauuauaucccuuuucugcauuggaugugagauccacaggacuguuuccuuuacaucauuuacaucucagcucaaaaaucaacuucuccuugaugccuuccuugaugaccuuaauuaaaguagcaggugaguguaaagaagaguaucucucacaaaaucuggcacuuuguguacauagagacaauuuuuuuucuuuuuaaaaacucugcugaaucuuuguauauucugucuacccucaauggaaucuuuguguuuuaauucuugauuauaaaucuauauuuuucaaauuuuuaaaaaguauuuuauauauauauauguagaaaaaauauauauuuucuaaccauauaguuuaaugaauuugcacaaacugaacucacccagaacaaaaacaauacucuggaagccccucuugugcucccuuucagucacuacuuuucccuguagggguaaccaacuacuauucugacuuaacacauuaaaucaguuuugacuguuuuauauuugauguaagugaaaacauauaauguguauguaguuuauuuugcuuaagagauuauguuugaauauguaguuauuguucauuuauucuuacuaaucuuugguuauacagcuugacguuaauauuagaugauaccuaaagggucaugacuauugucuuuaauccccuuuauucauuuugucagagauacguuuugaagucauauaguaugaguccuccaacuugguucuucaguauuauguugguuguucuaagucuuuugccuuucaaauuguaccuuucuuuuuccguguaaauuuuauaauugcuugucgaguuuuacaaacaagccuacuggaaauuacauugggauuuguuauaucuguaaaucuguuuggaacaauuggcaucuuaacaauauuguuauaguucaugaacaugguauaucucuccauuuguguagaauucuuuaauaaguauuuuguaauucuuagcaaacagaacuuauacauucuguuagauuuguauuuuauggguuuuuuuggguacuauauuuggaauauaaguuucauguuuuguucucugcuauaucuucagucucuaggauauggcacaaagucggauucaguaaguauugaaugagugaauaucugcuaucaaagaguucacacucuaggagcugagaaagaaguacauaauuaaaagaugauacacuuuaggggaacuguaaacaaaauucuucgggagcuccaugugggagcaauaaauuucauguaacagauuucuuuuucuuuuuuucugucagauuugaaagaagauaaaccuaggaaaaguuuguuuaaugaugcaggaaacaagaagaauucaauuaaaaugugguuuagcccucgaaguaagaaagucagauauguugugaguaaagcuucagugcaaacccagccugcaauaaaaaaagaugcaagugcucagcaagacucauaugaauuuguuuccccaaguccuccugcagauguuucugagagggcuaaaaaggcuucugcaagaucuggaaaaaagcaaaaaaagaaaacuuuagcugaaaucaaccaaaaauggaauuuagaggcagaaaaagaagauggugaauuugacuccaaagaggaaucuaagcaaaagcugguauccuucuguagccaaccaucuguuaucuccaguccucagauaaauggugaaauagacuuacuagcaaguggcuccuugacagaaucugaauguuuuggaaguuuaacugaagucucuuuaccauuggcugagcaaauagagucuccagacacuaagagcaggaaugaaguagugacuccugagaaggucugcaaaaauuaucuuacaucuaagaaaucuuugccauuagaaaauaauggaaaacguggccaucacaauagacuuuccagucccauuucuaagagauguagaaccagcauucugagcaccaguggagauuuuguuaagcaaacggugcccucagaaaauauaccauugccugaauguucuucaccaccuucaugcaaacguaaaguuggugguacaucagggaggaaaaacaguaacauguccgaugaauucauuagucuuucaccagguacaccaccuucuacauuaaguaguucaaguuacaggcgagugaugucuagucccucagcaaugaagcuguugcccaauauggcugugaaaagaaaucauagaggagagacuuugcuccauauugcuucuauuaagguaggaugcuuacucugaaauaccaucucagaaugaggccaacuauaaagcaauuucuuugcaguuuuugaaaaauggcauaggauuacuaggauaauuaaccuuucacagacaugauacuuccucugaaccagagaagccagauucauagggagagcaucucuacuucaguuggagcaguggccccugagucugggcgcaugaucuuguaggagaaaaccaauauuugaauauuucggcuuuuauuuugccaagugcuuuugcuuuugucuauuuuaccuucaguuuuuaucauuuuguuuaccugucuucaugcuuuaugaauguagacaauugcuaaguuauuacaggcaacaauguuuacuuaguaaaaaagcccauauuuaccauccaaauucaaccaaaauuuggaagguugaaagauguggucuguacauuucuccaaugaccgggacauuugacuaucagaaauggcuccuccaguucaccacaaaggagcugcuuuuuacccuacaaucagcuguuccuuuuacugaccuguucauugacguucauucucuuuaauuauugccucaacaccugagauguggcagcguuuuauggaaccuggccuguuuucugaacacuuggcagugguuaaucuuugaaacugacacaaacacuacaugugaaauagagcaguaggcaccauagcuuuauaagcuuugcucugugauuucaugcaaauguuaggaaaguaugauaugguagaccuuaguacuaaauuaggauagcuuuuaugcagucucagcgacuguacguagucaauucacccaggaaauccuuuggucuucuggauggguagagaacuuugggacaccugggaggaaccacuuggagguccacaaacaugaggcuggugggcaacauaaaacauuugagaagaacauggaguagacauugagugugguccaaagauuccuguauuucuguguggagaaagggaauagcauaaacugagcuuaucccagcugcugcugguuuguuuuccuugcuuuucuuccagauuaaugaggaauacagucagcucuguguaucugugcauucuauguuuauggguucaaccaacugcgaaucaaaaauauuugggagaaaagccaauaacaauacgcaauaaaaaaaugcaaauuaaaaaauaucguauaacaacuaucuacauagcauuuauauuguauuagguguuauaaguaauuuagagaugauuuaaaguauacuggaggaucucuguagguuauuugcaaauacaucauuuuauaugaggaaucuggauuuugguaucugcugggauucuggaaccaaucccccacagauacugagggaugacuguacucuauuucugauaccagugaggcagggaccuuacaacaugaccacauauccuuuggacauguugaauuuuugcacuuggcucugguuguguuuuaguuugauuuuugcaaagccugacuuaacaaaauuagacauuuuuugucaucucuguuauauauauguauauuauauguacauauaagcuauuguaaacaaaguuauagacauaaguagcuaguguaaugauuauuuuuguucauuuugcuggcuaauacauaguaauuuauauauuuugcuuucugggaaauuuuuggacuaucaggcaagcauuuacuuauauugguggcgacuuuuucuucuaaccauaagaauaauuuaucuuuauuaaugaggaucccuagggucuaggccagaguuuuguaaguucuuucuuaaaggugcaguuagaguaaauguuuucagcuuugcaggccaugaaaucucuaucauagcgguucagcucugccuucuuagugcaaaaguagccacaggcaauaugcaaacuaauaaaacuuacguacaaaauugggugacuggcccauaggcuauaguuugccuacucuuggucuaggcaugugaagaaacuguaauagaauauuaagucaggauaaaaugauggcaugcuccugucuuggugaauuuucucuauuaauacguucaagauuacuucauaugaguuuugucaguuugcuuagaguuuugccggaauuauuaaauccauuuuuauuuccuugaacuuaauuauuaaaugcaauuauugucaccaguugucagauuauguuaugguacauuuuuuaaaaguuaauuuuuauuguuuuuaaaaucaccaauuaauaguguccuuuuaaauuuuuuuaugaguugaauguaugccucucgccuuagcuuuauuuuaauaaauauauccuuaaaaucagauuugcuuauauaaauauauuuauauauuuuuuucuuuuuuggggguggggggaggggcgggggacagagucuugcccugucacccaggcuggagugcaguggcacaaucucagcucacugcaaccuccgccuccuggguucaagcaauccuucugcuucagcuucccgaguagcugggauuacaggcaccugccaucaugccaggcuacuuuuuauauuuuuaguagagacggaguuucaccauguuggccaggcuggucucgaacuccucaccucaggugauauguccucggccucccaaagucuugggauuacaggcaugagccaccauaccuggccaaucuuuuuagaaacaguuuucauuucauuccuauccuaauuuucucauuugcagccaagaaugaauaaaucuauguguacacauauugcaauucugcuaucuuauuuauauuuugcacccaccugcuucagaaaaggauuugaaguggcucuaaaguuaaagcuacuauaaaauggaacaaggaguugguaaagaggaaagaguuacuacaacuggagugaauuuaguuuuggugaccuuuaaggcagccaaagcaaauaaggggaaggaccagguuuugugcugucaaaagauaaugcaucuuuuuugguggugauuauuuauguuuuguacccaccuacuucagaaaaggauuucaaguggccuaaaguuguuuagacuugcguuguauuguuucuuaagcauguugguaaacuugcaguuucuauaguuugagcacauguuugcgcugagcauccuugguguaugcaccgagggcagagaacccagcaggaguuuguucuccugcacuaguuaccuucccccacugcagguagggcuuuacugauugauuucugagcuuggaaacauuauuaauaaacaucguauaauaccuugccccaaacuaccucugggcaucaucauuggccauaaccuuuccauagcuaccacccuacuggcagcuacuucucuuuucuugccccuaccacuugcauuaauuuucuauuggugccaaaacaaacuuccacaaaguuagugauucaaagcaaugcaaauuaauuuucuuacaguucuguacaccugaagucuaguaugggucucaucacacuaaaaucauguugucagcuguuuucaggagguuccaggaaagacccauuucauuuuugcuuggaugguuggcagggacuucauaauucuugugguaagacugagauccagauuucuugcugguuuucagcugaggguuguuuccagguucuagagacucucacauuccuuuaguucgugguccucuucuucaucucauccagcagcagcagauugaguccuucucacaucuuaucuuucugacauagccagaaagacccucugcuuuuaagaauucauacgauuaaauugggcuacuugagaaaugcggaauaaucuccccaucucaagguguguccacuuaauuacacugcagugucccuuucaccacguaagguaacauagucacagguucuggggauuauucguguguggacauuuuuggaggucguaauuuuuugaccacaccacugaaguagcuuccuaauuucccuuuguauuuccugcagucaguucucuauguaacagccagaguaaucugaccgaaaucaaaauuaucauuucucugcucuccuaucaguaagucuuuuuuauaccccucuuccuauuugaauaucuucauaacucauguuccuauuugaaugucugcaucagcuauguuaaacugcuauugagaacacugugucaugaaugggagaguuuaugagaaagcuuugugcguaaguagaaacuaagauacucauuguuuauucuucugauuuauuaccacaauuacuuuugcaccaacccaauagaaaacaaaauacuaaggauauagagaaaauuuuuuauuuucuauuaugucagcuuugcuugagaauuugugccauccugaccuuccccuuuucuucccccacacccuucuaccaaguucucuagcacaaauucuuaaaauggcaaugacuacucauaauuuaugccacagcaaugacuuacuguggaauagaagaauggcuugaagcuggcaugccaugauuuauuagugauguagacauaauagauaauguuuugaaugcaacuuacaaggcaugguaugcuuagaacauaacaaaggugaugaagauccccuggagagagagaagaucccuugugaggagucucauuuagaguuuaacuuuguaguuuauuauacuugaagacagucauguuauauugugugugaaauuauauauccuucauaguagcuucaugagaagguagcaaaggaaacaaaagcagccuuggcauaugugauauuuucaagaguuuaauuucuaaaacaccuccuggagucaguaucuauuuuucuccucugucacucaccacauauguauaagucugcuuuuguaauaccaguaacuuauugugccauugaccagguuaucagaauuaucuguuaaauuacaggcauaccucauuuaauugcacuucacuuuuuuaugcuucgcagagaguuuuguuuuuguguuuuuuggcaauccugcauugagcaagucugucagugcuguuuuuccaacagccuaugcucagugugucucugugucacauuuugguaauucucacaauauuucagauauuuucacuauuguuguaucuguuacggugauuugugaucagugaucuuugauguaacuauuguaauugcuuuggggcaccacaaacccuggccauguaacauggcaaacuuaauugauaaaugucuuuucugacuauucugcuuacugauaauucucccaucucucucccuuugaaucccuguuuccugggacacaagaauauugaauuuagguaaacuaacaacccuacaauguccucugaguuuucaaguggaaggaagagucacucaucucuuacuuuauauaagaagcuagaaaugaugagugaggaaggcauguugaaaguugagauaggccaaaagcuaggucucuugccaaacagccaauuugugaaugcaaagaaaaaauucuuuaaguaauuuaaaagagcuacccuguugaauacacaaaugagaugagaagaaagcauaaccgccuuacugccgauaugaggagaguuggaauggucuggauagaugaucaaaccaaccacauuuccuuaagcaaaacccuacuccagagcaagauccuaaaucucuucaauucugugaagacugagagaggugaggaagcugcagaagaaaaguuggaagcuagcagagguugguucaugaaguugaaggaaaaaagcugucuccauaauauaacaaugcaaguugaaacagcaggugcugauggagaaacugcagcagguuauccagaagaucuagccaagauaauuaugagaguggcacacuaaacaacagauuucagugaaguugaaacagccuuuuguuggaagaauaugccaucugugucuuucauagcuagaaaggagaagucaaugccuggcuucaaaggacaggcuuucuuguuaggggcuaaugcagcuggugacuugaaguggaagccaaugcucauuuaccauuuagaacaacaaagccugggugggagcacaucuugacagcaugguuugcuaaauauuuuaagccugcuguugagaccuacuguucaggaaagauauucaaaauauuacuaauugacagugccaccuagucacccaaguguucugaugaagauaaggacauuaaugcuguuuucaugucucccaacaaaacaucaauucuguagcccauggaucaaggaguaacuuuacuuucaagucuuguuacuuaagcauuuuguaaggcuauagcuguuguagauggguauuccacagaugauucuggaaaugacucaccauucuagaugccauuaauaucauugaugauucaugggaggauguccaaauguuaacauuaacaguaguuuggaaaagaguugauuacaguuuucauggaugacuuugagagguucagaacuuaaguggagaaaguaacuauagauguaguagaaauagcaagauaacuagaauuagaaguggagccugaagacguaacugaauugcugcagccucaugaucaaacuucaauggaugaggcguuguuuguuauagaugagaaagaaagugguuucugcagauggaaucuacuucuggugaagauguugugaacacuguugaaaugacaacaaaggauuuagaaaauuauaucaucuuaguugauaaaacagcagcaggguuugagaggauuggcuccaaucuugggagaaguucuacgcagauaaaaugcuaccaaacagcgucacaugcuacagauaaaucuuucaugaaaugucaguggauguggcauacuucauuguccugauuuaagaaacugucacaaccacccaaaccuucagcaacuaccugcuugcucagucagcagccagcagcaucaaggcaagaccauccaccagcaaaacaauugucaccauuuuuuagcaauaaaguuauuuucaauuaaggucuguucauuuuuuuuaaaaaacauaaugcuauugcacacuuaguagacuacaguauagugcacauauaacuuuuauaugugcugggaaaccagaagauucgugugacuuguuuuauugcaauauuugcuuuaucgcagugaccuggaacugaacugacaguaucuccgagauaugccuguauuuuauucaguaaauucuaagaagcuacagaaauauuuaacauauuuuagagcuucauuccaguugguucauuuuuguuuguuuguuuuaauggcaucuaauugccaagaagggaagucuuugguuccuggucgguucauuuacauggaaaggcuuaaccaugcuaggcaagucauuugucuuauacuuaauuguaacguucuguauuguuuuuaugaauauguuuauuaaugguauuuuagaagagcuaacauuuauaauaaggaaaaguuuuguuuuuauguguguguuuuuggaaaguuaauuuauauuguuggaauauguguggaucugcaguauguacaaaugugugaaggaucuuuccuuugauugaaagauuaggaauaaaagauucagugggacacacacacacucuuauuuucagccuucaguguauuacuugaaaauaccaaauucauuuaaaauuuuuaauaagccuuggcaaauacuuuccuuagauaaauuauguuugcugugguuuaagaaaaguucaauuauucuuucaaguugugaggagcccaaaagugaguacuugaaaguaauuuaaagaagccagaaucaaaacuuaauuuauuuccuggcuacuucauaucaguucaagcuauuccaguuacuguagacucuaucuaauuaucauaauuuuauuuaugcgcaugacauuacauuuacaugaaguagaaagaugaaaauaugacaaaacuuucaaguacuagagaggagaaagcagauugguuauaaaaagcaagccguuugcuaaucagcuauacaguucagggguggggagaauguuaacagaagacacuuugauaauaugaagaggugacaugaaagaaaaauagcaacugucuaacaaccuuaaaagagagucuacuuguauucuuuaaauugucacuccguuucuguuugacuauucccuugagacucuuccauuucacaauuguguuuauauuauuuuuuaagcuucuuuaauauuuuuuuuuugcauuaccauguagaauuagaauggggaaaucuuugagaagguuuuugugugugaguacuuucauguuaaagauagggaaugugugugguucuggcaguuuaucugcucacuuguuacaggauuguuuuggaaaaaaaaauuuguaucuuggcagauauuccugcauucauuuguaaccguuaugaauauaaagcaaaaguugcaggggcucacaccuguaaucccaauaauuuuggaagcuaaggcaggagauugcuugaguccauuaguuugggcaacauagugagacccccaucucuacaaaacaauaaaaaaaauuagcugggcauggugauguaugccuagcaguagcauacugcugaggcugaggcaggagaauugcuugggcccaggagcuugaaguuacagugagcuaugaucaugccauugcacuccaguugcuaaauacaugauaacuugcucuagaaguagaauuugcacuguuaagaaaucugggaaaauguugcuuuuuuuuuuuuuuuuuuuccugaaacugggguaauuaauuugaaaccuacaauccuuuuagacccauugagcauuuaaggucauuuuguuaauuuaggaauauaaaaauguauguugcaugagaauuuacuuuuuuagaaaacugaagauuugagaaacagcccagagcacagaaacagagacaauuagauauaaaaagcauuuuuuuuuuuucugagguagagucucgcucugucgcccaggcuggagugcaguggugugaucucaacucacugcaaccuccgccuccuggguucaagcaguucuccugucucagccuccugaguagcuaggauuacaggcguguaccaccaugccuggcuaauuuuuguguuuuuaggagagacgggauuucaccauguuggcuaggcugaucucaaacuccugaccucaugauuugccugccucagccucccaaagugcugggauuacaggugugagccaccacgucuggccagcaaaauuuuuuaaaaagaaaaaaaaaucaaauauuauauuuaggagaauuagugauuucuacauuaucaaaccaacagaggaaaaaaauuucagaaaaaaguauugggagagggguuggguggggagagauuuauucacuaaagaagcacucacgaaacucauugaacacaauguuaugcauguaacuucugucuauagcuuuuuauuuggucuuuuuugagaguaugcucugcuagauauuuuugcuuuaucgucauggacuuagguacuguacccugcccuguuauccuaaaagaacugauuaguuauauuugcagugaguggugauaauaauguaauuucaagaaaauuuuuaccuucaucccgcugcauaaaugccuccuucuuccuaaagccugacauuguuuuacaaagggacaguauccuuuauauuacagcuagagauuuuuaaaaaggcuuuaagaguuaacggauacuuaaaacguaauauguaauuaaauauaaaugauagaugucagaucuuuccacauuacaugaagggccaaauuuaagagacccugguauuagauagcuggaggauuauuaucucucacuucuaggaaaauaaaaaagaagagugggagggcagacuaccugagaccaguuccccagaacuccuuugccacagucuaccuucgcuggaggcuggcagcagagggaagcuauuuuuuuugucuuacuucaagacagcuuuaaagugaccuuaaaagucuacucauuuauaguaggauuuaguuggaucaugacacacaagacacagaaaguucaaaacuggaaggggucuucaauuuuaaugcuauuuaauaauugacggugucuuaauaugaaagucgaauuaauauugucugccuucagaguauuuuccuugccuugugccucauuuuaauucacuuauuccccggaucuugcucaucugauuuaaaaagagguugugauuucuaaaguaaaguuauuguauuucuuacuauuccucaucugccuucuccauugcaucagugugcuacuguugcuacuguuauaacauuguugcauagcucuccagaguacuggaauagagaaauagagaaauugaaaaccacuuguuagaaaagacuuguaaggcuacauuacagaagcucuauuucguauaguugaauuaguugauaauggguggugauuuuagucuugaacugggcggggagcagggggauaaaaaauuuaaugcuaauucugugggcugauuugaauagguuuguacugaucucuuuuuuugccauuuuaaacagagcaacuguugcuuccuagaaaauguugaacaaauaaggugaauauaaacuaaauguauuaggauggaguaacugccaauaaaauggcaguuuuuggcuguuuuuuaacuuugguuucacugaguagucuucugggcuaaacaguuuugguuguuuuaaacaauacucagaagccauuuacaaaugcucaaaaauuguuuuuuucacaagugaaauuauggcuuuuaaaacuucauugugagcacaugaucuuuggccaguguccuuuauuugguaccugaaaugaauuuugaauauggcuuucuaauagauuuuguagucuauauucaagcaugacuguacuucuugauaucucagaauaauuuauacgcagacaauuucuuuuuuguuuuguuuuuuugagacggagucuugcucuguggcccaggcuggagugcagugacaugaucuuggcucacugcaaccucugccuccugggcucaagugauucuccugccucagccucccaaguagcugggauuacaggcuggcaccaccaugcccgacuaguuuuguauuuuuaguagagacgggguuucaccauguugaccaggcuggucucaaacuccugaccucaggugauccacccaccuuggccucucaaaguguugggauuacaggcgugagccaccacacccggccuaauaauuuauuaacucaugaacaguagccuuaagagaaaacgauuuaaguuuuacuuuauauugaagaaggcagcauuuaaaaaagcucaauauuuuccuuucuuuccuuaaugcuuuuuaauuuccguuuuguucauuuuucuagggcgacauaccuucuguugaauaccuuuuacaaaauggaagugauccaaauguuaaagaccaugcuggauggacaccauugguaguugucugguuuuuauucucauucuuucuguguuuuacaguucuuauaguuuauaguuauguaguugucuauauaucauccucugccacauauacucuuuuuagucugaagaacuuauguuuucaucaaguaugagaacaugauuacuuuccuucuagcuuuucauuugugacaggcaagaaauugguuaccuuuugacagacuaccuuuagauuuaggaauccauuuguacuguacugcagaauuuagcuaaugucuagagguaacagcuacagcugacaucaggcuccauucuguagcacugcaugucacuggaaccaaauuucuuggaacaaaaagaggucggaggaacugaguauaggaaagugaucacaaggaaguaauucucacugagggucuaucuuagccucacuuauacccuauccaauuguagauauauaaggcaguagaaaucuuugcuuacauuaaacauuuuuaaaggucuuugcuuauuauuacuaaaaaagugugaagcauaaucuggaaacagaaugacacaaauacuuggaaacaauugguauguaggccaauuacauuaggacaaacaugagauuugaaugcagccacagaagugucagcaaaugaaguggaugccuucauccuguaacuagaaauucagcccagaaauuaggagacucucaguaggcuaggugcaagaaagcugggagaguuuagucuagaucagucgcuuugcugguuggacucuacuggcuggcuaaccuuuucaaagaaagguuaauuuuauuuuuuucuucaaagccacuaaggcaaguuguaguaaagauugguuagugauuuagaggguuuagugccuaguuuggauuccuuucuccuaaaaauagaccuacagauguugagugugauaucacuuauuaugaauugaaauugauguacuuaaaaaguauagaaugccagagauuuauuagaauacagcauuguuuauaguucauuagacauaaggaaagauuuggauguaaggcaucuuugaacacuccauuguugccguuucugucauucagcaagcucuuuuuguauuccuacucguguuauuucucuuaucaauaacagcagccauacagcaauuuguagguucagcaaauagcuuaucuuaaaagcauuccuucacggauacuuacuuuguugcaugauauguguauguacugguacagauuuuauguaucaucuuguuauuaaauauguagacuuuuuucuuaauguguuacauuuauuguagaacauuuaaggagcuaccguugguuuaaaacuacauuuucuucuaaaaaacagaaaagugcuugacccaaggcucaaaugagaauagccuuucuuuuuuuaugaguuacacagaucuugauugaaagauuauuaauaguaacuuucacucugucagcaacuuauaguguuuuugaguauuuagguaacaauaaauuuacugccugacguuuacauuuauuuuucuaaagugugauauuauaauaucauccauugcucuuucuuaucacuucuuucacuucuuuuucaaaaaauuuaauuagcaugaagcuugcaaucaugggcaccugaagguaguggaauuauugcuccagcauaaggcauuggugaacaccaccggguaucaaaaugacucaccacuucacgaugcagccaagaaugggcauguggauauagucaagcuguuacuuuccuauggagccuccagaaaugcuguguaaguaguucaacguaaaaauuauuuuuaaaauggaccuauauucuugaaucaaggugugugauaaagcagacuuuaaaauagucaaguugauggcuuucuucacuuucacaacuaaaauuagaugugaucaucacauucugcacucauaaucagccuucaugcccuuuuuaugauacaguugguccuucauauucuuggguucuacacuugaggauucagccaacugcagaucaaaaauaauugggaaauaucaaugacagaucggauaaaaaaaauguguuacauauauaccauggaauacuaugcaacuacaaaaaagaaugagaucauguuuuuuugugggcacaugauggagcuggaggccauuauccuuaguaaacuaacgcaugaacagaaaaccaaauaccgcauguucucacuuauaagugagagcuaaaugaugagaauucaugaacacaaagaagggaacaacagacaccagagucuacuugaguguggaggaugggaggagggagaggagcagaaaaaguaacuauuagguacuaggcucaauaccuggguggugaaauaaucuguacaacacacccccguuacacaaguuuaccuauauaacaaaccuucacaacuuaaauaaaaaccuagaauaaaaguuuaaaaaggggaaaaaaaauaacacuacgauaauaaguaauauagguaaaacaauauaguauaaauauuuauacagcauuucauacuauuagguauuacaaguaaucuggagaugauuuaaaguauacgggaggauguguguaguuuacaaguaaauacuaugccaucuuuuauaagaaacuugagcagcggcacauuuugacaucacggguugaggaaccaauuccccauggauagcaauggggauaacugugcugacauauuugggggagauuuacuuucuuaauucagaaacaguugucaauuuuggaagcuuucauuuaauggaaaaauuuacuuaguguuuauauucuguagauugauuuacacuuuaauaagcaguuauuguagaaauaauuauuuuguaugcuuccuaauaguuuggaauuauuuuaaauauuucauucccauuuuauuuuuucuguguauuuacuauuacaacagguaaagcauauaagaauuuaaauauugggccggggcaguugaauuauuucuuaaauuuuuuacaucauucacaugagguucugggugaacuuuuugcagugucaggacacagagaugcauuagugaaugccagcagcuggauuuuaaaauuggcauugucaagagugucacaagcaaaugcuguauguagauuuuguaucuuuaaucuguaacuugguucaugucucccuauguaguauuuuauucuuuucaguuaauuaaguaguugaaaugaaaaugcagguauugcgucucugcccuuguugcuucuauagguuugaaaagggcacaaaaaaauuaaguuuucaaugguaacagaugcaaauaagaauuauaaaaugcagggcuucuaggucguaauuuuuuauugguaauuauuuaacauaauugaaaaccaaauuaauaaugcaagaauguaccauaccuuggugcuguuaguuucaguaaaugugucuaaucucuuuuaucucucaucacagguuauaagauaauuggggcaaauucaggggauguguauauucuuccgguuuuuauuuguguguguguguguguguacacacgugcguguuugugugugucuccauauacauggaccuauuucuuuguaaggaccuaaccgauaugacccucccauauguguugcaagcuauuugguaacgcaaauuauugcuugggucaggugaaacugacuaguuuucauucuaggguucuuaaaucagccaugacuacuuuaauggauggagcacuggucagggcguuagggaaucuagcuuuuauuugugacuccauuacugacuguauagcuucaggcagguuaauuucugugccuugguguccucaccuauaaaacaugggugaugccugcugcauuucuauuucuucagagcauagugaggauuaaugagccaaaacacagagccugucuugugguuuguacaccaugauucgucacugcacugugagggcuuauuaauauacaaggaguggcaugagacagugagugagucugccuucacaggugccuucaguguugguuuaaguaggacuaccuagugaaguggcaaauuuagguauaucuguuccucagcacuguccaguagaccuuucuguggugguggaaauguuuauaucuaugcuggacauucaguagccacuagucaccuuuacuauugaacacuugaaaauuagcuauugcuaccaaggaauaaauuuuaaaauguauuuuauuuuaaccauaugugccagugacuacuguguuggacagcugguugauacagcugggcaguugggaaguaggguuuauuucacccaagagguugggauugauauuggauaaaggauaguagggcagaugaagggacagauuuaauccuaggguacaagaguaugguggcuguuucuaaaaauuuccuuuccagacuauuggucuucauacuuuuuuccuguguuuuuugccucuuaaaaacaugucguagucauuguuguucaucugauuggcuuuacaaauuuccugacuguucuccuccuuuucagguuacuuuucuuuauucacucuccauccugcagccagagcaccugcagaagaacacgagucuggccaagucauuuauuugcuuaaaauccuuccguggcuuccucuuaauguuuuuaaaauaaagguuaaaucccaaaauaugguuuauaagacccuggauggucuggugcuacuuuccucucuguucucaucggucuucacagcuucuccuuucccccuuuccuucaagcauuuuuugcaccagcuuuucugaauuuuuguuuccuuaaaauauguagggucuuuuaccuccuagccuuuguacaugucuuugcauugucuagaauauuuguuuuugguagccaguuucucauuuggguuucaccuggguuauccuguccuuuuggccaccuuuccugaugugguacuucuccccagucguaggacuuacuguuuccucccuucucgugaggcuguaagcuguaugggccagggaucaugucugcccucccuaguucugccaagugccuaauguagucuguauccacauuuguuuguagagugaauuaguguuugaaugaaugaagauuaugguauacuuuuuccucuuuuuugauaaaaggucagaugacaugaaaaugggaauugccuccuucugccacuaccuuuacugugugacaagaugucuaaaaccaaguuucccauaucugugccuuuucuaaggugguugaacugguuccuggcagcuuuugcccaauuggcauccauggcauguuacuuuuugugggauuguggcuacccaaaguaauuccuauagccuugacuuuuaagugcaugcugucucaauguucuagagacugucuucuagaauuagguaguaacaggugagaauagaugaaauuuauuccugcccuuuccuccauuucuuaaggagaucaugggaagggggucuggagcauggagacuaugggauucuuacuacucuucuauuucuuccugaagcucuuacuccuuauaaaccauuaacaucucaaauucuggaaucugaguuggcaaacaaacuuuuucugucucugcuuacuguaucucuuacucuugcuggaacucuuuucucaauaaccaggccugaacucuucccauggaagaaggguaagaaccagcaagggcaaacaccauucugucugacccucuuuaggguuugcuacuuuggcugauugaagaaguaaaguccuuuuugcuuacuguaaauuucuaaguggccuccuuuagcucuagcauagacauuuuggcuguguucuucaugaccucaagguugaaguuuucucuuagaugccuuccuuucuucuuaagucuucucauagucccuccauugcuccuuugccucaucauccccucaguugucugccugcuucuguucuaguaggagugaacagugaacagucuguuaaagcacugauuauagaauggugugagguaugccuucauagcacggugcucacaguaguaugaaagucucagcuagggcugaaaguaagaccagaggaagucacagaaggcuuucuggaagaagaagaacuucgaguuuugaaaaaauagaacgggaggaugggauuuugagaaagauaagauaugggugcuaagguacucaaggccagacugcuucuucauucauucuaggaacuuccguuagugauguaaguggaauaaaaggauggaggaggaugagaggccagagaagaugggcagggucuuugaaaggcugugugugcuaaacagagugcugauuuuaaguugaaaaccuccuccuucacacuggggagggaacucaguuaagagguuuguccaguaauccaggaaaggagugaugagagucaaaucaaaguagugacaguaguggugggaggggggugggguggagaauuagccauauuuauuaauuuauucuuucaaaugaaguuugauuuacuuuguacuguuucaaaaauaccauauuaggauguuuugaaguuggguacguacauagauucuaguggaguaccgauuaggauguugauugaaauugguaaguauauacaguggauuaauaaaguugguuucuaucaagucgauugauaaacuuuaugucguguguuauucuuuaaaugaauacaucaguuugcuagguuuuuguuuaggaauuuugcauuuuaaaaguuagagugauuugugauuuuaucuuucacuucuugucgguagauuuugauaucaaaguuagacucauagcuucuaaaaaguaaucaggaccaagcugcaugucuccauuuguuuaagcauucuguuauauauaucuuaguaaaguuuuuagucuguuucauauauauguauguagguauacacaugcauauaccuauuaauugagguuauucuaguuauagacugaguaucccuugcccaaaaugcuugggaucagaaguauuugggauuucuuucagauuuuggaauauuugcauauacguaaugagaugucuuagggaugguucucaagacuaaaugugaaauuuaucuguguuucauaaacauuuuauacacauagccugaagguaauuuuauacaauauuuuaaacaauuuuaugcauuaaaaugguuuuuuaaguacuguguuuggaauuuuccgcuugugucauauuggugcucaaaaaguuuccaauuuuggagcguugcaaauuucagauuuuuggauuagcaaugcucaaccuguauaguauuugauuauuuguugcuaguaaacuggauauuguguuaauaaauauaauuuguuauucuugauauauaggagagcuguugauuuaguacguuucuauccagucaacaccuaauucuaaagaucuaauuaucauuuauuaacuucuauuucuuauugcauuugucagugcuuccagaaugaugcaauaaugaugauaguuggcuugcuuguuuuguucuuccuuuuuuaaaaaaguacugacccauagaguuauagucaauacuaauauccauauuaaauacaaagauuaauguucuuuauugcccuguggaagcuuucuucccuuuauuauuuucuaacaagacuguauuuuauuuuauugaaugauuuucagcuucugcagagaugaucuuauacuuuuuuuguuuuuguuuuugagauagggucucacuguguugcccaagcuggucuugaacuccagggcucaagcgauccucccaccucagccucccaaagcuuaugcuuuuuugacuauugauguuguuaauacauuuaaaaauauuaaauaaugcuuguauuccugggauaaccuugacuugguguugugcaucauuuaaacacaaauuuuacaugaauuugcuaggguuuuaggaauuuugcauuuaugauuauaaguuagagugauuugugauuuuuaucuuucauuuuuuugccucggauuuugauaccaaaauuauacucauaguuucuaaaaaguaaucagaaugcuuuuuuuuuuuuucuuuuuaccuuuccucuucucuggaacaugaauagaaugucuucuggaaauauccugcccccugccaacuuagcauaacaguaucuauuuugauaacucacauauuauauaauuuuuggagaucucucuaguuuuguuauuaguaguaaucacucugauagaccaguguauucauaauaaaauacagacacuaaagagaaaauggacuuuuuuuuuuuaucccaucaaguucauccuuaaaaagucccuguggauugagaagccaaggcggguggaucccgaggucaggagaucgagaccauucuggcuaacacggugaaaccccgucucuacuaaaaauacaaaaaauuagcugggcgugguggugggcgccuguagucccagcuacucgggaggcugaggcaggagaauggugugaacccgggaggcggagguugcagugagccgagaccgcaccacugcacuccagccugggcgacagagcgagacuccaucuaaaaaaaaaaaaaagaaaaaagucccugugaacuguaaaacuuuuaccuauuuugacguuuuaucugaggcugugauuuugauuaacuuuauaacuuuccuguuacuguaagaauauuaguuugaauuagaagaguaaauauuuuuguaaugcagcccuaggagagagaagaaaaacuaagacaaaauccagccauagaguuagucucggaugucacugggagagaggaaggcuuguauaagagggcuaaguaauccagguuuuauccugauacauguucuggcauuauuaauaaguuaugggccuggcgcagugccucaugccuguaaucccaacacuuugggaggccgaggcggguggaucacuugaggucaggaguucgagacuagccuagccaacauggugaaaccccaucucuacuaaaaauacaaaaauuagccggguguggcggcgugugccuguagucccagcuacucgggaggcugaggcacaagaaucgcuugaaccugggaagcggagguugcaguaagccgagaucgugccaccacccuccaaccugggggacagagcgagacucggucucaaauaauaauaauaauguaucaugaauggugcuaaguaagaugugacuuuaaauauuggagaccaggcuuaagaaguaccuuuucaguagugacauauaaaauauaaagauaacugagagcuuuuuuuguagcccaggaaguggggacaguaaccaacucagucauauaaguuagacauugaauguguguggaagacuagacauaggaaaaagaauggaguauuaucugcugcaaagccaagugaauuuaaaagcguccuauugaauauugguggagggaaaucuugaaaccuuauaaggcaaggcaaaauagcuaagaauuaaccauauugugguaugaauuuaaagucaaugauacucuuuauuugccaucuucacuauuuaauuuuaaauuaaaugagcuuuuauaguucaccagugaagucucccaauccuauuuuuucccauagaggcuguguucuuuauuaauuuuccuacugcaauguuuuugggcccuaaaucuuuauaauuauggaggauucgaauguacaguggaaagucauauaucuacuucauacuuucucuuuuguuuugauuuaacucuaauauucuggcaacuuacuguuuuuauaugucuugcauuuaaauaacaguauuaagucauuuaacccuuaauuuuuuuuugcauaaaaaaaguaccuuuugugagcuaaaacaauaagaaagucaguucuguuuuaacccuagaucaugaaaaaaagauuuauaaucuuuguugucugggaguauuuauaacuguucaaaacaucauugguaaucugucuuccccacugcccucuguacaucccagugugaagcuagaaccacagcucuuacggucacaugagaaccauuuugaguguguggcgaauaacaugugcuucuuuuuuuuuauuuuuaauggauauguaggauuuuagaaugugguacuugaucugccauuaacaguuuuccuuggaaggauguugaauucugaaguagaaaauauuacauggaccauuggaccuauuaauugucccacugcccuagguuaauuuuaaaaaauuaauugccagagauaauuuauguuuuauagcuuuaaaaacccauguugcuaguuugaauuacucugcuuuauccugcuccauagcaagcaaagugacuugaaaaauuaaaucuauauguuugcaguuuuguaguuauucaugaaggguuucauucaugaacucucuugguauccugucaugcgugauagauuuaguauuaguaaaaaugccuuuuugcauauguuuuugcaguuuggauggucuguacaugcaaguacaaguuuaaauuugcccaucucuccuuucucucuuuuauuagugguguaaugaauucagaucaccauuguaggcaggugucugccauauuauuacugaggggaaaaggauauuaaaagguuauacugcauccugaauguggccuuugggacaaaacugaaacauugaacaccacaguuuagcccuuucauaaguacuuccuuuuccucaucuucaggaucagaaggauuccuaguuaggaaaaggauuuucagaguuaugugguucauacucuuuagauagugccacaugggaaaaugaaaaucuacucuuagaauguuguuaagaagacauaauucuauacuuucccuuaguaaacuuccagauuaucaugaaaaacaugcaucaauuguaucauaaaauuggggaaaaugaagauaugagguuaaugcuccagacauaacuuauuuugugcccuuaucuucauucuguaucugucuuccaaaaaugcaaauccaauacaguaauauaauggcaguuauugagcuguucauauaugcuagguacuguuuuaaaugcuuuugauguauucauuugauucuggcaacaauccuguaaaauagauaguguuauuauuuccaucuuauaaaugaggaaacaggcacgggauuuaaguaauucguguaaagucauaagacuuuugaguggcagggcugaaauguaaguucaggcagucuuauucgguaaccccaacucuuaacuaccaugcuacguugaugccaucccuccugcuuacaaugauuuaggaagcuguucaggguuucuuauugccuuugggaggaaguccaacucuuuaacaccuccucuuuguucuuauauaaucugaccauagcuuacaguucgagaguaccucauauuccugugguacauucccucucuuucucucacucucccuuuacccccuuuuuuccuuuuuuuuggugguucuaaaaaguucuaagugcuaucucacuuaaaguccuucacacacuuuucugucugcuaggauauucuuauucuguuuguguacccgcuuuucuuccuuacccuuucaggucuggggagcuuuaccagacugcaaaaccuuuucugugugccucucugcuuuccuccucugaguucugugaggacauuguuucuauagugccaaaaguuguugguacauuuuuuucaaaguauuugcugaaugaugacuauuuuccaaacuaauugcaaaacagaguuugugacuuuucccccuacuuguuuauacaaauauauucauuccauguguguuaaauaaauaaacgauuauugcuacuucugauauaugcaauauauauaucaugcauuauguauauuaauacauauauccauuuucacauagguucuaucaacaucaguaacaaaucauccaguauuucauacuacauuuuagauagcaaaaagcaaugacacaugaacaccuggauugucuguucaagauuuuaaaauguaaaaucuccagucauaucuuuaaagauuuuauaaagcauauuuuccacauuaugauuuaaaaucauagguaaaggaauagcgcaagaguacauuagaaaaaaaaaaaacuggugaaaucugccaguguacuguguugucaaggaacagaaaaaaaauuagagccuuugaauuuuuaggauucaguauauguauuagucccuuuucauacugcugugaaacaccugagacuggguaauuuauaaggaaaagagguuuaauuggcucauggcuccccaggcuauacaggaagggccucaggaaacuuacagucauggugggagaugaaggggaagcaggcacaucuuacguggucagagcaggaggaagaggcgaggaggugcugcagccuuuuaauuuauuuauuuauuauaauuuuuuuauuuccauagguuuuugggaacaagugguauuugguuacacaaguaaguuuuuuaguggugauuugugagauugugguguacccaucacccgagcaguacacacugaacccaguuuguagucuuuuauccuucaccaccuucccaccuuuuccccuugaguccgugaagucuguugugucauucuuaugccuuugcauccccauagcuuagcuuccacuuaugaaugagaacauacaauguuugauuuucccuccugaguuacgucaccuagaauaauagucuccagucccauccagguugcugugaaugccauuaguucauucauuuuuauggcugagugguauucuauuguauauauacaccacaguuucuuuauccacucauugauugaugggcauuuggguugguuccacauuuuugcaguugcaaauugugcugcuauaaacaugcaugugcauguaucuuuuucauaucaugacuucuuuuccucuggguagacacccaguagugggauugcuggaucaaaugguagcucuacuuuuaguucuuuaaggaaucuccacuguuuuccauagugguuguacuaguuuacauuuccaccaacaguguagaaguguucccuguuuaccacaucuaugccaacaucuguuauuuuuuuauuuuuuaauuaugcccauucuugcaggaguaaggugguaucaauaugguuuugauuugcauuuuccuggucauuagugcuacacccuuuuaaacaaccagaucuggugaggacucaaucacuaucacaagaacagcaaggaggaaauccgcccccaugauccagucacuucccaccaggccccaccuccagcauugggaauuauaauuugacaugagauuugggcggggacacaaauagaaaccuuaucaguauagguaaaguauauuaucuacauauaaucauuuucaauucacugaauucgcgacuguccguugauaaggcauuaaaagaacugacugucgaaagugguacauguaaaagauauuaauauacugucguguacuagauguaaauucagcaguuaagaucucgacauuuucauauauuccaaaauaguuuuaaauauuuugguguugcauugacccaugucauuuagcuaguagacacaugugccuuuccauuuucacagcaacauacgcuuugugucuguaauguucauugcuuuauaucugauuuuuucauugguuuuucauacuguguuugguuucuacacaugagcacacagugccuagaagguuugauagaaagcuuucuuccaucaguugcauccauuucaguaaucauguugcuuauucccuacacggccccuuaacaguuaaccaccauauuccaguuucuaguccugggaucaaggccauuuaaaucuuaucuucuauuucaccucauuacuuguuuggguuuauacuuuaucaguuugauaccuguuuguugaaugaacguuuauccucaguaggauuauaggcaaggacaguguuuuucuaagucuuaugugucccuccaaaacaccuaguuugguaaaacuuuagguuaaaucaugcuagaaaagagagaauuuacuauauuuaaguguauuuagaaaaagccauuuuauaagcuuccccaguaacccauucuaauaaauaucaaaucaaguuauugaugucuguuuugaguccaugauguaguaaaucuaaaaaagagucuucuucccuuguauagugaugaagaauaauguauuuaucacugacuucucuauuuaguaauaagucauguuaauaguuccugagauacauuucaacauaacuuuuccuguauguaguaccuauuaguuuuacaaugggaauaaaauccaccucuguguauuuuaaauugauuuuucacacuaauucucuaacuaaaguguuagucuguuaaaauacaucagugggaagaaagcacacauuauugugcccaaauaauaagaaaucuuacacaugccccaucuucucuugcuauggucuuugaacgucccacauguaaacuuacaucuacuuccaaauuuuaaugguucaugacaaagcagaagcaacaugacuggauuuaauaggcucuauuucccaugaugcaggacugagguaaacugauuaucuuuccaucuguagcacuuguaaugugccauucaguucauuagcguuacaggagggcuaagaguuuagugaauugugugugagcagaagccauccauaauccaagcagagaaaccacauguuuuaagaccauaugacauaguaagcuuuguauaguaaggauccuaaauguaaauuggaacucugguagucacuuuguaaaaucaucuuacuggcuuagaccauguuuuacuggcugauuuuugguuuauauuccucccuagcugauggugguacuuugagaagcacuugaacaguuuuucauguugucaucaugcacuuuuuuucaaauauguguaaaauaacuaugcuaaugugauucaguugcugugcauuaaagugcacuugauugggcucuuagauuuuauuuuuuugagguguaaggucuauguuugucucugucaaaaaguccuaguguaugcauggauuuuuuuuuuucucauuuuuucuuuuuuuguugaaacaguaucucuugcucaggcuggaguaccauggugcaaucauggcuaugcaguuaugauuuuuuuuuuuggauggcauauaauguggccauuauauguuguuguuguuuuguuuauucauuuuugcacuuggugguuuaagaccuagaacauugguucuucaacucagauuucuauuuuuugauugucauauguauagcauaugugggugaggagauuguguaguugguauaugagcauaauaauuuagagaaugaauuaggaaguaucaagaauaguggaugaguuucuuuuaaaauacccugagauugucugcuguaaauguauacugugacaugugucacuuuguuuuaaauuauaaagcugaaaugcaauccgcuguauuauaucuuggcuggagaaagacuguugccagaggaagguuguuggacuuggacauaaagaagagucagaauacaaacuugucaguguuuacccaggacuguccaaagaagaaagcaauuggaccugauagucacgaauugcagucauuagagaaacauuugcugugguucauuucuuauucuaauacauuagcuuucuuuucccacucugccaucaaaacaguuuucaccaaggucauuagugaccuugucugugaacucaguagaugcuuauaucccucaucuacaugaucucucucugcagcaucaaacggaauuggcauuuuucuaccuuucacuuccccuaauguuucucucuguuuccuuccagaucuuuuucuauacauuugauacaauuuacagaauuaguauuauaccauguuuauaacuucaugucccauuuacugcauuggauuuucacauggacuucuguggccauuauaugaauauagcauaaucuuuaaaaaaaacauagaagacuauaaaagaauugcucauuuugaaaacuucuugccaugguauaguguauuuaaaucauauucugaaaccauauguaaggaaacagaauaguagacagaaguccuuuaguuuuaacaaguuacuuauaauugaaagacuuuaggcugggcaauauuuaauuucagugaaauugaacaaggagaauaugaccuuaguuaagccauuggaacuuguucuucucucuuuuuuuucuuaucuugaacaggaucaaacugggaucucuaaaaucucuuccagcguaacauucugugacuugugaauuaguacaugcugagaaguuuguaucucucugagccauaauacuuuguucugcgaugguugugauuauuauagguuauuguaugcacacauguuuaaauuaauuuuuaaaguacccuguuaacuauauuauuaaacuguuuguuauguggcauaauuuuccuucuaguagaacaaaaucccuguccugugaauuuaucuaauuuuuuauugguuuauaaagacuauauggccuauaauagcuauaguaaaugauuuuuauuggcauuugaaagucugucacuuauagugauuggugauuaugaagccauauuuuaauaugaauaagaaugcagaauacaguugugaaaaauucauaauacuauauucaguaaaaacaaucccuauaaucugaugucaaacugaaauuuuacaucauuucuccuuugaguucagcagcuuuugauucuagauucuucugccuaauaugaguucugaguaauuuauuuuaguuaaaauuguauauuauuaaggauguugaaaaauugagucgagucacacauuugacuuacuuaaacacaucugcacuuauuuuaccaguaauauauuuggucugcggccugucgauuauacagaugaugaaaguaugaaaucgcuauugcugcuaccagagaagaaugaaucauccucagcuagccacugcucaguaguaaguauggauuuagcuuugggacauuuauauauuuuauuaaaauugguuaugaaaggaacauaauagaaaaauuuccauuugaccaauugcuuacauucaccaaacaauuauugagcacuuccugaguauuagcuacuguggauucaaagacauaaucacaguacgaccaucuagaaauacuuauugagcccacucuguauuuuaggcagcauucauaaaacaaugaauaugacugguagaacucuuauucucagggaggagcuuaccaucuggugagagguaggaaagagacaaacuguaaauauugaacuaauauaaauaaaauaauuucagacacuuagacaugaguguuucgaagauguuguagagugucguuggguggagguagugggcuucugcaaggccauugcuuuagcuagggucacagaguggagccuuaaagcacugauuugaauugaagccugaauguugaagugaggaggcugccaggugacuaucuggaggacacaguguauaggcccuucagugaaugaggcugguauguuggaagguuagaaagaaguuuguuauugcuggagacuagcgagcaucaaaacgggacuuucggauagauuacauaugaagugugggaaaagaauggaauaaguaugaccuuagcagggaaauagaugguaaugccauuuguugccauggagaaggaaaucaauaguucuaugugccaauuugaugucuguaaaacaugaaauggagauaucgaauagauaauuggauaugaaagucuggagcuuaggagagagguacaagcuagagauaaaguggaaagaaugccuguuucuuaggaacccauagcuuagcagggauuucagauauaaaaacuuuuacuguacauuguaauaaauuuguaaaauaagcuauaaaaauauacaguagaaucaaaguaaguagaaacuacaggagaugucaggaaaaauuucacagaaaggccaggugcaguggaucgcaccuguaaucccagcacuuugggaggcuggggcggguggaucacuugaggucaggagucugagaccugcuuggucaacauggugaaaccccaucccaucucuaugaaaaauacaaaaauuagcugaguguggcgguaugcgucuguagucccagcuacuagggagacugaggcacgauaauugauugaacccgggaaguaaagguugcagugagccgagaucaggccacugcauuccauccuggguaacagaacaagacugucucaaaaaaaaaaaaaaaaaaaaaaaaaauauauauauauauauauauauauauauauauauacacacacacacacacacacacacacacacacacacacagaauuucacagagaaagguguccuaagucuuucaggguaaacauuuuagcagagugucuaauagaaugcuguuggcugccaguaacagaaaaccuuuucucaaaugcuugaagacaauuuauuacuuuauauagaauuaaucccaaugcaggauagcucugcauuugcuuaauuuagcacuuagugguugcaucaaggaaccaaauucuuuguaucucuuuaccuugccauccucaguuugggggauuuguccucacuaagaaguuuccuuuaaugguugucgaaugauugccacaauucuagauaugacaguggccaacugaaaaagagacacuaaagucuuucccugaagccuuuccguggacuuccccugugucuuauugucagaaauugauuuugacagccccuccuggggcuggagguuagggucagucuuugaaaggggggcuaccugaacaaaacugggcuucuguuaguguggaggaagugagcaauagauuuugaguguaacagccaacauuccccacugcagucagguguacaaagugagaauggcagcccaaaucuaaggaacagcugcucagagacaaggaggcauaaaggaccuuaggaauuugagaaacuauagcauuuacugugagaggaguaugacguguguuuaagagggauucaggguaaaggguuagguugggaccagauugugaaaagccuuaaauucccugauacgaguuuagacuuaauaggguaccuucaguguguuuauaacugaaauaggacugucugcaggcuagcugggaguaggaagagacugaaggcugauugggaggcugcaguaguggagaccagguuugaaaugcugaggacuggaauuauagaugguaguuauguggggauggagagaagaagaagaguuuuagagagaguugguagacucaccagaucccaguacugcucagaugggggaaaguaacagaaagggaggagcugaggucaaggaucauucacaagaguaguaguagaugccauuguuuaagauaaggagguagccuaagguagcuacaguuugauacucucauagaugcuuucaugagcuaguugcuuucauaucuugaaaacccuaugucuucugcuuuagacuucagccuuauaaaucuguuccaaacuauaguuuugguaaugaauuggaagagaagcuagaaaucagcaguuuaauuuucucacuuuacaaaugagaaaagugagaccuaaagaggcuaugauuugccccaggguuaaccagccauuaaaaaaaaaaaaagguuguuuuuuucuuuauuaauggaccaguuaaaacucacauuucuuaaaacuuaggucgguacucaauucagucccaccguacucagcaacuauaaauugacuuguuuucuucauuuguacuugaagucugacagagcauagcauaaccaaguuguccuuugcugauguuccuuuuauguaaaagcuggaaaaugauuacuuuaaaugugucaagaauaaagauaucuuuaugguauucuuggagucuggggguggcagugccuuucagaaaaggaggguuuuuauuacauggaagagaccuauacuuugggcaugucauguagacauggccuuuugaguuuuacuauuuacugucuuaaugguugguacuuggcuaaggaaaagauaauaucaaguccuucagguuuaaaggguaguuucuuaaugugcaguccuuaaagauggaaccucuggaauauaccuucccccagccacuaccagucucuucuucacucacucuuuuucagucacaugggcugccuuacugugucuugaguccaccaaacauacucucauuucaggugugcagcaccacuuguuuaguuuuuuuuuuuuuuuccaggaacuagauguucccauggccagcuuccucacacccuucagacccagcucuagcaucgucuuagcagagagggcucugugccacugcacaguaaauagcaaccucccagugcugucuaacccccuuccccugguguguuguaccauacuauuucucauuugauguaauguauuuuuauuuucuuguguuguuuuccccucucaacuagaauauaaacugugugagggcaggggcuggcucuucuguuuacuauaguagcccuagcauugagaacaguguuuggcacauacugaguguucagugugugcugaaugcaugaaggaacauuagaguauucuuuaugauacauacuugccucugaaacaagcacaagugcuugguagcgucauugggaacccuuuaaaucagugaucuccagugagcugcuuuagggaagcagcucacugcuucccuaaaggaagggguuugaauuucucuccuuucucuuuagaauuuuuauguuuuaaguaaaauuuaguggcuguuggaaaucugcuuugagaagcaaccucuaaucuuuuaaaaauuuaaaaaacuccuuaucauucauucauuuugagacuucucuguuugugauucauuuuaagcagcauguuuaccuuuuuaauuuuuuuucuagauuuuuuaaccccauuuuugaugaacuuaagaaaaacuaaugauuuuaucuaagaaaaaguacccuauuuaauuauuccuuugaauuuaaugcuaaugaacauaguaucuaaucucuauaaaaucaggguauuaaaccuuugggguguuuuuuguaccucuuuugagccucaugggucagagaccuaugcuuauucaagucaaauccccagcccccaugccaccucaccccaaaucagacauguggcuuuggcagcuguuugcuuuauguuuuauuauagcacucuuuaacugugagaaauuagugccaguuucuauuuuuuaugcaaauuuuuaaaaguaugauaggaaaauacuugacccacuuuggugcuuuccuuggguugguagaaauaguaucauaugcuauauuuagaaaugauaucuuuuucacucuuguguuuugugcagagaacuaauguagcugaaguggaguuauauaaauugagaaguaauguguucuguuuagagcuauuuuuaugguauuuguguaacuuaagaauuuuugaaauacuguaguguuuuuaaauauuaucaaagaguaauugaacaauccauaaaguacacugaauauuuuccuuuuuuaauuuuuuuauuuuuuauuuuauuuuauuuuauuuuauuauuauuauacuuuaaguuuuaggguacaugugcacaacgugcagguuuguuacauauguauacaugugucauguuggugugcugcacccauuaacucgucauuuagcauuagguauaucuccuaaugcuaucccuccccccuccccccaccccacaacaguccccagagugugauguuccccuuccuguguccauguguucucauuguucaauucccaccuaugagugagaacaugcgguguuugguuuuuuauccuugcaauaguuugcugagaaugaugguuuccaguuucauccaugucccuacaaaggacaugaacucauccuuuuuuauggcugcauaguauuccaugguauauaugugccacauuuucuuaauccagucuaucguuguuggacauuuggguugguuccaagucuuugcuauugugaauagugccgcaguaaacauacgugugcaugugucuuuauagcagcacgauuuauaauccuuuggguauauacccaguaaugggauggcugggucaaaugguauuuccaguucuagaucccugaggaaucgccacacugacuuccacaaagguugaacuaguuuacagucccacuaacaguguaaaaguguuccuauuucuccacauccucuccaacaccuguuguuuccugacuuuuuaaugauagccauucuaacuagugugagaugguaucucacugugguuuugauuugcauuucucugauggccagugaugaugagcauuuuuucauguguuuuuuggcugcauaaaugucuucuuuugagaagugucuguucauauccuucgcccacuuguugaugggguuguuuguuuuuuucuuguaaauuuguuugaguucauuguagauccuggauauuagcccuuugucagaugaguagguugcaaaaauuuucucccauucuguagguugccuguucacucugaugguaguuucuuuugcugugcagaagcucuuuaguuuaaugagaucccauuugucaauuuuggcuuuuguugccauugcuuuugguguuuuagacaugaaguccuugcccaugccuauguccugaaugguauugccuacguuuucuucuaggguuuuuaaugguuuuaggucuaugugaggaggguuuauagcguuuagguuagaugugguuacaucaucuuacaauuuagugacuaggaaagaugagcugaacuuuuaagugcugaauucugucauuuacaaacacuuuuauggaaauauauauauauauggacauauauuguuuccuggagucuuucacuucucagcuuuaaugcuguccacucuuaccuucucuuuauuuuugucuuuuuugucuucugugaauucuaagucuagauuuuaaagugaaacuauuagucuuuguuacagcacuucuuucuuagucgugagcuauauggacuucuuacuauuuauggaucugaucuccuaaguuuugaauuaacuugucuguuuuuaucuuuuccuaguuuugagggguuacuauuuugaugcuaauuuguuuucuaucuuugaggucagcacuguucuagaagccuuggcauucuuugauuuuucagauaaucucaguuuaaacuaaacaaguuugauuuuaacucuauugggacaaguuaguggagguggaauagggaauugcugauuuuaaguggauauuuuaaguuacuugggaaaagaaaaagacuuacuggugacugaaugaaguaaaacccuagagagacccaauuuaaaauugaagaaaugagaugcccuggguauagagagcuaucacaauugacauuuucuugagggaaaaauaaagagaaaaaauuuauuuaaaagguucuggguguagauucaauggaaauaauugaaaauuauuagaguaaacuaaguaaugaaauucaagcuuauaucaaguaacagucuguuuaaugucuuugucuagucgucuaauguuuuuaacacugguaucuccuuuuauauuaacagaugaacacugggcagcguagggauggaccucuuguacuuauaggcagugggcugucuucagaacaacagaaaaugcucagugagcuugcaguaauucuuaaggcuaaaaaauauacugaguuugacaguacaggugaggauuuugaauuuugggaggugggguagaaaaaauguuaaauagaugauccuuuuggagaacuaccuuugauaauuuacauauguuuuaaccauugggagauggcuguauacuuugcaucuuguaauacaucuaaauuuuuuuucaguaauaaacuacuuauagacaacaacguaguuaggaaauguaaaguuuaaagguuugcauauauuuuaggacaagacaguauuucagaagagcaaauuugugacuuuugcuagugacaaauaaauuguugugcaguguaaugucauaaucccuuagcuguaauuugaaaauaaaaauuuguguuugccaauauggcuuuaagauauaugguuuaugaucugauuuuucauauugauggccagguuagagaacuagauacuaaauagaaguagucuuacacuuaaguguaaaaauuguugccuuugaagauucagauauaagcuuacaaaauauagaugaguuauaagaagcaggccaaagaaauacuuuggcuuguaucuuucuuucucuuacugcuuuuuuuguauuuuaguaacucauguuguuguuccuggugaugcaguucaaaguaccuugaaguguaugcuugggauucucaauggaugcuggauucuaaaauuugaauguaaguguuggauuugagagaauuaagaaaugaauuagacuaguuuuguuuuucaugguuauuaaugccugugauuaaggaacuugauguuaauuuucuuaccucugguuagucacugcauuuuggaaaagcuucuggcugggcgugguggcucaagccuguaaucccagcacuuugggaggcccaggugggcggaucacaaggccaggagaucgagaucauccuggcuaacacggugaagcccugucucuacuaaaaauacaaaaaaauuagccgggcgugguggcgggcgccuguagucccagcuacuugggaggcuaaggcaggagaauggcgugaaccugggagguggagcuugcagugagccaagauggugccacugcacuccagccugggcaacagaaugagacucugucucaaaaaaaagaaaaaaagaaaaagcuucucauauuuauggugucauuuagauguccuuaguaaauguauauacauauguucugguuuuaaagucuuuuuuccuacaauaccaacuauuucaaugaaaaguaaauggaguacauaguauacuuuuaagccuaagcgauucauguuacuguuaaaugauauauugaauuuaauaacacauguuuuaaauauacugcaugacaugucugugaaaugaaagcaauuuauugcuuuuccuuuaugauuaccugcauaacacccuuuuggucuuaguuaauuuaauccaguauuuuuaggaagcuguugggaaauugacugccuuuuacuacuuuaguuggagucacuauaccagcuaucucaaccuccacugaaaauguauaccuguuccccucuucuugcugauagucaacccaccaucaccuucagagcugccugucaccuucccugcugucacucauuuacauuucuacuuggauucucuugggacuuaaaaugaaaagaaagcucauacacgauuauuuucuacuccuuaauaguuaacauaucuacuuuugauacuauggcuaacauagaacaguggauugaccuuuuuuuguuuauuaauuguuuacaaaagauuaguaguuacaaaagauuagugguuacagaggaggaauguggggagcaauacaguugcguaucuugauguuagugguggccauguaacacaagacuaccugagauaaaauuaugcaaacaagugcauuuauaaccagugaaaucaggccaggcacgguagcucaugccuguaaucuuagcacuuugggcgaccgaggcaggcagaccagccaggccaacauggcaaacccccuucuguacuaaaaauagaaaaaugagccaggcgugguggcacaugccuguaaucccagccacuugggaggcugaggcaggagaaucacuugaccccgggagguggagguugcagugagccgagauggcgccacugcacuccagccugggcaacagagugaaacuccaucucaaaaaaaaauaaauaacuagugaaaucugaauaagcucuauggaucguauugaacucaauuuguugguauuauguuauagcgguguuagauguuaacauuggacacugaaggaaaaguacgugggacaucucuguacauuccuuugaaacuuccugugacuauaauuauuuuuaaauaagauguuaagaaagaacaguggguauauuuauugaaacucuuuaugaagcaacugauggauuaaaauuaguuuauaaaaaugguuuuauggcuuugugcuuugaagguuuuaugguagaaugccugauuuaucaagaucuuaauuauguuauuaauuuaaucuguaguuagaaguugauuugguuuguaaaacaguuuccuuucaucaauugguauucaugucauuuucaaauacagcuaccacuucuuuuuuugugaugcuugucucaaccaaugcagucugauccagcuaagaggcugugacuagcaaugccacuccaucuguucucaucaaucccuauuaauuagucccuccuaguuaugaugaguuugagaaguauaaguaauuggacuaauuugucucacuuaguuuugaacuuucuuuuuccuuuuaaaucugugaaagucuuauugagccucaguguuuaaaaaauucauuuaaaaugguuucaugauuagggaugcuuuuguaucaaaccugugccagaaaccuuuccagugguuauaaggagaaauagauuuucaucauaguaaggucgcaguaauaaagaagccauacgaaauuuugaauguuaagacauuuaccacuuaacuuuugagucuaguucuugugaauaugcugaaguggcauuugguuacauauacaggcuacaugauuuauuuccauaaaauaugccuucuuugggaaauguggguuuugucacuuuaauaucuuggccgugucguuuuuauagaaccacugauggacucggacuaacuuaauagugugcuauuuggugauucugacaguagugaauaacauccucuaauaucaaugguucuuuuaggauaaaggauggauggaaucccuuacugaaguucauaucgucauauuuucuaauauagaguacaaagagaaacagauucaaaguuugagauacuuccuuuaaauagucacuggguuuacaaaaagaaggcaagaaccuucaaauaguucuuuccuaauauauauuucucauaguuucuauacuguucucagugucaagcaucucaguuugauucuuuguuuguuuuuuaagagaugaggugucacucaagcaauccuccagcuucagccuucugaguagcugguacuacgggugcacaucacugcaccuggcucaguuugauuuuuaaaaauguuucagagcuauuuaaaacuauuugaaaaccauucauauuaaaagaugauagguggaccaaagcuuucaaaauuaauuuuaaagauuuaugacuuuuuaaaacuaggucucauguuugagucuguccauuaacuugcugguagacaaaacuucaggauuaacuauuaggaaacuuucauauuaacuuuucaugggauuucucauaaaccaaauagauucaaguagaauuuuauuuguaauuuucucuauagauaaucaacacauuuuauaaacuaaaccauuuaacaaaaagaauuauacaaaagauuuggauccauuggguccaaauuuaacuaugagaaguuuucuguugaaguguucugucuuaauugguuaauaucucuuauuuuccuacauuguuuauacagaguaucuuacagugccauaauuaaugaacuuagcaugaggauucugagacuaagccauaauuuuacagaccauccagucuaucuuauauuucuuuuacagauauuuuacagaaugauacuuauuuuauauuuuacagaaauaggagcuauagauaagaaaagucccuccuucaacaucaaaauggugagggagacucuacuuuaguccuagucugggugcuaauuucucacaggccauuagcaccacccucauacaagguugauuuuggcauuaaagaggugauaagaaugaaagaauagaagguauauaaauaagucaucuuacgaaucucauagaguaugaauaagaugaaacuguauccuaaagaugcaaacuaggccaagauaaaauguuuucuacugaccuauucuuuuaguacacugcuuucaaaauuuuuuuguaucuuagccuuuuuuucuaaaauaaauuuaauucuacaucuucuuuucuuaucucauuaugaaggggagaacagauggcugucaucuuuucuuuaauaaucuuucccucuuccccacucucaucuaaguuuaaauaaaauugcagcuguagaaguuguaaaauuccccaguaccuaagggaauuacugaaggaaugugccagacauuuuacacuggauuuaugucugugagauggggaagggcuaaauugaguguuuuuucauuuuuguuuuagcugaggagagauggacccuagaagacaaucauuacaucaucauuuaauaaauaaccucauaaucaggcuaacacauuaauucuuuucaaacaaauucuaacaaguuggcuucuuuaaauggauacugagaguacuauggaauuuuaaaauuaaaugcaacuuuuauucuauacagacuuugcuaauuauuuaaaaaaaaacauucguauaaauuaagauugauuaggcaacuuuaugcugacagaaggcuuccaccaaagauugucuaagaauaaaaaaaaauaacauccuuugaucuaauagucccaguucugagaauuuacccuacgcaagaaauacagaugaaagaaaaaguauuugcaguguuacuucuaacagcaagaaguagagaauauaaccuacauaugaaagauuaggaaaauucugaaaugccugaagauacucucuggaaaaaaugcauauuuuuaauaugauaaauauuaagacuaaaagauuaugaaaaauagaauuguuuaaauuuuaaacacaucaaaauuauaucuucacuuucaacaauauauaaauguaugcaugcauguggguaaaaaaauaaucaaagagcaguaaauugguggguuacugaagaggacuauuuguuuauaacaguuuuaaaaauagugugugccuguuagaucaaauuuaaguucucuaggaauaaauuaauacguugaaauuuucaaguuguaauaauaauuggaaguauuuucacuuuucuaacgauuaauuggauagggaagggcuuuggucuuaauuagggaaauuagaaccugcauguauuuauuccucccaucugauacaacaggucuuuuauaccuguuuaauggauacccagcaaauacauuugaauauggugauuguccuaaucagaacagaauuuuuuacauaaaaauuugaacuuuuaauauaugacuucaaaagaacacugagcaugaguuuucuaauaauuaggagaauuuuuggacguuagacuguguucgguuuuuaaccauaccuauauagagacagacaauuuugauauuauucauaauacaagagauagacuauuuugauauuuugauauuauuaugcauaauacaaggucuuagaauugauacccaaguuuugucuaagaaaaauuuaugauauaauaauauauuuuugcaauagaauuuaaccugcuucucaaugcauuaaguaaaauagcaaauuacacaucuuguaaugugaagaaauauauuucuacauauaaauaugcugauagccagaauuuuuacuaaaaugucaaaaauaaauaauugcuaaaugauauuuauauggagccagaauuuaaugacugucgacaguauuuaaugagauaucucaaaucuuaaauggaaacauuuagccuuuauuuuauauuuucagccuuuauuucauuguccuuucacuuuucgcuauggaaguuucaaauuucaaacucauuucucuguucuuuuacuuaaguuuuccaaaaauugcagugauaguaugcuacuguuuuuucauuuuugucauuguuguaggcugccuauugugaugucccuuuuuacuaaaguuuagugcuguuauaguuuacucgacuaaaaagucuaaaauauaaucauuugcaaaacacuuguuuugcuuuuacaaucuggguguugauuuuuaauagaaucaaaggaaauucuuuaauuuuuauuuuacuuacauacuguuaucuugagugacacacaucccuaauuuaaacaucuuuaguuuagaucuaaugacauacuguaguagaacauuuguuuucauauagaauagugauguuugauucuguauuuuaauuuuuuuuuuuuaggauauuuuguauugacuaaaagugguuaauucugauucccauagcuauuucaguuacaaauagccauuaauuccagaauaauaacaacccuuuuuuccccucccucacucugucacacaggcuggacugcaguggugcaaucauagcucuuugcagccaugaacuccuggguucaagugauccuccugcuucagccuccugaguagcuggaacuacaggcacucaccaccaugccuggcuaauuuuuuuuuucuuuuuaguugaggcagagaucucacuuuguugcccaggcuguucuugaacuccuuguuucaagcggucuuccugcuucacccucccagagugcuagcauuacaagugcgagccaccaggucuggccuaaaaauucuuuaaaauguggaucuguuuacuacucugggauuugaagagugagaaaauucuaaguauggcuuuccaugcagaguuaauaaucgucuccuccuuuggacauuuaacagaucuccauuuugaaguuuucuuccaucuucauuguauucucucaucauuuuuguauaacuguggauucaggaacaccccuccuuuuuuuaauuuccuugcauuuguguuaucuuuuuuuauuauaggaaauguaagcuuaauauaaaaccaugaccaucaucagugguccaugcagcuaaaacagaaauauacaucuacugauguauaugcuuuuaugagguaggaggagagagugguuauuagcaauuuagaauaaaaaaauaccuucuguacaguacaaguuucuuuauagaaaaguguuguagcccuggaauucauaagcgucauuauuaugcaaaaauuccaggcuuugcuaagguagacagagcuaccuuaaugacuuuggguuaaucaguacuuuagaaauggggcugcuuaccuauauguaaaaaauuaauaagaucucaggaaaaaaggaaagcuuacaugaaauggagaacaugaucaggaauacaccugggcuaaaagaaucucuaguuguaauagcuaaguaguucauccguuuguuucugcgaagugauagcuucagucaaaaccuucaacuauaaaggaacauaugaaaaguaacaaagaugaaauaaagcauacauuuuauaagguuaguggcuugacacauuuucaaguauguaucauucuggcauaugcaaaaguuauguuuacguaaacuuacucaugcaagguaauuuuaguaaggaaauuauuagccaagaaagcuaacuaaaauguggucuuauauuuguauuuuugcuuuuuuuuucuucaaaaggaaguagaagaguucaucuuucuacuaaacugauggaauaauuauggacuuuauuaacuguuuauuacaaauauaaaauaguuuaaaucuuaaaauguaacuguguuuuaaauggaaaauagguuaagaauucuugcugcagauugcuuaacuuuuauucaguaaauaaaaccuuaaaauguuagucauuauuuaggcuuggguuaauuaaguaauguuuggcugguagauucuuccagugcauugauaauguaucaccauuugaauugcugaaaguuuauuuuaaagcauuucauucuuauuuacuuuucaguaaaucaacucaauugauuugucuuaaaaaaagguucaguaggaaguugauaugaauuuguaacugugguauugucuccggaguaggucaucauucugaaacucacaguuucagauaacaaguuagacaguggcaaccuuagcaugucggauugaguaagcacauugauccaacuaaaaauaaagaugaacaaaaaaacuugaucugugacauggaggauauuucaguucucaucucaguuaugucacugagaaagccacuuaaaucucuugggacuuaaguuuccuuaucuauaaaagagguugauuagacaaagcaucaaaaguuucaaaucggcaggcugaggacucugagggcugaaggaaauacagugucugguuuugucuaacauaauuaauuuuuauauauuuaggcaugauguuuguuacagucuccauagcuuccuaccaccucacaccagguucuucacacauuuauguaaucuaccuggcuuuuguaggcauuugagucgcaauccuugaaguaguugucacucccagcuuugaaaaaauucuagagauuuucuaugcuauaacagcaacuuuaacaaaacacuuugccacccuucaaauguaguuguagaccuggaaacauccuuucuuuucaggaaaagaaaaagagcuacuuucauucuuccuuaguuagucuuaggugacacaggauucugcaaauuguugcuuggaguaaaagcauauuagagaaauguauuuguuuaacucaaucauuguaacuagagcauuggauuugcuuuacuuuacagaaacuuacuacauaacucccaugaaacagaauauuuaaugaauuaagacuuacacuggcuccuucucauggaaguaccaugcugcucuguugguaucugccaucucauuuuuuugaugccauacuuacuggacuguaguaucuauuaagguuaaauucuguugauugacuaaugccagcauguuuucaggaggaauagaugccauuuuaauguguuucuuguaaauaaucagucaaauaaacccauaaaauggagaagcagcuggcacaagcacagccuacuuaauucugcaauuagacauuagccauucauucgauacaguagauaucauaagaauguucaguccuuggcuuucugugccaccauaugcaguuaaagauacaauuaugaauacucuguaaguaccauugggaaggagauuugggaaggggaauaccugcuuacguaaugaggaaaauaaaaaaaucacauauaaaauagugaauuugaguuaaccauuucacuggauuccugaugguuuuuuauuugauuuuuaauauagaaacaauauaugacauaauuccagcacacuggcagugcuucuaguaugguauuuugacccagucaagaauuuugagucucauuuucaauguauaauaaaauuaauauuuauauuaccuuuauuagaaagguuuuuaauucagugagugguuauuaaaauuuaugccuuuuuuagaguauaauuuuuauuauauguaaacaauuuucaaagcacauuuaugauaauuuaaaauuauaagauucggaaauucagcuuagcaaccuugggugaauaugacuuucauauuaaaaaaaugggggagagagaucugagagccaaauaaaacacagauaaaacuaacaaauuaagauugacaugauggguaaucauagacguccugagugugaguguugaauuugaauuugcauuaaugacccaauucaggaaagacucagcgucuugacaaaccucugcuuuuggagagauggaguauucaguuguuagucuucugaccuuuuuauaauaaacaacaucuuagaacacucaauuuaagcagcuuuuaagcauuugacauauucacaucaugcuaagauaauacccaagguuuaucuuguguaccacuaaguuauauuucagugugaaauacacagccuuuagaaaacuaagcagauuuagguucaaauucccauucugccacuuaauggcugcauucagcuuuaagcaaguugacuucuuagcauuucaguucccuccccugaauuggaaguaauaaacaguaaauccucauuguuuguggauucuguguuugugaguuuucuuacuugcuaaaauuuuucuuguaauccccaaaucaauacucacagugcuuuuguagacauguacagaguagugaagaacuuuaguugacaaacaaguguguccccagcugaggucaaacaaggugauacuuuaccuccucuuuucagcucucacgcuguaaacaaguggcccuuucacagucuguugaugccauguuuuuugcauuuuuguguuuuuguugcugauuuuauuauuuaaaauggccucauaauacagugcugaagugcuguuuugugagucuaagcucaagaagauggugaugugccuuucagggaaaauauuaaauacuguguaggauaagcuuuguuaaggccuuaauuguaguacugcuggcccuaaguuuaaucuuaaugagucaacaguauacaauaaauaauguguauaaacagaaacauacauaaaacaaaguuaaguauugaucaguugauggaaaugcuggagccacaggcccacagaaauguaacccuguauuuccuuuaacagcaguguuucauuauucacuaaucgguguucauagcaucuuuauagaacauaacuacuguagauaaugagcauugacuauacuacucuugcuggauuuggggaaggauacaaguacuuuugguagcuguuaucacaguaauuuugaucaggaucuuuucuuagaacaaacaguuguguccuuggucauuuaaaguuagaaaaguaaaaagaaaacagaauagaauaaauugguauuuuaagaauuuucuuuuucuccuuugaccagaaaauauuggugugugauuuuuagcauuggauugguuaggccuuaugauuuaugaguauuuuauucuagauuguggaaaaauuaaaguuuucagagcacugcacaauguacacguucaaucuauaguaaaguauuuugcucauuggaugaauauuagguaacauagcauucauaguuuuuauaaaaugauacugcucucaugguucucuauuaauuuauaagaagagaguucugucugauaguauuuacagguguaaaauaaacuuauauacaaucaaauaaauucuacucagguucuacucaauuuaaacccagagaaguaacaauggaacaacuuauuccauauuuucuuaaugauguucuacuuuuucuuuccauauuuaauauugugauuucguauuuguuuaacaagagcuauaaauggcuaaaacucuggcuguguauuauuuccugcuuuauuaguauuuuugaauaccacuucacuaauacauguaaaucauuaauacuuccagcauauuuuuuuaauauuuaaaauauauugguccuccauuauuuucagaaacaacuuugcauucaaacauuuuauucaaaaaaccuauuaucuuugcuuuuaacauugaaauacaugcaaaauauaaaagaauauuuuauuaucuuucuggcaagcaaaucugcucccacauuuguuauucuuugaaagguuagccauuuuaaguaggaaaagagggaaaagcugaaucugaaaaacgaaucuucucauguuugucuauguauaagcuauuaaccuuuuuucuuucacugacuuuguaacagaaguuuacguaaugugaaguucuuaggauuucuggacaagaguagggaguuuucuuguuauuagauauaccaugauugagauuaucucaguggcauccuuaauaucuuuaaaacauggauguaauuuuaaaugugcuugaaaaauuaaauuugauaguggauugcuuguugacagaggaaaauaaagcaauaaaauuucauuuaaaauuaagcacucugagauagagcauacaauauuaaugaaaguucaggauuagauuauugaaauaaagugacaggaaacagcaggaauuuucuucuuagggaagagauuaugacuucucuuguacaugauagguguuuaacacaguuugagcauuccuaaucugaaaauccaaaaugcuguaaaauacuaaacuauuugagugccagcacaacacacacgaccuaacaugauggcucacagucuaaacgcagacacaacuuuaugcacaaaauuauuaaagauaguauauaaaauuaucuucauauaugcuuuaucuguauaaagcguauaugaaacauaaaugaauuucuuuuuuagacuugggucuuguugccaagauauaccuaauuauguacgugcaaauauuccaaaauccaaaacaaaauugaauuuuaaaacacuugugguuucaaacacuucagauaagggauacuuggccuauaaauaugauauaggaagagcgccgaaguggaagucuguugcuuuaggaagugguucacuuuaacuuugcuauuagugaucuuagcaagucacuuuauguuucugcacuugacugugcagaucuuuaaaacaagaagguaggacuagcucuucagggucuuuucuaccucguaaguuauuugauucuagguauuuucaaaauucaaguuacaagauuagaauaaauaaaacauuuuauaaagaggacucaaacacauuuuuuuucccucagaaaguaccaguuuuuucaguucugucgcuuacuccaaauucugcagauguggcuccuggaaacaguugaaguuuuguuauugugucagugugggguaauaaagaagaaaguuuaaaaccgauuaugccauaaagucugaguuagucuaaaguggaccauuacucacucuuggaaaacauugcauuucuuuuucuucuccaguauaaguuuuugcucucaagauaaucauuauaggucagcaagguguggugguucacgccuguaaucccagcacuuugggaggcugaggugugcagaucacgaggucaggagaucgagaccauccuggcuaacgcgaugaaagccugucucuacuaaaaguacaaaaaauuagccagacaugguggcgggcgccuguagucccagcuacuugggaggcugaggcaggagaaaggugugaacccaggaggcggagcuugcagugagccgagauugcgccacugcgccccaaccugggugacagugcaagacucugucucagaaaaaaaaaaaaaagaaaaaaaaaucaucauaggucaaaagacauuuuacucauacacaacugaaucuuaauuuauauuagaugcaaucgcaggacaguucuggguagcagauuaacuguugguucuuagccacccuuuagucaagaaaggagcccuuuugcaggcauaugcaguuuacaugccgaguagugguucugcuccuguguuggaaucaauuuacuguugaaguaaguagggaucagcuggacaaaacuuuaucacuagcauuuuucaagagguuuccaaaacacuguaguauauccaacauauaugucuaauccucaauauaaaguauauguuuaugcagccauagauuuuuuucugaucauuuuaagccauuagauaucaagugauaacaggauguaacaguuugauauucaaaacuauguguaacucugaacucuuacaggugcuauauaauuacuuauuuuuauugauguggauacaaucugucaaugcuguguccauagugaauuuuuaaaaacuuuuguuccuuuauguuaacaacacuagacagugaaggggauaccugaguuauuguuccaacuuucccgauacccucugcuauuaaacuccuguucuaugggaaaguguaugaaauucugaagaacgcauaggugaauaauauaugguuccuacccucagugauaaaaugaaguauugagcaaaacaaccucaaagacaaauaggaaauuguauggaggguuuguuuuuaugaugaagauaauucauuguaguaucuaguuuuuagaaugcuucuugcauuuuauccacagaagcccggugaaaaacauuguuuucauuuuuuauuuccauaggcaaggaagcuuccagaacaaguaauugggauagccaaguccuucaacugcaaaucucaaauuuaguuuaguuauaugccaucagaacagaagcaugauaaauauauauacaugccaucaguucccucgcuuggugguaaacaggcauuauccaagauguugucucuagcugaagcugaccauguccuucaugauugguccugggaaucccaaggguuccuuucauuucuagagccuagcgagacaauugguacuggcugccagccaguggcccuacuuagggauuccccacccaggugccaagcaguggaaugacucuaaacagugccaggcugagcugucucuauugcuuuugcuuuuuaaccugaagcugugaacagacuuacucaagccaucaaaagaaugcuuuuuuuuuuccugcaaagcccaaucaaaucaucucuagacuagcaaccucaguuguguaccugucacaugccaaaccuaucccaagcucugcuuguuuauuuuaggaagcgcuguugaaccccuguuguguggcuagcugagcuuggugcuguagacuaaagcacauuccuucaugucaaaucacuuacaguuuaacagacgauuagacauauaacugucaaaaugagcaguauagaugguaagugcucaguuuagguuauugugucauggacuuuuuauucaccuuaauuuuggguaauugcuaugaguggaaauguagacuuuuauuuuugucuuugaaauaguauccuggcuuagguuuuucagaaaggagauuaaaauuacaguuaguguucaguacuaacuuauggcuuaauccuccaaagaaagaguuuuuuaaaauauuuucuuuauaugggaaaaccaguuguauuacauuuuguuuuggcauaaguaagauuucuguuugcauuuuagaauaauacuuaaaaacugccaugaagaagaaaaaccacuuagguaaauugcuugauuuuaaugagagagauauagugcucacuugauacuuaguuugcuuuaauucuuguguuuuugucagggguaaaagcaugucuacgaagaaaaguaugugaacaggaagaaaaguaugaaauuccugaagguccacgcagaagcaggcucaacagagaacagcugguauuuuucuuuuaauacaacuuucauuguucuuauuaugacauacuauuauuaucaccaucaggaagaacuucugcccuuucaacagcuacaggugacugauuaaaauuuuaauugugcuuauuucaagcacuugauucugaaagaugaucacgaugagcaguaaaauccagaagguaauaauuucauacuguuaauggauuuuuggcaucuugaacauugccauaaaccuuucagaaucugagguaaaucucagauacaggaaguagcuugaaagaagacuuacagcugcugcuuggauuuaguuaccauaugucucuauggccacauauuguagcuuuaauggauaauaucgcauuauccuguugauauuauauaaguauauuagaagucacaaagaaaauuuccauagaagggaauuaugaaacuuuuuuuauuuccaacgagcauacggaaguauguuucauagcuaauuggaucccuagccucagcacaaaaaucuuuugugccccgugaauacauuucuggaacccuggagggcacacccccaugguggcugcccuggagaccuuagguugguaauauguaaggaccugaauguggaugggcagaauuggauaaaaguccacggaaaagauguuacucuuguaauuuaauaauguuuagccuggugucucugaagccuauuucaaauaagcuaggaguuguggaggcuuuaagucccaccaaauaagcauaaacauccugaugaaaaaaguuugaugaauaguuuguuuuuuucuuuauaccaagcauaucuaaaauuuuagaagagugaaaaggaaccgagauggugacugaaucuuagggaaaaaauuguaaauaggaagccccuauuugccuaaguauuuuucuugauccaguuaguaugcuugaaauauaacuugucccagcaccucauuaaguagcuucuuagcugcucauaauuguuacagauggagcauuccuaauccaacaucuaaaaugcuccaaaauccaaaacuuuuugagcuuugacaugaugccacaaguggaaaauuccacaccugaccucaugugacaggucacggucagaacacagucaaaauuuuguuucaugcacaaaauuacugaagauauuguauaaaauuacuucaggcuaugugcauaagguguacaagaaacaaacgaauuuuguguuuaggcuugagccucauccuuaagauaccucauguauaugcaaauuuuccaaaacccaaaaaauuuaugaaucugaaaugcuucuccuccaaauguuucagguaagggauauucaacuuguauuuuuauuuuccucauucauauacaguguuuuugaauacaguauuuugaucugccuuuaacaaauguuuucucauuauuucaguugccaaagcuguuugauggaugcuacuucuauuuguggggaaccuucaaacaccauccaaaggacaaccuuauuaagcucgucacugcaggugggggccagauccucaguagaaagcccaagccagacagugacgugacucagaccaucaauacagucgcauaccaugcgagacccgauucugaucagcgcuucugcacacaguauaucaucuaugaagauuuguguaauuaucacccagagaggguucggcagggcaaagucuggaaggcuccuucgagcugguuuauagacugugugauguccuuugaguugcuuccucuugacagcugaauauuauaccagaugaacauuucaaauugaauuugcacgguuugugagagcccagucauuguacuguuuuuaauguucacauuuuuacaaauagguagagucauucauauuugucuuugaaucaaaaaaaaaaaaaaagucuaaugccagauuaggaauucauguuauguuuaccauuuagaagcugggauugcuuuuaaagguuuuucuuuuuaaaauuggcauguuuuugauuuaucaugucuuucuauucagauuauuggguaucaaagauuaaugaggacaccagaaucuugguuaaauagacaagugguaucauuacuguuugagucuuuuaauauucuccauaccugccaccagugaaaaaacuugccuuuuuuuuuuuuuuuuuuuuaguaaacagaauauuaucaaacaauuuauuuuggcuuuauugaaaaaagaguauuuggucuaaaugugccaccauagguguuaaauucuccuaucugcaauugucuuuauccuauauuguguucauuucuuuucuuaauaauuuacuuuguuguguguuucuacacuuucaucccuguuuuuuaucuuguauaucaucaggaaauugugauuuaaucauuaacauugguuuuuuugugugugugguaaaaaucaacacuaggcucaugguacauauuuuuauucuguacauuugcuuguaacuaucaauuuguaacucuguuuaucuacuacauguguauauauacuuagagcauuuucucuaacacauuuuaauguuaguauuuuuuaaaaggucugaccagucuagcaaauugucaguccaacgucauuacuuuaaauuaagaagcagucuucuucugguaaaccuuguugguauuuguaaaauaauuuugaaggucuuaauuucuuccuuuguaaaaggaaaagguuuuuuuuaaaguuuuuagguuggcauggaggcagaaguuggugauuacuugauuuacaacagauuuuuuccagaucauacaaaaggccauacaguaaguauagaaguagguauggggagggcuuacuaauaucaaauaggcaaggccuuagugagugggcaggauaccaccugagaguggccagauguggggagguuacucugcucugggugcucucauucaugaaucgacaaggauacauuagauuauuuugaaacauuuuuuuaagaagcagaauucuuuaauaauuccuuccuagacauugaauauacuuauaaaauuaaagacuuggggaaggagacacugagagacuugccaguuugguuccucaugaacaaaagaggacaguuugauaacuaccagaauagaauaucccuaguuuuaaaauagugagaaucucugaaguucaucaacaucuuaagaugcacuuacuugaaaguuugagauucuguuuaucauuugaaaacacauuuugcuuuaauucuuucuuugacauguuguuuuuucauaucaagaaauauaugaacaaaauaauaaccuuuugacccugaccuugcugggugaauuagcucugaaacacucucuacaaccaguaaugcauuugucccacauuucauucugauagaaaaugaacaccauagcaccaaacaaaaauccgaggcguuagauaaugucuggauuaaauaauuuaagacucucuaggauuuugguugucauuuuuuauuuauaacagacuuuaagucacuuucuguugccucauaggucacauuuuagacagguuugugucuguuccuugcaucugaauuccugauuguaaagacaccuaugaggucucuuaguuuuugucauucauuuucuugguuuaucaccccucccuucuuuuuguuguuuuucccugacuguuaagcaguuucaucuuugcuuuuguuaaauauuugacagcaguuaguuuguguuaagcucuugaaacuugugauuguacuuucuguguagauauacauguaauuauuuuuuauuuuucaaucauagauucaagcuuccuucuuuuuuaccacaaaucauuaaaguuauuuguguuuccauauac

SEQ ID NO: 21341 - RNA, 23286 nt, Homo sapiens
uuguugguuuuuuauuuccuuaaguacaaaaugcuaaacgggagccgagcucuuccgcauucagguguuuuuuuuuuuuuuuucggcuuuuuuuuuuuuuucucacaaacugguugcauuuguugauuuauuuuuccauccuuuucaccaguaaagauuaucaucguuuauuuuuguuuuuaaaguugaaaacaaaaaagaggagagaacagaguuaugguaugaauguauguaaaacuauagagaacuacaguaauauguacugugguuauugcugucuucaaaaaaaaaaagaaaaagaaaaacaacaacaacaacaacgaaaacaaccgguaggcaacucggaaucugaaggaaucuugucugacaacugugcuauccaugugggcuacggugugacaguggcgguagagaggagacuccggcuggcgaccggggacugguggaguggggugagcgggcacagggaagcugggguccccuuccccucggacccuccccaccuucccuuuccccauccaaaaggauuucaggagaggaggccagagucugugaaaugacuaaacuauauacuccauuagaaaaccaagaaaguauguuugaaauagaaacaaaagccuaagagaaaauaaaaaguggagaaacagugcaauguaauucuugcacuuuagugguuuuaaaaacacagacaguacaaggcccagguugcuggcuggugaaaccccugucccucgucccuccuccacuuugcaaaacggagccuccuuucucuuggaagccagacauauccucucugacgcuaugggguuucuucuccuuagagcucuucucugagguucccauucugggccggagcccucucaggagugaguggauggguccgggguacugucccaccuugaggggggcuuggcgguugccguggcagcccugucucacuaaccggugcguggcgggagcaggugguugaggcccacccucuaggggaggccagcccuguggggguaccauggaggccacagagguggugguggggagauggggugggagagaaggggcaugaucagaaaagggccucccuggaccucgugcgccugccuuccuccccucauggggccaguguccccaggccugucugucuaggccuggcugucaaagaaagguuccagucucuuccuccccaugugcccugcuuugccaggugggucagggcaggcuggaggaaggagggucaguccuggcugggcuucccuaucuccuggcagucgugggaaagacagaggcaucuuccucacugguggagugaggcacgaaucuaaaggggaugggaagaccuucugugggugugagcaugggagugggcagcacuuagauucggagccauggauaguccggaguccaaggucucugggugagcagacagucggccaaaggccagccuggagucaaagagaccagaccccugcuuagauugccauacucgcaccauuccaaaccugccucccucacacccugccaugggggaagaggugccgucuuccuccagugccucccuucccaggaucuccccacccugggcucagccagaacucccauuugggaggcuuaguuccauguguccaugaaggcccagcuucucuggggagugaccagcugcccaggagaaacuccugcaugcagaagagacucacagguuuggguucgcaggcacgaacuuuggaaaccggaagagucuggcgcacuuacaccaggcucuaaucccccaccugauggcuggcagcaaagagccaacgcaaggggcagaagccugcucaaaguccagacacaguccgugaagagagagccccucucaagaauuagguccaggcugggaggaauguggggggagcuuguaguuccuggcucagucuuuucucaggggaguggcaccccaguauccacuuggcagauccuaguuggauaacugcucaagaugcaaagggagaauggguggaaagaacagugacguggaagagguuugggauacuggccuaagacauacagaaacgugaguuggguuuaggggacagcugugcagagagauggggcaugcugacucggcaggucaaggccuuguggcugcuggcccuaucgggccccuuugucucaugaagauugagcacuucuccuguccccagccaacuguccuguccaggggcauaggagauagcccccaaguucuauagcuauaggguucccaucaguugaaacagauuugcuuuuucgcuauuccucuucguagccccaaauucguuguuggaggcggucuccgcugugucaugccaugagcaaagagugaagagagcuguguccacagcacgaaggggucuccuuggccaguguccaagcccccuuuccuggauaucuucagccuuaaagaacagucacaaggccacccauugguugaggaagucauuggagaaugggaguuucggaaucuggcugccgagugacagcaucccugaaucaugcguucccugcuugucccagcuuuccuuccauccuccaccccagggaggaugcagggacuggccagaauggaggaagagcuggaaagacucgugggccucagucccucauugcaggcugaaggugggcagcggagcacauagucuugucccuuccaaagcauggccaguuuagacugauucuuccuaucuggcuucuaaagucuagcacccuccuaaaguuacucaccuucccuggcucugcggccuggauuaagcucauuucuauuuugcaacccauucccccauuuuccucucuuuccucucaaauccuagaaaauacauaugguggggaagcuaaggaaauuucuauuggcuuuucccccuuucugcugcuuugugccaaagcuagaauggaacagucagcccccucucccuucagcccucuguuccuccccacaucgacucuggccggaaccauccaucuuacuguucuccugcaucuaaaccuuuuugccaccaucucccucugccaucucuuacuucagucucccuccugcucugccagcauggagagugagggaggcuuccaaaaaugcacauucuguucagaugaaaggaaaaggcuggggugggacugguggauccaucguggaccuguugggcucauguggugugguguccggagacugugacuuccugaggguuuaaagacuaaaaugggauggacugaggcgcgugcugugugcaccacggagggcuggccucugccuggcucggugggugcagaugaacacacguggggaaucacugucaaauccaguacugugccccacaaaaaagcugaguuuauugcucacgggaaacucugccucgaggcaggcaaaaaugcuauuacggguuguauuaggagaauauggguuuucucaguuuucccagaaugaggaagcuccucaaugccccuauaggaacuacuuugaaaaguuaaugcaaaccuuugaaagaaaggaagaaagaaaaaaacaaagaaaaagaauagauuuauaugccuauauaugacuauauggaguccuguagauaaauacgagcccacuuuuuuuuuucagccuauccucccccacagaggcugcugcgcuacuuacaaauugaauuaaaugagggcugaaacggcacgcuucagcauguacuguagucaccguggaagaacaagucuuuccaauauuggggcauguauugauuucuaaaaaaugucugccuggggaaugaaauaugcacauguauuucauauucacagaucugcuuccgaaaaccucucuauuuaauaucacucaauuaugaauuuguuuugcuuucagaggaauggaaugcauuuuaguuuuuauaaauuuggggagagacaacacucugcccagguaagaggagaggaaguucagggguccagcuguccauacugcuggcuagaggaggagacagauccgggagagguccuggaguguuuugccuuuuccuuucucccccugaccaauccauccugggaaaccccaauagugucauugauugccacauccugggcugcaucuucuagcgcccaccucucccgaccccaggccagggcuggacgugaaaguugggccccugccuggucucggugcauguccuuccugcccaccugcuugucuuccuuuuccuaacucuauucgucuuucucucucuucuacacaaacacuuccuucccuucucuuccucucguucuuccucucuucccuucucuguucauccaacuugccucaaaaagaaaaccauuuaaagggggggggugucuuuuuagcuuuuugcaucucuguuguugccauuuucgaaguugagcccuugcuagagauuccgagguccucaguuuccucaaauagauagauauauauuuuucccuuaaaugagaugaaaugaguggcguccugggguggagggaggcgcuggcuggagucggggcugggggugggagggggugagggaaagguuggggggggacgcaucacucaacguugcugcugucgaagguguggcacugaaaguccccgucaacguacuccaugccuggcagcuucaucccguacuuguccacgcaccagcagaugccacguuugcggccacgggaagguuugcacuggggugaguagagcaacaggcggugaggacggccgcaccccagggcucugcuccucccugcccugccucuugucuaccccaaggcaagacucucauccccagagaguugagggcacuagacccgacccuuggguuucugguguccccauuucacggaaagacccagggaaaaugugaauuuaggcagccuacccuuggcaagcuccuucaaucccuuucuuuccuuuuuuuuuuuucagacauggggucccguuauguugcccagguuggucuaaaacuccugagcccaagugaucuuccugccucagccucuggaguagcugggauuacaggcgugagccacugugccuggcuuauagucccguuuuaaauauuacccauuugaguucccccaacgugaaacucugcagggauucucaagagaguuaugauccaauaauaaugaugaugguaauaauaauaacagaaggaggcaugauuugugguguuaucauguaguagacaccacucaacguuugguaggcaguagguacuguucuaagugcuuuacaaagaccaaucacucacuccucauucaccauuuuacacaagggucuggaggcacagagacauuaaauggugaguaacaggacacagcuaguaaguggcagagccaagauuugccccaguguggccuggcucuuacauuuagauuauuggugcccuuaaagcagcaucagggucacguguccaccccggaguccaccccaggucuaccaaucagaaacugcagggguggggcccagccaucagccaugcccuccagggauaggaugcccuuggaaaucuaagaaccauugcccaaaggagagccuggcugugaagggacaugaacugauuucaggugguucacagagaaaauaugguuuaaauuccugagugugcggugcaccaaugauacgugcugugcgauaguguuacagaguuaccuuuugcaaggaauucauguagcuaaggcgaccuguggaaagcauaguggauuaccgcauaggagagaaugaggaaauggauuacagcauaguagggaauguggaaagucaugaucgugguauaugaauggguaucugaggcccaggaaacacuaagugguuaacgguggaaaccuuaggcacuugcccaagguggaguuuccuggcaggugccauuuuuggagcagucugagccuggagcucagggcaggggacguaccugcuuucucuuguagaauccuuugcggucacaauugggcagguacacagcacggggcaccaugcgugggcuggcuuugagcuccugcagggaagccuccaugugucugcggcaggggcccuguguggacaggagggugagaggcguggcgagaccaagggaaaaccacccagcugcgcugacgaauggcccagggggugggggcugaagggucucuggaggaaagucaccaccuuugguucuaaucaucugcuaccaaagaucuuuccucccugucaccugucacgugcgcugggaucauacaaagccugccuuuggccagguacggagucauacuuucucuuuuguguuccaguccacccccuccccugcagcuuuucucuucugcugaguaacaauguccagaggugcccauuucuagaugcucuaggagaauauucagucucugccuuggacuggacacagcugcagggcccagguaccugguacguggccgcugggcuggcacacacucuccucaaaugagcaccgccucuauucccacuuacuugcacaagcccuuggcccugacaaguguaugcucuggaaacucuacucccacguccuaagcugagccacauggugggcuguagguccucugcugggucuagucuagcaccuccugccgccaugaauguccauuuagaugcaggaaaaggucaaaagcugggagggaaugagggaauccccgagaugcaccugcucagacuccugucucaucucaggugcagagaugauccgggggugggcaguguucucggcucccccgacaaacuuggacugggucagcuucuuucugcgguccuucuucacugcuucagccuucagcucggagaugcggguguguuugggccggaagaucuugggggaguaggucuccucggccaucucagagguggugggcuccucgugcucacgggagucucucucugcaggagaaggagccggagggucagcccccgugggccaaggugcacacggccagagcccagggcugggcaguuuggggugaggggaguaauaaaggcugaagcagaugugucucugcccuccuggagcacacccugaaagcagggggauaagaaccaggaagcagagggaaugcucauuuaaguggcaggaaguuucuggcaugcuuggagucaagcagagagugcaggcagggaggcuucacagaggaggagaaucgagagacugacagacugaugggugaggacggagcaggccuucugggggcaguaaggaggaagggcaaggaaaauggccucugcaaggaugaagguggcagcgagcgguuugcuugcugggggauggccaaguagaugggacauggcuggagguggggcugagaaguaggaacccgggaaucugggcccauggaggcagaugacacagucagggcguggacgagaagggcaaaggcuguccuguuagugagaucuuugcacuuucagagcugcuggauguugaggucucuuuggaccuggggaaccuaggaggaggggguccuggggucuggagcagcaggguggugaggaccuucauaagcggcaggaggaggggaggggagagccagaaauguaggcccggaggggaccggcguggggccaaguggaagucggaggccuugcuccugcucuggcucagaacuggcgcggugcucgggggccugggaggcugggacguuacucagcucuggacugagagaggccgacagcuggcugagaccgggacaguuauauauaggaguggcuugcugacagucuauacuuagcuggcuuuugaccuuuagagaagucagacuuuguugauguauuuguugauccuuaauuccacccguccggccuuuucuuggugcgcaguuuuccccuaaauucugaucucauaggcauccaucccuggguccccuucuccucucagauccuugaccucccccagccucagaggaaccagaaugggggaacuuuagauuguuguuuccaggcgggcagcguguggccaggaugccucacagugggaccagaugcaggggugaguggagguggggggcccugucuucauugccucccucuuuuuucaaauacuggaaagagaaaauagagcuuugagugaccuuaaauaacugaaaugaggugaaagaaaauucuguucuccaucuacuccaugaucacugggauguccaggaacagugaccgccagacaucugggauggggaacagaagaaguggguagaauuccaggaaguggggguggggugcaaggaaagagaagcuuuuuugagaagacgcuguuuuaugccucugggcagguauagaaccugacuucugagcuugcagcccugggcaaguuccaggugugaguuaggaaaggcauuuggacaccuggccuaaccugggcaggauggcagguggcaggaagcacccaagcaucuguuucucucuuggcucaggauuugucaagucuaaugaaauagguaucuggucuuuaaggccuuggcagagaaggucccugcccuaaagaagccuccaaagguucgcagcguuccugguggugaguugcuuuggguauuuauucacaggaaaggaagggacguaauuacuggagaggaagaugaugacuuggggaaagcaaauagcaagguggugggugggcucucccuaaauaaaauucaaccugagaauccugguaccccuucuggacucucacccccucuucccagucaugucuugaugucccaguaccucgauucugcucuaucagacccugcugugacgacucaucaauagggugacaucucugguagguggaaugcaggauucuagggauuaguuaaaagggucauguucugggguaaauugacuuuucuugguuguagcgcaagugagauuggcaggaggaagggagaagcauggcugguuuggggacuuuguacaaauugaaaggcuggggcuccguuaucuaguaacacaggccucacgccaaggcucagaucuuggagaagagggaguagggagagggagugcuaaccauugcacagaagggcuuuugggcacgucuuauggagggacuggagccgugccacucaaccucagcaucaccacgcauuuuaauccucaaaaaguaguugacuacuguagggggaggggcagacaggauaugguggcuacugaaagccuggaggggguucagauuggagaagccuggaccccuuccucaaucaagauuguaacuggauaaagugagggcaggugggggagugggcuggcugcugaccagcgcaugcgucuaugcgucuccuucagugggcugccccagccuggccuggagagccaacacauugucaccucuucaaggggagacagccugggaagcuggcuucucuccuguggcugguguagcaguuccuggaauccuuuccguaggccauuuaguccaucccccuguguccaagcagaaauaagcaucuaucucucuaguucuuaaggacaucugaaaugggggugccauuccauccuccucuggcuaccuguugggggaggcucuguccauuuggucagagggugcccuuuuccagcugucauuuuagcuuauucucucuuuggccuugggggacacagaagcaugguggcccacagccuucccucaacagcucuucucaagaccuuucaccuuuugggacuuuuucuaagaagugcugugggcuguccuuaaccuugagucacccuuucugggagggggauggggcuguugacaacgguuugauaaaccuugggguaaauuuauuuugaccucucuuacucuuuucuuugaaaguguucaaguacugccccggggccaagcaaccaugauacuggcauacaaaauguagauucuuguaucucucuucauuuaaggaacucaaaaugcuuuugcaaacucucuccuuuucccagccuccccaaggcaagucuccugagggcacaccuuccccagcuuugcaagcuuuuuggcugcuucugaagagcaggcuuaacauuuugaugugccuccugguuucuggugccacuuaaccccaugggaccuauuccuuaggcagcagcagaguccagugucgaagauacuaaucagggucuuguggucaccuguaggcuccagagagacagcggaaacuuggaggggagccagggcagagccauggagauuaaagggcuggaaaguaagacuggagcugagugccagaagcagccagcccgacucagcugcucuguggcugagucauaaauaggcuuucaauuguggaaggcuuugcguuuuagauaaaacaagaaggaacaaguagacuggcuacucuggagcuauuucaucaagagaaaaugaacugagguugcagaagggaucuaggcaggauacccgggaggacuuccuggugaagauuguucugcacgugaacagcaaaagaacucaacagucugcucuggaaccuguuugacaaacaggucaauaucuccauguggccagcagagggcgugggagacugacacccacacagcaugggcacacuucuagggacuggaagcguuuuuuguuuuuuuuuuuugagacagagucuccuucugucgcccaggcuggagugcaguggcgcgaucucggcucacuguaagcuccgccuccuggguuuacgccauucuccugccucauccucccgaguagcugggacuacaggcgcccgccaccaugcccggcuaauuuuuuguauuuuuaguagagaugggguuucaccguguuagccaggauggucucgaucuccugaccucgugauccgcccgccuuggccucccaaagagcugggauuacaggcgugagccaccaagcccggccuggaaguguuuuuaaaaucuggaauuuggaauugagagcgguggcucauaucucuaaucccagcacuuugggaggccaaggugaguggauugccugagcccaggaguucgagaccagccuggacaacauagugaaaccccgucucuacaaaaaaaacacaaaaauuagcugggcauagaggcgugcgccucuagucugagaaacucaggaggcugagaccggaggauugcuugagcccggaaggugggagguuggagguaggagguuggagauuggagguugaggcugaggcugaggugagccaugauugcuccacuuugauagcuccacugcacucuagccugggggacagagugagacccugucucaaagaaaaaauaaaucuggaauuugggugccucccucuccuacuucugcaauaaucauucaaauaaaucccuuccuucuguuugugugucugcaggauauauuuaaagagucagggagacaaacaagcgaggcccggagagaacccaugugugggagagugaaggcaggugagggagaggggaacagggcuuguuugugcauggcauucugcuguuucuguaaccuccaacuggaaaaugauccaggaaggaagagagacauauuccagacuuccccgcccaugagaugcuguucugagagguuuuugcagaggaugggaaauguggaaugcucagcauccauuucuccugcugggaucuauggaggccagaccuuaccuucauaacccuauucaaugacuaagggaggggaugaugauaauauuaucuggauacaguauuuaccuuuggggugggaucuaaaucucuggcuucuauauaauaccuccaguccuucccacuggcucuccaaugccucuggccccugccacauuuggguggccaacucaguccucuuucauucauaaggaguuccccauacaccccagugcagcagcauccacagaggcacacacaguacaucagccucuccccaugguaacaugaacacguguuugaggauugcaccauccucuauguccuggcaaacacagagagugucaugaugcaagcccagcugcuacagacccagaggcaucuuagggugagaaauacuccaugcugcacaauugcacaacgcauguacccugcccaagcucaaccacuuucuccaaaccugcccuuuugccacggcuguucucuuccaguagagucugaaggguucugacuccaccuugcuugcuggucacagcaauggauggauccaggagaccugccugccuaaaaucuaaaccccccgcccccggaccucuuagccacaccccggugcuauuaacagccuguuccugggcugguguuaguuuaucacucuaucucacuugaccuaauaaucaauuguaagagaaaacuaggugacccagauauugugccuuagcuuacaaaaaucgaagaaacagaggcauccuugaaauucacaguccaggaagagugucgggcuuugccaggccacccagaccuggggagauucucccaucuccuuuucuagacagaagauaagaugaggacgccuagaaucucucuacaaagaaugaaaaagggagcugaauuuguucuggguuucauucuaguccccccuguggaauuuaaacagccaacuucuuacgggcagagcuuugucauuucucuuugucucaccagcauauaguauucaauaaauaaccuuuaaauggagagauguguaaaucugcccaagaggcaaagagaaguaggucuggaaguauuucuguaauauaagcuggggcuuagagcccagugcaugccuugggagguuaucucauccaugcuccugcccuggagcaagauaacccugccgcagggcacagggaagcagacagaugagcgucaugggugugagaaacagcaggggugcuccuggauucacugggcuucucuuuggccuaaggcuacuauauauuaauguacuacuuaggccaggcaugguggcucacgccuguaaucccagcacuuugggaggccaaggagguuggaucacaaggucaggaguucgagaccagccuggccaacaugguaaaacccugucucuacuaaaaauaaaaaaucagccaggcaugguggugugugccuguaaucccagcugcucgggaagcugaggcaggagaaucacuugaaccugggaggcggagguugcagugagccaagaucgugccacuacauuccccccugggcaauagugugacaaaaaaaaaaaaaaaaguauauauuuaauaugguagccacuagccaauguggcuauuuaaauaaauauuaaauaaaaugaaaaauucagcuccucagucacucuagccauauuucaaggacuucguggccacauauggacauugcagaccugcaacgcuuccaucauugcagaaaguccuggucagugcuggccugacggcacugacuugugccuggguauggaugaaaauacugaggcccagucuagaauguucugcagucccccuccucccuugccaacccuaggucccuagccaacuugcagccaccagccccucccuacaacacaaggcugguggaagcaugagggauuggcuguucacuguuugaaaaaauguaagacaugucucagucucuugaagucuguuucccagcuguggaugucaaauggcuuuucugcgcuugugugugugcauuugcagaaggagaaaggccacagugguuguggcagggggaaggugcuguggacacuuccagggaaguggcaacaucauuucuuuuccuacccaucccaucucugaccagcagcugccuggcgccagucucucucagaagacauuuuuuuuuguuuuuguuuuuuguuuguuuguuuuuguuuuuacuugaucgucagaaauaggcaugcauguuccggguucuuuuuaaccugaauuaugggcugaggaggaaaugagcacuaaccuuuuaagaaaaaaaaaaaacccaaagcugucauccuaaaaagcagcuguaagaauggaggaaagccaggaggaagaccccggaggggaguugagcagacuuagagaacuacugacuggaugaugagggcuauagguguacccagcugagccccccuaccccauuuuaggccgggagaaauagcaugguuagguacucuaaaccaacagcaaagcuggccaagcugggaauauaucucuauccuuaccagagaaauacagacaccauguaguauaguggauaaccauucagaaucaggaaccagaccaccuggguucaaaucccagcuccacuacugaauagguacagcaaacugugccacccuaaaccuucagcuguccuuucugggaggaagaugaagcuguugacaauagcucaguaaaccuugaugcagcuuuggcaacacagcaagaccccaucucuacauaaaaugaaauauuagccgggcguggcagugugcaccuauaguccuagcaauggggagucugagaagggaggauggcuugaacccaggaguuggaggcugcagugagccaugauugugccacugcacuccagccugggugacagagugagaccuuguuucuaaaaauaaauaaauaaacaaaccuugguacagauuuacuuugaccuuucuuuuuuuuuuuuuuuuuuugagacggagucucacucugucgccaggcuggagugcaguggcaugaucuuggcucacugcaacccucuccucccagguucaaaugauucuccugccucagccucuugaguagcugggacuaaaggcaugcagcaccacgcccaggauggucuugaucucuugagcucgugauccacccaccucagccucccaaagaccuuacuuucuucuuccucuuuccaauucaguuuucucaccuguguuauggggaggauggcaauggccccuucuccauuauauucugaggauuaaucagggugaugcaugcuaauucacucucagaacaggucucugccuuuguagugcuguuuccuaccaccucccuaguucgaaucaucaacuaaaaauuugguugcugugacaccugguugacagacgccuacuuguagaccacaagaucugaggcuccuuggacugcaggaaggucugccagaaaguguuggcucgaccuuugucucugggggucuguuggccaacaccaggugaggacuuggcacaggugcucuccggacccgucuccacuuagagagcucccccugggaguccuuccucugccuaaccccauuccuucaugcugcguuaagggcacuuagccuccuucccugaagauauauagagaaaagggggcccaccgcccuccacaguguagaugccacaggugggaaggugacaccucacagaguaaggggcugaggucccccuuacaucugccccacuguccagggaccagagguaaagagaggcuccuuguuguuuucugaugccaaacuaggauuugggguugugacucugguucacauuucuuggucccugggaagcagcuggcgauaacuguacacauaggaaauacacacugaugcacaagucccuggcugagaaucuccagccaagcuucuuuuggaguuggggaagggggagcaugcuuaguagaagugucugucuguuccucauacauuccccaaaugagaagguaaugguggggggauagguggggagcagccucuggaggaagcacugggcagcuuuucuccuggccacuuucccaucaugacccaucacagccaguucagaacauugccagccacagccacauccccccaaaguucugcaugaccagaagggggcggcagggaggaaguaggguuuacgcuucucuccugaggccccgaagaaggugcccaggcucugcuagggaccaaacaagggagcccugucugucaacgaaagcugagacuccccuuuuuugagucuuugggagcaaaaggaaagaguggggacagcaguugccuucucaggugagagagggguuugcugguagccauuaaccaugugcagauacauacggaacaucugaaauguggcccggggaacugaggaaccacauuuuaaaauuuauuuaauauuuauuuaauuuuaauuaguuuaaauuuaaaaacagauacucaacucaguuauuggaaagauuuuaaaguauguuuggaaugccucagguaugugacucugcuuuuucaacuguaaauuuuaugaaaucuaaauacagaucaaguauuuccaaugaaaauuuagugucugaauugagaugagcuguaaguguaaaaaacaccggauuucaaaggcuaaauaugaaggaaagaauguaaaauaucucauuauaauuguuuuauuuugagcguguggugaaaggauauuuuggauauauucaguuaaaauguauuauuacaauuaauuucccuguuuuuuuuaccuuuuuaaaaaagauguggcuaccagaaaauuaaaaaugacaaauauggcuuguauuauguuucaauuggaagugcuguucuaaaugaucuggaagaagagucauccuggcugaggugacagaggggugucgcagucccaguucgggauaacuggaacccacauuaaacaacucagagaaucagcagaggucaucugaggccuggcucugagugcagauucagugggaccuuauuuuaggccagggaaaggggccugaugguuuagguugagggaucaaacaugagauaacugaguucguuuaaaauguuccuauaguucaccuggcaggucugacuuaccggaaaaaggggccuaucuuaucugccuccuuccuaagcaucccagaaggaggagcugccacggccuccaggauguauuagaaugggucucagcacuuccugcagcacaaccagaaguccccagcugcccucuggaagcacaucucuccucuccugcugaaagaucugagacacaucugccuaugaaagaaagccagggggcccucaugcucucuuccuuaucagcuuuggugguauaugguuuuccuucucuccuucggaugcagaacuuccuaguuacugcacucaccccauccaaccacacccucucucgaucucugcuuucuguuggcaccacgugaggacugugcuguuggaagcgggccacuucugcaccauguucuucaagacuacaggccgcugcacagcucagaggcagccaggccugccugccucuccacaucaggagagcuuccugucauguagaaaaugagguuuggcgcauggaccugaaagcuggggugaacaccccuccuucacacccucuugguccucuuucucugaccaaaccacuagccuaagccaggcuuguaugcaagacuguguagaaaaagggacagaagugagugugaaaauaagagaguguggcccucuccacuuuggggccgcuucacuccuuuuccuacugccccuaaaacagagugccuucagauuauggguucuuaugucauggagugauagcaucuggcaguguuugccaaaggccuuacugcagguuagcccagguccaggcaugagccccagugacuagcgagaaagccaggaauggcugaaugcagugcuggagccccugcgggaaagagcugagucccagccccuugucugucucuaacccugcugccacaucuugggcaagugacuucccacucagggccucaguauccucauucuaaaacuaggaccuugacugugaugauggcuauggguuccuuccagcuuuaacauuauuuggccaauacccagacaauuccuggagagacacuaggacugagcuaagcugaguggccaggcacuaacuaacuaaccugguuaggugcucuaaaccaacagcauaguggccaaggugggaauauaaccucuccuccucacagagauuuucagucacuccucuggauuuauauuuuuuaaaaagagagagagagagagaaaugacaucauaacagaauuuauggaaagaaaugaaacuggaaauaaaagggggggauuucacugguauugggggaggggaguagaagccuacacugccauccuuguuuauuuuauuauuuauuuuugcaaguauguaaucaauguguaaucagucuuacuguuuugaauaacauguccugauugcaauuuaaggauagucucugggaauugcagcuuuuggaccaacuguagagaaaaagcaaauguaaaacuaaacaaaccccuccaaaucgccugcuugacucaacgcagccauucucccacccucuucccuucugcucuggccccugguugguaccugcucuuuaugaucuucuuccaguuucuggauguagugggucuggaguguggugaucucuucuccagaguuuuauuuuccacacacuaaauaucuuaaaaguuucauaggcauugcucagguacaaaguagaaacuuuagacaaguauuaccuucccuucccgcuggcuucuucgcuccauuaagggggccagggcuucugcagggaauuccugcucccaugcccuuugcuguaacccucacgaugaccucuggcuccuagggucaggcugguccacccucugcagcugcaggcccaccugccugcucaaauccagcccaagccccgggacuaacucacagcugcucugacuuaaaacucaagcccucaggggaugccuuagaguugggguggggggucgggggguggauggagaaggucggagggaagaguaggagggaggggugagaaaggggaaaaagagaaauggaaagaauaugagcucucacuagggcuaacucugcuuguucuuccagucugagcugacacagcagaaaggugggggagggggggcggggugggcgggggcgggggcggugggcggagguggcgagaaaaguccaguuaaagccccaucucguuuucccaacucccguuuugguuggcucagggcacgccauccucucaaagacuuguuucagagggagggggugcgggugggaaaggaauuuggcuccuucaguuuuccaugaucuugcucaacccagacauaaauuuggccaauaaaccuaacucuggaacucgacuucaacauggcauuuuagaccaggcuuggaguugaagccagggugauggaggccaaaccccucaaagaagcaaaggcugaauucacuuuuauuuagguaaugcuuuugcuuucuuuuccagaagccuauuuuuugucccacggugucucauuucuuaaugacagaaccgaaagccagaacccacggcucccuacaucuuaaacugaaugucucaccagcacagaggagaccuacccgaaccccgguaucuaugcuggggaccagcccaucaaaccucauuccccaccaaaaaugcccgaaagcaaacccaguacuuccuugacucccuccacucaccgcuauuuacugagcuuugcccaucaaauaacucccgucuuucaucucccuccagccucacacacauucuuuuuuccguaucuaucucugcuccugaacuggccagaaugaaaugcagagccaggcucgcucucagcacccugcucucgggcccacucccucuccaguugcucagcaacagccuagcaaaacacccucuccuccgcccucuccuuucccucccagaggcuuuggcugccugccaccucacucucuucugcuccccauuucugauuccagaaaugcaccuuuuuuggguucuacauguuugguuacauauaaauauauauaauauaguauauaccauauauacaauauauaauuauauagauauaauaugucguguguguguguguguguguguguguguguguguguguguguaugcugcaacugcgggagggagggggcaaauccauaucugcaagcucagauuuuggcgggggugggggagaggagggagguaggagguguguugggaagcaggaauuuuggcuaaaggaccaaaagggcacucucccucucucuguccauuucucucuccuuaagaacggucucuacaccaucuccaacuuuuuggggacccgcccagugguuguccggcuaaaacgcccuuuccaggagcgcccacucccaucccaucuguucgggaagaagaugucggcaccagcagcgguggagcgccgccaacccgcaacagcagccggccgggcaccugccuucggcgggguggagucggagaggagugcuggggagggggcggguagaagaggcggcuucggguuggcccaaaggcacucagaagguggggguugagcaaggggcggcagggaauucuacaggggaucuugcuugggacugaagugucgugugugugugugugugugugugugugugugugugugugugaugcgcccuccgugcucgccuagcaauugcgcgcgcgugcgcucugcguguacacccuucacacuagccacaucacacuacacgcuugguaaauaauaaguggagccaggaugcggcugagugacaccuuacguucuuucggugugacuggauuguuacccagggcgguggcucccaagccgggaaaucaauuaauguuuuccuucuccgcuaggcuuuuccaaauccacaucccccaagaugaaggcgggcaggaccgccuuugaaaaguggaucuuaauaaaaauaaucucacaagccggucucugggguucccagagccugcacauccuccccuuuuccucuuuuugcaggcugcaaccugcaaaaagaucgacuuuuugcagguuuggagaucgacuaccucuugcaaagcuagaggggcuggccccugcgccacucaaacccugcaggguuugcggggacugaggcugaacacaggaagcucuccggccuccuggcaagcgcggacgcacuccucuccugcacuauagugacugaaauuugcacuucagaaaacucauguuagggugcucgugaguaacggaaagggacagggagggagaaggggauugcccccguaacuaaacugucuccguaacuaaacuacgccaaauaaacauuguuuagccaaguuuuaaccccuuuuggagagaaucaauagccaguuugacgucuuagaacccagacuuuuauguaguuuauuuaacuuuuuuuuuuuuuaacuaaagaucagguaacucuuuccaaaaagaaacucagucuaaggggguagaacuguucugauugaacaaguagcugugucaaucauuucaacccuagacuccuggcgccgagaauuugggggcggcgcaacccgggggcggggcaagcggaggcgaggcucccagugcguggcuuuucugucuccgcccccugaauuuugcauucugcguuuccagggccccucaugcacuuaauccacacccacuugugaucugguuuaagagauuggggagggcgggguggggggauugcggagggaggaauugcggggcggggguggagguggugguggugccaggaaucugcauaggcgaggaaguugaaagcucugaaucucacauccccuuuugccucccagcccuauguccaccuuucauccuagguaaaaucugaauuggagagggggaaaaggaauuagauucagaaacgaacaccaggcacagaauaccaaacccuuccuuucuacucuuccccacccccaccccgcacccccgcacuccuaaaguauuuuuuucccuuccugggauaaaauaaaagucauuuugcaguuaaauauguuuuaccaucuaccacaggcaaucaucuucaauaaaaagcaaugguuaugcacaugggaggggcuucagggcucccacccgaaaggcauuagcuaccaaggaugugggguguuugugguguguguguagggguggagggauagaaacgucuggaggcacggggguggaggggccaagagggacaaagguggaauuagcucagaagauagguaaugccucucucuccaggccgcaauuaaaauaauauuuuaacaaaagagauuuuuuuuccaaguucagaaaaaaaccuaugcggggcgcgagggggguggaggagggaguugauaauguaacauacacucuuucagacuguagauaggguaccaggggauuuggaccuugugaccgaauaagagcucagaaucaguauucggacagaguagggggagggggcgggcaacguguggguaggaggaaggagaaagagcgaaagcugggauagacucggcuagacaguucccccggguagcaggauccuccagggcuccaauuccggggugcaaggacccuccccgacuacucccgagcugcaccccagcucgaagccacuugcugcgcaaagcgcgcgggcccagccggucucgugucccccgcccgugcgccgcguaacugacuggcacacugagcgcgcucaccgaucuugacuugcucgcgguagcucuuuucguugaggcaaaccccgcggccgugcagcagggcgugcagcggcuucuccucguccugccgggggaggcagcgcagccccugggcgcagcgcucgguguagacgccgcacgacugccccucggccagggcgcaggucaugcagcagccgcagcccggcuccuugaccagcucgcagcccagggggcugggggggcacauggagagggcuuucucgucgcagggcucgcagugcacgaaggagcccaggcucugggccggccccgcauaggcggccagcagcaggaggaccgcggugagcaacaccaucuucucuuagucgcccccuuuaccucgggguggggcaggagagcgagagugcagggauaaaggggccaagagggcccccggagauuuuuuuguuuuuguuuuuguuuuaaaauuucuggcagguagagcaggugcccucccccagacacuugcaaaaauguagagagagguggagggcuggggugccugcgagcaggucccaguugcaagaauuaaagccuugcaacagguugggggaagcagggcagcgccaggugcacgcagugagcggaggccggagaaacccucaagccugagcgggucagaauuauaggggaaaaaaagccacaaaauuguucacccccaagcaaccaccgaaauaaugagaucggaugcaguggagauggcguugggggugggagagaaaaauggauuuaucuuuaaaauuuuugcuuaaaaucuaaaauacaccccgcuuucuaacccucagcugccagcggugcgcggcgccgcagaacagguaagaggcguuggcugcagccgagagggugggagaaaauguugaaaucaagaaauuaaaaaacaaaaacaaaaacaaaaaaaccccaaacccuaacaccucuuuucucccacuuugccaccuccucuucgaaauucgcagguucuacgcgaaguccggagaagggugaaaacggaggagggguaaugaaaaggagcaaaaaagggaaaaagcccacacugcuuugcagcucuuuccuagcucuuuu

SEQ ID NO: 21342 - RNA, 23286 nt, Homo sapiens
aaaagagcuaggaaagagcugcaaagcagugugggcuuuuucccuuuuuugcuccuuuucauuaccccuccuccguuuucacccuucuccggacuucgcguagaaccugcgaauuucgaagaggagguggcaaagugggagaaaagagguguuaggguuugggguuuuuuuguuuuuguuuuuguuuuuuaauuucuugauuucaacauuuucucccacccucucggcugcagccaacgccucuuaccuguucugcggcgccgcgcaccgcuggcagcugaggguuagaaagcgggguguauuuuagauuuuaagcaaaaauuuuaaagauaaauccauuuuucucucccacccccaacgccaucuccacugcauccgaucucauuauuucggugguugcuugggggugaacaauuuuguggcuuuuuuuccccuauaauucugacccgcucaggcuugaggguuucuccggccuccgcucacugcgugcaccuggcgcugcccugcuucccccaaccuguugcaaggcuuuaauucuugcaacugggaccugcucgcaggcaccccagcccuccaccucucucuacauuuuugcaagugucugggggagggcaccugcucuaccugccagaaauuuuaaaacaaaaacaaaaacaaaaaaaucuccgggggcccucuuggccccuuuaucccugcacucucgcucuccugccccaccccgagguaaagggggcgacuaagagaagaugguguugcucaccgcgguccuccugcugcuggccgccuaugcggggccggcccagagccugggcuccuucgugcacugcgagcccugcgacgagaaagcccucuccaugugcccccccagcccccugggcugcgagcuggucaaggagccgggcugcggcugcugcaugaccugcgcccuggccgaggggcagucgugcggcgucuacaccgagcgcugcgcccaggggcugcgcugccucccccggcaggacgaggagaagccgcugcacgcccugcugcacggccgcgggguuugccucaacgaaaagagcuaccgcgagcaagucaagaucggugagcgcgcucagugugccagucaguuacgcggcgcacgggcgggggacacgagaccggcugggcccgcgcgcuuugcgcagcaaguggcuucgagcuggggugcagcucgggaguagucggggaggguccuugcaccccggaauuggagcccuggaggauccugcuacccgggggaacugucuagccgagucuaucccagcuuucgcucuuucuccuuccuccuacccacacguugcccgcccccucccccuacucuguccgaauacugauucugagcucuuauucggucacaagguccaaauccccugguacccuaucuacagucugaaagaguguauguuacauuaucaacucccuccuccaccccccucgcgccccgcauagguuuuuuucugaacuuggaaaaaaaaucucuuuuguuaaaauauuauuuuaauugcggccuggagagagaggcauuaccuaucuucugagcuaauuccaccuuugucccucuuggccccuccacccccgugccuccagacguuucuaucccuccaccccuacacacacaccacaaacaccccacauccuugguagcuaaugccuuucgggugggagcccugaagccccucccaugugcauaaccauugcuuuuuauugaagaugauugccugugguagaugguaaaacauauuuaacugcaaaaugacuuuuauuuuaucccaggaagggaaaaaaauacuuuaggagugcgggggugcgggguggggguggggaagaguagaaaggaaggguuugguauucugugccugguguucguuucugaaucuaauuccuuuucccccucuccaauucagauuuuaccuaggaugaaagguggacauagggcugggaggcaaaaggggaugugagauucagagcuuucaacuuccucgccuaugcagauuccuggcaccaccaccaccuccacccccgccccgcaauuccucccuccgcaauccccccaccccgcccuccccaaucucuuaaaccagaucacaaguggguguggauuaagugcaugaggggcccuggaaacgcagaaugcaaaauucagggggcggagacagaaaagccacgcacugggagccucgccuccgcuugccccgcccccggguugcgccgcccccaaauucucggcgccaggagucuaggguugaaaugauugacacagcuacuuguucaaucagaacaguucuacccccuuagacugaguuucuuuuuggaaagaguuaccugaucuuuaguuaaaaaaaaaaaaaguuaaauaaacuacauaaaagucuggguucuaagacgucaaacuggcuauugauucucuccaaaagggguuaaaacuuggcuaaacaauguuuauuuggcguaguuuaguuacggagacaguuuaguuacgggggcaauccccuucucccucccugucccuuuccguuacucacgagcacccuaacaugaguuuucugaagugcaaauuucagucacuauagugcaggagaggagugcguccgcgcuugccaggaggccggagagcuuccuguguucagccucaguccccgcaaacccugcaggguuugaguggcgcaggggccagccccucuagcuuugcaagagguagucgaucuccaaaccugcaaaaagucgaucuuuuugcagguugcagccugcaaaaagaggaaaaggggaggaugugcaggcucugggaaccccagagaccggcuugugagauuauuuuuauuaagauccacuuuucaaaggcgguccugcccgccuucaucuugggggauguggauuuggaaaagccuagcggagaaggaaaacauuaauugauuucccggcuugggagccaccgcccuggguaacaauccagucacaccgaaagaacguaaggugucacucagccgcauccuggcuccacuuauuauuuaccaagcguguagugugauguggcuagugugaaggguguacacgcagagcgcacgcgcgcgcaauugcuaggcgagcacggagggcgcaucacacacacacacacacacacacacacacacacacacacacgacacuucagucccaagcaagauccccuguagaauucccugccgccccuugcucaacccccaccuucugagugccuuugggccaacccgaagccgccucuucuacccgcccccuccccagcacuccucuccgacuccaccccgccgaaggcaggugcccggccggcugcuguugcggguuggcggcgcuccaccgcugcuggugccgacaucuucuucccgaacagaugggaugggagugggcgcuccuggaaagggcguuuuagccggacaaccacugggcggguccccaaaaaguuggagaugguguagagaccguucuuaaggagagagaaauggacagagagagggagagugcccuuuugguccuuuagccaaaauuccugcuucccaacacaccuccuaccucccuccucucccccacccccgccaaaaucugagcuugcagauauggauuugcccccucccucccgcaguugcagcauacacacacacacacacacacacacacacacacacacacacacgacauauuauaucuauauaauuauauauuguauauaugguauauacuauauuauauauauuuauauguaaccaaacauguagaacccaaaaaaggugcauuucuggaaucagaaauggggagcagaagagagugagguggcaggcagccaaagccucugggagggaaaggagagggcggaggagaggguguuuugcuaggcuguugcugagcaacuggagagggagugggcccgagagcagggugcugagagcgagccuggcucugcauuucauucuggccaguucaggagcagagauagauacggaaaaaagaaugugugugaggcuggagggagaugaaagacgggaguuauuugaugggcaaagcucaguaaauagcggugaguggagggagucaaggaaguacuggguuugcuuucgggcauuuuugguggggaaugagguuugaugggcugguccccagcauagauaccgggguucggguaggucuccucugugcuggugagacauucaguuuaagauguagggagccguggguucuggcuuucgguucugucauuaagaaaugagacaccgugggacaaaaaauaggcuucuggaaaagaaagcaaaagcauuaccuaaauaaaagugaauucagccuuugcuucuuugagggguuuggccuccaucacccuggcuucaacuccaagccuggucuaaaaugccauguugaagucgaguuccagaguuagguuuauuggccaaauuuaugucuggguugagcaagaucauggaaaacugaaggagccaaauuccuuucccacccgcacccccucccucugaaacaagucuuugagaggauggcgugcccugagccaaccaaaacgggaguugggaaaacgagauggggcuuuaacuggacuuuucucgccaccuccgcccaccgcccccgcccccgcccaccccgcccccccucccccaccuuucugcugugucagcucagacuggaagaacaagcagaguuagcccuagugagagcucauauucuuuccauuucucuuuuuccccuuucucaccccucccuccuacucuucccuccgaccuucuccauccaccccccgaccccccaccccaacucuaaggcauccccugagggcuugaguuuuaagucagagcagcugugaguuagucccggggcuugggcuggauuugagcaggcaggugggccugcagcugcagaggguggaccagccugacccuaggagccagaggucaucgugaggguuacagcaaagggcaugggagcaggaauucccugcagaagcccuggcccccuuaauggagcgaagaagccagcgggaagggaagguaauacuugucuaaaguuucuacuuuguaccugagcaaugccuaugaaacuuuuaagauauuuaguguguggaaaauaaaacucuggagaagagaucaccacacuccagacccacuacauccagaaacuggaagaagaucauaaagagcagguaccaaccaggggccagagcagaagggaagagggugggagaauggcugcguugagucaagcaggcgauuuggagggguuuguuuaguuuuacauuugcuuuuucucuacaguugguccaaaagcugcaauucccagagacuauccuuaaauugcaaucaggacauguuauucaaaacaguaagacugauuacacauugauuacauacuugcaaaaauaaauaauaaaauaaacaaggauggcaguguaggcuucuacuccccucccccaauaccagugaaaucccccccuuuuauuuccaguuucauuucuuuccauaaauucuguuaugaugucauuucucucucucucucucuuuuuaaaaaauauaaauccagaggagugacugaaaaucucugugaggaggagagguuauauucccaccuuggccacuaugcuguugguuuagagcaccuaaccagguuaguuaguuagugccuggccacucagcuuagcucaguccuagugucucuccaggaauugucuggguauuggccaaauaauguuaaagcuggaaggaacccauagccaucaucacagucaagguccuaguuuuagaaugaggauacugaggcccugagugggaagucacuugcccaagauguggcagcaggguuagagacagacaaggggcugggacucagcucuuucccgcaggggcuccagcacugcauucagccauuccuggcuuucucgcuagucacuggggcucaugccuggaccugggcuaaccugcaguaaggccuuuggcaaacacugccagaugcuaucacuccaugacauaagaacccauaaucugaaggcacucuguuuuaggggcaguaggaaaaggagugaagcggccccaaaguggagagggccacacucucuuauuuucacacucacuucugucccuuuuucuacacagucuugcauacaagccuggcuuaggcuagugguuuggucagagaaagaggaccaagagggugugaaggagggguguucaccccagcuuucagguccaugcgccaaaccucauuuucuacaugacaggaagcucuccugauguggagaggcaggcaggccuggcugccucugagcugugcagcggccuguagucuugaagaacauggugcagaaguggcccgcuuccaacagcacaguccucacguggugccaacagaaagcagagaucgagagagggugugguuggauggggugagugcaguaacuaggaaguucugcauccgaaggagagaaggaaaaccauauaccaccaaagcugauaaggaagagagcaugagggcccccuggcuuucuuucauaggcagaugugucucagaucuuucagcaggagaggagagaugugcuuccagagggcagcuggggacuucugguugugcugcaggaagugcugagacccauucuaauacauccuggaggccguggcagcuccuccuucugggaugcuuaggaaggaggcagauaagauaggccccuuuuuccgguaagucagaccugccaggugaacuauaggaacauuuuaaacgaacucaguuaucucauguuugaucccucaaccuaaaccaucaggccccuuucccuggccuaaaauaaggucccacugaaucugcacucagagccaggccucagaugaccucugcugauucucugaguuguuuaauguggguuccaguuaucccgaacugggacugcgacaccccucugucaccucagccaggaugacucuucuuccagaucauuuagaacagcacuuccaauugaaacauaauacaagccauauuugucauuuuuaauuuucugguagccacaucuuuuuuaaaaagguaaaaaaaacagggaaauuaauuguaauaauacauuuuaacugaauauauccaaaauauccuuucaccacacgcucaaaauaaaacaauuauaaugagauauuuuacauucuuuccuucauauuuagccuuugaaauccgguguuuuuuacacuuacagcucaucucaauucagacacuaaauuuucauuggaaauacuugaucuguauuuagauuucauaaaauuuacaguugaaaaagcagagucacauaccugaggcauuccaaacauacuuuaaaaucuuuccaauaacugaguugaguaucuguuuuuaaauuuaaacuaauuaaaauuaaauaaauauuaaauaaauuuuaaaaugugguuccucaguuccccgggccacauuucagauguuccguauguaucugcacaugguuaauggcuaccagcaaaccccucucucaccugagaaggcaacugcuguccccacucuuuccuuuugcucccaaagacucaaaaaaggggagucucagcuuucguugacagacagggcucccuuguuuggucccuagcagagccugggcaccuucuucggggccucaggagagaagcguaaacccuacuuccucccugccgcccccuucuggucaugcagaacuuuggggggauguggcuguggcuggcaauguucugaacuggcugugaugggucaugaugggaaaguggccaggagaaaagcugcccagugcuuccuccagaggcugcuccccaccuauccccccaccauuaccuucucauuuggggaauguaugaggaacagacagacacuucuacuaagcaugcucccccuuccccaacuccaaaagaagcuuggcuggagauucucagccagggacuugugcaucaguguguauuuccuauguguacaguuaucgccagcugcuucccagggaccaagaaaugugaaccagagucacaaccccaaauccuaguuuggcaucagaaaacaacaaggagccucucuuuaccucuggucccuggacaguggggcagauguaagggggaccucagccccuuacucugugaggugucaccuucccaccuguggcaucuacacuguggagggcggugggcccccuuuucucuauauaucuucagggaaggaggcuaagugcccuuaacgcagcaugaaggaaugggguuaggcagaggaaggacucccagggggagcucucuaaguggagacggguccggagagcaccugugccaaguccucaccugguguuggccaacagacccccagagacaaaggucgagccaacacuuucuggcagaccuuccugcaguccaaggagccucagaucuuguggucuacaaguaggcgucugucaaccaggugucacagcaaccaaauuuuuaguugaugauucgaacuagggaggugguaggaaacagcacuacaaaggcagagaccuguucugagagugaauuagcaugcaucacccugauuaauccucagaauauaauggagaaggggccauugccauccuccccauaacacaggugagaaaacugaauuggaaagaggaagaagaaaguaaggucuuugggaggcugagguggguggaucacgagcucaagagaucaagaccauccugggcguggugcugcaugccuuuagucccagcuacucaagaggcugaggcaggagaaucauuugaaccugggaggagaggguugcagugagccaagaucaugccacugcacuccagccuggcgacagagugagacuccgucucaaaaaaaaaaaaaaaaaaagaaaggucaaaguaaaucuguaccaagguuuguuuauuuauuuauuuuuagaaacaaggucucacucugucacccaggcuggagugcaguggcacaaucauggcucacugcagccuccaacuccuggguucaagccauccucccuucucagacuccccauugcuaggacuauaggugcacacugccacgcccggcuaauauuucauuuuauguagagauggggucuugcuguguugccaaagcugcaucaagguuuacugagcuauugucaacagcuucaucuuccucccagaaaggacagcugaagguuuaggguggcacaguuugcuguaccuauucaguaguggagcugggauuugaacccagguggucugguuccugauucugaaugguuauccacuauacuacauggugucuguauuucucugguaaggauagagauauauucccagcuuggccagcuuugcuguugguuuagaguaccuaaccaugcuauuucucccggccuaaaaugggguaggggggcucagcuggguacaccuauagcccucaucauccagucaguaguucucuaagucugcucaacuccccuccggggucuuccuccuggcuuuccuccauucuuacagcugcuuuuuaggaugacagcuuuggguuuuuuuuuuuucuuaaaagguuagugcucauuuccuccucagcccauaauucagguuaaaaagaacccggaacaugcaugccuauuucugacgaucaaguaaaaacaaaaacaaacaaacaaaaaacaaaaacaaaaaaaaaugucuucugagagagacuggcgccaggcagcugcuggucagagaugggauggguaggaaaagaaaugauguugccacuucccuggaaguguccacagcaccuucccccugccacaaccacuguggccuuucuccuucugcaaaugcacacacacaagcgcagaaaagccauuugacauccacagcugggaaacagacuucaagagacugagacaugucuuacauuuuuucaaacagugaacagccaaucccucaugcuuccaccagccuuguguuguagggaggggcugguggcugcaaguuggcuagggaccuaggguuggcaagggaggagggggacugcagaacauucuagacugggccucaguauuuucauccauacccaggcacaagucagugccgucaggccagcacugaccaggacuuucugcaaugauggaagcguugcaggucugcaauguccauauguggccacgaaguccuugaaauauggcuagagugacugaggagcugaauuuuucauuuuauuuaauauuuauuuaaauagccacauuggcuaguggcuaccauauuaaauauauacuuuuuuuuuuuuuuuugucacacuauugcccaggggggaauguaguggcacgaucuuggcucacugcaaccuccgccucccagguucaagugauucuccugccucagcuucccgagcagcugggauuacaggcacacaccaccaugccuggcugauuuuuuauuuuuaguagagacaggguuuuaccauguuggccaggcuggucucgaacuccugaccuugugauccaaccuccuuggccucccaaagugcugggauuacaggcgugagccaccaugccuggccuaaguaguacauuaauauauaguagccuuaggccaaagagaagcccagugaauccaggagcaccccugcuguuucucacacccaugacgcucaucugucugcuucccugugcccugcggcaggguuaucuugcuccagggcaggagcauggaugagauaaccucccaaggcaugcacugggcucuaagccccagcuuauauuacagaaauacuuccagaccuacuucucuuugccucuugggcagauuuacacaucucuccauuuaaagguuauuuauugaauacuauaugcuggugagacaaagagaaaugacaaagcucugcccguaagaaguuggcuguuuaaauuccacaggggggacuagaaugaaacccagaacaaauucagcucccuuuuucauucuuuguagagagauucuaggcguccucaucuuaucuucugucuagaaaaggagaugggagaaucuccccaggucuggguggccuggcaaagcccgacacucuuccuggacugugaauuucaaggaugccucuguuucuucgauuuuuguaagcuaaggcacaauaucugggucaccuaguuuucucuuacaauugauuauuaggucaagugagauagagugauaaacuaacaccagcccaggaacaggcuguuaauagcaccgggguguggcuaagagguccgggggcgggggguuuagauuuuaggcaggcaggucuccuggauccauccauugcugugaccagcaagcaagguggagucagaacccuucagacucuacuggaagagaacagccguggcaaaagggcagguuuggagaaagugguugagcuugggcaggguacaugcguugugcaauugugcagcauggaguauuucucacccuaagaugccucugggucuguagcagcugggcuugcaucaugacacucucuguguuugccaggacauagaggauggugcaauccucaaacacguguucauguuaccauggggagaggcugauguacugugugugccucuguggaugcugcugcacugggguguauggggaacuccuuaugaaugaaagaggacugaguuggccacccaaauguggcaggggccagaggcauuggagagccagugggaaggacuggagguauuauauagaagccagagauuuagaucccaccccaaagguaaauacuguauccagauaauauuaucaucauccccucccuuagucauugaauaggguuaugaagguaaggucuggccuccauagaucccagcaggagaaauggaugcugagcauuccacauuucccauccucugcaaaaaccucucagaacagcaucucaugggcggggaagucuggaauaugucucucuuccuuccuggaucauuuuccaguuggagguuacagaaacagcagaaugccaugcacaaacaagcccuguuccccucucccucaccugccuucacucucccacacauggguucucuccgggccucgcuuguuugucucccugacucuuuaaauauauccugcagacacacaaacagaaggaagggauuuauuugaaugauuauugcagaaguaggagagggaggcacccaaauuccagauuuauuuuuucuuugagacagggucucacucugucccccaggcuagagugcaguggagcuaucaaaguggagcaaucauggcucaccucagccucagccucaaccuccaaucuccaaccuccuaccuccaaccucccaccuuccgggcucaagcaauccuccggucucagccuccugaguuucucagacuagaggcgcacgccucuaugcccagcuaauuuuuguguuuuuuuuguagagacgggguuucacuauguuguccaggcuggucucgaacuccugggcucaggcaauccacucaccuuggccucccaaagugcugggauuagagauaugagccaccgcucucaauuccaaauuccagauuuuaaaaacacuuccaggccgggcuugguggcucacgccuguaaucccagcucuuugggaggccaaggcgggcggaucacgaggucaggagaucgagaccauccuggcuaacacggugaaaccccaucucuacuaaaaauacaaaaaauuagccgggcaugguggcgggcgccuguagucccagcuacucgggaggaugaggcaggagaauggcguaaacccaggaggcggagcuuacagugagccgagaucgcgccacugcacuccagccugggcgacagaaggagacucugucucaaaaaaaaaaaacaaaaaacgcuuccagucccuagaagugugcccaugcugugugggugucagucucccacgcccucugcuggccacauggagauauugaccuguuugucaaacagguuccagagcagacuguugaguucuuuugcuguucacgugcagaacaaucuucaccaggaaguccucccggguauccugccuagaucccuucugcaaccucaguucauuuucucuugaugaaauagcuccagaguagccagucuacuuguuccuucuuguuuuaucuaaaacgcaaagccuuccacaauugaaagccuauuuaugacucagccacagagcagcugagucgggcuggcugcuucuggcacucagcuccagucuuacuuuccagcccuuuaaucuccauggcucugcccuggcuccccuccaaguuuccgcugucucucuggagccuacaggugaccacaagacccugauuaguaucuucgacacuggacucugcugcugccuaaggaauaggucccaugggguuaaguggcaccagaaaccaggaggcacaucaaaauguuaagccugcucuucagaagcagccaaaaagcuugcaaagcuggggaaggugugcccucaggagacuugccuuggggaggcugggaaaaggagagaguuugcaaaagcauuuugaguuccuuaaaugaagagagauacaagaaucuacauuuuguaugccaguaucaugguugcuuggccccggggcaguacuugaacacuuucaaagaaaagaguaagagaggucaaaauaaauuuaccccaagguuuaucaaaccguugucaacagccccaucccccucccagaaagggugacucaagguuaaggacagcccacagcacuucuuagaaaaagucccaaaaggugaaaggucuugagaagagcuguugagggaaggcugugggccaccaugcuucugugucccccaaggccaaagagagaauaagcuaaaaugacagcuggaaaagggcacccucugaccaaauggacagagccucccccaacagguagccagaggaggauggaauggcacccccauuucagauguccuuaagaacuagagagauagaugcuuauuucugcuuggacacagggggauggacuaaauggccuacggaaaggauuccaggaacugcuacaccagccacaggagagaagccagcuucccaggcugucuccccuugaagaggugacaauguguuggcucuccaggccaggcuggggcagcccacugaaggagacgcauagacgcaugcgcuggucagcagccagcccacucccccaccugcccucacuuuauccaguuacaaucuugauugaggaagggguccaggcuucuccaaucugaacccccuccaggcuuucaguagccaccauauccugucugccccucccccuacaguagucaacuacuuuuugaggauuaaaaugcguggugaugcugagguugaguggcacggcuccagucccuccauaagacgugcccaaaagcccuucugugcaaugguuagcacucccucucccuacucccucuucuccaagaucugagccuuggcgugaggccuguguuacuagauaacggagccccagccuuucaauuuguacaaaguccccaaaccagccaugcuucucccuuccuccugccaaucucacuugcgcuacaaccaagaaaagucaauuuaccccagaacaugacccuuuuaacuaaucccuagaauccugcauuccaccuaccagagaugucacccuauugaugagucgucacagcagggucugauagagcagaaucgagguacugggacaucaagacaugacugggaagagggggugagaguccagaagggguaccaggauucucagguugaauuuuauuuagggagagcccacccaccaccuugcuauuugcuuuccccaagucaucaucuuccucuccaguaauuacgucccuuccuuuccugugaauaaauacccaaagcaacucaccaccaggaacgcugcgaaccuuuggaggcuucuuuagggcagggaccuucucugccaaggccuuaaagaccagauaccuauuucauuagacuugacaaauccugagccaagagagaaacagaugcuugggugcuuccugccaccugccauccugcccagguuaggccagguguccaaaugccuuuccuaacucacaccuggaacuugcccagggcugcaagcucagaagucagguucuauaccugcccagaggcauaaaacagcgucuucucaaaaaagcuucucuuuccuugcaccccacccccacuuccuggaauucuacccacuucuucuguuccccaucccagaugucuggcggucacuguuccuggacaucccagugaucauggaguagauggagaacagaauuuucuuucaccucauuucaguuauuuaaggucacucaaagcucuauuuucucuuuccaguauuugaaaaaagagggaggcaaugaagacagggccccccaccuccacucaccccugcaucuggucccacugugaggcauccuggccacacgcugcccgccuggaaacaacaaucuaaaguucccccauucugguuccucugaggcugggggaggucaaggaucugagaggagaaggggacccagggauggaugccuaugagaucagaauuuaggggaaaacugcgcaccaagaaaaggccggacggguggaauuaaggaucaacaaauacaucaacaaagucugacuucucuaaaggucaaaagccagcuaaguauagacugucagcaagccacuccuauauauaacugucccggucucagccagcugucggccucucucaguccagagcugaguaacgucccagccucccaggcccccgagcaccgcgccaguucugagccagagcaggagcaaggccuccgacuuccacuuggccccacgccgguccccuccgggccuacauuucuggcucuccccuccccuccuccugccgcuuaugaagguccucaccacccugcugcuccagaccccaggacccccuccuccuagguuccccagguccaaagagaccucaacauccagcagcucugaaagugcaaagaucucacuaacaggacagccuuugcccuucucguccacgcccugacugugucaucugccuccaugggcccagauucccggguuccuacuucucagccccaccuccagccaugucccaucuacuuggccaucccccagcaagcaaaccgcucgcugccaccuucauccuugcagaggccauuuuccuugcccuuccuccuuacugcccccagaaggccugcuccguccucacccaucagucugucagucucucgauucuccuccucugugaagccucccugccugcacucucugcuugacuccaagcaugccagaaacuuccugccacuuaaaugagcauucccucugcuuccugguucuuaucccccugcuuucagggugugcuccaggagggcagagacacaucugcuucagccuuuauuacuccccucaccccaaacugcccagcccugggcucuggccgugugcaccuuggcccacgggggcugacccuccggcuccuucuccugcagagagagacucccgugagcacgaggagcccaccaccucugagauggccgaggagaccuacucccccaagaucuuccggcccaaacacacccgcaucuccgagcugaaggcugaagcagugaagaaggaccgcagaaagaagcugacccaguccaaguuugucgggggagccgagaacacugcccacccccggaucaucucugcaccugagaugagacaggagucugagcaggugcaucucggggauucccucauucccucccagcuuuugaccuuuuccugcaucuaaauggacauucauggcggcaggaggugcuagacuagacccagcagaggaccuacagcccaccauguggcucagcuuaggacgugggaguagaguuuccagagcauacacuugucagggccaagggcuugugcaaguaagugggaauagaggcggugcucauuugaggagagugugugccagcccagcggccacguaccagguaccugggcccugcagcuguguccaguccaaggcagagacugaauauucuccuagagcaucuagaaaugggcaccucuggacauuguuacucagcagaagagaaaagcugcaggggaggggguggacuggaacacaaaagagaaaguaugacuccguaccuggccaaaggcaggcuuuguaugaucccagcgcacgugacaggugacagggaggaaagaucuuugguagcagaugauuagaaccaaagguggugacuuuccuccagagacccuucagcccccacccccugggccauucgucagcgcagcugggugguuuucccuuggucucgccacgccucucacccuccuguccacacagggccccugccgcagacacauggaggcuucccugcaggagcucaaagccagcccacgcauggugccccgugcuguguaccugcccaauugugaccgcaaaggauucuacaagagaaagcagguacguccccugcccugagcuccaggcucagacugcuccaaaaauggcaccugccaggaaacuccaccuugggcaagugccuaagguuuccaccguuaaccacuuaguguuuccugggccucagauacccauucauauaccacgaucaugacuuuccacauucccuacuaugcuguaauccauuuccucauucucuccuaugcgguaauccacuaugcuuuccacaggucgccuuagcuacaugaauuccuugcaaaagguaacucuguaacacuaucgcacagcacguaucauuggugcaccgcacacucaggaauuuaaaccauauuuucucugugaaccaccugaaaucaguucaugucccuucacagccaggcucuccuuugggcaaugguucuuagauuuccaagggcauccuaucccuggagggcauggcugauggcugggccccaccccugcaguuucugauugguagaccugggguggacuccgggguggacacgugacccugaugcugcuuuaagggcaccaauaaucuaaauguaagagccaggccacacuggggcaaaucuuggcucugccacuuacuagcuguguccuguuacucaccauuuaaugucucugugccuccagacccuuguguaaaauggugaaugaggagugagugauuggucuuuguaaagcacuuagaacaguaccuacugccuaccaaacguugaguggugucuacuacaugauaacaccacaaaucaugccuccuucuguuauuauuauuaccaucaucauuauuauuggaucauaacucucuugagaaucccugcagaguuucacguugggggaacucaaauggguaauauuuaaaacgggacuauaagccaggcacaguggcucacgccuguaaucccagcuacuccagaggcugaggcaggaagaucacuugggcucaggaguuuuagaccaaccugggcaacauaacgggaccccaugucugaaaaaaaaaaaaggaaagaaagggauugaaggagcuugccaaggguaggcugccuaaauucacauuuucccugggucuuuccgugaaauggggacaccagaaacccaagggucgggucuagugcccucaacucucuggggaugagagucuugccuugggguagacaagaggcagggcagggaggagcagagcccuggggugcggccguccucaccgccuguugcucuacucaccccagugcaaaccuucccguggccgcaaacguggcaucugcuggugcguggacaaguacgggaugaagcugccaggcauggaguacguugacggggacuuucagugccacaccuucgacagcagcaacguugagugaugcguccccccccaaccuuucccucacccccucccacccccagccccgacuccagccagcgccucccuccaccccaggacgccacucauuucaucucauuuaagggaaaaauauauaucuaucuauuugaggaaacugaggaccucggaaucucuagcaagggcucaacuucgaaaauggcaacaacagagaugcaaaaagcuaaaaagacacccccccccuuuaaaugguuuucuuuuugaggcaaguuggaugaacagagaagggaagagaggaagaacgagaggaagagaagggaaggaaguguuuguguagaagagagagaaagacgaauagaguuaggaaaaggaagacaagcaggugggcaggaaggacaugcaccgagaccaggcaggggcccaacuuucacguccagcccuggccuggggucgggagaggugggcgcuagaagaugcagcccaggauguggcaaucaaugacacuauugggguuucccaggauggauuggucagggggagaaaggaaaaggcaaaacacuccaggaccucucccggaucugucuccuccucuagccagcaguauggacagcuggaccccugaacuuccucuccucuuaccugggcagaguguugucucuccccaaauuuauaaaaacuaaaaugcauuccauuccucugaaagcaaaacaaauucauaauugagugauauuaaauagagagguuuucggaagcagaucugugaauaugaaauacaugugcauauuucauuccccaggcagacauuuuuuagaaaucaauacaugccccaauauuggaaagacuuguucuuccacggugacuacaguacaugcugaagcgugccguuucagcccucauuuaauucaauuuguaaguagcgcagcagccucugugggggaggauaggcugaaaaaaaaaagugggcucguauuuaucuacaggacuccauauagucauauauaggcauauaaaucuauucuuuuucuuuguuuuuuucuuucuuccuuucuuucaaagguuugcauuaacuuuucaaaguaguuccuauaggggcauugaggagcuuccucauucugggaaaacugagaaaacccauauucuccuaauacaacccguaauagcauuuuugccugccucgaggcagaguuucccgugagcaauaaacucagcuuuuuuguggggcacaguacuggauuugacagugauuccccacguguguucaucugcacccaccgagccaggcagaggccagcccuccguggugcacacagcacgcgccucaguccaucccauuuuagucuuuaaacccucaggaagucacagucuccggacaccacaccacaugagcccaacagguccacgauggauccaccagucccaccccagccuuuuccuuucaucugaacagaaugugcauuuuuggaagccucccucacucuccaugcuggcagagcaggagggagacugaaguaagagauggcagagggagaugguggcaaaaagguuuagaugcaggagaacaguaagauggaugguuccggccagagucgauguggggaggaacagagggcugaagggagagggggcugacuguuccauucuagcuuuggcacaaagcagcagaaagggggaaaagccaauagaaauuuccuuagcuuccccaccauauguauuuucuaggauuugagaggaaagagaggaaaaugggggaauggguugcaaaauagaaaugagcuuaauccaggccgcagagccagggaaggugaguaacuuuaggagggugcuagacuuuagaagccagauaggaagaaucagucuaaacuggccaugcuuuggaagggacaagacuaugugcuccgcugcccaccuucagccugcaaugagggacugaggcccacgagucuuuccagcucuuccuccauucuggccagucccugcauccucccugggguggaggauggaaggaaagcugggacaagcagggaacgcaugauucagggaugcugucacucggcagccagauuccgaaacucccauucuccaaugacuuccucaaccaauggguggccuugugacuguucuuuaaggcugaagauauccaggaaagggggcuuggacacuggccaaggagaccccuucgugcuguggacacagcucucuucacucuuugcucauggcaugacacagcggagaccgccuccaacaacgaauuuggggcuacgaagaggaauagcgaaaaagcaaaucuguuucaacugaugggaacccuauagcuauagaacuugggggcuaucuccuaugccccuggacaggacaguuggcuggggacaggagaagugcucaaucuucaugagacaaaggggcccgauagggccagcagccacaaggccuugaccugccgagucagcaugccccaucucucugcacagcuguccccuaaacccaacucacguuucuguaugucuuaggccaguaucccaaaccucuuccacgucacuguucuuuccacccauucucccuuugcaucuugagcaguuauccaacuaggaucugccaaguggauacuggggugccacuccccugagaaaagacugagccaggaacuacaagcuccccccacauuccucccagccuggaccuaauucuugagaggggcucucucuucacggacugugucuggacuuugagcaggcuucugccccuugcguuggcucuuugcugccagccaucaggugggggauuagagccugguguaagugcgccagacucuuccgguuuccaaaguucgugccugcgaacccaaaccugugagucucuucugcaugcaggaguuucuccugggcagcuggucacuccccagagaagcugggccuucauggacacauggaacuaagccucccaaaugggaguucuggcugagcccaggguggggagauccugggaagggaggcacuggaggaagacggcaccucuucccccauggcagggugugagggaggcagguuuggaauggugcgaguauggcaaucuaagcaggggucuggucucuuugacuccaggcuggccuuuggccgacugucugcucacccagagaccuuggacuccggacuauccauggcuccgaaucuaagugcugcccacucccaugcucacacccacagaaggucuucccauccccuuuagauucgugccucacuccaccagugaggaagaugccucugucuuucccacgacugccaggagauagggaagcccagccaggacugacccuccuuccuccagccugcccugacccaccuggcaaagcagggcacauggggaggaagagacuggaaccuuucuuugacagccaggccuagacagacaggccuggggacacuggccccaugaggggaggaaggcaggcgcacgagguccagggaggcccuuuucugaucaugccccuucucucccaccccaucuccccaccaccaccucuguggccuccaugguacccccacagggcuggccuccccuagagggugggccucaaccaccugcucccgccacgcaccgguuagugagacagggcugccacggcaaccgccaagccccccucaaggugggacaguaccccggacccauccacucacuccugagagggcuccggcccagaaugggaaccucagagaagagcucuaaggagaagaaaccccauagcgucagagaggauaugucuggcuuccaagagaaaggaggcuccguuuugcaaaguggaggagggacgagggacagggguuucaccagccagcaaccugggccuuguacugucuguguuuuuaaaaccacuaaagugcaagaauuacauugcacuguuucuccacuuuuuauuuucucuuaggcuuuuguuucuauuucaaacauacuuucuugguuuucuaauggaguauauaguuuagucauuucacagacucuggccuccucuccugaaauccuuuuggauggggaaagggaagguggggaggguccgaggggaaggggaccccagcuucccugugcccgcucaccccacuccaccaguccccggucgccagccggagucuccucucuaccgccacugucacaccguagcccacauggauagcacaguugucagacaagauuccuucagauuccgaguugccuaccgguuguuuucguuguuguuguuguuguuuuucuuuuucuuuuuuuuuuugaagacagcaauaaccacaguacauauuacuguaguucucuauaguuuuacauacauucauaccauaacucuguucucuccucuuuuuuguuuucaacuuuaaaaacaaaaauaaacgaugauaaucuuuacuggugaaaaggauggaaaaauaaaucaacaaaugcaaccaguuugugagaaaaaaaaaaaaaagccgaaaaaaaaaaaaaaaacaccugaaugcggaagagcucggcucccguuuagcauuuuguacuuaaggaaauaaaaaaccaacaa

SEQ ID NO: 21343 - RNA, 5000 nt, Homo sapiens
guuagaacaacucagcaaaauaaaauuccuguuuauuguuggacaacauuguuucacacauacaucaaacaggccaaaaaaaauaaacagcaacuucauagacaaaaaaggaaaaaaaaagaaaccuuuuaucuuuggccuuuuuaaccaucucauacaaaccaacuacuuauaguacagcuaaguacauacacaaaaaaguuacuggaaugcucggaauaagauuguuuuucuguugucauuuuugcuuuuuuuacaagguuuuuuuucuccuuugagauuauaaugaacauggucacaccacaaguaaagucagaaguaggacagagaacgcuccgaaggcugguuuggucauccgagaucauuaaaaauggcugacccuaacaauauguacaaaaauauaaaauguaaauaaaaaauacaaacaaauuuccuuuuuaaaguacuuuuaagaaaaaaagcagggccuuggaaguuuugguucuuuuuuccuccccuguugcaaauucucaugguuuggguugggugguggagagcgcgugucaucugcggguggcacugcccacggugggcgggcgggccucucuacucgaaggugaccacguuuagauucugagacgggaaguggagggugaauaggucacggcggccuuuuuuuuuuuaguuuaacuuuuccuuuuuugcugucuagucauccucgucggucuucugcuucuugguaucgacaucgucauccuaagcagagaaagacugucaaaggccccuccaaccccaggagcccuauccagcccacugccucagcuccugcuggcagagcaagaaccagggacccccagcuccacagcccaaggccucugggaaguugagcccagcccuguuuccuuccuguucuuaagauucaggaccacacaguggccaccuacaaagucagaaacagucccuccgcagcuugagcaccucagcuaaaggcagguggggagacccagaugccaaaccccccuucuucucaagccagaacccaccucaucaucuucagcugcccgcuugcccguagcugacucagcuuccucaucuucaucuccauccucuuccucaccuggagagaaucaaaggccagguaaaccacacuucccuccuacuguggcuccuggggaaaucccgaggaacauguaguggacugcaaggucccugcccugccucuacugccugcaacugggcccaaucagggcacccacgcccacuacacaggugggacucuccagaggagagaggcccaagcagcugcaccccaaaaggccagcccaauagaucaguggcuuucagagcugcacgaaagaaacuuucaggugugcgagugagugugagugggcaugggcacaacuccaugucagggagaccuucccugacucuacaggugggugcccagggccaugugguccacuggccccaaguaccauugucccacucccaggagccccaauuccuuccuuccccuucugccagacaaggccaggaaaaaguaccugaaaaggggaagauagacaaggcuacucaccaucaccuucuucuuccuccuccucuuccuccccaccuucuuccucuucuucgucuaccucauugucagccuccugcuccccauuuuccucauucuccucgacagaaaacaggccaugucauuaccagcuggccccaggcuggacagagcguugcuccugaugcccggccucccaccagaggcuggcggcugcaucuacagcccagccaagccaagcccaccccagagacccuucuccagucaacacccuccaggcuccaucaugaaaccugcacauuaacugccccaggacaagggcuuuuccccacccugggccaagcccaaacucagacuaccggagucuccucugaaccuauucuuguucaggcgcugcucgaaagguuuuuauaaauauuuaacuagcaauaaucgcgccucggguaaagcucauuggcuacgauacugccacugugcaaagcuauacauauacacauacacacacauauauagguauguuuaaaguagaacaggaaaaauuuuguggggcgguagcugccagggcucaggagcaaagcagacacucacagcauucccguuagcaggggcgucucuuccauuuucugccucuuccacaacuuccuucuucuccuuuaaguccuucaaaagggaagaaggaaccaguaaccaguaagucuucugagcaacccaggguaagcaaaggcgcugagaacuacuggucuguacggcuguucuguccgucccaaauuaagagucgcauguugagaaaggccugaugccccugcggucccucucccacuggucugguggaaggaaggccggcggggggcaucugugaucaagguuucccauccuuuaaggcccgcuacagcggccccgguggcgguucccacugcccccuggcgcuucccaggaaaaaggagccauguggcgccacagcccccagcccguccggccggguggacgagccccggacacucacgcccaucagccugcuuccaagugcaaagagcccgccccucgagccgucuagaaaggcggcagguuauguuccaaaaauaaauaaggcaaagagagaggggccugcgcucggggagagccccacaggcgcgccagccuggaaggcccgcgaggccgcaccgccccggccaggacagguaucuaaaaaagccaaagcacaccgaccccccaaauccgaccgcuguuccuagaggccgcaaaccgcugcuuggcggugccccaggccggggccugccgccggagccaccaacucccggccuccccgcggcggcuagggaucccgacagcaccucgggggugggacuccgcccgggauccaaaaggcagcgcggccccgggcgcccgguaacuuuuuccacacgacacggccaccaauaccaacagagguccggcguccgggccugcgggaaccccucggccgcuguccggcgagcggcuccgggccaccugucggcccucucaguccggcccgccccgcuccgcuccgcggaccccggcuccgcccgcucucgcccccuggcggccgaagccccggggagcagugggggcagggaggucgcggcgcgcaggcgcgcaucccccgcccggcgggcuuugcgcgcgggccucggcacgcaccgcgcgcagggagcacguggcccggggccgccgagugcgucccuugccuuggagacucccggccggcaggcagagcuugcaguggcacgcgcgcgggucgcgcgucggucggccgggcucucgacucgacgccccacugccgccaccccggcaggcccgaaugucugcauucggcgggccaagucccacgggaggucgccccaaaguccaccgggcugcguagguccgagacugucggggaugcgccucucgggcuacuacucaucgcccucgcgggaagucaccuuuuggugcuucggagaaaaucgaacagccaggccccgcacuggggacgguguucucaccccacaaacucauucccggacugaguccagaaggggucacugagagccccuguggagauccgggccccgagcuccgcucugccaagaagucgccccugggagagucagagaugacgccagggacacaaggguuaaggagacgccaaggugacucgcgccaaucccugcaggggcacgacgggcgcggacgagggccgaaauauuaagaaagagccagucagucugagagcgccccgcucccgccaagggcggagacgcuacccagggcgggcagugggaccgaggcggcgccgacaacaggagcggagccgcaccagccgcgcaggaccucauagccgagggcagugaacccgccacggggcccgggcgcccccccaguucgacccuaccauuggccugucgcggccgccguguuggcccgcgucgccccgagcugcggcgcacacggugcucccgggcagccgcggggggcgcccaucgucgccccagcgccgcgcuucacuuucucuuuccucccugcggcgcgugggcucucgccuccucagccaagcccggcaccgcgggugcaugacugaagcugggcggccgcucccggcgcacucaccucgaagggcgcccacccccgccucccagagcgcccaaagcggauaagcccgucacaccuccgccgggacggccgacgucgcggccagccagcccgucgccccauccgccuuaucgggacuuagucuagacaaaccaccucagguccgcugcagggcgcgaaaccgccggccuggcgccgaacaaagagcagcgcggccggcgggcgcucgccgccacuucccgcggccggcccgcgccccaacacgcgccccccagcacuuccgauucccaacgcgcuugaguuucaaaguuauuuccgugcgcccggcgggccgacgacccccagccaggcucuucuccucccgccgccacucauaccggccacagacgaguuucgagggccgugagccggccuccgcgccuagcccucggcccccgagggcgcccggcccacuccccgacgggcaucacgucugcccgcggcgguucccgcccccucccccgcaccacacaaagagugggcugccugagggcaccgcgccgggggcgggccguuuccccgcgagagggagcaacagcgggcuugagacaguccagcugcugcgcgccaaacaccgcccgagcggcggcgcgcggaccccgagggggcgggcggcguccagccucaccuugguggugauuucggagcuggugucuacggcugcgucugacaugguggggcacgccggugauccgaugcaggggauuaaaaagaaagcgagaguucagggacucuggcgauaaagcugccggaguccgcggcggcggaggaggcgcgcggcggaggcggcugcggcgagcaaggaggcggaugaggaacaaugcaaagauggcuuuucaga

SEQ ID NO: 21344 - RNA, 12990 nt, Homo sapiens
ucacaguuguugcaaagugcucagcacuaagggagccagcgcacagcacagccaggaaggcgagcgagcccagccagcccagccagcccagccagcccggagguaaggaaacggugcucgggcagcagcucugcucggaaagaaggcacggcuucugcucuuaagccaaguggucuuuucaaaggccuucuuuaaaaucgcucagaugggugcuuuugagucugcgggucugguuucugaaaacccaggcugcacgcagcugcauugcaaagugcuuuugcuaauucggagggcuucaccuuucucuucagaaagcaaagggcaguuuucuuaagucacuugcagaaggaaauuuccauguguauuuaggaaucugguguuuauuugcuguguggcuauuuaagcuccaguaagcaggggaacuuugcaagaacacagacuauccauucugccugaccaauuuggcauggggauuagcuuggcacccacuguuuaccuguuuugcuucuaguauaucaguuuggaaacagauaaaauuggcaguaaauacguaauuccagaaugaugaacacuuuauuaagaggcauccuuaaauggagcagaaaacugcugagaaucuuugugaguccaagauguauuugaauucaguacuuugggggauuuaccagagucuguaaguccggaagcuauaaacgugaauguuaaacacagcccggucuucucuucucuugauggcacgcuugcuaaucuaauuugaguauuguucucuuagaagguguuaaguccaacuucaauugggguugggggaagcacacacacaaaucuacuauuuugcaauuuaaauauacucuucagguaaaauguggauuuuguucaauuuuguuggcaugugcaaagauucaaggagugacugagagaacuuuggagugaggucagggaugggugguuagccaagacuuguaacuuccagggagaaugagaaguuguaaaagucagacuggcugucucucuuucucucuuccucuuucuuucuuucuuucuuuccuuuugcucacaacaggauuacuuaguguuucaaaagugggagagagccuccuuaaaugguuuacagcccuuugaauguauuuggugcagugacauccccugaaacuucagucugcaaagucucaacaugguaacuuuguucuuuucuuuuuuaaaggcagaugcugcuuuuagugucccuuuauuuauuccaggaaaaauguggacaucagcuaggcacgccuagcaaagaaaguggaggcugcugguuucugugcuuuaacuuuccauagauuuuaaauggauaaacugcuugcccuucuuucaucagaauaugagcuuuccccagauggaaagucuuuucuaaagcaaaguugcacaugggagcucuagcuuggaaacaauuugcucuuuuuuccccagucucugccauaaacacuugaaugugcacacaacugcagagcuuaaugccacaaccuccaggagauuggggggaggggaaagcugcccaggaugggggugggaaagcgaaggaagauggagaaauggcugcaguuugcugcccaucagcuuuucucuuuuaaggggcagacauugcagacguaguuuuaaaaaaguuccauaaagcaucgccaaggcagcaugccugugcgacacacgcagggcuuuggggguguguuuuccccguauuaacagcaagucguugaagcguugagaagguauuaugauuucuaaucaggcccagaacaggccaaguauaggcuuucugaaugaaaaaaaaaaaaaaaaaaaaaaaacccaaaacaaaaaacccugcuuaaucaggaacaguggcuuuuugugugaucauuuuagggcgagagcuccuguuuucaagucgacgugagggaaauugguugaagucacucaaaccugaggcugaagggcagucacuuuauaaaccuuaagaguaaccgaggggaaagaaaaagaccucaaagauugcaaaacuuuagauuuuuuuuuugugauuuuguagaacaugaggggaaucuggggccagaaggcauuuguaccuuuaaaccaggcaaucaaauaacuuaguuuuauuauuagaagcaagaauaguauuaaaacgccuucaauuggauugcacguguguaggcauaauucaggaagaaacuaaagaucgugucaugucaaguguuacuaaaguucaggaaggaaaagacaaagcuccaggacacguauuuucuguugaaauaaaagaaagcaagccagaaauagacagaucaggacagggaggcgugcaggcgguggcccugauuuugaauauuugaugguuuccuucagggaauguuugaugcuuuuaucgacuaauuuggaauugaaaaaaacaaaacaaaacacuauugcuucaauauuaaagugaucagggaauugcauaauuuuauggugacaauuuuaaagagccacagguaguuuuggaagcagacuguguuuuguuccaggcacugaaaaaguggaugggggccgagacuaucucagguggccuugaaccacuguuggcaaagggacagauaacgagcccagggcagugugggggacuuugcguuuugaagucugggucagccagauaguaagcaucuuuugcuuuuccugcuauaacagauauguggccauccucccucaguuguauaugcagagccuaaguuugcacaguguccuccugggaaccccauugugucuggcuuagggcgggggugaggaggcucuccuagccuggcugaccucccacugccucguccuaguccuaagcugggugggaaucagggcucugguuacacugggccggcccagacggcagccuuugugacgugggaaucucuggaccugcucuuguggguauagcuuugcuucccugucgggcagcugagcacaauagaccagaucagguuucuggacgugggauuuauuugaucccccaaauccuuaaaguggacgagggugucccacguguucaugugaaguaugucuaaggacccugggaagagguggacuguaucugaaucaggauauagaguuuucuguaguuauuauuuuuugcguucucaaguaauucaaagcaguuauguacuugcauaaaauaagaucacucacggucacuagugaauguguagucaagacuguuuuccauuugcuggcagcagaggggacagacagcuacccauucugcuaucagcccuagcagauagucacagagagucugccugggccaaagcuccccuagguuacuugguugguuuccccauagauucgauguagcauugguuaaaaacacacagacacacagacacacacacaugcacacacacacacaccccacucaaugaugcgcaguugccuaaugguucuucagagguaguguggauucuccugaucuaacuugcaggcucagcguaagcggggcuggccugguggaagagguguuaucugcucaaggagaccagagcguuugcuuuuguagcaugauucccgcuggagagucccuggagauguuggaaaggggaagagaacucuguucuuagccacaagcgcaccauaacccagucucuucacccggccuggccucaguuuccaggugugcaaacagugagggccacugucccagcucuugucugggacaauaccaaguuucuucaugaaauucccuuguaggacacaggucucacacugcagaaagccagugaaggaggcagaaguccugcagggcccagauggccagagggucccccuuuucggagcuggucccggggccccaggccuggccugaguuaucuuaucuauaccacuguagaggagugauguguguguagcagccuggucugcacccagcuaccagaccaccccacugcaaagcugccugugggguucguaucacuuccauucucaaagccuccucugcuccaaagccauggccuugcucuagacuguccuggcuccugcauggacaagcccuggucauauuccuugcccacccuuuaaggcccaacucuuaccuccauuugcucuucguggagaguccuugccucagccaggcugggugacucuacccauggcugugccuuccuggaacauccuugaucaccccuaccuccuugaagucccccauaagccaccagaguagaaaccccucauuuuccugcugaaggggcaugcaccaccuugcucaugccuggggggugaugggccugcgugccuucccaauuagccggcggggucucggggguuggggggagauguuucugauuuguuguccucacgugccccagagcagugccuccuggaacaagaggcucaguccgucaacaccagcucggugacgauuucagaaaagucucuccuggacgcccgucuccgcugcuggccacagucgcuggucuugguggggcacgauuaacugcuggcucauugaguaccuacuaugugcagcuguagcuguauagcuguauagcuguagcuacacaaaguuacagaagacuugguggggggugcggggccugguaggaaugagguggaggggcaagaaaccugaacaacgugaugguacaaaagccauuccagaauagagaugugcaguguggggccaggagaaggugggagaaucagaagggcagagggcaucaguugggaagagucugugguuggagacugcaaacauguggaagggaguuuggagggacacuggccaggugccugaacacguggcauucucuggaaggaacuaaccagcgugaggacaugcugauugcauacucagccaccacccaugaaggcucuaaaccugaguaccuguaauuccggcuucacccucagcuugcagagugagcucagggagaccauuuggauguggcuaaauaccccaggcugcuugcugcagcacggucguugucaaggauacuugguugaugaauaaaacaucccagaaacgagaggugcaucuccgagaaaguccugcaauugacaagaggagccccaguaccaucugggcugugagugacagaggagucccuuugcaggccauaggcuggcagggauggagggcuggacaggugcuugcccaccgccggccacgggaaaguucucucccugucacugcaacgugcgacagggccgcuaaaaaggugaccccuguacgaaggaaugaaugagauaaaacagagcaagcgcugggaaaaagggaaugaaagcugacguucacugcuuuuuguucucccuugggucucugugguccaggaaaaugcaacaugaaccucgauuguucuguggaccauuccucccucuaugaaaauuuacauaauucuugaugucaaauuucaaauaacacagaaguuuauagaguaaaaacuacaagucuccuuuuguucccuccuccuaccuucccagccccaaguuuuauacuuacugcaggucuuuuucuaugccuucgugcacauguauuuacauauaaaaauacacaaauguaauuuuuguguuucuuucugcauagcugggguugugcugugugugcgugugucugggguugugcugugugugugugugugucugggguugugcugugugugcgugugucugggguugugcugugugugcgugugucugggguugugcugugugugugugugucugggguugugcugugugugcgugugucugggguugugcugugugugugugugugucugggguugugcugugugugcgugugucugggguugugcucugugugugugugugucugggguugugcugugugugcgugucugggguugugcugugugugcguuucugggguugugcugugugugcgugugucugcguauugucuuucacugaacagcaugucguaacucucccugugcaugaagggaggccucccucucacagcuguauuauauuccagauggcggagacaccaggcuuuacugagucgugccuuuguugaaagacauuuacguugucuccaguguuugcucguaaauaaauacugcuuuaaaaaacaucuuguguacauuuggagacacaugaauauuuugaggagagaaacguaugaauuuguaucaucauagaacuggaaagaaacgucuuuuguucugcacccccuccccuuccuucccccuggaaucuuuuaugcagaaaccuuagaaccuaagugucagaagugggucucauuccccugccugcccuggcaugggcacugaggcccuagagacgcaggcagugggcagguuugauucacacccagacauguuucuuagacccuggccucaagcgggaauggaauugcugguugauuccagcagagggugacuggucuaaguggaugucuccuucaggcccuguggcuaucggccuucccaacuucccagcguaaacagaccccgcacaggcugagaggcauuaagaauguauacaaggacccgagggcuggcccauccagaucugugcggaaugcagucagcucuuucuguaugggaugagguaauccccugcuuuugcuugaggggaccugugauuucugugcagggcccgcuggggguucauuagaggccucccucccucucuccacuuucagauuuugcagggagcuuugucaccaggcuuuugagaaccaggggcccuggguacacauuucauaguuugcucuaugaagcuuuuguuccuaucagggauucugagagugucacuuauuaagaucuaagcagguaauuuaggaagauucuuugcuccaauaguggacgcacaaccaucagugaaugguggucaaugaaagugggcccugcccacccuaaacguccugcacgcaggcuggggcggccagagccuuugucgcaggccaccuuccauguuacacggcaguucccuauuuugaauaaggggauugucuuugucaaauaauaaucuguuugcuggagacagcucuuguuucugaaaccuaaugcaugaaaaauaccgaaaugacaaaaggguaagcuauaguaugacauuuuuguuuuucuguuuuuuguuuucuuuagcucccauuugaauuugcagaggacuugaugacugcacugucugcuuaaucucccuuuucacuguacuuuccuuccuaucugaccccuggaaccuuugguggugggaagggagaggcccguccaggccccgagaggaaagcagguggucagggugugggccucuggcuuuguuuccuggccagccccagugugggcugcuguuccuugggcugacuggugguuaaugauugaggaucggugaucggugagugaugauagguggccggugaucgguggggcagugaggagcuccagccuccgcucucucauucagcccuugggcagcaacagccaugcccuuguuggaaguuucccacugugccacccgggaggggagaagcaaggacagaggcgaggacggcugagcggggaagugccuaucucagaaauacuguuuuugacucagaggaccaauggucccuaaaucaaauuuucgucacccaaagaggcaaagguagaaagccaagggcuggaugggggucccugagcccuuuuccaccucucagucccacucugggcucugagaauacugaaggcugcugguagcucaaagcgggugagugucuauuuugugcuaagaguggaggaacuggaaggaaggacacacucgagaugugggaaccaggcgucuucucacugagugacccugccuccugcuggggccuguccaugcugagcaguggccaggcgccuggccagccggcaucugacaugucucuacacuggagggcaaguaagaccugagccagaggaaugucaccauggugggggagagagguggggcggauucgggauccaaguucgggcgaacaaagacugagggucauuucuuucuagccccugugaauggcccaaaccccaggauuuauggcagcuucugcuguguggcugugccaguggggacagagcagggagcccaagccaggcgccagccgagcucccucuggacccagcugcugucccugcugcugcccagcuguggggcgguccuccauucaagcuccucugcuccccgggacucuggggucagaugagaucaugggggaaaguguuuuggaaaccaagccaugaugcaaauguguuucguuuuaaggaaaugggagaaaggaacaaggauuguugcaguagagccauguggggagagcaaaggugaaauccuugucuccuggcaucacgggguggagaguggaacgucagcucugggucauuugguggccaaggaaagauggcgauaguagcuucaaggcacggccugggguugcccguccacccuggaggcagucuggcaggacaggguguccucagcucccugcugggccuacguccuuuuggaguucuagagcugcgucuuaggacaagugugccaagccuccugcuuugaguuucuguccugaccuugaccuggcucaccuccaugggcagccucccaugcuugggcaucagggcuugucauaaguccguggucacagggcuugauuccuccuagugggugacucugaggacggccaggccucccgcugcaggaccagcgugguucccuccauggaaggcuuucagaguguggaggggaugcggcugucuugggaggcccagcccuuucugucagccguggaggacacugagucagguuaggucacgaggaggggaccccacagucauuuacaucccgcagagggaagugcccagaagcccgcaacagucuccgcuaagugggguucacgccagguccucugcugugaauguggaggcuguggagccgaggccgcgaaauuucucacuuuucagggauucuguucaaguugucccaaaggagaagcccaucaaacaacccagucucugugcgagcucccccgggggcauuuacuacucagccagugagagccagguuuccaggggaauagaauuaaacaagguucugcuuuuugcugaagggaaaaaccgcucccuuaggugggagaauccccaggguucuuucuuccuggccagggagggagaagggggugacguuuuauugagcaucggcuagggccaagcucucaauuaggcccuuucuucuuucuucuuaggguaucugugagauaggugcugcuguccuggggagguagaugcagacagauuaacucucaagguaaaugcuaaugaauagaggagccagaaucccaacccaggaaugucugaucucggagugggcggcuucccagcuguggcuuugcauaccgcuagcguagccacccggacccugauccccugacccuuguccuugauccuccaggaaauucucauauguaaccuggaauccacuuuaaaugaacucgguaaauaaugucuugacucuaggccagucauuaccugggacaggugagggggaagggcaaccaccugacuaugucacugucaacagugcauccuugggcugagguuuucauuuuacagugggguucaggcagggcuaauugcugacccaggacuguggccuggagggauuucagggccuucccaugggcggacugacaguagaagacagccccugucagucuaucugaagaaaucagugccagauaacaaugguaccccguggcugaauucuggcugggagugaaauggugauggaguguuggucucaccucaggucagcagggaaaacaguugggaaaauggucagcccuccugaaaugcagcagguggugauuuuuguguuuugagucuuggcacaccuugcuguugaagcaguugaacaaauaaaggaauggaaaaacaggugcugacccaaagcuugagacagcugguugguugcccuucguugaaaaccacacggccaacccagagucuucagguuuggggcgcaguuaagcuguggggcacccugcguaggcucacuguguuuccagaggcuuuaugacugcacacuggggccgccugagacccagguuuauaugugaauuuagcagacaaguaaaaagugcugagucacauuauaaaugcaaauuuggaggaggauuugaaaugcuuucauuaagacaccaaagcaggacacuuguaauacagcagugccaggagaggacaacccugccauucuuuggggaccuagauaaaauggcuccacuguccccugcugagagugagcaggccaucagcaucgcgguggccggggcucagcugccugacguuucuuuggccccuguacuguguugauuucacacacugggcacagccaugcuggcggugucuugagaacacagccaugaaaagauggagaaagcaaacacaguuucugucuuggagcaccacauggauuuagauucagaguaugauuuauuuuguuuuggagaguuuuauuaugaauuuuuuuucucccuucuuugcaaagacauuacagagcuaaacccaaacagcugagccuaucagggccuuggaaaagcauuuuugccugaaacuugaguuuuuccuaaugaagugacuuuccucuuccaucuuuuuuguuugcuugguuuucucauaggucauuugauugcccgccucagaacgauggaucugcaucucuucgacuacucagagccagggaacuucucggacaucagcuggccaugcaacagcagcgacugcaucgugguggacacggugaugugucccaacaugcccaacaaaagcguccugcucuacacgcucuccuucauuuacauuuucaucuucgucaucggcaugauugccaacuccgugguggucugggugaauauccaggccaagaccacaggcuaugacacgcacugcuacaucuugaaccuggccauugccgaccuguggguuguccucaccaucccagucuggguggucagucucgugcagcacaaccaguggcccaugggcgagcucacgugcaaagucacacaccucaucuucuccaucaaccucuucggcagcauuuucuuccucacgugcaugagcguggaccgcuaccucuccaucaccuacuucaccaacacccccagcagcaggaagaagaugguacgccgugucgucugcauccugguguggcugcuggccuucugcgugucucugccugacaccuacuaccugaagaccgucacgucugcguccaacaaugagaccuacugccgguccuucuaccccgagcacagcaucaaggaguggcugaucggcauggagcuggucuccguugucuugggcuuugccguucccuucuccauuaucgcugucuucuacuuccugcuggccagagccaucucggcguccagugaccaggagaagcacagcagccggaagaucaucuucuccuacgugguggucuuccuugucugcuggcugcccuaccacguggcggugcugcuggacaucuucuccauccugcacuacaucccuuucaccugccggcuggagcacgcccucuucacggcccugcaugucacacagugccugucgcuggugcacugcugcgucaacccuguccucuacagcuucaucaaucgcaacuacagguacgagcugaugaaggccuucaucuucaaguacucggccaaaacagggcucaccaagcucaucgaugccuccagagucucagagacggaguacucugccuuggagcagagcaccaaaugaucugcccuggagaggcucugggacggguuuacuuguuuuugaacagggugaugggcccuaugguuuucuagagcaaagcaaaguagcuucgggucuugaugcuugaguagagugaagaggggagcacgugcccccugcauccauucucucuuucucuugaugacgcagcugucauuuggcugugcgugcugacaguuuugcaacaggcagagcugugucgcacagcagugcugugcgucagagccagcugaggacaggcuugccuggacuucuguaagauaggauuuucuguguuuccugaauuuuuuauauggugauuuguauuuaaauuuuaagacuuuauuuucucacuauugguguaccuuauaaauguauuugaaaguuaaauauauuuuaaauauuguuugggaggcauagugcugacauauauucagaguguuguaguuuuaagguuagcgugacuucaguuuugacuaaggaugacacuaauuguuagcuguuuugaaauuauauauauauaaauauauauaaauauauaaauauaugccagucuuggcugaaauguuuuauuuaccauaguuuuauaucugugugguguuuuguaccggcacgggauauggaacgaaaacugcuuuguaaugcaguuugugacauuaauaguauuguaaaguuacauuuuaaaauaaacaaaaaacuguucuggacugcaaaucugcacacacaacgaacaguugcauuucagagaguucucucaauuuguaaguuauuuuuuuuuaauaaagauuuuuguuuccuaaaaaugcaucaagucucaguuuucaaaguguguuuuggcacuugaauagcacacaugauaauaauucauggauauauauggcacacacaggccaccugcaugaacaugcucagaaaaagagugcugcuguaaagcaaaagcuaccagguuaacuuguuugaaaugauauaaaaagaaaaaaucauuugagcacacugcaugguuuuuaaaaaaauuuucaggcaauaguguuuuuggugugggggaugauugcuaggguccagcuaggagagaaggcuggcacagagaaggugccacuugcuucuacuuccugcuggccagagccaucucuguucugaaccugucugaacucuccguccagacaggagaguuucagggugcaggacugguguccucaucuguaccaccugugugcuuccagggccaguggcacagccccuuaaaucucaucugcuaagguaa

SEQ ID NO: 21345 - RNA, 4335 nt, Homo sapiens
ggaccuccugaaaaacgcugcccggggaaaguccgggcagagcccgagcagcggccaggguaacgcugucuuguggacccgcacuucccacccgagaccucucacugagcccgagccgcgcgcgacaugagccacgggaagggaaccgacaugcucccggagaucgccgccgccgugggcuuccucuccagccuccugaggacccggggcugcgugagcgagcagaggcuuaaggucuucagcggggcgcuccaggaggcacucacaggugagcgcaugccgaggggccuggcgccaccgggggucggccccaucccugccagggccgucuuucuucuacuccugcggcagggugacccacgggagcagcuuugggacucgguggcccuccuccgacccccggggcggcccgcaguccccaguuuccuggguccuccuccccagcccugugcucgggucucggccguggcgguucugauggggcgcgccccucuacgcucucggaggcgcagacccugguccuggagugccagcccgaguccccagcuuaugccccugucucauuacgggcucgucucccucgcuggacccucgagaucuuaagacccucgauggauguuguugcgggccgcccggucggccgaggggucccgaugagggaagaaggugcagucgagccuuuucaacaauuuggagucccagugcgguucuuccugccggucggggugcgcugugccugggguaguccacugguugcugacuggcuucaaguuggaauuugggcccccuuuguguuaucuuugguuccccuuagccaucugccaccuauugugguagggaggagagccucguagcucgugacccugccgugcgggccuucaaguugggaggugaagagauaagcagcccgcucgcuggcuggggagagaccucucucccagcuguuucuagcugguuacugucaguuuugggaagcgauagccaucucggaacgcacccacacagacccugccuucugaggaaaacagauguuucaucaaaacaacccaguuuucacucccuuaggcacugcuaaggaagguucucugacucuucugaaggaagcagagggaacacagggugggagguccagugacuugcuguggacccaacaauguuggcagccuuccuggcccugaaacuucagcucacaggucuccagaggcccugccuggacaugccagucccagucacacccuucccuugcuuugggggugugccaaaagcaauacacuggccacuagagaguacccuagagcucuagaauccccucccaacacgcacacacacacacacacacacucucucucucacacacacacacucagucacacacacacacacacacacacacacucucucacauacacuuguccuggaagcaggaaaguggaucuuuccagcuuccauaaaauuuucucugcuaaguggaaagaggguccuagaacucagaggaauccaccucccuuacuuaaagggccccuuucucuccuccugucccuugacccuccaccccgcccuaugguaguauccauggccuagcugcucuaaccagggcaucugccccugguccugucuccacagagcacuacaaacaccacugguuucccgaaaagccguccaagggcuccggcuaccgcugcauucgcaucaaccacaagauggaccccaucaucagcaggguggccagccagaucggacucagccagccccagcugcaccagcugcugcccagcgagcugacccuguggguggaccccuaugagguguccuaccgcauuggggaggacggcuccaucugcgucuuguacgaggaggccccacuggccgccuccugugggcuccucaccugcaagaaccaagugcugcugggccggagcagccccuccaagaacuacgugauggcagucuccagcuaggcccuuccgcccccgcccugggcgccgccgugcucaugcugccgugacaacaggccaccacauaccucaaccuggggaacuguauuuuuaaaugaagagcuauuuauauauauuauuuuuuuuuaagaaaggaggaaaagaaaccaaaaguuuuuuuuaagaaaaaaaauccuucaagggagcugcuuggaaguggccuccccaggugccuuuggagagaacuguugcgugcuugagucugugagccagugucugccuauaggagggggagcuguuaggggguagaccuagccaaggagaagugggagacguuuggcuagcaccccaggaagaugugagagggagcaagcaagguuagcaacugugaacagagaggucgggauuugcccugggggaggaagagaggccaaguucagagcucucugucucccccagccagacaccugcaucccuggcuccucuauuacucaggggcauucaugccuggacuuaaacaauacuauguuaucuuuucuuuuauuuuucuaaugagguccugggcagagagugaaaaggccucuccugauuccuacuguccuaagcugcuuuucuugaaaucaugacuuguuucuaauucuacccucaggggccuguagauguugcuuuccagccaggaaucuaaagcuuuggguuuucugaggggggggaggagggaacuggagguuauugggguuaggauggaagggaacucugcacaaaaccuuugcuuugcuagugcugcuuuguguguauguguggcaaauaauuugggggugauuugcaaugaaauuuugggacccaaagaguauccacuggggauguuuuuuggccaaaacucuuccuuuuggaaccacaugaaagucuugaugcugcugccaugaucccuuugagagguggcucaaaagcuacagggaacuccagguccuuuauuacugccuucuuuucaaaagcacaacucuccucuaacccuccccucccccuucccuucuggucgggucauagagcuaccguauuuucuaggacaagaguucucagucacugugcaauaugcccccugggucccaggagggucuggaggaaaacuggcuaucagaaccuccugaugcccuggugggcuuagggaaccaucucuccugcucuccuugggaugauggcuggcuagucagccuugcauguauuccuuggcugaaugggagagugccccauguucugcaagacuacuugguauucuuguagggccgacacuaaauaaaagccaaaccuugggcacuguuuuuucucccuggugcucagagcaccugugggaaagguugcugucugucucaguacaauccaaauuugucguagacuugugcaauauauacuguuguggguuggagaaaaguggaaagcuacacugggaagaaacucccuuccuucaauuucucagugacauugaugagggguccucaaaagaccucgaguuucccaaaccgaaucaccuuaagaaggacagggcuagggcauuuggccaggauggccacccuccugcuguugccccuuagugaggaaucuucaccccacuuccucuacccccagguucuccuccccacagccaguccccuuuccuggauuucuaaacugcucaauuuugacucaaaggugcuauuuaccaaacacucucccuacccauuccugccagcucugccuccuuuucaacucuccacauuuuguauugccuucccagaccugcuuccagucuuuauugcuuuaaaguucacuuugggcccacagacccaagagcuaauuuucugguuuguggguugaaacaaagcugugaaucacugcaggcuguguucuugcaucuugucugcaaacaggucccugccuuuuuagaagcagccucauggucucaugcuuaaucuugucucucuucucuucuuuaugauguucacuuuaaaaacaacaaaaccccugagcuggacuguugagcaggccugucucuccuauuaaguaaaaauaaauaguaguaguauguuuguaagcuauucugacagaaaagacaaagguuacuaauuguaugauaguguuuuuauauggaagaauguacagcuuauggacaaauguacaccuuuuuguuacuuuaauaaaaauguaguaggauaaacuugugugguguagagaaguuaaaauccucacguuguacauuuguguuucccuuucagauccaaauccuuucuuuguguuuaauaguauuucuccucacuugcacucagacaaucuauagcaugugggugguauaaaagaaaaaucugguuguauggcugggccauuuccaagcauccccucuuuccuggaaaguagcuccuuacuucccucc

SEQ ID NO: 21346 - RNA, 12730 nt, Homo sapiens
accgccauggccgggcuaucccgcggguccgcgcgcgcacugcucgccgcccugcuggcgucgacgcuguuggcgcugcucgugucgcccgcgcggggucgcggcggccgggaccacggggacugggacgaggccucccggcugccgccgcuaccaccccgcgaggacgcggcgcgcguggcccgcuucgugacgcacgucuccgacuggggcgcucuggccaccaucuccacgcuggaggcggugcgcggccggcccuucgccgacguccucucgcucagcgacgggcccccgggcgcgggcagcggcgugcccuauuucuaccugagcccgcugcagcucuccgugagcaaccugcaggugagcuggggcccgcggcuuccccaggcgggcugugggcggggcggccacagagcgagccuucacucuccccagaauucuucccgggaaguggagcguggcucgaacggcuguugcuucucugccgcgcaggcagguaggugggcguugcagcgucccagauguugggcagcuggguaccaggaauuucccacaagccuccgccacugggccacgcaccugggguaaauucucugccagcagcccgaggacuucucauccgugagugguucucagucgucuuggggcccagugucucuauuaacugugcuccuauucucuuuuuuuuuuuuuuucccuuugagacagaaucucacuuuguggcccaggcuggagugcaguggcgcuaucucagcuuacugcaaccucugccucccagguucaagcgauucucgugccucagccuaccgaguagcugggauuacaggugcgugccaccacacccggcuaauuuuuguauuuuuaguagaggcgggguuucaccauguuggccaggcuggucucaaacuccugaccucacgugauccacccaucucagccucccaaagugcugggauuacaggcgugaaccaccgcgcccugccugggcuccuauucuuaaagguuuuacagggcauagagauuguuagguacuuaagcacuuuaauaugugacuucaggguuucucacucucuuacccuuccugaauuaagcuuuucccuccugcagcaagacgcuaacguacaauaucauggacgauuacaaugauuacugcagucuuuaggccuccacaggcauaguggcuccucaguaagaugcagagcugauugaagguguaucucuuccucgcccuuugcccaccuucuggugcagggccacacuuacaacucugauggaucucugcugucucagggauggggucacagacacccagcuugggaggccggagacacacagaguccaggaauggagccugauuugauggagggucuuuuugacaaagcucucacauuugaguucaacucugaaaguacaacauuguugauaaagacaggaugcaagaaacugaugcuugauuaaucacuuuuccauuugccuuccauucguugucucuucuauuaauucuuugaaguagguauuauauaccccauucugcagaugaagaacuugaggccuaccuagguuaaguaacuuguuuaaagccagcgggcaaaccccuaguuucaucucagguucaucuuucuucaaaccaccuaucacaggcugguggcccaucagcugaauaugucccacagaccgguuuggccuacacaaaguucuguuuuguuuuuaauaaauuugaauuuguuaccaacauuuuaaaauuuagauuuuacuuuaaaauguaaaucucuaacuuuucuugaaaaaugggaagauccagugacacugugggccugcacucuuugagcaaaaacagaagcagugcccucuuuuagcuaaggcagauacaccccaguucaccauuuucuuauucccagcccauuccacaccuuuaggcguuugcucaaaacaaacucacuccacuccaucaguggugcucaacuuugacugcaaaucauagucaccuaagaaggcuuuaaaaaugggaugccaagguauuuuauugaaagcacauuuuauuuuaagacaacaccccuucccgccuccccacaaaccacucccugaugauucuaaugggggaggagggagauugaccaauacauaaucauauuuaaauuugugaggugacuagggaguugcugguauuauuguccccauuuaggaagugaggaaacacagacucagaggugcagggacuuacccugugaccagucagcuaauggcugucagguaggacauuagcccaggucuuucauguuucuagaaauagacagggcaguggcaaggaaccuacccagggcuuuagguuuccaugauggcagugaaaagaaguggccacauuagaauuugucugacuugauuccaucaauuagcaggucaaaguuucugcuuuuuucuuuuccuccuccugaccuccagggugcucugcauuucuucucauugacagggggugaaaucguucagaaggaacaaaaagaccuagguuugggaccauuucucauguguaaaauaccuguccucuguaacuuagagauauguugugagcuucaaacguacuuaccacugggcuguuucuuuuguaugucucuuucuuuguggcauuuuuguauaguaaaugucuguaggacaguguugcugauguuagcuuauagugggaccguguuuggcugcagagccagugagucugaagggaaaucuugggguuugauuauuugcaccaagaccucuuacuauuagccucccuuccauuuuggcauucuuuucuugugaugugccccuuucuguucuggucacucuugguuuuuuuucucugacccacuaaaauaaguaucccucaaagucaguuuccuacucuuuuguucccugcagcgauccucagaagauuguauacacucucguuguauacauucucuucuaguccuuacuaggacucacuuccagauguguguccauuucugaccucuucaaaguucucuauauuucugcuugcuguucauuuuugcuucguuacuuugccaccacuucaaauucaacauguuuaaauccaguccuucuuccuccugaaacaagcugcuuuugaucuucugcauuucuguuaguggaauuauuguuuucucaguaaacccaguugguucucacugccuccccaaaucccucaguucccaaguccugacaguuuuuuguugccuucuuuaccucuguccuugccccuuccucuucauuccugccaccucauccuuaagcuuaucaucucaugccuaaaaguacuagaacagcucuuacauagucuuccugucugccccauccaccuugccuacccaaauagauuaacaaaaauaccugucacagcauugcccucuggccagaaaccuuuaacaauacccagcugccuauagcugcguaagagcuaccugggauguuuguuuaaaaugcauauagaggcgggugcggaggcuccagccuguaaucccagcacuuugggaggucgaggugagcggaucaccugaggucaggaguuugagaccagccuggccaauauggugaaacccaccucuacuaaaaauacaaaaauuaacuggguauggugguguacgaccguagucccagcuauuugggaggcugaguugagagcaucaguugagccugggaggcagagguugcagugagcugagaucacgccauugcacuccagccugggugacagagcuugauucuguuucuaaauaauaaaaugcagauagaggacagcuugguggcucaugccuguaaucccaacacuuuggaaggccgaggugggaggaucacuugagucuaggauuuugagaccagccagggcaacacagugaaacuccaugucuacaaaaaauaaaaaaauauuagccggguguggugaugcacaucuauaguuccagcuacucaggaggaugagaugggaggaucacaugagcccuggagguugaggccacaaugagccaugauugugccacugcacuggguggcugccugggugacagagugagacacugucuuaaaaaaaauauugcaggccaggugcggugucucacgccuguaaucccagcacuuugggaggccgagguggguggaucacaaggucaggaguucaagaccagcuuggccaacaugaugaaacccagucucuacuaaaaauacaaaaaucagcugggcgugguggcacacaccaguaaucccagcuacucgggaggcugaggcaagagaaucgcuugaacuugggaguuggagguugcagugagcugagaucgcaccacugcacuccagccugggugacagagcaagacuccgucucaaaaaaaaaaaacaaaaaaaaauugcaguuauuuggguugggagugaagccuguuucaacauuuuaacccaaaucagcauuuuaucaagcucuccaggcaggugguucuuagaaaacagugccuaagguuggcccacaaauuacaaucuagacuccuuaacuuagguuggagcccucuccacucccaaccccaggcuccucccguaggaaagcccuucuuuccagcaaaucagguuucuugguacuguucaucaagucuuaggcucacccaguucuguguuuuuugcagucagugucuccucucccuuuaauauguccucccaccuucuauccugguuuugaauauauuauaaagcuccuuacaguuccucuaucacucuggucuaugcuggacauacacauuuguuuaugucugccuuuucaaccagauuauaaacucacggagggagagaguuuaccugagugucccccuccccuucuuuggucuccuguggugccuugccuaauaguuucuagacagugacuauuuggcuaaaugauuucaaagaaaucucuuuaugacucuuuguuuugaugggucagugugaaauggcaaaauucuccacacaaggcacuuagagcuuaaagagcuaaauagucuaaaaugcgaugugugaauuuugcuauaaucugucaacagugccuuuuaugaaguugauuucugaauaagaaagcauuaagaauuuuacuuguguuacuuuuugaaugugggauaaaacucauuguuacuaaagcaggaaugaacaacuucuccaguuuugaaaucacaugacaguuucugcuaauguaagauaaccaaguagcaugauucagcuacuuucuugcuuaaaucgcguaguuagccaauugagcaacugugguguuuuuagcaaugguuuuguauagaguuuaacccuuuaaaucuuucagugaagccuauagaacagccuugaauuugggugucacuauaauuauaauucuucugaugaauauggaauaaauucaggguuucagaaaaagaauauugaaauaauuuuuaccaagucaguucauuuuaaauaugaacccccgcacccccuuuggggaguggucaggauacuuuccaaguauuauuuuccccugaguggaaggugauguuuuaugauucauuguuucguggaagaccagucaagcucuagggacaucauguaugcaacuuuugaaauuuauuaccucuccagaaaccauauuucacaugagaggaucuucauuuucucucuauaggagaauccauaugcuacacugaccaugacuuuggcacagaccaacuucugcaagaaacauggauuugauccacaaaguccccuuuguguucacauaaugcugucaggaacugugaccaagguaaguaguuauccuacaggaagggagaugguuucagaacaccaucguauucacaaugaaagaauagaucauuuuucuuuugagacagagucucacucugucucccaggcuggagugcaguggugugaucucggcuuacugcaaccucugccuccuggguucaagcgagucuugugccucagccucccuaguagcugggauuacaggcacgcaccaccacacccagcuaauuuuuguauuuuuaguagagaugggguuucaccauguuggccaggcuggucuugaacuccugaccucaagugauccacccaccucgaccucccaaagugcugagauuacaggcgugagccacuaugccuggcagaauagaucuuuucagaaugaaaugcaguugauuugugauugccaugcccagucagaacauguucuauucuaauaggugaaguaauuccaugaaaaccaaacguuuuaauaaguugcuuucauauagguguuaaauaagauaugacaaaaaugaaugauuuucugaagccaagcagauguaacaacuaugaagcuccuguauauaaaguuauucuuacuaaagagcaucugguugaccaaagcccucuacucuccauuacauuuuacauugguauaauguuuuuccaugucugggcuccuugucuccauauuuuaacaguggcuuaaagcagagaaaacauauuaaguaggccaaccagaggacuauccauuacugaaaacuggaagugaauuuaguuuggaucaccugcugaagggaagaggucaaauacaaucucaggaagagcagugggcauggugucaggagugcugaucugauuacccagccagcagauuugcuuuuugaccgugucaaucauuaaugccucagacaaguguuauuuauggucuguaaauucuuuguggaugcaucucuguaguugaguguccuucacuggcaggaaaaagauggaggagcagcacaugcuuuugaguucuguuaugugguuucuaaacauuuuuauccuucaguacauucaucuguauguuuaacauguccauguuaugggauaaauaugcuaaacauuacaugucuuaggcaccaguaauguuacaguacuuagugcuaguuauucuaauagcucaaaaugccuuuuuaccaaugaaaguugguauuauacuuacagugguuucccacuucgugguaucuguuauuaccaacaauugaaaucuuuauucucugcauucuuuacauuuccuuuauuuucucuugauuccuuaagguuaagaucaagauuuacaaguaaguaaacucuuaggauuuauagaaugcuagagucacacauucuuuuuuuuuuuugagauggagucuugcucugucaugcaggcuggagugcaguggcacgaucucggcucaccgcaagcuccgccucccggguucaugccauuuuccugccucagccuccugaguagcugggacuacaggugcccaccaccacaucuggcuaauuuuuuuuuuuuuaguagagaugggguuucaccguguuagccaagauggucugagucuccugaccucgugauccgcccgccuuggccuuccaaagugcugggauuacaggcgugaaccacugcacccggccuaaucacacauucuuaacaaaugagaagauaaaguguuacugccauaagaauguuuauuucauauauguccuuuaggugaaugaaacagaaauggauauugcaaagcauucguuauucauucgacacccugagaugaaaaccuggccuuccagccauaauugguucuuugcuaaguugaauauaaccaauaucuggguccuggacuacuuugguggaccaaaaaucgugacaccagaagaauauuauaaugucacaguucaguaaguacuuacacaucuuucaccuaagauugccgcccuuacagccauccucagccuucuaaggcaagggggguuuaaccguuucaugugcccuggacacccugggcagucugguaaagccgcugaccccuucucagaauaauguuuuaaacacauaaaauacagaggauuaagaagaaaaucaacuauaaugaaauacauuuaugaaaauauuuguaaaugugugguauaaucguuuuauuaauauauuaaauauaagaucuaguaauaagucuauuacuuuuucuuuuuuuuucaagacagagucuuacucugucacccaggcugagugcaguggcaccaucucagcucauugcagccuccaccuacuggguucaaacgauucuuaugccucaagccucccaagcagcugggaauacaggcauagaccaccacacccagcugauuuuuuguauuuucauaaagaggguggugucgaacuccugagcucaggcagucugccugccucagccucccaaagugcuaggauuacaggcaugagcgaccaugccuggccuuuucugugcuuuuaaaguagugaggauugaagacaauauuuuaagacaucugcaacaccugugacaugauaugaacguaucugugauuucucuauuucuguuggagacagucacagauaggcugucacccugugguuuauucccuacauucauuauugaaggaaaugauacauucaguuagagccuaaugaaaaugaaaaaaaaauuuuuuugagccaaguucgcagaccccugaacucugucuacaggccuggacaccagguugagacuccauuuuaaggcugugcuuauugggcccugaacagagcccaguuaugacccacgauggcauuuucucaugaggcuuagacucaggugcuccuggacugugaaugcccuucaucugagucugagcaaguaaccccaucccaucagccccaguacuacaaaugccuauggggaugugugguuuaucccacuaagaagugcauggaagggaggaggcugagauaaaagaggccaugggagaaaauaaagcccaggaccugaagacagaaagggaaaggaaagaagaguguaacuggagucuuuggaguuagcuaaggguucaaaugagggaauacaagggacuggugcuucucccaggugacacagggaauucuggcauaucuggggaggugauaagaacaguaacaauaacagcuaguguccauuguuuauuacuggcugggugcuauacuggcuacuuuucauguauuaacucauucaguucucaccacaucccuuucuugcgcaaccuuccaccgcaacagguaggugcuguuuuuccacaugugugaaauggaaagcugaugcacagagaacaaacuggccuaaacuguuuguucuugcagccaggaagugguggugcugggacucaaacccaggcauucuugcuccagagccaucaccugacuucuauccaugaugcuguacuucuccucuggcugccucacugguagcuggccaggcuccuagcucaguguaauuuauaaugcacuuucugcuuguaaugauugacugcuguuucaggagauuacggugaugauaacuaagguagacuuguagguuguaggucauuugagggcuuaaauucuuagcauuuauuuaaucucugucuuuuucaauuguagaacaauuccguguugaacuauugacucccuaccaugauuggaaaucucaguuuuguuuuguuucuaauuuuuuuuaauuccaagcagggccuaggacagugugugucauagagcagguguuuaggaaugauugucuggcucauuacuugagacaaacacucucacacucuguuggaauaaagaaucccacaguccuggcgcuuguuuugcugcugugcaugcaggagaggcacgggccacuggucgucuucugggcuggcaaagccaucugacuucauaggaauauagagguagcaauuacaacuuuauucccuggcaacaaauuaucaggaugacuguuaagaagggccugcucuucgaaguuaaaguuuacuuucacaggacauaaucucuaaagcgcaguuaucuuuauauaaauaacaugcccaaaggcagugccugguuuaauaacaaaauaaaacuguuuucccauaagucuccacacugaauaagugaguaaaacagauacuuuugagguucccacuuuauuaugcugacaaaggagcacuucucugcagcacagagauagaacauuuuucccuuguccugagaggcggcccaaaggcuagagcagaugugacucuucugaggcagugcaccagaacccgagggaugggcagggccugaaagcugcccgcucugaccgggugccucuggcuaggaauuguccaucuccgagucuaggagugcccccacuaaucccacccgccagguuugccaccagagcuguuuaauaguccggggaguguacagugauaucugugaggaccagggcccccaucuucuuggagaaccacccacaggggccucacaggcguucuggagcuuccccacauuggcagccaccuugcuuggcuugcccagaucgguuuuggaagguauuauuccuccaaauaccacgaagcccucugcaucugaaaucuguuucacacagauggagacugccacuugugagagcugauacggagcuuaacugaaugugguuugccucauuggacuguugggugaagcccccaugagcauguuugcaugaucaguggaaggcuuaaaugucuacacgaagcauuugcuggcacccuggaauaagcaguucuuuuuuuuuuuuuugagauggagucucacucuguugcucaggcuggagugugguggugcgaucucagcucacuguaagcucugccuccuggguucaugccauucuccugccucagccuccugagcagcugggaccacaggcaccugccaccacgccuggcuaauuuuuuguauuuuuaguagaggcaggguuucaucaugucagccaggauggucucaaucuccugaccucgugaucugcccgccucggccucccaaaaugcugggauuauaggugugagccaccgcgcccgcccaacaagcaguucuuauaagcauaagcauugcuuuugaccacuguuaagucugggcagcagcauguuugugcuaagccucauuuuaucuccucuggcgcacauccggauauuuccuagcaaacacacagguaacaaaaggucauggauuacagacuugcccagucuugauaccuagagauggauucccugguugguggcagcagaaagggggaaaguucaccucccagcuguggucacuaucacugggcaauggcuaaucacugcucuucugcccugauguucaggaccccuucuguucucaacuauuuuugucuuuuaagccuucagauacucuuaaaugagauaacaacagcagccacggcaguggccugcuucuugcuacauccuaguagcguuuaucagugugucagaaucauacuuggagaggaggguuauugcuaaaaugaggauuccuaggccccacccucaaccuauugaaaccgaaacucaggagucugcauuuuaacaaacccaagugguuauuuaguauauucuagugguugaaaugaacugaaaaucuuaauuuagaucagaaauuuuaucuaguccuucccuagaaugaauuaauuuuuaagauuuguuaacccaguuuaacaaaauaauucuucucuguuccccuuucuaggugaagcagacuguggugaauuuagcaacacuuaugaaguuucuuaaaguggcucauacacacuuaaaaggcuuaauguuucucuggaaagcgucccagaauauuagccaguuuucugucacaugcugguuuguuugcuugcuuguuuacuugcuuguuuaccaauagaguugaccuguuauuggauuuccuggaagaugugguagcuacuuuuuuccuauuuugaagccauuuucguagagaaauauccuucacuauaaucaaauaaguuuugucccaucaauuccaaagauguuuccaguggugcucuugaagaggaaugaguaccaguuuuaaauugcccauuggcauuugaagguaguugaguauguguucuuuauuccuagaagccacugugcuugguagagugcaucacucaccacagcugccuccugagcugccugagccuggugcaaaaggauuggcccccauuauggugcuucugaauaaaucuugccaagauagacaaacaaugaugaaacucagauggagcuuccuacucacguugauuuaugucucacaauccuggguauuguuaauucaacauagggugaaacuauuucugauaaagaacuuuugaaaaacuuuuuauacucuaaagugauacucagaacaaaagaaagucauaaaacuccugaauuuaauuuccccaccuaagucgaaacaguauuaucaaaacacaugugcacacagauuauuuuuuggcuccaaaacuggauugcaaaagaaagaggagaagaauauuuuguguguuccugguauucuuuuauaaguaaaguuuacccaggcauggaccagcuucagccagggacaaaauccccucccaaaccacucuccacagcuuuuuaaaaauacuucuacucuuaacaauuaccuaaggcuuccucaacugccccaaaucucuuaauagcuucuagugcugcuacaaucuaagucaggucaccagagggaagagaacauggcauuaaaagaaucacaucuucagaagagaagacacuaauauuauuacccauauacaugauuucagaagaugacauaagauuccucuuaaagaggaaaugucaggaaucaagccacugaauccuuaaagagaaaaguugaauaugagucauugugucugaaaacugcaaagugaacuuaacugagauccagcaaacagguucuguuuaagaaaaauaauuuauacuaaauuuaguaaaauggacuucuuauucaaagcaucaauaauuaaaagaauuauuuuaa

SEQ ID NO: 21347 - RNA, 2942 nt, Homo sapiens
augauuauuauauuuuucaaugccagugcugcucagcccucagcagaacuucaguuuccaugaaauaaacaaugacuauauaaaauuccaccuuucugaaacugcagucugaccucaggugaagcucaggugaaaguuucuuucccaagcagcccaucuguguuccaucaagagagucaagguucuccaagugaggggagcugugccuggauccugccuccaagucacaugagcacuagcucauaguggcagggugggggugggaggggcaggucuaaacucacagaagucaagucuuaagacagugggugacccagauugccauagaggucaggccugcggugcuggaacacaggcaggugucggcgcaacugucgcagauaguugaggucuauucgggcaaggcagaggccuggccccucagagcagcgggccaccacuguuccccaggggucuaccaccaugcuguggccauaacuugcucucuucucaugguggcgucca[450 bp omitted]ucuggaaugaaaaacagccuacuuaguagucuuccugcucuguuugucacagcaucuagucauauuuccauuacccccucucuuagggcuuucuauccucuacugccaguucaaaguauuccuguuccccucccucauccuuucacaacuccuaccuugccugcuggugugcugacaggugacucaagacugggcccaggcaugguagaguugcuuucacacauaggccccugcccuggaaucucuacgucacacagaugugucuuccuguaaguggccacuacugccccuacaguaagaaagaaggaauaucagugcugguguucuagaagccuugcuuacuccucccaaggaggagauaguuuauaggcuaggaacugaaguaggaccaccccuaaauccuugggucaaggaaauaagaguugagaaacaauucuggagaaucuagguagaagagcaugggaagaggcaggcuaaaggguuauaaagucucaccuuugcuguucagcagcacgugacaauuguagauuuucugagucugcucccagucuuggccacgcucauggaaaccacccaaggacagccagaguccacauucccuggggggaagggacacugacaacucuucacugacuucucaaggcucuacccucauaucuggcaacccagggacacuguccaacaaagauucuaccucucccucgcuauuucccugauaccuggcaagcuggguguauucuuccaaaaguuucccacccagugguucagacagguguagcgucucugcagggucccgugcaaugaagucaaaugccucaggcaggaaagccaggcaggcacccagucuggcagccucucgaaccagcucagcacauguuuuaaaguucuguugcuugucuggcgucgauguuaccuggcacacagccaccaggggcaguucgcaggaggaagaggagauagccauggcucugggccugugaacagcauaggcaggauucucagauuucauagcacagggaagcaaauuuaaugcuaaggggugcaaguggagaggcaggaaagcuggacuuccuuuugaucaugcucuuacagggcacguugacccagggcuaguagggcucaccaaucaaauguguggauaguugacacuccugugucucccacuauccauuuaacaaacugagcaucuaagugccaggcacugaggacacaacaaaacguguuaccugggcugagcacaaaguacugagaguugagguauccggaguccaggacacagaagggacaggaaucugugaggaggccuggugaugaagcccagccugaggaaggugagauaugaggacaccaaccccuucuucaagcaauaaauuucuaggauucucugacuucucucuuuauacugugagccugaaucagggcccugccaguaaaaaccuagucuucaaaacgcucuuuauaagaaauuauaggcuaagggacaagaccauacagugggaagauggagaaaggggcucugcucgccgccugaauaguucaacuuccaaugaucucacauuaaacugaagccucuuuccucugacaaacguuuccgcaguccaaaagucaucuccgggaacuauccuugguuuucccaagacucucuccuugacugugcacuugcgcagcuuuacugacucgaagcauauuuccccuuucaccagaaucucgcaggggaaaguucacccucucucgucucccaccccucccuggugggcaaggggcaaaggaacccaggccccaagccgcgccccgcccuccacccucccgccgcccgcuccaguuggcccgucccuccccgccucucccagaggcagcaucucuguuacacaaguuaaagcaccgcaggugggauucaccgcggccgacgggauagggaguagguccuacaugaagauauagccaaaaccauucgcaggguccgauccggagggcggucuggagccaga

SEQ ID NO: 21348 - RNA, 2942 nt, Homo sapiens
ucuggcuccagaccgcccuccggaucggacccugcgaaugguuuuggcuauaucuucauguaggaccuacucccuaucccgucggccgcggugaaucccaccugcggugcuuuaacuuguguaacagagaugcugccucugggagaggcggggagggacgggccaacuggagcgggcggcgggaggguggagggcggggcgcggcuuggggccuggguuccuuugccccuugcccaccagggaggggugggagacgagagagggugaacuuuccccugcgagauucuggugaaaggggaaauaugcuucgagucaguaaagcugcgcaagugcacagucaaggagagagucuugggaaaaccaaggauaguucccggagaugacuuuuggacugcggaaacguuugucagaggaaagaggcuucaguuuaaugugagaucauuggaaguugaacuauucaggcggcgagcagagccccuuucuccaucuucccacuguauggucuugucccuuagccuauaauuucuuauaaagagcguuuugaagacuagguuuuuacuggcagggcccugauucaggcucacaguauaaagagagaagucagagaauccuagaaauuuauugcuugaagaagggguugguguccucauaucucaccuuccucaggcugggcuucaucaccaggccuccucacagauuccugucccuucuguguccuggacuccggauaccucaacucucaguacuuugugcucagcccagguaacacguuuuguuguguccucagugccuggcacuuagaugcucaguuuguuaaauggauagugggagacacaggagugucaacuauccacacauuugauuggugagcccuacuagcccugggucaacgugcccuguaagagcaugaucaaaaggaaguccagcuuuccugccucuccacuugcaccccuuagcauuaaauuugcuucccugugcuaugaaaucugagaauccugccuaugcuguucacaggcccagagccauggcuaucuccucuuccuccugcgaacugccccugguggcugugugccagguaacaucgacgccagacaagcaacagaacuuuaaaacaugugcugagcugguucgagaggcugccagacugggugccugccuggcuuuccugccugaggcauuugacuucauugcacgggacccugcagagacgcuacaccugucugaaccacugggugggaaacuuuuggaagaauacacccagcuugccagguaucagggaaauagcgagggagagguagaaucuuuguuggacagugucccuggguugccagauaugaggguagagccuugagaagucagugaagaguugucagugucccuuccccccagggaauguggacucuggcuguccuugggugguuuccaugagcguggccaagacugggagcagacucagaaaaucuacaauugucacgugcugcugaacagcaaaggugagacuuuauaacccuuuagccugccucuucccaugcucuucuaccuagauucuccagaauuguuucucaacucuuauuuccuugacccaaggauuuaggggugguccuacuucaguuccuagccuauaaacuaucuccuccuugggaggaguaagcaaggcuucuagaacaccagcacugauauuccuucuuucuuacuguaggggcaguaguggccacuuacaggaagacacaucugugugacguagagauuccagggcaggggccuaugugugaaagcaacucuaccaugccugggcccagucuugagucaccugucagcacaccagcaggcaagguaggaguugugaaaggaugagggaggggaacaggaauacuuugaacuggcaguagaggauagaaagcccuaagagaggggguaauggaaauaugacuagaugcugugacaaacagagcaggaagacuacuaaguaggcuguuuuucauuccaga[450 bp omitted]uggacgccaccaugagaagagagcaaguuauggccacagcauggugguagaccccuggggaacagugguggcccgcugcucugaggggccaggccucugccuugcccgaauagaccucaacuaucugcgacaguugcgccgacaccugccuguguuccagcaccgcaggccugaccucuauggcaaucugggucacccacugucuuaagacuugacuucugugaguuuagaccugccccucccacccccacccugccacuaugagcuagugcucaugugacuuggaggcaggauccaggcacagcuccccucacuuggagaaccuugacucucuugauggaacacagaugggcugcuugggaaagaaacuuucaccugagcuucaccugaggucagacugcaguuucagaaagguggaauuuuauauagucauuguuuauuucauggaaacugaaguucugcugagggcugagcagcacuggcauugaaaaauauaauaaucau

SEQ ID NO: 21349 - RNA, 50083 nt, Homo sapiens
gggcccuccccacacaggacaccgugcaguuccgggggaagcugacucaaaucaaccuugaaaucucaugaaaacaaaaugacuugucuuuuuauuugauaguguaauaucauucauuuuauaaauuuuuuaggguuuuucucguaauauuguacaguuuugcauggccuggugugaucauuuuuugguuagaauauaaugcugacaaauguggauggaggggaagauacugcuuuagccuaucacuccuuauuuuauuuuguuugguuuuaugcccucagugucuuagggaacuuuuuaagagauccucugcuaccaaacaaugauguggauucuuuugcacagaaauauuuaaggugggaugguaaaaaaugucacaaaagacuccucaccaauacuuuauguugauaucacuuaauauuaaccagacuuugcuguauugcaauaaaacagagaacuguuagcauugaguauuuugucucuuuuccccccacuugaaagucugagaaauagagaaaggugccaccucuccgccugucacuucucuucuuucugcuggccuccuuccucauccaggcugcuucuuuaugccguaaaaggacaugggguuaguuugccccugugguuuaaucuaggacuuucuuaauuucuuccuuagcucggguaagaaugauguucaauucuccugaagcuuucaacuccccucuucuggccagaacuucgcuguugcuguuacuucgguccacaagaccaaacccuggcugcgugagguuuccugaguggcccugacagugugaaugugggagcaguuugauuuugugucacuuaaacaagacggacuguuacugcuuuucuggaguuagaaugguucaucuaagaacauacagggaagguccaggggugggguuaaaggaacuccugaacugguggcagcuaaguaguuauucggagaauacuuccgguuccaauggcccauggaauugacauuuguggcugauacuguuauguugguuuacuguagugucagcugugcagugcuuuagaacagggcuuggcaacccuuuucuguccaggaccaguuaagaaauccuugugccuuuguguauauaguuugcugcagcuccccggcucuggcauuucagugcaaaaacagucuuagccugcuacguacauaaacgagaguggcugugccccaauaaaacuuacaaaaaugcagugggccagauuuggcccuuggaccaucauaguuugccagcccuucguuugguccccuuaguguagacuguaagacuagacugucuuguuccaaauccucauucugccacuuaaccucugggccucuuuuuuuuuuuuucccucuguaaaaaggcccacuuggagugucaggaguuaaugcacucagaaucuaacuucuagccuaugguuuaguguuuuguccuuaugaguaaccgccaaagccuacaguaacaaauauuuuuuuguugugugguguccagcccuucacuagauguuagggacacgaagacacagacccugggaaaaucaagccaugauuugccauguucucaugccccaugucucagugugaaugggugagcacggggagucauucaucacaauacuguaaaaaucaaaauagguacaaaagaauaaguauguguggccagcuucagagccagcuuuacuuggggauuaaagucauuugcaauccagugauccccacugucuucacagggagggcucuaguucucagccggcucucagacuuaggacacacaaaccacauuccaguuuucccuuagaaaacuucuccuguuccagcaguuauggucgugguuccuggggaagcaaaugcuggcugcuguuguucuccucucccuuccccccgcaugcugcugcuugacuuguuuggcuuguuguucaagaggaagaggagacugugagagcccuggcuggggcuggccuggguucuuccccugcuguuuacucugcagggcgauggcuucagaucugagugcugcagaggaguuugcuagacaacagcaaauacccuuaagaagagggccacaagaguuucagccagggaucugacaguggugcugggcgccgcugcuagccaggcagccucacggacgccacccaggccucuccauccugucccggagcccacugggucugcuacucggcaaucccaaauuucagaaacuauauuuucuuucuuuaagaacccugaaagccuauaccucucaaagccucuuuugggccugugcauucugcagaugcacuuucaacugcucacagguccguagaaagggccccagcucaguguccaguguguccuguuaucuaggaaucagucuggccccaggaaaagccacuuuucaggacgugguccucaacugcagcugaugucuagagaggagacgucucacugugaugcagaccuggcaucagccgugcuggcaggugucacuguccucccaguugccaccaucaccagguacagcagcuucagcagugugguacagccucccgggggcuggggcagugacaccgcaaccucuccuccuguucuccaccccucccaccucccuucuuacagggaacggggcugagccuuccagguucagggccaagggccucacgcugaaccagucccaacccuugcaaaugggcugugacacugaaccugcugaccgucaggucagaaaagaaccaccaccacgagcuagaagauacgggucgucauucuccagaauacagaagaggguacacgcgccaaagcacuucccaugagcauuuuuauuaaauugaaacaaguuguugauucgauaauuacaagacuuguacaaaaauucacagcgccugugaggagccuuuggcuggaacuggugacaccugugccucuccggacagaggaaggaagucccaccccgccuuccagcagcagcgagccugugucuggcauucccuguuccgcugcucccacccucacuguggggcagcaguucuuuaggaacauucagcugucaaaggugagaaccagccccacaggccugggccucgcaggcuuaaggagcacuuguuggcacuguuagcucagcaccucucccagcuccagcccaucggcuggagaggaaaagggcagaaaacacaaaucucacucuagaaacacauacacacaccuacuacacagaugauaaaaucccacaaucguaucuguucauguuucuggguuuugcacugaacagagauuggaagggaguaaggacucucucccuucugcuuaacauucacaucaggaaaaagaagaaaacaaaguugcccuuucaucuucaucugcuuauuucagaggacacacggaggcagacugaccgagcaguggggcuucaucuucauucuugcacuucucacccuacaaccauuuagcaacagaaaccguggaaagcgcuggcuacggggcuccaggcagccaccccccuuauugggcaaaggaguuaaaaagagcaucaccacgaccucgcuacugguuuuuggccugucugagggagagaguucccgcggagccggccugggcguggcccgcagcccuacugcugggccugccucuugcaguaguugcuguaggccuccucgaacauggccuugcaggggaagcgggccuucagcuuggagcagaugaggaaggagccccccaucuuccugugcagggaguagguuuccucggguggggggacgagacggugccucagcaugacgggaaucagguuguggaucuucucgguggugcucugagugccaaaaucaaaaggcucaucagaggcgaaggccucccccaggaugaggauggcauccaagugggcgucuuccaugaccuggggcaagagaggaaggauaaauggcggcgagacaccagagcccuccaccagcccggguuccucccacagugcccggggcgcugaguucucauucaaagcucugcuguaaacuggauuacaucaugguaaugggcauaaacucaaacccacaggggccgggaacacgaggguaacauggacugggcugaugugauacaaaagggaguggcggggccuguggcagagugcagaggaugcgucccgccucguggcacucauacagaguuuuaacaaaacacuguucuggccaaaaagaacagaguccgugggccuaagcuggcagggccucccaccaugcgugucugagccugccagaguccacccaagacacacccagcagccgugugucugcccacgggaacuagcaaccuaaggaagccgccgccagcagagcaggggagaggagcugccgccagggacagcccaagguggucagagggacggggcggccaggaaucgagucagugcgaguggccauaaggaagaggcgggagagagcugcugcccgcugagcgcuuacagcugagauaaggggggcucagagauacugacaagccucaaaugacacuccuaugagacggcagacccaaggcuugaccuggauuucuuuaacuccuuccccacugucaagcagcaagcggaaaaugccacuuuguggguggcuucaggcggcaccagcacagaccguuccccuuuauuuaaaaggcuucuaagguuucuuccaacuccccccagggaggcucgaugaggggagggcuggggcuucccuucccacuugcucugcacguuggcucaaucgaggcccaaccccaagcccuaagugggcaagagugagaggcagaaacaagagcuucacgacaaguccccaacucacuggcccacucggaaaaucucacgcucagcagggcagcaugggccggggugggccccagcuuucagaccgugcccaaggaggcccgggcucugggggccccuugagggcagcugcccccugugcuuucauccauucuuacacagggagccgggcccugggucagcaggcccaggggaucccccgcaacccugcucaccuugaccucguagccggugaggaacuucaucucuauggauuucgcccgcacagucucccugucccugucggcagcagcccugaugaucuggggagaggcacaggaggggaccgugggcagcaugaaaagcucagcucccgacaucccagggagccaagugccacacccgagcccaccccacccucauccucucccugcacagggcccccggccagugcugugacaccacgccuggcagcugucagccuaacugccugcugucaccagaccugaggggcaggcagcgcagauggggacacaagggcaggaacccagucauucucccuaccccgagucccccagcauccugucccagccucagaaaaacauggaccaaggccagggccccucuccaguuaccugaauguagaggucggugaaggaucugucauauucccgcguugccccaaaauccaaaagagccaccuggggacagagacaccaggagaaguuuggcccuggugcuccauggugcggguguguggggccgggaagggggugcaacagagggcagugaggauccccacucccagagcccugagcucucugcugacuuucccaggacaaggggcaguccagggccucacgugccccauucggagaagcucucaggccuggcugcgggugcccccacccuggggcucaccuugugcugcugggggucauagaagaaguuggaccaguuggggucuguuugcaugaaguggaacucgaacagcucccucaggcacagaaccaggauguuguagcagaucuguggacagcgcgaagggucugugucaggcagcaccacacugccuggugcccugggagacuggggccagagaagccccugccuccuguuuuacccacccuacccuagggacuguuugauucccaguguuacuugggccagggaaggcagcagcuccccugugucccccuaagucccacuggugcuacuucacugccccucacccccagggagcaccucagggcuccaaguccccagcucacacuauuaggucaccaaacagccacacagcagggccacccuggccccaccugucugcuggcacagacaaaccucguuccgaaucuccuggcugagcccuucggccugguccagggggaagccagacaccagcucuguggucagcacaugugggcugcagagcucauccacaaucucaggcacauagaagaagggguggcccuucagcaggucccuggguaggggagggaggucacgcccuagccacaggcccuccacaccguccccccccccacacacaccccccaaccaggcagagggcccuccuucaccccaggcaggauauggccucggcccaggcugcaaccccagcccucugccccucagagcuggaggggccuucaccagcugcugaacauggucccuucugccucccuggugcaaacacgcaaggggcccggccgggggccacaccugaacuugcgggcacaggcggccucucgcugguagucacacuccagggccagcucccgccucagcacgucgaucaggugcucggggaacaggccugggccagggaggagggcaucagcgaggaagggggcucugcagggaggacccccucugguccccagaacccaacacagaugccugccacccacuccugcccuugacccaaccaccuagccucagaccuucuggaagcauguugcucauguucaacacggccaugagguuguugacaucacuguugaugcucugggccacgccaggguacuguggggguaugggugaggcaggggaguuagcccagggagacgggugggcccugccuggggcacucccccaacccccaacuggcuucccagcuguguccuggccccagcccacacccuggagaaccagagcuaagacccagccaugcugccgugaccuggaccccaucacagccucguuguccaccuacuccugccucaccucaccccugggaacagcucacggccacccucccaccagcucuggccccaaaaagcaaucacuuguccccuguccuugcccaccccaaaucaagcuugcugggggccccucugugcccccaaagucacucauuuagcaaauacuucccaagcuucuggugccguccaggcacuggggccagaagacaccacauauggcccugccaggagagagggugcccugcgggacgugggguguagaggccuccaugagccaggccccagcucugccccuugcagcccccauagggacaggcacugcgcaucaggccgccuaccuggaucuucauggccaccucgcggccgcccuucauucgggccaagugcaccugcccaauggaugcggcggcgaagggccgcuccucgaaguauuccaacuugucccgccaguuggggcccaggucguuguugagaguuuucugaagggcagggccagggaggggcucugagcaugcccugccugggccaccgggagaagccccaagucuguccccuccacccagugggggccgaggccacagagagugggcagagccccuggcuccucaccaucaucugcuucaguggcaugaaguccgcgcucugccgcacccgcucgaagaucuuagccagguggggguugauaaaggcaucaucuggaaggcaggagaaugacacagggcgaaccuggggauuaaagugugcgcccaggaccugggcgggcacacuccugggaugcccuggccaccacacccuccccaccaggagcacgggugaggccagaaagacaggagcccucgcacacacgcccucggccacucagcuucccgggagccccagccuccgcccagugaccugagaaggugggcuuuuuacacucaacaugcagaguuuuucauaauuacaaaagaaauuuggaaaauaaaacauaguaaaauguugaaaugaccuguguucugaccaccuguagagagcaauuuuuccucucugcucuuuauuccauguguuucuuuggacccagagccacccgucuggagaccaggccuauuaucuucuaagaucucuccccagccugcucacaucuugcccacugagcuuugguggggccacugcucccggcccuggaaguugacccccccagcagcccacgcagucccggggcagcagcccccgcgcccacucacccuggaugcucagcaucuggcccagcuugagugccgcaccacgcaccuugcagagcgugcgcacgauccgcucugcauuggccucggacaggaaaggacuggaacccagcacggccuucuucccugugggcgggcaagaggggucaccacggcacucgggggggucugggagugggauggcaagccccaccugauacagacggaggcucagacaauguccuuccucccaggcguccauaaaaccagcaacauaacuaacuacuguuccauguccaccuccccaagccugugugagccacaugcccaggcccuacgccagcgccucccaauacacacaggcaugcacacguacauaugugcacacacaaacgcacacacacaaagggccucucccuuccauauggggaccuggcgggccgugacagggccauggugcugccuguggcuggaaggggcgugggagugggaaccaagagggauguagggacccagaggaccccaggugaggaggugccgagccuuugcccugugcacccccacccagggcacugcacaaaggcccgcugcaccuguggggucggcaugcauuugcacauggggccaaguggcuucagccagagggcuguccucaagggaacggcgcucaggccaagggcagcacagcccaggggugcccgucucucccguccacccacagaggcccccugcagcucagugcagccagcuggccagugaugagcaugcagugaccccaagggugcagguggccuuuuuccaguccaccaaggggagggcugagggccgcgacucaggagcagcagaaggccggcuaagucaacugccagcaggcguguggcccagggcugcuggguccucucuagcuuccccccuauccugggccaucaguucagugcugccuagacauggaggugccccuauccagaggcagacagaggccugagcagggaucuggggcuccaagucuuuccaccuucccugaguuccucagcaccccuugucgccgggccuccagcccuugugacauucggagcuucuccugccuucuguccugugaaucuaguuagaucucaagccccaagaggucgcagugcggcuuccuccucucuggcccccacagcacccagcauuugccucaguucaaaucacuucaggccuggcacagcgcucggguggcacggagccagguccccagcaggggaagagagaggugaccgugccacugcccucugccccggagccgggugcagccuggccccugagaaaccaggguggggcgggccgcccugagaauggaggcccugcgggcccggaagaggagccucggagaagacccgcaucugcccacacaugcaggcagcuacguggaaaggggccaggcucacuccagggucccagacagcaggaagggaccugugaaggugggagauguuagcucugcgggaagaggcugagcugcccugggaggcugagcuaugacccaugggcagagcgaguccaagagggcugggcccagaagggucccucggccacccccuugccuuaggcagcagcagacgccagcaccaaaggaaaggcagucaauguccccucugcccccuaggccugugguacuugugggcugggggcuugggccugggucccuggggaggggcaggcagagaggcaaaccuugaggagaggccacugccccaggccagaggagggacagucugucuccucaugacacacagaguaggccuaggcuagcagcagcacuccugagagaugggaacggugccuggcccaauccgggcuuucccagguagcccauuggcaaagcuggucaaugccacaggcuggagguaugucccccacccaggcagggcuggcugugagaaugaccuggcaaguggggaugggcccagggcuacggcagugugcccccagcucaggaaagguccuuccagggcagagcucagccaggguggccgguguccuccaguccagagggugccagggccuggucaggaagcuggagcacaguuuggggcugcccagggccaccccacuccagccuaagccucgggucccccucucagggcuaacaaugccugggccccuuaacccccagccuggggucaccacugucccugacaaaggacacuagcuguaacugugaagccagccuggccucuucccugcuuggaugagguagucuggagaacagccagcuuuggagaggacaguaggggacaguaggggaaggcuggcuucuccuuccagagaaacccaggcuucauuucccagagagugucagcaccaacgcuaaaaauacccuugcuaagcccuccguccucagccccuuccaaggacgugcaugccgcccguguccccaggacucaguccgggccugugggauggacuagugcccuugccccagaaggcagcguuggugggugaaggggggcuguccggggacuggcagggcccccaaaggaggcuagcccaggcuggaagacagggcugugagggcugcaguguggccagacacugggugucucuggggguccccauggacggggguggaagggcgugauaccagaaugagcugacauucccugaaugggccggggccaggggacuuggcccagaacuccagaggcauugaggaagauccacacgcagacgguucccuuggcacugcucuccacaccccaggccccacuaacaggaaagccccugcugggcugaccucgcaccuaccuggcccgccccccgugccugaagaggccugaggaggagcccggccugguguucacaggcagaaggcggcagggacucagugcgccccacuccucaucacagcagcacgaaugcccaaagccucagcgugguccguucgcaggaccucuccacagagggcccggccacagcgggccaccaaccucagugggaugaguguccugaccugaccaccugccugacccuggcugugaccuucacgucagaggugaggugccucugcauagacuacagccuccccagguuacuaagcuggugaggagaagccugcagggucugccugcacaccucgccuguccccagccacaccugacccggccagaccagcgacuuccagagagcagggcagcagcaaaagguggguuuacaaggaggugugcggguguguggaggguaaggugugugggugugugguggguguguggagggguaaggaggugcaguguucagugggugauugguggguguguggaggguguguaagguggugugcagguaugagguggguguguaaggaggugugugcauggaggguguguaaggagcugugcgggugagagguggguguguacggagguaugcgggugugagguggguguguaaggaggugugcagguaugagguggguguguggaagauguaaggaggugugcagguguguggaggguguguaaggaggugggcagguguguggaggguaaggaggugggcggguguguggaguguaaggugggcggguguguagaggguagaguguguggagaguguguaaggugguguguggcugugggggguguguggaggguaaggaggugcaguguucaguggguguucgguggguguguggaggauguguaaggaggugugcagguauuugguggguguggaggguguguaaggaggugugugggugagagguggguguguggagggugugcaaggugugcggguguuuggaggguauguggaggguguguaaggagguguucggguggguggaggguggguggaggauaaagaggugugcaggugugugguggguggguggaggguguguaaggaggugugcggguguucagugggugcggaggcuguguaagcaggugugugugguggguguguagaggguguguaaggaggugugcagguaugagguggguguguggaggauguaaaaaggugcguggguguguggaggguaagauguguggguguuuggugggugugcagggggugugugacgugugcggguguucggugggugugcagggguaaggugugcggguguucggugggugugcaagggguguguaaggucuguggguguucggugggugugcaggagguauaaggagguguguggguguucagugggugugcaagggguauguaaggugcggguguuuggugggugggcaagggguguguaaggugugcgcguguucgcuggguguggaagggguaaggucugcggguguucggugggugugcagggguuguguguggguguucagugggugugcaggggguguguaagguguccaggugugcagaaggcguguggaugugcaggcagccaaaaagaaggggcuggguggccacuuugggcugggaggaggaagggccuccagccucacccccucuaaagcaggucaaucugucuguaugaacagccucaucaccccagggacgccacuuacguggaaccccaugcaaaugcggcccagcuggcugacacucccagagcacagguggggcugggggcugacaggcucaacccucccggggcccacccugccccucccacugaagggcccggcucaccugagggguccucggagcgcaggcucuucuuggcgaccucugccagugccccgaagcccaggcccacggccagaccugcaaggaggagggggcgggcacucagugcucacgcagggcuggggccacccgcucgcccacccacaaggccuggggcagcaccacacagacaccgcuugcaccaggggcccucgcugccacaccagcauuuugaaaaguggggaacaaggugggagaugccaccuguuguuuuaagagaacauuuggcucgagguagguguuucagugaaaaagauucaggaaucccccacuccacaccaucaccuuugauaauucacaggcucacgggcacacggacaccccaaaguaaugccagcugggaagcaccugggaaggacccagcacaaaugggaagacggaccagggaugguccacagaccaacgucaccccgaccacacagggcacccugagaacacaaccacccgcuucaggucugucugaagagccucccaucaccuagacuucccuaauucacuggaacaggaaagguguugccacaggcauacaaagcacuugguggugagagugagaacacuuuuggcucccccuaauccaagccaggggaacucgcggggcucaggcgcagcccucgcuggguaauggaaggcccucucgcccaccuugcccuuucugcggggcuggcaaacacugacaucugaggaccguggggugccaggccuucccauuauccucuuucacaaucuuccgaaucaagguccacuaacaccucauuuauccaaaaaucagucaaugaaugaucccagcugcucaagaaagccacuccccaccccugcccaggagcccagaaggugccacuaaugccacaccucacccagggccaguauucucuuccuuuauacccagcuguagcuggcuuuccggguaggcaugggugagcagaaagagggugaagagcaccuggcugggcacggugaccauggccggcagggcugagaccagagcggccgcacgaugagccggccucggagagccccgcaccccgcacccgggcaacaucgcagccccgcagccccgcagccccgaagccaggcaacaucgcagucccacagccccgcagucccacagccccgcagccaggcaacaucgcagucccacagccccgcagucccgcagccccgcagcccggcaacaucgcagucccacagccccgcagucccgcagcccugcagccccgcagccaggcaacaucgcagucccacagccccgcagucccacagccccgcagccaggcaacaucgcagucccacagccccgcagucccgcagccccgcagccaggcaacaucgcagucccacagccccgcagucccgcagccccacagccaggcaacaucgcagucccacagccccgcagucagacaacaucgcagcgccacagccccacugcccggcagccaggcaacaucgcagcagggggcuguugggggagagggcucacaccaggacgcucuguuuaaggcgcaaggaaacuggcaucugcuugcauguuuccaaauucucuacagugauuaugcaugacuuuuaugaaaaauacagaacuuguugaaaauuuaaugaaaaguacauuuuaaaacuaaaaagaagacaacucaauuuuuaaaaaaauguuuuugcgauacauuuuuacccacaccugggcaacagugcacccuccacguccccagcagucugggcagccccugccucacaggcugucgugcgggcgugaguagagcacucgccgggccaggaacacacaaaggccacacaagcagcugcuguuguucucgugacucuauucaaaaaggcugggccggcgcagaacaaaagaaauagaaggcaagccacacauauaauuguuacuuuucuagcagccacacugaaaaaggcaagaagaaacaugcaaaaugaauucuaauaguauaauuuacuuaauauacccaaaauguuaucauuucaacaaguaaucaaaauaaauauuauuagagauauuuugcacuugugugugugcacaaagucuccaaacaccauguguguuuuauacucagcacaucccacuguggaccagccgcauuuccaaggccccgugcggcuggcggcuccguacugggcagcauggggcaggauaagcugagccuccuggcccucaggagugacaacacacaugguacagaugucugcuguguugggaugggggugccuggcagguacaucagcucuuucucucgcuguagaaagcccugggcucagagcugggagacacaguccccguuuaaacauuaacucccugaugccugcccaccucugcccugccagcacucgagcacacgaucugacuuagcgaaauaaacggagacaggcaacauuagccugugcacugcagugaccuucaccaaugucucucugugucuggauucuucucugccugaagcaaguccagagacaagcccacgagaggggcagguggauccacagguuaccggagaugccacagcuguagggugggccacauugagcuccuccuucugcaggcagaggugugucccccucaucacccuccaucaggaccccccucaaacuguucucuggccacuuucaggcacacagcucuccacuggcaaggaccuguuauuaaacaaaugaccaaaagaacauuccacagaggaggccucaggccccacacgucccucaggaccgaccagcccagugccaggccaaggcgcugcccacugacagacaggcaggcuccccaggggacagaaaccagcccagcuggccagcaacccugaccuuggccucacgagcuccugcaccagugaacccagaauaaacugaggcccucccgccccagacucagcgcauugcucaggaacccaggccagccucugcccuccauuagaaccagccagcacuggaggcaacuccagaagaugagcaccucagccggcacuccccggguccucgugggaccccacucggcacccccacagcccucaggacaccucacaccucucccugcucagauccacauucuaagagcgcccccggcuuggcccacguggccagcaaggucguccuggaggaaaaccagccccagcacaagcuccaggcucuaaagccacugugagcagccuugcuucccuccuggccuguuccaggaaagcuucugacauguuucuccgagagaaguuaugcaaugaaggaaugacaggggagggaggggcaggcucucccccaggcaggaacacaggcugcaggccaaccuccuaugacuucuggagcccagucccccacaaggccccauccucccaaaagucccucuaggaggucaucagagccaaacagggcccuccugugggcagucacucggcuucugcccagauggacaccaggagguuaaaaaaagcaaaacaucaaacaacuuccaacaaacagggcccuuccuagcaggcugggugaaaagugcuuaagggcaggggugaguaaguaaaguuccuuggggcuuuggcuuuaccugccagaaacuaggccuguuuacagagaagggcucgggggaguuucucuaccagcaagggguaaagauacagcuaaacagcagcaaacuauaaaccaggcgcugcgcuaagcccagcuuuuacugaggcauccaacaauccucaucuaauagacaagaaauccccacagaaaaugcagcagcccaggaggcuucccuuugcuucaagguguuccugaauccccaguguucagucuuucucuaucaccaccuggcauccuccagcugcccccagccucaggggaggacagggggccuggggagggggcugcagcccccagcauggcaggaaggggcacgggaaggcgagaggaguuccuagcggcugcucucacagguucucaggaucugucccucuguucccagaacuggacuggugggggaagggaagcccuauagccccucuggggccuaauuacagagccuggccaggcucagacuuccacacacaccacagaggccugggcucuagucccagggaugucacaaauaaccauauggcccugggccauaugcuucuucuuggcucagcuuccucaucuguaacaggagagaauaagaaccucucucaucuccaacacagagcuccugaaauacacagaaaagccccuuuccaaggaggcuccugagaaggcaaaaaacuacacucccgcaccccugcugagggugcagaacucuuggaucuagaacacaucuauccugcugcaaaguggacccagaagagcacuggcacugcaggaagcauggcgugugcccucagcaaaucaggcuggcgucacugccugccacuugucgcuggccuuguaugcagcccugucaacaaaggggcaucaugccagcagguuagggcacacagugcuguugcaggggguccugaaggucccagccaaaggguccaacagcauugcugcugugggauggcucucaaggccacagcaagccacagccaggucucgaaccguguccagaaaccaagugauacugugagucuuucacaaaacuaaguuauuccauuuauucuccucugucuuaaagcacguacuuuauacuuuugcacuguuaaaauguccuuuugaaaagauaaauaaagugaugguauaaaguggugcuuuguuuuaaauguccuuacaugcaaaauuuuaaaaauaaccaccccaagcccauucacccaauguuuguuuuaaauuuuaccacugagaugagggacacaaaaguuuggggggauggggcacaauggucccagagagagcuuugcugcugguguauuaacaguauccgaaguguacuggcaucuuugggaaauuaagcaacaagagccaacagccuaagcaaugccuguuuucuaacauaagagaguuaccuuaccucuuaggaaacccaauagagucucauaagcuauauuuaaaagcaaaguauuuuucugggaguaagggacccccaaccuuuuaccuuuuaaaaauaauaggauacccaaagguccauucccucuacucuucauuccuggcccacugaccugcuuuuucucauaugagcaucuccuuguuuucacaggucaaauuucaaaauccuuucuacacagaaucaaauaauauuauugcuuccucuuucuuuacuuuuuguuuccugucuuccucucuccccuuuuccucucuccccuucugccuuaaugauguggauuguaaguuccugugugaaggccccaggaaccaccacagagcuaugcacaaagcagugcucaacuccuucuggcaagucuucucuagugccuccucuauccauuaaagucucacuucuguagguguccauuucucaauguauagguacagaggagauaagucaucuccucuaaaccugcaagacugaaggauaaauggaaaaaggcauggaaaauacagaaaagagcaaaggagacacaggggacagagggaaaagaucuaacauauguguaauuggagucccagaaagagaggagagaauaguacagauacaguauuugaagaaaugaucaaaauuuuccaaaacugauggaagccacaguucaagaugcucuguaaaccccaagcagaauaaauacaaagcaaaccacacucaagcaugucacagucaaacugcuagagaacaaaaacaaaaaggaaaucguaaaagcagccagagaaaagaaauaagacauaacuuucaaagaagcagcaauauaacugauagccacauuuucaaaaaaacaaucaaaguaagaaaacaauagaggaauauuauuaaagugaucaaaggaaacacauuuucaacaucgaauauucuacccagcaaaaauaccuuaaaaaaauaaaguaugaugauauauucucuuuuuucuuuuuuuucuuuuucuuuuugagauggagcugucauccaggcuggagugcaacgccgccaucuuggcucacugcaaccuccaccuccccaguucaagugauucuccugccucagccucccaaguagcugggauuacagguacccaccaccacgcccagcuaacuuuuuguacuuuuaguagagaugggguuucaccguguuagccaggaucgucucgaucucuugaccucaugauccacccacccugaccucccaaagugcugggauuacaggcaugagccaccgugcccagcuauaaugacauuuucaaaaaaauaaaaacuaggucgggugugguggcucaugccuguaaucccagcacuuugggaggcagagguggguggaucaccugaggucaggaguucgagaucagccuggccaacauggcaaaaccccaucucugcuaaaaauacaaaaauuagcugggugugguggcaugcaccuguaaucccagcuacucaggaggcugaggcaggagaaucaccugaacccgggaggcagagguugcagugagucgagaucacgccauugcacuccagccugggugacaagagcaaaacuucaucucaaaaaauaaaucaauaaaaaauaaauaaaaacuaaaagaauucaugauuaacagacuacacuguaagagagaggagaguuccucagagaaaaagaaaauuauaccaaauaaaauuauagaaaugcaggaagaaagaaacacaaaaaagggcaaauauguggguaaaucuaaauucauaugggcuguacaaagaaauaauucuugugguguuuaauauaucuuaauaucuaaaaaguguucuaagguauuagcaucauuggagaaguaguaaaaauaaucacuuauuuuuauauuguaauaagucaagaugcgugcuguaaucucaagagugaucaccaaaagaaccguaaaggaauguaaaacauaagagcuaacaaagagagaacaugcacggucacgcaucauguaacauuucagucaacggacugcauauacgacagugauagauuguaucauauuuuuacuauaccuuuucuauguuuagguacacaaauaccguuguauuacaguuaucuacuguauucaguacaguaacauguuguaaagguuuguagccuaggagcaacaggcuaugccauacagccuaggcauguagcaggcuauaccaucuagguuuguguaaguacacucuaugauguucacacaaugaugaaacugccuaacgacacauuucucggacugaauccuuguuaagacacacaugagggccaggugcgguggcucaugccuuuaaucccagcacuuuggaagguugaggcagguggaucacuugaggccaggaguucaagaacagccuggccaacauggcaaaacccugucuccgcuaaaacuacaaaaauuagccgggcauggcagcacacaccuguaauuccagcuauucgaguggcugaggcaugggaauugccugagguugcugugagccgagaucacgccgcugcacuccagccugggugaccgagcgagacugucuccaaaaaaaaagagagacgcaugacuauaauuuuaaguccuugauuaauuuaaaagaaggcaaaacaggugagaaaaagggggacauaacagacaggucaaauaguaaacaaacaaaaacuaagguaguagauauaaacuccaauacauccacaauugcauuuaaauguaaauggacuaaauauucucauuguaagauuaucagucuacacuuaaaacacacaaaaaaccaacuauauaugcugcucauagauaugcauuaaacauaaggacauuuuaaaaguugaaaguacaggggaaaaaaaaaagguaacaugcaaacauuacccaaaacaaagcuggaauguagcuauaguaauaucagacaaugaggacuuucacagagaugaaaagaggcauaacauaagaaugaagggucaaucccuaggaggauauaagaagaauucuaaaucuggccgggcgcgguggcucacgccuguaauccuagcacuuuaggaggccgaggcgggcggaucaugaggucaggagaucgagacuuaucacgcacguguagucucagcuacucgggaggcugaggcaggagaaucacuugaacccaggaggcagaaguugcagugagccaagauugugccacugcacuccagccugggcgacagagcaagacucugucucaaacaaaaaaaaagaauucugaaucuguaggcaacaaauaacauagcuucaaaccauauaaagcacaagucaauagacuaaaaguagguaaauccacaaucauagcagacuuuuuaaugccucucucgauagcuuauugaauaagcaaaccaaaaucacuuaaaaaucugaucaauaugaauaauaaaccagacuagauagacggaucacugcacucaacaugaauuauuuucagguaaacauggaacauuuaccaaaauauucccauuuggaaucaacggcaagacccuuauuuuacaaaagagaaaaccacgguagagcccaaggucacacuggaagcacaguuguaaucaaaggacagcuauuaugaugaacuaaaguucaguucugaccccauauccaauauaugacccuuucuuucacaccacucuuuaagaaaaucuaauauccacagaucauccugcccauagcaucacagucauaaugucccauagccaaauuggacuuaggacucaugccccgcccccauuucagcaucaaaaugagccccuggaauuggaaaguccuugacuuccacuucuauauagcugaauaccuacugccaaccucgcugaaaacccgucugggucccugcagcagcccuaccucccugagaccuagagcaaucccuuuccuucauaaccccguguaaaaacuuccuaaagucugucagucugcaccugaaaaacaccuuuccuccaugaagggaagaaaggcuagagguauuuucuaggagaacaaagcgcaacagugcaacuacaaacuguuuggaugaugacccaccaguaagcuauauauuucacauuguagugaagaacauacuuaaauaguauguaugucucugaaacuaaaauaucuugccauguguauaguucauuguaaggauguacgauauuaauucuaaucuuuucuauugaauuccauucuguuuaacuuguuuuuugagacagagucucacucugucgcccccacuggagugcaguggcgcaaucucagcucacugcaaccucucccuccugggcucaagcaauucuugugccucagccucccgaguagcugggauuacagucacaugccaccacaccuagcuaauuuuuguauuuuuuuaguaggaauugggguuucaccauguuggccaggcuggucucaaacuccugaccucaggugauucucccaccucggccucccaaagugcugagauuacaguuaacuuguuuuuuauaugcugauccugaugcauuaaauuaauuucacaguuacuaaagggucauaaccuacaguuugaaagguucaacugggugagccagaaggcccagaauuccccacuagggccagaacggcacguucuuuccugaccuggcuucucuuugcucccauccugccaucuccaagccugaaacaucaucugucaauugcuugggcaacaacaugagcaucucugaaucauagcugugggcaauccuccagcacacagacacccacagauggcuccguacaucaggcaggugucagcaaaggcuccagaggcuucugaugcuacaaagcacccaagacuagggcuucaacuccacuaacccaggcucccucuggcuacccauaaucccccacccucugaggagagcucucuaccuuuuucuuccuacacaucuuccuauauauaaccccuuccacaucagucucugucuuccuuaacccgucacccaaaagggucugacuacugccuccuucgccaggacuucguggugcuccaccagauucuaauucaccaucaagacuuucauucugaccacuuuucccuaacagccugcauuagcucuaccgcuucuccccaccccacaaagacuccgaagugaggacugcaccaguccugaaacacgucaaacucagccuuccagggacaggcucaccaagagucuagagugaaaggaagagggaggggacagagaaaagguaccgaugugaaaacaggguagcuccugcccucaauaucauggggaaagaagacagccuccauucaauauuuuaauaagaaauaauacauguuacccaaugacaagccaaugugcaaagcaaguaacaugccaagucuuccaggggauaaggaccacuagaggccaccaaggcagugauucucaaacucauucugacagcagaacucagggaggugugauauucuaugagggacugcuugaaauguuaccccaggaaaaggaaauaagcaaauacucuuggcugucacauagaugacacuucauacuaaauuccugaauggcuaaguacaguggaugccaaauauuaagguaaaaauuaugaaagaaaaccuuacugcugagaaaauucuauccaguuaaccaagucugcucagcaccuuggagaggggggccagccaucauucaaugucagaacccacacacauuacgcagcucccagaauaccaggcucucggggagcacaguacgugagccucugcccagaaccagucuugaacaaguaggaugggguuuccaaaagagaauaggcaggagcggaggaacagcauguaugauggaugguguaugggaggaaaaacauaaaccagcaaagagacaggcagacccaugagagugcaucuccaugccccacccagcaccagcaccaucauggaccacucagaccucugcugccuacagcccuggaacuaaccacucacccaaggucaggguccaaaucaagccaccaaaacuguggcuuccauuaauuauaucaccuggagaaccuacugaggacagcugaguguuaaagaaaugcaaucccaguaacuaacuuagaguguaccacagcaaaggagauggcacuuuaacaggaacaucugggccagcgcauuagcagcagcaugacaaacaugaugccaucaaagcagacacaacugcuauaaaccuucacuauaaaaucacccuucaacuucuauaaaaagagcgcauguguacugggcacaaugacaacucaaccccccaaaguacagacaaacggcuuuaaacagcagcagcuggaggccauggcaucuugucacuccacucaugagccgcaggccuguggggacccagcaaaugggcucccuaaaugucuggucccagggggaaagaaagcccugcugaguugcugaacagccccagggaagagcuuuuccucacugcccagccuccuuccugagaggccuccaaagcagccgacugguagugaaccugaggcaggggugaaacagagaugcugcagacaccgccuccaggcgaggccugccgggcaauccaaacucagcuccuggcacagcaucggcccuguaccaacccgcaggggagagccaggcagagcuggaauccaguaacugaaucauccucccaugaaaaacuccagcuccccaaaagcucaugcaggggcggccaccgccaccugcucccccaacgcccuccccgggauauugcuggguccccaccuccaugcaggccgcagcguggugcccaggcagggcaggugaggcaguccaggggcacacagccaccuuaccuccgaaguuggccagccggccaauccucgucacaggcaccuuccgcucccgggcaugcucgcugagcuggagggagacgagaaagagaccuguggaaucagccaaggggacaggaccaaccuucagaggcuccuguugcccccacaucuccucuccaccccacagucagcagcuccgccugacagcacacuccaccaagagaaggccaccacgcuccuaaaaaccccagaccacagcacccaggaaaagucccuagagcagagcccaaggccaucacugcuguggguggcagcuaccucggcccuccaggggccucccauacgcaccgucuguuugugcugcuuguucucggggcgagccuuagccugccgggccuucucaauguccucggcugugaggcccccaacaggggauugguccugguggaagaaccuucgcugaaagcccauggcagagaaugagucucugggguuugcaaagagccucccguuggcccugcccagaggggaggaggccuggccggggaacccggcuucucuaaaggguccacuggccacguaggcaggagcugggcccucgcugugggcaugacccagggaugggggcgcugacuggucgggagcggaggcugaagagaagucuguggaggcuccggcugcaugcgggacugagaaguggaacuccccuucugggccgccgaaguucucagcaaaauauucuucauguuuauccugacccugcagggagcaaaggccagcauuaggagagcaagagcgagccaggagcuccucccugccuguccccugcugcccaggacagcacaccaccagcaucccgcccccucccaccuccagagguggcacagugcugcaccugaggcccggcacccuucccagccugggagccgggaccugggcuccagcccugcuucuguuggggcucugcugugugguccuaggugggacacugagcaccuacugugugcccagccggggccaggccaagugcacacuacgcccgcagcggguuccucaccuauaaaacagggccaagaaggccuccagggcuuuggagaugguaaaccagggcgcaaaagacagggaaagcucugagaggugaacacacagccuaaggccagcaaggggugagggaagcacaccgacgggcccaccuaagcccacagcuuacugcagacauggaugccacccaccagccgggguaugcauguaagagauccucacuggagaggugguuacaaccaggaccaggccuggccgucccuaagagcucaggguacagggaaauggaggggcaggggagaggauacgccauguuuucuuugugauggucaccaaggccugagcuucgggcccagguccuuucugcuucugaaccaggagugaccuugagugagcuccugacccuucucugcuacuuccucaucugaaaauagggcuccucacagucacaguuacuggaggccacagacagggccaggaaacagcacccaggagccuauaauuagaacagcaccggcuucuagagggagaccaguggccuggauucucggcuucaacugaaacaaaugaaaugcgcaggguaugcagacagcaggauacccaagccucacguucugcugucuaagaugucacaggaugggagggaggagagagacaggcuguuacacucauuucaaaaacaggaaacugaggcaaagacggcugaugugcuggugaaggucaccaggcagcaaaugacagagccgggauccaacacccaggcuggcccugcuggcuguggcacuacucucagaguagaaacaaguuguauuuaugccagugcgauggcucacaccuguaaucccagcacuuugggaggaugaagcaggcagaucaccugaggucaggaguucgagaccagccuggccaacauggcgaaaccccaucucuacuaaaaauacaaaaauuagccaggcgugguggcaggcaccuguaaucccagcuacucaggaggcugaggcaggagaaucgcuugaaccugggaggcggagguugcagugagcagagauugcgccacugcacucuagccugagcaauggagcaagacuccaucucaaaaaaauaaaaaauaaaaaaccacagaagucauauuuaaauucacagagcccccagggaaggcuugacagugagggagccugggcagggcccuccuucugccccaucacucccaugaugguccccuggcccugugcuacuaacaccugucggugucacuguggaagcccaaggccaguggggggguccccagggccccgaagggacccggacucaguaaguaucugcugaaugaauguggaagcaaccuugaggggcuggagggagacaggauccuggaguccgugaccuuccuccccucgcgagaagggagacacggaaaagcgaagcacugagggagugaauggcagcgcacugcgggcagccacccugcuccggugccuacccugcucccgugccuccugggugguguggcucgucacucagcccuaccuccgagugacugauggggaagcccugccccuuccagacaugcuuugggagcagaggguuggagagugcccgaguaggaggcccugcucgccauuagggcuaaggccuguccaggcugucccacuccugggcaggcccaagugagcugggcaaccucacuuucugagugucccacaggcaaaacacccaagagcgaggccgaggccccacacucaggcaccaaaucaggcaaggggagggcaagagcauggaguccaggcugggaggggacaagaauucugguccugucacucguuaugaguccugcagcaaauugcuucaccucaguuuccucaucugagaaaugggugugaugguccaggcuggcccccaucccaggacaguggugaggcucgggggagagcacaggugugaggacuucugaacauuaaaggcagguaugcuuggugacagccacuguaucacugugggauccucccagagcggcagggaagggccugcagguccuaaaccugagacugagaugccugggggcugcgacggccucacagccugcaggagggcggugaccuuuguccagaaaucagccauccacagaacagacguggaaggagagaagcugcgacacaaccuccaaugcacacaugccuaagcgcacacacacaggugcacacgcgcaacaggcacacaaacaccccccacccugucuccuugacugucagggaagcugcuggcaacugugcaaggugacgccauggugggccgugcucugcuguagccagcccugucuauagucaccucuccagcacacgauuucacugaaaaucaccccuuggagguaagacaucaaggcuuccuggaccuuggcacaaaaggucaucuccuccccuagauggcacagggaugagagagaggcuggagaugaagcuguucuuggaagggcugugccagcugccaccaaggaaaggagggcccccagucaggagugcagagacccucagcaaacugaaggagaaaaaugaggccaggccuuggcggaggcucagcaggcucagugggaagggccuucgaaggcugagccaggcugauggacacaugggccccaguaaaaacugcauugugugucuccaaagugcacacacugaaaccuagccccuagugugauaguauugggagguggggccuuugggaaguaauuaagucaugagaaugaagcccuccucaaugggauuggugcccucauaacacaggcccuagagagcagccuugcccuccuccugccccaugaggacacagugagaagauggccaucuauggauuaggaaacaggcccucaccagacacugaaucuucuggcaccuuaauauuggacuuuccagucuuuagaacuuugagaaauaagcgugcauuguuuaagccaccagucuauggaauucuguuauaguugccacagccucacacaggggcccugucccacccuggaaggaccgugggacacauuagcuggugggcccucaggcccuggccaccaaagaccaguugccauggucacagcccuuggucucccccagagcuccaggucccacccucuuccugccagcaccccucccacugccaggcccccuuaccugcaccuuccccaagaacaugccaaucugcuccacagccguggacugcagggcccuggccgccaugaucagcuccccuccgaugcccaagugcugcagguggguuuccacggccgccugggucagcuugacaaggccuuuagccaccaugauggugucucccaauauggcagccauccuucagggcuggaagagaggaggccaagucaggggaggccccaggccucugcaggccaaacccacacuaccaacuccacaccaaacucugagcagaagguccagagggcugguuuuuccacugaucuccccuucugcuaagagauaagaaagggcccagggcucaagggaggcuccacgugacucuggacacuccaggggaauggagcagaauaaaggccguugagucaguggugcggugugcuugcugcuucccacacauuuccucaccugggccucacaagcacccuacggaaaaccugaggcacagacagguggcgugauucaugauucgcagcagaaccaggacuugagucaggcgcacagacucccagucuaggguucaucccucuggaccaaaacugccuguugggagaggagcauccaauucccaaagaacuucccugcaagguccaagggaccacucacggcauuggugcuccaacccaaacccacaggggcugaggcugccugucccugcccagccaccauugcucugcccagugaggccugugacggauauccauagaccaagggacaaccagagccccucccugaccccucagggucagcccacccucagcuucaacuauucaccaaaccaauguuuucaaacugcaguccagacccacagugcaauaauuuggaagauccuaaccaccauucaaaagaaaugaacaaccaccaccaccaccaagcaccacuaccaccaccaccaccaccaccaccaucaccaccgccacugccgccaccaccaccaccaagcaccaccaccaccaccaaguaccauugacaccaccaccaaguacaaccaccaccaccaagcaccaccaccaccaccaagcaccaccaccaccaccaaguaccacugccaccaccaccaaguacugccaccaccaccaaguaccaccaaguaccaccaccaaguaccaccgccaccaccaaguaccaccacugacaccaccaaguaccaccaccaccaccaagcaccaccaccaccaccaccaaguaccacugauaccaccaccaaguaccgccaccaccaccaaguaccaccaccaaguaccaccgccaccaaguaccaccaccaccaccaccaaggaccaccaccaccaaguaccaucaccaccaccaccaccaccaaguaccaccaccacaaguaccaucaccaccaccaccaccaaguaccaccacuaccaccaaguaccaccaccaccaaguaccacuaccaccaccaccaccaaguaccaucaccaccaccaccaccaaguaccaccacuaccaccaaguaccaccaccaccaaguaccacuaccaccaccaccaccaagcaccaacaccaccaccaagcaccaacaccaccaagcacuaccacaugaugcagaaucaaaaaggaagcaucaaggagcacuguggguagcuuucuuaguucacuuguccuacuuucaaaguggcaaauauauaagccaucuaaaaaaguacacacugaacaguacuugguugugucuuucuuccuaccuaaacaguugcauccuacauacccagugaacucccaacuggugccaagccccacccuagacaguggcgccagagccaggaagcagagauggugagcacccacuccgcuggaaggagggcccaauaggggaaauaccccauagauaugugguccugcauacugggaugcaaaaccuguucuucucaaaucaauaaacacagacugcuaauaaacagaugcugcuaauaaacacagucugucauuugugagcagacuaacauguagacucauuucaaaaccacagccuguacccaccccccuuugacaaauaucgcugaccuacuguuuaggggccacacccacaccuccccuuaccaugcaaagugaacccuucacaccucaucaacaucagguacuuuuuuuuuuuuuaagagaggggucucacuauguugcccgggcuggagugucaaggcuguucacaggcauaaucauggcacccuacagccucaaauuccaaggcucaacugauccucccaccucaggcucucaagcagcuggaauuacaggccugcaccaccaugccagcuuaagaccagguauuuuucugcaagggagucuacgcucucacagaaguagaaaggagggaaggggaauaacuaccagaaggaaacaucuguccagaacuuuucucaccuucuguuuucaaaacuuaggucuuaaaauccuacuucuaaugcaccacaaucccaaagugccucauaauucaacgaucccacaauuucgcugcaaaucccuuccagggguguaccaagaaccaggcacacagcuacaccaggagguauuuucaucaugauuuuaaagaaauaaaagcccucaaaccauguaauacacaaguuaaaaauccuaucagcaccgugacuucaucugcaaguaccaggcccucgcuaggaacaccagucucccaccuacccuacuucuuccugcugcuccaugagcacguuuugggggucucgccugugaguaacugaaaugaaguguuugggcucugugccuccuugguacagcagccuccugaaggccuccgugugccugccugcucuccucugaggaggggcagccaaaagagugaccauaaaugauaaagcagugggggugggagacaggugcucauguuugggaguguccacuagccaggcaugaaaccaaaauaaaaagucaaccggagguuccuucaacacaaguucacugaccucucccagggcucugggcuaguuccugcaggccccgaugaaccugcccuggcccagggcucauggcagcguggcaugcccguaccucuauaaugggcacagacaccagggagacagcuaggggccaacugaugcugacacgccaggaucggaggcagaguggaagcgacgaccuggagccgggacgugagacuccaggcccauacccaccagcugccgcugcccagcguguggcucaaccucuuccccccuccucaguagcucaguacggaagggcucugggugccucaucagaccccuuuucugguccuaaugugcuaaccugcucuaacgggcuuuugugggguugauagucuuuuuuauuuauuuggguggcaugacgguuauuuuuggcuauacuauggcgauggcuacugaggaguauccugaaacaugaggaucaaauauugacaucugaggggcuuuauuauuaggacuauuaauggaguugaugcugguucggugacuaguugagcacgauggaguugggaucacgauuaaaguaaauaaaugucuuuauugaagugucuagagagaaaaagaaccgugauaaaugcagcuucccaaccccacggacagggguuaggaaagcugcacaaggcuguguucccaccacaggaggguguuuucuggccaaacuuucacucucugaccuuucagggacaccgucucacucaugcuggagacaaggcuccgacucggggauccugaccugcacacgagcuggaaauuauuugggucauggggaccuucaaaucuagucuccaaaaccaaaagacacccccacgggcugucuaaccggccagauacaagaagauauaucaauaggaaaaugaguuguguccuuuuuaaaaaugaauucaacagucaauccugacagacggcagaugagauuaucacacacuguccacucaggacccaccagaaggaaggaauuuuacucugaggaucccuuauacacuccaaguccccccuucacagccaaaacucacugucugucacucaucuccucuaugacagcaggccagggacgucaucugcauuaccaagccacuguucaaucuccuccguaaauacagagcacagcauuauaaaccagcuccuccccagcaaagcauggugucuguucuaaaagccaaggacccacuguccugaagucucuugcagucauaucugccaccaaagccuagacaugacugguauaagaagcuagaagcaaguggcacaaaaagccuuucuucugggcaaagugugaaccagggaggugggggggggggggcagggagagugugaaucugggagaguaggagccagggagagugugaacuagggagagugugaaccagggagaguaggagccagggagagcgggagucagggagagcagaagccagggagagcggaagccagggagagcaggagccagggaaagugugaaccagggagagugagagccagggagagugugaaccagggaguggcagccagggagagugugaaucagggagagugggagccagggagagugugaacgagggaguggcagccagggagagugugaaccagggaguggcagccagggagaguggcagccagggagagugugaaccagggagagugagagccagggagagugugaaccagggagugggagccagggagagugugaaccagggagagugggagccagggagagugugaaccagggagagugagagccagggagagugugaaccagggaguggcagccagggagagugugaacgagggagagugggagccagggagagugugaaccagggaguggcagccagggagagugugaaccagggaguggcagccagggagagugugaaccagggagagugggagccagggagagugugaaccagggaguggcagccagggagaguggcagccagggagagugugaaccagggagagugagagccagggagagugugaaccagggagugggagccagggagagugugaaccagggagagugggagccagggagagugugaaccagggagugggagccagggagagugugaaccagggagagugggagccagggagagugugaaccagggaguggcagccagggagaguggcagccagggagagugugaaucagggagagcgggaaccagggagaaugggaaccagggagagugugaaccacggagagugggaaccagggagagugggagccagggagagugugaaccagggagagugagagccagggagagugugaaccagggagaguggaagccagggagagugugaaccagggagagugggagccagggagagugugaaccagggaguggcagccagggagaguggcagccagggagagugugaaucagggagagcgggaaccagggagagugugaaccagggagaaugggaaccagggagagugugaaccagggagagugagagccagggagagugugaaccagggagagugggaaccagggagagugggagccagggagagugagagccagggagagugugaaccagggagagugggagccagggagagugugaaccagggaguggcagccagggagagugugaaucagggagagcgggaaccagggagaaugggaaccagggagagugugaaccagggaguggcagccagggagaguggcagccagggagagugugaaccagggagagugagagccagggagagugugaaccagggagugggagccagggagagugugaaccagggagagugggagccagggagagugugaaccagggagugggagccagggagagugugaaccagggagagugggagccagggagagugugaaccagggagugggagccagggagagugggagccagggagagcgggaaccagggagaaugggaaccagggagagugggagccagggagaaugggagccagggagagugugaaccagggagugacagccagggagagugugaacccagggagugggagccagggagagugugaaccagggagagugggagccagggagagugugaaccagggaguggcagccagagagaguggcagccagggagaguaggagccagggagaguggcagccaaggagagugugaaccagggagaguggcagccagggagaguggcagccagggagagugggagccagggagagugggagccagggagagugaaccaggaaaagcgggagccagggagagugggagucagggagaguccacgcugagaagccuuccccagggcagcugucugcugcaagccuagcaccccaaccaccuauagguaccuccuauaggaaguacgucccaaacugaccuuaccacccacaccucauccucccagggcucccacccugaggaauguggccaccauacgcuucuuucaagccuccucccuugcccucaagcaucugauauucccacugggugaugcagcaaccguucaccauggcucugcccuucccuccacugccuuuagguuccagccaggccaacccacuccuggaaccagagaggcuuccuccugcaggccugugcagagggggcacaccuccucuccuccucccggaucucagcaccaacaucaccucuucugggaaggcuuccccaacaugccucccagcacccugugcccauccccuccagcacagcagugaccacuuccugaaucugccuaacucucuccccagucggauaucagccacaggacaaggacuacaaggaccaucagccauaggacaaggaccacaucugucuuccucucuccagcaccgaacaccaugcucaggauugagcagacaggucauuaauauuugccaaaggaaaugaacucagcuggucccuccaaaguuugagaaagccugcuauucucuggcuggcucacacuugcuggcaacuuuuacuccacauacagaaucaagggccucucaggaggcuggucugaggcacugguccucaagcugcugcgaacgucucaaucaccuuaagacgaguccagagugcugggccacaccccuaaggguuccgucucagcaggucugggguggggcccgggaaucugcaucucuaacaaguucccaggugcugcugacacugcaggucccaggaacuuacuuugagaaccccgguucuggaggaagagagggaaggggagcagagguggcccaugccuauggccaggcaggaugccuccacagagacccuuuccuaagagucucccccugaaacccucuucccaagagucuggcuuugcccuuaggcggaagucuuccaccugccccuucuuuuuccauuauucuucaagaaacagaaaaaggaaaucaaaagugaaugagcuuagagaccgugacccacagagcagaccuccaaaggcucucaagacugucaauucaaggaugcuuuggcaaggacuguuuaaugauauucaggauacccugaggggcuggcaguggccuucugccccccucccagccaggaacugucuuuucacuuugggcaugaacauucucaauuucuagccugugugggcacugaaacauuccuuuacguccuugaaauuuuuccuuuuuuacucuuagaaaaagaaaacaauugacuguuuccuccaaggacucacaagaauguauguguuggggcaaagacuucaaacuucugaaccaaacuccaugagucucuuuagauguaaccuucaccucagucuuuaugaucacacaccagggagcaucacucaaacaucucgggcaacucccggcuucuaucucgcgagguccagcuucagggucucugucaguagguccugaaauauccucaccugcuaccaguuuucaaagacaacugaacacaugaagaacccaggagaugagaaagagggaaaaaagccuccguccuucccccgucagugagccccagcacaggccugcugagugagaccuucacagcgggagcccaggagccuguacucaagagucuaccccagggcugggcucucagagcuggccccaaagagcacaucuuccaggaaguccccucuccccuucuccucaggcccugccuggcaaaaccugucaaauuacaucucccuaaaaacagaugugaacauucacuacaagaauguaaacaucacaaccuugccuaagauuaguuagcuaaacgguggaauagucauaggagggcauuccacauagucauugaaaaugacacugugggccaggcacaguggcucaugccuguaaucccagcaccuugggaggccaaggcugguggaucacgaagucaggaguucaagaccagccuaaccaacauggugaaaccccaucucuacuaaaaauacgaaaguuauccaagcgugguggcaugcgccuguaaucccagcuacucgggaggcugaagcaggaggauggcuugaaaccaggaggcggaagcugcagugagccaagaucaugccacugcacuccagccugggagacagagccagacuccaucucaaaaaauaaauaaauaaaauaaaauaacacugugaaagguguuuacugacaaauaagaaaguguauuauuauauauucccgggaaauaaaaagcaggucacaaaacuaucaucuuuccuuuuggagcaggaaaggagagaagaaagggagggaggugacaggaagcaaaaacaggaacguugcuuuucaugcaguggugggaagacaaaucuuucuuuauagaaagauuuguauauagauacagccuuuguaccuguaucuauauuuucuaaaauauucuacaaagaacaugaacuacuuuuacaauagaaaauaaauguuauaaaaauaauaucagguugggugaagcggcacacgccuguaaucccagcacuuuggaaggccaaggugggaagauugcuugaagccaggaguuuaagaccaacccgggaaacacagggacauccccaucucuacaaacaaaaaaauuagccaggcguggugcugcaccuguagucccagcuacucagaaggcugaggugggaggaucgcuugagcccagggauuugaggcugcagugagcuaugaucacacgacugcacuccagccuggguaacagagcaagaagaccugucucaaaaaaaauaaaauaaaagauaaauaaaauaaaaauaaucuuaaauaucuuuuauuaaaauuuuaaaaaguaagcaagcacacaaauguauuccccauccccuaagugcuuguccauagcagaacgggcaaggguuaggcagcagauuggaauggcauaaacauugccucuccuuguuuagccacuguccuucaucagaagacaacugcuccuaacaggccaccaggcggauggaaaguggcaccuccaauuuggagagagaggcucaacugcccuucucgggacaguggggaaaaaaaucacuuggaacaagcagcgggucugccugccuucccuaauguuggccucuggguuaaaagacggaaauaaugaaagggugcuuacccccgauccucaaaaaaacaggauccuaguuuagaacuggguaguaggugcagugaccacaucuuuugcaacaaaaauuaagacacauaauuaguguccuuccagggcagggguuagcaaaccaugguccucaagccaaauccaguccuacugcuugcuuuuuugucaauaaaguuuuauuggaacacagccugcucacccauuuauagauuacguauagcucauucguuuacauauguauugucccuagcugcuuucuuuuuuuuuucuuuuuuggcuacaacagcaaaguucagcaguugcaagaaagaucuaugacccauaaagcccaaaauauuuacuauuugucgacucauauucuagggcaagaguaaaaaccacagcugucccaggaaauuuggaaggucaccagaguugaaugagaacaccccaauaaggcucguguuggggcaaggacccccccauuauaguucugcuccugacccugagaaaugggcucaccucgccagacacagagcugcccaacacccacaggcccccaggugaagccagagaaaggcaagccaccugguacuguauuauccaggccaggguggccccuaaguacugcucaugaagggacaggccuggggggcugggagggguuguccaaugccaacuuucuguacagcucuccucccuccuccugucgcuucaggaggcucacagccuaacugcagacacccgcauuccccuccacguuguugguccacggcuugggcuugggcugauauaaaaucauccaccaucuaaucauuccuucaucccuccacuuucucagccuccuuuacaagaacccccuugcaaggcaagcacugacguggguguggggucaggggguggucaggggagacacagaggcagacagggacgcacgcugcugccuccaccccaugccccacauagagucccuucugacugcagggcguugguggccuccuggugagccacauacgcuggccugucugccccggcagagaggucugagcucaccauggcccucacacaggucuguacccacagccucuggaugucccagugggucaugccuuguaagaaagggaguuuccagggcucaacuugccuucuaggcuaaggacuucaaguucccuugaaaguugcucccagacuacugggguuuuucuuugaacuguuuaaaaauuauacauucuugugcuaauaacauaaacaagagcuuguugaaagcaggcacugaaucccauacugcuaauuuuuucuuaaaaaaaaaagcaagcaacuaggcacugacauucucccccaugaaugaaaccaguuucacagauguuuucauuuugugagcagcagaaccagcccaccaugccaaugauaacuacagcugcuuuugcuggguuuaguauaugccaggcucugggcucaguguucuacuuagcacaaagauguauuaacucaaucauuuucaaaagguaaauuaugcccauuuuacagaugagggugcuaaggcacagagugguuaaguaauuugcccgaagucacacagcuuuuaagaaguaaagcugggaccuggauccaucauggcucaggagcuaggcaaccuguuuaacagguaagaggagaaaaagagcaaaacaguguguuuuugaugucccaggcugcaaaccuccauucuccauccauuggaagauuaagauauucuuaggauucccugggugaguugcccuguggugagcacuggguugggagcugggcaggguugggggugauauaaaagcagcagaaggcaaaguuccagccucugaugauaguccagagaaggacccaacacugugagcgaaccugcaugggcucagagcuccaaccacaggcaggcaacagagggucccaagcagccucucccacucugugaguugauauagccgaugacacacaaggcuuuuaaaggccaaccagccaagcgcaagguccugauggcaauuuaguuuucugacuaaaaaccuagugaaguuuacugcuuaaaacauuuaaauuaaaauauuuggcucaggaagugauacuggugacaugguuaagaugcucugagguuaggugaucuggguucacaucaugacucugccacugacuugcuagugugaccuaaaucaagucaugugagcuuaucuuugugccucaguuuccucaucuguucuugaaaggacuggauaaauccauguaacagcauucaggacauauaguaggugcuuaaaaaccauuagcuaaugccauuauuauuaguaguaguauugcaagcacacagacauucuggaaugaaguucagacuuggugagaccaacgguuagggugaaugggaucagucuggauaacccgcaguuguuccugccaggcacagucucauaccugaguugggaggaaggcugggcuggggaggaccagugugguuuauuuagugcugugguaugaggcaucauucaggagaggcaguccaaagugcuggcagccugcuucgaaaccagggacacaaauguccacugguauuccuuaccacuucaccuuaaaggagaaaacagcaugggaggcuuuuguccagguacauucagggagaggcaguugggaagaaaaccccucuaacucccacaagcuccccagcuccgagccauggaacacucuccugccagauuccucucccuauaaaaaaacccacguucaucaugccaacgcguugcucaaauggcuccucuaccuguagacauguauguagacauauauauaaaacccaaacuccugcgccugaagucccaggcaucgaaaucaggcccccggccuccuuuccagccuccagcuacgcgcgagccaugugagcgcacuccacucugcagguccuacuuucucaggcaggcccgcucgccccuucaucucuguacgucugaaaacccacccauuagccaagggugagggccuuggggccuuggggcugggaaucagcucugcccugaccagcugggcugcuccaggcauauucucgaaccaucucugaccuguuuccucuccucgaaaugaugguauaaguuauuauauuguccaauauaaauggagggguggguggauauacuuugaaauguguuaaagcaccauauaaauucaagaacguauuccuauucaggcccuugauucccagcucuuccauauuuacguucuccugacagcugaucuaacuugcuggucagauuccuacauuguaaguuacucuucuucuugcacauggaccucucuucucuucaaacuauaagcuccuugugggaggcucuugucucagacaacucugacucuucccacuccacccacacacacagagugauccacccacacaaauuacaagcgcaagcguugacugaauucacgaaccacugccacccaggaagguaauuaaggauccuaaaguugagguugaaggguuucuuucaacguuucuuucagacgcuuacaggguugucuuuaaaucuggccaaaauacuguggguggcugugguaggcugaauaauggugucucaaagauacccauaccacaauccccagaaccugugaauguuaccugcaaaugggacuuugcagauaugaugaagucagggauccugagaugggggauuauccaggugggcccaauguaaucacaagggcccauauaagagggaggcaggcagggcagagucagaacgaggugaugggagacagaagugaggcuggagugaugccauugugaggaagaggccacaagccaaggaaugcaggcagccucuaggcuggaaaaggcaaggggucggguccugcccuugagccuccagaaaugaaccagcccagcugauaccuugauucuagccuagugagaccaauuucagacuucuaaccuccagaacuguaagaucauacauuuaugaugcuuugagccacaaacuuugugguaauuuaucacaacagccauaggaaauuaaagcagauccuuggguuggggagaggggcuguauucuagaauaauuuccagaccauucuucuaaauuaacuuuggucacuccacaaauacuacugaaugccaaccaagugcgaggcaccaagcugggugguagacuaccccacagacagcucagugcauuccuguucuuaaugacggaguccuguugacuuucucuauauugggcccauacuacaugccaggcagauagauauauauauauauauauuuuuuugagacagggucuuacuguugccuagguuggaauucaguggcaugaucacagcucacugcagccucaaccuccccaggcacaggugauuauccugaguagcuaggacuacagguggguaccaccacaccuggcuaauuuguuuguauuuuuaguagagacaggguuucaccauguugcucaggcuggucucgaacccccgaccucaagugaucugcccaccucggccucccaaagugcugggauuauaggugugagucaccgugccuggccucgguuuuauauucuuaaucuuucaaaacacuuuuacuucagguuuaauaucucaaugaaauaggaauaauaacaagaacagcuaccauuuauuauuccccucugucugccugucacuuuauauuaccucuaguucuuacaaagaccuggugagguauuauccccacucauugauaggauaauuaaagcucaucaaggcugagcaaucuccuaagggccaaagcugugggaugcuggacccuuccacaccugucugacucaggcuccaguccuuucuucuuacugccuaggaagcugagagauagcagagaagaacacugccccaaaucaauaacuccuuuuuuguuaaaucaauagucacucaauaugagacaucagcaagguuuacauccugaaaugugucuuccugguuacagaaaauugagucauaaaaauucuggggccagcugggcucucaaaggccaucuggccaaacucccugcucuggaaaguuugucagcugccaggacugaggguaucacaauucucagcaccagugauccuacccacuagaggcaaagcuugguuccagagccaguuugaucuuaaacauaaauaguggaaagaggcagacgcccuacacugaagacugccucugggugugcaagagcuaggaggagccaucgggcacacggcccucagucuugccacacucaacaccagcaccaaccuuuauuagcaucaccuccaaaugccacacacaggccagguguggacaugcacacaucacugguauggaaguuaaauaaacauguucugcccugaggucacacacaacccuuaggcacuacauguguauguaaaaccucgauagcuuuuaaaaucacccaguuaacccagacaaggggcaauccuagacagacaacaaccacacacgcaacgagaaaugagaagaggcucagcagggugcaaggggaccacagacccaggagagguggccaucuccuugcugaucuccacucucccuggucuggccuggccagcaaggcccuucacuguggagccccagacaccucugcagcgauaccucucgcuagaugccuccgugccccaacgcuucagccagaauggacccccggccccgcccaacacccacacagguuuuccagcuuccacauccugcucccuccuccccauggaauaucauuuccccugcuggaaucuuggccacccugcuggacugguaaaccccuccauaggcaagucaucuccuuuccucuaaacucccucaucucuuaauggccuaaggucaccucgccaugcccuguaugacucugugugugccugucccauuucccuuacugcaagguaagcuccggagggaggggcccucucuuucccaguucuguacccccaacggggucuggcacuguccucauacacacgaguuuauuagcauuaugagucagugaggcaggacccaggcacccaggcuccguggcuuccugagcucccucaucgagagcccaggacugaagagaccaccgaggaggcugagcaccaggggaaccugaauccccaacaugcacagccacagaaauggcagcagcacccuguucaaaaagugauuuuuacaggagcaaaagccagaugaguuuccaagccagcuucauaaucccgcucauggugggcacacagacccagggagggagcaggggacgcagucacugcuacugcuuccucugcgucacccccgucccugucuaagacugagggaaaagaggaggggcugaagccagcaggcagcuguuccucagcaggccaaucagcccuggcccaugaaccgugagcaccaagcagguguaaacagcagcuacaacaggcaucgcggcagcacaauguccaacccuugaccacaugcuggcuguaaacaccuuagggagcaagagccacaggauuuuuucaaucucgggaagauuagagauguuugcucaagcacgugucaaacaguaaccaccuucagcuuaccgggcaaucgacucuuacuuuuacccuccucugagccaguaucagugccaaacaaaaaaugugccaagcacagaacaaacacugggcuggggcccaggcucugagcuugaacuuuaacauuucuuuucauguggacuguccccaggaccccucauccagccccgugaacagcagggacuugccaccagguccuccaguucccagaugacaccgcauauauugugaugagggccgacggggaggaccaacagcaaggccaccaagcgcgggugaccucaggcacaccgcuucuccucuuggggccugcguuuucucauuuccucauguguaagugaggcgacugaccuggaggaggucuaguucccagagauuaggaaagggccaugcaucccuggagugcagaaagucagcaaggagagcacacacagggcuguucugaaagcugggauguaacggggucuagaaagaguaaugcucaaaacaacgcagauacugauccuucuagagauucuaugaaauagugagagguaagaggcagaccaacccugcugucuucagaaaggcagagaggggcgcuacagccucucugucucucaggaaacacaccucugggaaauggaaaauuccaguggacggugcagagguagggagagauaagggacugggcuuuuccaaaugacccggaaacaccuaccuuccugccucccuucuacacauacacacacacucucucucucucacucucucucucucacucucucucucucacucucucucucucucucucucucucucucucucucucucucucucucucucucucucaggguacaacuccucaaaggaugcugaggcaccuaaggcucuucaagcccccaccccuggcccucucacauuaaacagaaggccucgaccccucuuuagcggaccuuuguuacuccagaaaugggggcaaccagauaggagggcccgcacauucuuggccacaucucucagacccuuccccugccucuguccaaucuccucccacacugaccaucccuccuccuucccgcaacaagaccuugccccugaccuauuuuuuucuuuugccuucaaucauaaaagcccuccccugaagcccacaagcccacucucugcucuccuguaccaaacauuuaaauaaaccucccauaggcucugcuucuccuccacccucuggacauggcuaccaucucccaaggauggagugcacuugccaucuucccugcucccucggcacacacuuucuggccccaaccccaagcugccccucugugacaccugagggcucaagccagugggucuccucagccacccccugccccacaguguucccugcuggccccacacucuucccagaagcccucccuccucccuccucucuggccucaccuccucagcuuccucccccagcuccucuuucuccaccuacuccaaggccugggaguucccaggcugguccucgacaccccugccucccugccaucugcacuggcuccuggggugccagagccccuccacaggcucugcacugaugccuccccacacucaggccaggcaggaccucucaacaaccgaacccauuuccagaacaaaccaaguuacacacacacauaccgcaucaccacuucaaagacccacaggcaacuggaaaggggugcagggaaauuucggagggugaugaaauuguucuauagcuugauugugguagggguuaugugacuaugugcguuugucaaacugcgcagaacugcacacuaagaaggaugaauuuaccguaugcaaauuauaucaaacaggauggaaagaagucccauaggcucccaucaugucuaaaacuaagaugaccaccuucucccaaaccagcucuuccuccaucaaccagcuccucccccugauuagaaaucucagccauauauccagucagguagucagucuagaaauuccaccugcauaaauuucuuugaauccaugccuucaguucuaucuccccuuggggacucgggccauccucacuucucacaaaccaccuccguggggcucccaccccuccauaugugcaacuccagaaagagcaggacccucgaacucacucacucccaccagcucuccuuuccacuggcucucccgaguuccuggcuguugcuuaacaggaaugacagaaguaucuccagaugccacugucaaaucaagacaacucucugucuaaauauuccugucuaauuuugcacacagcucuuguuucaacggacaaagauaaugacucaguguccaugguucuuacuggaaaauuauccugccaaguuuugagcuucccaauaauagccuucuuuaaaauucucuuugagaaaggagaagugaccuuccuuccugauccuuuucuacaggcaacaaagggcacccaaaagauccccuaacugaccaaggaguguuacaggaaaauccugauacauccccacaggaucaaaacagcaagaaaaagaaacucacugaauaggcuuaggaugguuuuccuugcccugugcaagaaaucccuguuuuucaguuuuucugcgugccaaucaguuugggacuuagaaauuuggggcauaaauucuggauuacacugaaggcaaaauuuagacucagaaguaaagcaucuuucuccacacacacguaaauaugucucuuuggugagcaggcugaccaaaggagaaaagaaaaagaaaagguucacugaccuugacacugaugcuucaagcaacuacaaaagaacuccacaaaucauacccauguccacgcugcuguguaaaaauacacauacguauguuugaaaugcacccagccacucacucccugaagaugcaggcccagccccucccacaucacaagacacagagcugucugagcaaaaagugaggaugaauaaagcaucuccuugaagaaccacuuguggauagcugaguuagccuuugugccagcacucagcuuaagcauguuuccuauuuuaaaacuggcccauaguuauucaugugcaaauccccuagucuugcaguauccccgagaagcuaccagucuucuaauucuccagcacccccaacccagccagucacugccacacauuuagcaggcacaguacaugcccaugggugucuaccuccuaacuuucugcuugcagguuuugccucugcccuccuaggugcacagguagcccaaucuacauggcuuuuaccacuggguuagggcaggaggcauaacacuacccuuugccuaaaccucucaccuacucacgggcaggucccagagggaccccuggcagcacaggacaacucuuuuuagaguuuuaccucagugguucucaaucaagggagauuuugcccuccaggggacacguggcaaugucuggaaacacuuuugauggucacaacggcuagaagggguggggagcggugcuagucuaguagacagaagccagggauacugcuacacauccuacaauguauaggccaggucucccacaacgaagaauuauggguccaaaaugucauuaguccacagguugaaaaacuuugucuuagauaacacacuggcucugagggaggugcccauucugccugguucacuuuuccuuugaguugcucaacauuaggccccaaaucauuacgauucugcauaguccgcaccauuugcaaggcugaacaaaacacucuaagccauugccugagccuuuuuuuuuuuuuuuugagauugagucucgcucuguugcccagaggggagugcacuggcgccaucuuggcucacugcaaccucugccucccagguucaagcaauucucccaccucagccuccugaguagcugggauuauaggcgcccgccaccacauccggcuaauuuucguauuuuuuuuuuuucgguagagacgggguuucaccauuuuggccaggcuggucucgaacuccugaccuacggugauccacccgccucggacucccaaagugcugggauuacaggcgugagccaccgcacccagccgccugagucuuacagaugcugcuccuguagcuccccuuuugucucuccucgggagaaaggccuuccuccaaaagaagagucucccaagagcccuccugccaggaugaccuacccauccacagcgugacaacuggcaggcuggcaucaaggaauguucaaauccuuuggcaaucagguaggccuggcaugaccagcuacucaauccugucacguagauccaaggcccaagugaacgugcacaaguuuuucaacaggcuguaggcccgacucaggcuggaagacugcacacaagccucucacccuucaggaaccugacaucucucacccaaauggggagucccaacacccaaaccugccccugcagcacuccccaucgcccaaagaggguuuggcagaggggcuguuaccucugugcaaugggugagaaugagccucggaaagguucgaguuuaggggaguaagcccaaaccacucacaagaccccccagaguuuggagaagaggaaaggccaaagaaaagcgaaaggaagaaaggaucaaaaaggauccccugucccaaguucacacaaaauucccaccugcgaagcccaacagcuggcuccagccaaggaagucaaaguucucacccaaaccugcagccagcggcaacgagccuagagccccagacacacagugcaagggggucugggagugaagaacaacauuauuagaaagcgaagcaucaaagcuguauuggcgaccaaagggcaugggcaacgggcauucggcagcgggaaggcggucgggcaagcagcgggcguguuccagggacccaaggcucugcacguggcccucgucuccuccccgaagcaggaacgaggggcugagguggacccagggacgugagacggcugcagaggacccacccugcaacugaggcgcccccacugcguccggaccugaggcucgcggccagcgaaacucgcggggaagcugcgcugucacaugaagagaaugcaagaagggcugagguggguguugaccccagcucuggccgcagccagacggcgccugggcacgcggcgggccggcggguggcagccuuaccuggcugcaggaagcugggauccgcggucaccuucuagccgccuccgcgcccgccucugcgcgcuggccaccgcgcugacgcccgccacgcgcuccggaucuguuuaccaacucgcccgcuccgggggagccccagcucacaagccccgccccgc

SEQ ID NO: 21350 - RNA, 12095 nt, Homo sapiens
cugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggaggugagcgcuggaagccgagggagugagcgcgacgagggcugcucgccuucauucccuucgcgccccucuaaguaaccaguccgccgaccccugacccaccccggauccgcgcccccagccuccggcuuggaaauaacucuggcuuaaacuucuucuaagccaccgcugcuccucggcgcuucgaaaaguuucccgcaaagcgaaagaacuaacuuucucuuuugacuuggggcgcgaaagguuccuggugacggaggucgggcguccacucugccgccagccucgagcgccgcuucucuccgccgacggcgcuggcuugcccggcugggagagggcguaaggugggugggcgggugcguugggguguccgaggcugccucgcucgccgucccgcuccaucccucgcuucgagacacggcacugugggagccgauccuucccgggugggggggggggggcgcagagaggcacgaaggccggaggcuugcgggagggcugccccacgcgccgagaggaaugaauggggaaggggcgagagggcgggaggcgucccgggcgcggccgcugggggucgcccuggguaccccgcagcacuggcggcaggaccgugaaggcaaccccgagaaaaaguuagcugggauaagcuuggaaguggcgagcgcuggugucgcgcugucccggggcggaagacggggagggcucccggcaacggcugguguccggaccccgagcccgggacucccacacaccugggacucucacucuggcuuuuccuucggcggguccgcgggagacccaccguggcggggaagcgaggguguggagccacuugugcagauauuugagagaauggcuuuguggucuagugccaggacucugagcgcuuacacugcaaucgaugucguugggccucaguaugcggagccgggaaauaagggcacaugggcaguaccggcccccucugcguguuggagggcacaaugcagugguuggaccagauaacuacuaagguccuuucugucuggagauuuucagauuuuggagugguguaguggggagaaaaggagccagugaggggacuugaauggggugggucucuaucuaaugucauucaccaguguccagacagugggggaaaggggacuuuucugcagggcaucuuuucccucaccagcuuucuuuccacuggauucguucuccuucucugcuccccccacucccauuuucauuucucaucuacuuccuuuccuccuaaacauuuucuuuucccuaauuucauugcauaggucacauaugcuuucuuacaaauaaaauaguuacuaaauccuugaugaacccagaaagaaaaggagagccagaaaaucuggauguucucucaguguaccccuuucguuguaggugacagucauaucuucuguucgaaguuucugucucuguaacuuaaagugaaggcaaaaaauugguauuacuguccccauuguuuugcaguuagcauugguuguagaauaaugcuacaacauacaggcuccugcuuugaggauauccugggcaaagaugggauggggugaggauugcaguuacugucggaaugguuucagagacagcaaagaaggcagcaccccacgcccgcaguggggauaagauacagcacccagcaucuguggcagugaugggagccuucuuuuucucucucucuuccuccuugcccuuuagccauuauagaauuccuuuuucuccauggccguuuucuucgauagccccucccuaucucaguccugucaaagucuccucugugauugguaccaggugccaggacucuugaccccuuaucuaccuggcuaauggcucuguucucugguugccuuguugguugaucccuugaggcggucgauaccuauuggugauggagcaaaaugagcagucgguggguguucagcagcuuggcaugggcugggccacucaccagcuuuaugaccucaggcaagucauuuuuaccucccuggaccaauguacucauuaugaaaugagaaucugaccuagaugauucuaauauugagagggugugauuuccauuagauagaguccaugauuccuuccuuuuuaaaauuggcugggcaugggacagggccaguggcuucgaguguuuacccagccaggggaggaggaaggacauagccaagaugccucagaagcuuuccaagggagaaaugguuuauaugugagaauugguucucuuucaaauauguaaugcagaaaugcuggcaucagcaaauaguggggugaaaccuaccuggucugugaagaacuuggggucaaugagaguacaaaagaggcucugacugaccugaaugucuugaagguuccaguuaauuccucacuaacagggcuuuauugaauugauaacaacagaaugaguuuuuccugaaauggagaagauggagucacaguaguaaugacuacccgguguguauguaaaucucauauguccuucucaacagcccuuuggggaaggcaguuuugaucucaaauuacagaggaagagaaugagaggcccagaaagccuaagugauuuguugguggaugcucagcuuaugaguggcacugauaggcuuagaaacauugucucuggcccuugaugcccagcuuugcaccucuucaagaggucugggaggaagaccaagauaugaagaguuagugaaaggccaguacuggcuuccuaguaacauaagaugguuagcaagcaaugcuuaguggaaagaggaugaaaauuaaaagugaaaauucaauguagcuguagcuacuaggaaauaaaaaucugggagcugaauuuccaguuaaaggaauacaugaguaaacuuucacuuucuugaaaaugaugaaacugccaaugauacaacaugauuucugauuggaaauaaucaagcagaaacaaaaugcaaguucuugguagcaagucugaacaauuuuaugaucagcauagaaagucaacucugaucugagguccccaaacaauuuuuuucaaugaccgggauguuugaggaucucaacuuucugaaaaauugugugaagauuuaacuucauuuccuuguggggacacagccguagucuaggcugaaucauaccucgagagacugaguaaaggaauaacuagaaaguaucccgagaaguuaagcuuuagccuagugccgagaaaacccaaaucucgacagauacaucuguuuuauuuucugaaaggcuuuuaacauuuuuacaaccauuuauguccccaaggaagcccacccaaugcuuuucauaaaagcauuccauaccacugacauucuucagcuucuuucauugggacugcugacuuuacauaagaagaaggguagggggcgggagucauaaacagcagaccccaagcccugagagcucauuaauaaaccuaguuggauggcaaaauggaacuacacucuacugcaguggaauucaaaguccccguguagaagggagccauccaggccuccaaacaaagaccagcccaguggcagcucugaaugucauccccgaaucacugaguuuuuaauaaacuuggaaagggaagggaaacaugaaugcaugggagaaucuuaagccucuggcuuuagaaggcuaguuucucagaguuuauugccugacagcgacaaguauccucccagcauccuaagauuauaggauuaaauugagagaagaacuucaguucugacucaugacacagggcuuugggaaaagaauuacauacauagccuggguuucuuugacuagucaagggcagauuucauuggccuggaagucuugccuccauugguguauguuagaucuccagggggaguuugaagucaggguauucuauucagaagccuuugagaucaaagugggugaccagcugcccuccuuccuggacuccacagagccucugucagagagccagcccugggcuggagagaucucugggaggccuaguaaucauggagcuccuggccaaagaauguuuuccagggcauauucauguauuaguuccucaauuccucauaggauauuaugggaaaauagggcgauuauuacaagcccucuuuaacagaggagaaaaagccacggggagguacaaugauaacacauaauggaguaagugggcuucaaaucuucaucuucugaccucagucugggaauuuuguggauaagagacccacuugcucacacucccagaaggcaguuagcaagcagccuggguaugcaccgugacauaaagauuagcaguucauuaaacagaguucaguuuaucccgaggaaucuuuacuuagccuccccucuaucacuucauuuccaggccucccaccuaccuuaaggccugccccgagaaaauuugcucugguuuuuuguuuguuugugcaauauaacauaaugcuuguuuguuuuuguaauguagaauaauauuuguuuguuuuuugcaauguacaaauuaagggcaugaauccuggagccaaacuaacuuaauuccaaauccugaugcugccccauauuaauucugugaauucgggcaaaugacuuaguuugucuaaaccucaauuaucucaucuauaaaaggcagcuagaucuuaacucacuggguucucgugaggauuaaaugagauagugccccuaagguuucugguaugaaggaggcacuccuuaaauguucgagacuugccagagggcuucuucucugucuggacugugcuaaugaccacagauccccgguugagaggaaugcccagaccacacucauccuacacucaucccuauacucauugucccuugggaaccaacugcagggaggaggggaaauggccaccacuggagggaguacacagcaggccaagacuuaugggggacucuuccaaauuggggccauggaacugucacuauuucuacucuuuauuuuccuuuugucauccuuuuggguucaccgagcuauagaauaacagagggagaugaauuuagcaaauacaucacugaagcuucucccucggaaguugggcccaagcaaugggaaugagaaagguaaccuuggaccgugggggccauuugauuugaugaccccauccccacuucauuuaucaguuggccaaugaggcauggcgagucaggcauugggccaggcucuggguaaagcaaugguggagacucaaugcuugcauuggaggagcugucagucauuuaccagacacagacuggguccuagagagcugaaauuacuagcucaagucacugcuguuuagugccagagccagccccaggguucccugcccccacacccagccuaagucuaucccuauaccacaggccugaacaacucccccacaauacagugccucacuuuucuuuaagaccuuuugcuuugccaaccuuaaccuuaagaauccaccuccccauccccugccaaagacuggggugaagaaacgcaccuggcuacaguuaccuuucucauucccauugcuugggcccaacuucgggggagaagcuucagagauguauuugcuaaauucaaggauuccccacuuuuugcuuuuacuuccacucacugauaguuucagcuugacgucaagccucuuugaaaaagaggcuuuuuuuuuuaagugaaagaaacuuuauuuugaguaauauacaaaaaaaaaaaaagagagagagagagaaagaaaaagaagcugaaaaugagauuacucaugauuuuuaaaauggccucacugauuuuuaaaaaauguucuuccucuuucaggacuguuuguggccacauuugcacauaggcacaccagccaaaacucauagaucuugugaauucagaguagccugaaacaucaucccuuauaaauuucaaauaggcauuuuguucaugucacugagcuauguguauuuuaagaaccugcuuuacuuaagaugaggauggcaugaaaugaaaacaaaacagaaacccaagggcuuaugggacuuuucucugaggguggggcucugguguuggaggucuggugggggagggggacuugaucccaugccccagagccccugaaacaguuuggguuucaaugugucuuucagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguggguucuaucacagguauucauucuuucggcacauguuucgcucgcagccacuguguguugggcauguucuaggcagggggcuguuguugagagugaaacaaacaaaaccacugcccucagggagcuuaccuucuccugggaggagacagaaguacauaacauacguaaguacacguuaagagaugagugcaaaggagaaaaaagcagggagcggggcagagagaacggguagggaugggguugcuggguuuaaaaacuuuucaggccaggcaugguggcccacgcuuauaaucccagcacuuugagaggccaagaugggauuaucgcuugaguccaggaguuugagaccagccugggcaacacaaugaaacccaaucucuaugacaguauuagcugggcaaggugguacauggccuauagucucaucuacuugcgaggcugaggugggaggaccgcuugagcccaggagguugaggcugcaaugagccgugaucaccucacugcacuccagccugggugauggagcaagacucauuuugcuuuuagagacaguguugcuccaucacccaggcuggggugcaguggggugaucacggcucauuguagccucagucuccugggcucaagcgauccuccugcuucagccucccaaaacacugggaucacagggaugagccauugcacccagccgggguugcuguuuuaaauuaggaagucagguaaggauucacugauagugacuuuugagcagaggucaaaaggaaaggaagaaggaaagaggagagggaagaagccacguggguaucugguaaaagaaauuaagggcacugagguggaaguauuggugccuggugggcugugcaguggggcagaguauaggggugggagauaaauaggggcuggucauauugggucuuacagauuauuauuguauagaugcagcccugggcucaaagugaggugggaaaccacagaaggcuuuugagcagagaagcaacaagauucaacacacacacacacacacagauacacacacacacuuuuuuuuuugagacagagucuuguucugucacccagacuggagugcaguggcaugaucuuggcucacugcaaccucugccucccagguucaagggauucucaugccucagucuuccaaauagcugggauuacaggugcccgccacacgucuggcuaauuuuugaauuuuuuuaguagagacgggguuucuccauguuggccaggcuggucucgaacuccugaccucagguaauccgcccgccucggccucccaaagugcugggauuacaggugugagccaccacgcccagccuugauuuauauuuuuaaaugaucacccuggcugucauguugagaaugggcaguagggguaagacagaagcugagugcacagaaaggaggccguggcaggaauccacgugagucagggggccugcagcaggagggagcagugcaggugcugagaagugguuggcuuuggaucugacuugaagguaaagcugauuugcugauagauuggaugugggguguaagagaaagggaagacucaagggugacugaguuuucuggccagcauagcuguaagaauggagcguccauuugcugcugagauuugggauuauagggguuagggugguggcaagagcaggaggucuguccuauucugcagaccccuguggagaugucaagcaggcaguuggauaugugagucuggaguucagaggacagucugggcuagagauaauagaguuggaaauuaucggcauauagauggcacuuaaagccaugagucaggaugaggccaccuucuguguccaguuguucugaagaagcuuggagcgugguggucccuguuuuuaucacuacuaggacccaagcacccagacaguagagcaaggaccaggcagccugccccacccuucccuguagcaauguucacagccuugggaccagguguugcuccagguucacuucugucugacacacuugcacuguuccacgcuuggcaaccuuggguaagacuccuggaauaauaaacauggugagaagucugggagguggcuucuggcgaugccauaguggcuuaaggaugucagagcugagguuccaccauuuuauuggccuuuuccucaugguggcaaguggaaguguuucaggcuuacucaacuggcaugauugcagccuuugggcaaggaguagugggacugaccuaaaagacuguccuaguucaccacuugcagguggcaccccagcaugggccgauuaaugccgcuuugguugggaaugggcuuaggugccuuuucuacaggagcaucaugggcuucucccaaauuugggaagcuggugcucugaugcuccaggugaagucagaggugaaugggguugcccuugggucuugaauugaagaagaggccgggaguggguggcuagguaaugauccugagaucauuccugguucucaaagaaaggagauguuuaccagacagaaucuguuucggcuuuaaaugauuauaguuaauaccaauaguuaucaauuugcauauuauccucaucucaaaauccaaaugcauuuuuaaaauuggcuaacuuuuaauuuacuaauauauugccgguauaauuuuaacuuugauuuuuguuguucacucacgugugugugugugcguguguguguguguguguguagggguuuucacacaaaagucuagagcuuuaguauuucggggucuuuuagcgcuagcauugcccuugucugccagcuuuugcuggcaguaaaaggcaguguauuugagguagguggcauuucuuacugcccuuuaaauguguuucuuuuggauuuuacagguagccccugaagaagaugaaaggaaaaagaggcgacgagaaagaaauaagauugcagcugcaaagugccgaaacaagaagaaggagaagacggagugccugcagaaagugagugccuucuagccuuacccuuccucucgcucacgccugucuucaccagcuucauguggcuaucagaagaagaguuagaaaacccccuacuugguuauaguuucccaagaagggccuuguagcugguagcagaaaugccaguugcagaaugaggagguggcaaagcaguuaacacaauggaugugacgguggauguauaaaaacaggugugugaauucgucugaugccugacucccagcagccucggccgguucauacauguccaucagcuuccaggcugcaggacaugccagcccaguuaaagaggcuucacuugacuguuuuccugagaaaaggaagcugccagcucucauuuggcucacuaugaaaagccuuuaauuaaucucuucaaacaaguuauuuccuuaauccacaagcagugguuacacuugcuuugcauucuugucugguuccuaacucuagagcccuucucccuggcuuagccaguaagcugagccccuggcugcguucagccggcccgccugagagacacuaggggaaauagcuuuugugggcaagcaggguggccgguggugcucagcagucuuuccaguggcugugucccuccuccaaauguggacaggccaugacagagucuuagcccaagucccacagauccccaaaaguucuguugauugcuucaggggaucagugaaaauuagggaauuuuguguguugcuauauacauuuuuucuggggagaugagcuucucauugagaucugugacucagaaucgacuaagccaccauaagucuggauuucuccccagcucccaaggcccuuuuggguccagaagaccugcauaugggcuguugacucaugcaaaugagguaucugaacugcagcuucaguauuagcagagccacaggccgccucuguggcaucaccaggguuucucugaagaagagggucugcauuuuccuaaacccagugcugcucucccaucucccaucuuccucucgcagcuugaugagccccggugugucccagguacaccccugcauccaggcagcagcccaggccacccccuccucacuggcccuuggcuccuuucuugaugccucuguugcuugucccccaggagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 21351 - RNA, 51467 nt, Homo sapiens
aguagaaacaggauuuuaauauaauauucaagucuagcauuugcuauuuacaacaaauaaauauugccccuccccaaucaguaaacaaacauuuuuuuuuucuuuuugcuuuuuauacaaauauucaaucaccccacccccaccccaaauccuccuuccucacuaacccccgucuugcauggucucguaaagcccaggacgcaguggugaauggcacuugcaguggcaugagauucaacaucgaugggacucagcugggacuguccucacucaccgggugcagagucugguccaugaagaggguuucucucucugcucccaggggagggcugggguaagcggugggugagacucccucacucucaguuggcccugaugauggaaucuuuggugcagccugagaaaggcuagaguggugggaggggccgggaccccugcgaaggucacaggccagugccugugggcaugagagaacugcaguggucacagugggugcucuggggugcccaugggcacagguggcagugacccacaccugggaaggugucagggaaguguacagagguggcgcccgggggcaggcagggcaccaugccaugcccguuggcacugcuccuuggcaaaagucagcuaguccucugguuccagagagcagaaggcaccuaaggcagcgagugguccacgggaggccaggucagccugaccaauggcaggcgucaaucccagcagcgggagagguucaggaugaaacuggagucugggguacccugggcuggcaggugggaggaaggcgcccagcuggccugggccacucugguccauaagugcuuggcuaccagccagccagacccugggaggaugcccucagaagaugcccuuggcaaucuugaguccuuucugcuucaugcgagggaggguggagcuggcuccgugcuugaccuucacucccuuggugaagguccgcuucuugaggacaaagucauaguuggcgguagaguucauggcauagaagacguuggcguuuucagggaucuucagcucugguggggaggggcagaggggugaucagggaugcuccugggggcccugcaggauaccccuaccgcuugagagcccauacaaggacugucuugagccacagaccucagauccccuccaauacagcuccagaacuccaaggaccccucucaaugacuccugccugaggacagacucugcugagguccucacaaaaccugaugacucuuguuuaaacagggacugacuccagaaccccccggcuuggccugagcuggcagagggucaccccguccugcccauacugcagugcuggcugcccaccuggaacaggcuuucuagaauccaggucaccucccagaauccugcccuacucaggacaagggauccaaggaccaggaaaggacaggccugccccagggcucuggcgcccguuccagggaggccuguacuccuugaacccuggcacccggcaagcacuuccuuuuggcuccauuucccaccaucuccucuggcccacagccugcuauaaaccagagcugggcucgauuugugcuccugccgacaucguguggcuuuucgucaucuuuaaccucucuaggccucagucuuccuuuucuguaagaugggggucccgccuacccugcccaccuaaccgaaauggugcaagaagcugccagaggauuuagacuguaacuucuagggaucacaggagucauugcuuacugucugggcuaauggugggaggugguguucagcucacuggaaagaaaacagcgaugauaguauuuauaguuaacuuuuauggugcacauagaugcuuuauauauacaugcauauauauacacacacauauacaugcauauauauacacacacauauacaugcauauauauacacauauauacauacauauacacauauauacauacauauagauuuuuacauauaugaugaacacacuggcuacuuucauuuccauuugggggaugagaagacaagcacagagggcuuaaggagcuugcccagcgucuccaggcccaggauaccccacucugagccugcacugguucuugacacuuucccaguuucuagaauacugaguuggccuccuaguagccuguucugcuuuuagaaucacacacucauggauuuuaacacuugacacuuugguccacagcugucaccauucuuuguagagcacauguuuucuugucuuagccagaaagagucccuuccagugggccacguggcuaaccugucccagugaaaaaugccuuuucucuuugcuccucacugaugugagcuuugaacugccuguucacgccuagggaagggcacacacuggggagguccagugguugcuggggacagcaagcagacaaugggggcagccagggcugcccuguccacagugucuacccacacucugcuggugaauuuucuggggccaaaggcuuccaaccuggggcuggggagugguguggaccugcccccucugccaucgcccucuggucuucugacuuacuccggucaucugagagaaucugcagcagcucauaguccuccggcuccuccuccuccagguuguguuuguccauggccuugcggauuacagccggagccuuaucuuggcuggucaccugcaucgcggcgggggauggaccaucagggaaaagacccuggagcggcucccccagagugcaguggccaaggacccucuggaguccccucagcaccaagcacaggcacucacagccucuggccaggugcuggguccggagagggccuugucacauucuccuacuccccaagugaggccuccguccuucuguuccccaugugaggccuccauggaaugaggaggggucugucccagcagugccuacccugcuucuccuguaagagacuguucccuccucccacacuuccuugagaagcacuugccccuccaggauaacagcaucacugagccuggggaacagacagucccuaguccaagcccuggagguaagaaaggaggggccggccaggaugcucaguguggucagcauaggccaggccccugcuaccuugacccugagggccagagcacaggcggaacucggacauagggccacaggugacugcuuaaugacaaccaugcuagcuccuggcaaugaggggucaggagcgugugugaauaauggggcaccugacccagggcugggguacagaggguggggguuacaaaugguucaucugucgcaggacaccuggaggaugaagaaagagcccccaggcaaacccauucugugagcaauucccaucugcugucuccaaauccugucuagacucugacccugcuggccccuuccagggcucccagccugguugccacagcggccuccuaaccaacaccccugcggcucugguaccagcccacaccagacagagaagccagccaucauugcuccugucuuccuccccgagaaagucgagguccuggcagggcucagggccuauguggccaggcccuggauacuucccugaccucaccuccccuacagcaccgccccuucagcuccugggggcuuugcacggcugcuccuuuccucccccucugcccucaggccagccuugucccugaucacuaccuucuucauuucuguaccuggcugacaucuguccuuccccgccaacuacaagguagaccccgggagggcagggauggugcacuguguucagggugcauuugccgccaguggagggaggcacccaggccacccccgccggcuuaccaggaugcucuuguacauguugccauuguccacguccaggcugacgcggaugauacagcagucgcccaccugcugguuguagagcggcagcgcggagcuggaguugcagagcccugagacagagcgcuugugggugcguguggcagccacgggcgugguggaggcugaggaggacgaggugcugcuggaggcugagcugaugccggaggucuccggggaugacugugaggcugauucccagaacugagggagacgguaagaucagcagaucccacugcccugugggggcaccccaggccagcugccagauggggaaccuucuagaagcuguguucaggauccagggcuuccuggccccaugcauggauuuggaguggggagaugggaaaggauauuggggagaagggcaggcagucaccuucuuuuccuggccaucaggagacuccgggacgaagcugauguugaucuccuccacgucggagcuagaggagccggccgagugcacgcugagcgcgucagcgauguccccgcugcugagguaggggccacaccugagcuggucacaggacuuggagugggagcugccacugguacugagcucagugcugggggccuggcggcugggugaagaguuggcuuaguuaagggggcuccccaaggacacaucccaaccccacagccccugcacccugcgcccaaggacugugcaaagugcugggacaguugccaguacuccauucaccacagccaucugggagagcauuuaguaucaccccauuucacagaggaggaaacugaggcccaaaaaggugaggggacucaucccagucucagggccagucagcagcaggguaggauuccagggccagccucccugacucccugagcccaggcucagcccugaagcuucugagccccaaggcagcugccccuaccacccuuggccaggcccuuacucgcuccagcgcuugacaauggcuguguucuucuugguccugaggguguugcuggcugacucggaugggggcuccagcucgcacgacagguuguagcuaugagcagaggggcaguggugugacaaccaggggccaugcuccggccuucccccagcaccugcccagaagcuggagucggggugccccggccauccucaggcaacaggggcugaggcugaccaugggucauagcugcuggcccucuggagcuggcccccuaggacagccugcccccacuguccccauuugcugccccggccucaccucucagucucgcugagccgcuccacggcccggaaccaggccccaaauugcucaucuggcgcgaugcuguaguuguugcaggccgacugcagcagcuugaucugggcgaucaccucgaacuccuggggccagagggaagcacagggcggugacaaggccccccgggcagcacaggggccagucucugggucuuuguucuuggggucccuuccuccccucuacucccauccaggccuuccuguucucaaaguugggcucagccacuccccaggaggugguccuggauuauaaccuccuacccucacccuccagugggaggggacccccuucucucuguguccaaaugucccaugucccaugaaucuaaggagaggguaggaguugaaauguccuacccuggugggucuguuuuccaccccuccccaagucagggcugccugcagcugcuuaccuuccuccucuucucaaaguugaugagucugcccuggaagguggacacccaauggccgucagaaagugaccccuugaccauuacagucuccccaccucaugcugcacuaucaagagugcccaccagggggcagggcacgcacaccccuggauugaagccggugcugggcaccagggcaaggggacaugcgggcagaggcuuggggacuucuuguccagcacucucggaggacaauggacugaggccuugggugagaaggcccugcucagccaccacgugccgccugaccgcugagggccuggcuucccucugugcucagggucacugccugagggaugggcugugucccacucagccaaacccugcugcagcucuguguuugggcagcccuggggugucaccagcagggcacugagcuguuuacucauugcugggacagguguggcagcccagcccccagggcucagggaaggucucuccucccgggcccuacuccagccccgcccggcacacucacauacagauaguccuucauggcaguguccagcaucaccaggucggugaggaacgugcccagguagggaacggugcccuggaugaugcccugugacauugggguaggaggaugagcaaggccccuccccugaaggcuuucucagcccccagccccaacuggucucacuuggaacagcugggggaccucugggggccuccuggggcccacugucucccuggaccccagacucccucuagccaucucccuggcuggcaucugggaaaugccagguucccaagucguguggccccuggcccuccccagccccacacccgccugagccggcucugccaggccuguccuuucguggcugcagcuggucuucccagauaccagcugauccagguguggcucugcuaggguccagaggaggcuaccucuaauggggcccauaggcaccguggcuagagaggaaagggcccuccucccuacccccaggccagcccccugccccuccgcggccuugggcacucucaccgucuccuucggccguuucugggcucucuugggguucaucuccaggguggcaaacuuggaggugcccuccugccaggguagaggacagggucagcaaggcccuauccccucagcccucaggcacccugaccuggggugcugccaguguggucggguuccagggcugacccuguaucaauacucacuagugugggguccugggccgguggccuggccuuccugagccugccucccccucuggaaagugcggaugagaacuccgccugcugcauggugcgguggcucacgccuguaaucccagcauuuuggaaggccaaggcagguggaucacuugaggucaggaguuuaagaccagccuggccaacacagugaaaccccaucucuacuaaaaaauacaaaaauuaccuggguugguggugcacaccuauaaucccagcuacuugggaagcugaggcaggagaaucccuugaacccaggagguggggauugcagugagccgagaucacgccauugcacuccagccugggagacagagcgagacuccuucucuaaacaaauaaaaaaacuccaccugccucgcagggccucagagacucugcgcuacaguccuguuauggcugcacacuccuuucucccuugaaccuuccauaaggucagcaccccagggcuggcauuccuccauuuucuagaugaggaaacuauggcccugagaugggcagugacuugcccugggccccccagggacucagaacaggcucuucuguccuagccagaggcucugccccaucugccuuuacccguuuggucacugaucaggguaccguccucugggcuucucgugcaugccagggcccccaguggagcugugccacggagggagagggacaggugucccaggagcccccugcgaugcuccccuguagggaacucuguguguguccacgcaggaggggggcccuagaugccauuucacugaccggguaugccaggggcaccaggcagugacacuugacucccucugaggccucgugaauccauuagucacugaaaguucuccucagucaucugggguauccgccacagcuaauggggugccaugggaagaauucuacaggguucucuggucagugucucuucucggggcaggguagggaagccacauggggccuccaaaucugccucccaggucuggccaccuggccccuggcauccccugcagcuccugucccugggguaggcaggcugcccucuccuuggguguguagagcagacagagguagcgucaggagccuggccucccggggacagacugggccggugugggggcaggagccgcauccccuucccacccagcaggagggaccggcgaggaagccagaggccugcugguccugaugcccaucuacuccuccuggaaccuccacugcuacccuuacuguguccaauuaacuggggcccugucccucaaacacccaggggccaaacagaucccucuucccccuucacgcacacgggaaaggaacuuucccagcaagaagcgaaugccaccgcccgccgccccagcccccgccccagcccccgccccagcccccgccccagccccagcccccgccccagcccccgccccagcccccgccccagcccccgccccagccugccgccacuccaccuugaugagcagcucccggcucaaugaguaguuguucucaucugagaagaucucugacagcuucugaaagauccggaaacugucccugucagaagggcaaagaaggaaagagaaagcugggaaugguagggaggggugugagugcaaauccguuuuauuuuagagcugaaagaccccagacugccugaacgcagcacacaggguaccccagagcacuaacgcucugcaggucuggggagggggccuucauguuggugcaacaggaccccauucccguuuccacugagcagcuauuuccaaagggguuuuuuucuuuuuuuggagacaguuucagucacccaggcuggagugcaguggccagaugucgacucauugcaaccucuaccuccuggguccaagaaauucuccugccucagccucccaaguagcugggauuacaggcguuagccauugcgccuggcacaaagguuuugauuucaauuggaugaggguucuguggcuacaacacgaauaccugaaaaucucugauguggcucaacccaccaucugacagcuuaggaagccgagcucugaggcagagcugcugccaacucaggucagugaagggucccugcccucaggguuuguggccucccaugggcucacuaagggggugaugccagcccugugggaggucccuggugcaccaggagcuccuacagaggcaugcccaccuggaaacgucuucccacgucuucuucagacgguggauggaguugcucugcagggcagagaggauggcauacagugacgagaaguucuugaggauccggcacuccuggggcgggaagagcaggaggcaugagguggggcuggagcucccagcuugccuggccucagucccccuuggccaagccuccccuccuaaugagacagacacccagggaguccccagagggcacgccugcgacccgggggugacaggaggauuuuagcucaacccaaggaaagaguguaaggaagacgugagcauccaggcagugggcugggagagucaaggccagcaugccccugggaaggguagacuggggccuguacagggccuuggacugcagaccacaaccugagaacagaugaagccaaagugggggcccaggccccuccucuggcauacccuggccaccucgauccagugcuccaccacccuggcccugucuggggcuuucgugcuucgguucccgaggcagguggugaugacacaguuggccacacuguugaacugggugacaguggcgcggauggugggcgccaggugcuccuugcccuucuugucccgcugggaccagauggagcccaggcagugguagggcaccaccuucuugaacaguuccuggggaggaggcuaaaugucaccugguccugccccagcagucugggcuggugcuggggaagcugaggaugcagcuugagccuuguggggaucucuggguuuuaucccguguccaugcagggugcccagcacacaagugacccgggacagaacgcuggugggaagaagaggagcaccgccucgcgcagccucaccaagccccagcuccaacaggcggcucacgccugcccaccccccauccccccgccucagucugcuccccauccagacgcacaucugcugugggcgcuacaacuaagggcuuuguccagugucugccauaggcuccaggacacaccaagugccuaaugagugcugaggcuggugagccuccugaacagaugggggugacccauggaugcaccuuggugagcacccuccgcucccacaggccaggccugcugagcuuccugucuguuccaucuagaaucugcacagucacucuggaggauaggggugaccucaucucuacuguccagagguaaacugaggacuugggguuaaggaacgaccugguuacuugguguguagcagcagagcugggauuugaccagaacaucagcucuggaucagcaaaugguaggucugggacagcagaugcugccagaaggcaggcccaccccugcccugccaagcugagcugcucaccgcauccaucaguguaaacugcucugccaccagaucuggagggaacaccaagaggugaggcuucuccucacucagcccguucucugcaaccacaggugaaggccaggaaggcuguaaugauggaacuggugcuggagcuggcuccagcucuagaguuugugagggagcuggauccuguucuggagcuggcucuaguuccagagcuggcgcuggagccgauucuagucccacagcuggcucuggagccugcuggagcuccggagcuggugcuggagcuacuucuagcucugaaccuggagcugguguuggagcuggcucuggcuccggggcuggagccggcacugggcugggugcucgagcugguguuagagcuagcucgagcucuggaguugguuuuagagcuggcacuggugacagagcugcaagaggagaaaaguucaacaacaugccagccuuuccugugccuuuccaaagacacagaacagccccggcuuccagagaagccucucuccccgaacccacaaaacguguaccaggccacucuccugccuguggucccugccuguguggucugaggcucaucugggccccugacccagcaccagacccuggagccuccucuucguguggcccagcaccgaccccuccucauucacccucuggcacccaccccaguccuccucacccucaggcucugccucaauggguuccgagugcuccagcugggccaggagaaggugggcacggcgcuccaggucugagccuggcauguugagcugcacguaggccaccagcugcuugaggcagggaaaguccggagguugacagaaauccuccgaguacugguccagccaggugcccaggauggaggagauggcacuggggacagguggguggcagcagagucagaggccugggcuccccugagccaggcugggcuccugagccggccccuguccaucugaaggccaccugccccggcccaagcccccuuggcuguccagcuaaaagaaccaaggaggccccuggucaguggcgaacaccucuccccuccuccaaggaagccccgcccacagcucugcaugucucccagcacccccuccucgcuggaauguaaacuccaugagggaucgguccuccugccgggcaucugcaggucccuggcggcuccucaacuuguagcucagugcuggugagcugccuuacucucucagagcugugugugggucucaucuucccacuaauccuguucucccagaggguggggugcagccugcccacugagcacucacuauugaggggugaggcaaugugagagcagaggcucaccccaccucuugccaggggccccuagaucagggcccacugagccaaggccagcugggaugaggcuauggugggaugaguucccgccgggggcugccccgagccccagccaccccaggaccccuccacagcucucggucgucuuucuuccugcaggcgaagcccccagaccccagcccucuagcaggaaccacaagaggugugggagccaggguucugcccagccagccccggcuccggccccagccccauguacucucccacuguucgguggggacagggucccuuccucuuggcucaaagcucacucacuuuuuaaguugguccugggguccaccauccucgucggaauaggggaggaugcagccguaucuagaggaggccgugagggcgucacaucuaccguaccugcuuaugacgucuaguguuacugucugacucuccgacuagaacggaggcccaggagggcagggauuuuuuuuuuugcuuuuuuucaucaaauuauauuaaaugccuagaaaagggccagcacacaguaggugcuucauauauauuuguucaaugaauaagucccaaccagcuccuucccagcuaucugagcgccccuugggucccuccaacagcccccagauagaauccggaaucuccuugacaagugggaaaacugcuucgcccaaggccacauacaagagaggcuuggggcagagagcuuccccaugggggacaggaaaaucauaaaaacgagcaccacagccccgcagcccauucccuacagggccaggcguugagggagcacuuuccacgccucaucccgcccaggcauggugacaaccccaugagguccucuuagcacuccaguuucucuuucauaugagcaaagcgaggcucagagaggugaaucagcauugccaagacccgcagccaggugggggugggggcgagggccccugugcacccugugcaguggagggcucaugcucaccuuuugaacagcagguccaggaccuguugggugguggugaaggcucuauagguacacaggaagauggugacguaggagaggucgcugcccuggaaggcuggcaccaggugcuccaccagcuucuccagcgugccagccuucacgguccgcaccuugcaagucucauaaagguucagggccgacucauucucauacuggggugggacagaggagggacagacagucaguggcagcacacgaaucuccuggagcucagauggaaccccgagcccucagcagcuuguggcaagaggcaggacugaguaucucuagcagaaaaagguuaucagcuuuaaaaguagaauuucaggccaggugugguggcucacaucagucaucccggcacuuugggaggccaaggugggagcaucacuugaagccaagaguuugagaccagccugggcaacaaagugaaaucccccagcucuacaaaaaaauuguuuacaaaacuuaaaaauuagccagggccaggcauaguagcuuacgccugucaucccagcauuuugggaggcugaggugggcaaauugcuugagcccaggaguuugagaccagccugggcaacauggcaaaaccccaucucuacaaaaaauacaaaauuagccaggugugguggucccagcuaccuggggaacugaggugagaagaucgcuugagcccaggaggucaaggcugcugugagcuaugaucauaccucugcauggcagccugggugacagagugagacccugucucuaaaagagugaaaaaauuuuuaaaguagaauuugaggugcgggaaugauuuaaauacugacaccuucagguccguuguuagcugaguaaugguagcugcccugugggaagagcgucaucugagagcucuaacaaaauauccccauucuagagaugaggaaacagaggcuuauccaggggcugggagggacuggcccguuaggacgcacagcaucuuccccguggcacuguuuuguuuuguuuugagacagucacccaggcuagagugcaguggugugaucucggcucacugcaaccucagccuccugggcugaagcaauucucaugucucagccucccaaguaguugggauuacaggcacacaccaccaugcuuggcuaauuuuuguauuuuuaguagagaugggguuucaccaugugggccaggcuggucucaaacuccugaccuuaggcaauccuccugccuuggccucccaaaaugcugggauuacaggcaugagccacugcgccuggcuccugcagcacuguugaaguguccucagaggacucacaguggccccacagucaugaggagcugaacuggggcaguggcuccagccucccuucuggaauauuaugcagcugagucaggccccggcucucaaccuggaggaaccccagggauguguucugggagauggcaacuugcagagaccuaacagccugaagcccuuuuguccuugggugaagacagccccacuacuccagauggugugcacaucugggagaaggcauggaggauggugaggcugauggcugcacacccggggaagggaggucaaacaugaaaacccgauuaagccugggcuggacagugggggucgggaagggagugaaggccguuuccuuugggaucagaacugggggcccucaagugaaaaaguccugggagggauccccagcugcgucucccaguggagaccccgagcgcacucaccccgagccagcgcugccccuuguugccuccguggugcagcugcaccuugcgcagggagauggaguagaugacuccguugaucagcuccucaccgaucuccugcguggagcucugugaagacaacgcccggcagccgggcgcggggacgucaagggccugccuggccaccgugcaggggaugcaccuguguaaccuguuucccagauagggcacagacuggcggcugcacagaccuacagccugggguggaaugagaucacagcucgagagccacugucccggcacuccacuuccccaacccggccagccacgaccugggacgugauuaugaugaguccaccaggcuuccaauccccuaguaacuggcuucugcuccugcccaggacagacccacccucaagccauccccuuccacacaggggacuguuauucagccauugcacagauggguaaauggaggcugagagaggaacaacugguccaaggucaugcugccucggguaaguggugaggcagggaccccagggcucugacacggcugacugcauccaggcggcuaugccccaagagaaggucccccuaccuccccagggccagaggcccaugggcauccucacacucaccccuccucuacccagccuggggggcccuggcugaccuagcaggaacgcacagcuccucugggcccagcccuggugcguuggcagcccaggucugggcagguguggggcaccccagacagccacaucccagccacuuccuuccccucugcucauucaugcccucgugccugcuugggcaaugggaguucccaguucccugaccaucaucacgugaggggacgggugugagaggugacggugcugguauccaggcagaugcugggguuccacagagcccuaaaccacaggccuagacuggaacaggaagggggcaucuggccccaggcaguaaggaaaggccguugucuuaggagacagacuucccccaccuggcaggcuggccuaggucacuuagccacaauuacccccggccucacagcccccuaugccaccugcucuguccagggacggaaugagcuugcagcggguagaggagccgggggguuaaggacaucaaccucagagguuaggaaggagcuaagagguacuggccuggcccagggucauuaaccgcccagucagugccccagcccagguaggcguggagcucagagaaggccuggcagacagugcugacucaggcccuucccucaaccccagcaggagccagguagacuguccagcaugcuguggacgggacccuggccuccugccuccugcgcacccucagaggcccaggagccauccuggaaguccacuuccuccgaccugaggucgccucccacgcugggcuuuguacaacaggaaagcugcgggcauugugccgggcuccugaccgccaccgccucuggacagagagccagccccauuucuuggaaguuagcagggaacccacaggcacacucacacccacaccccacaaacagccccgccaggggaggucuggcccuuccacugacaggaaaagagacauacgcucaccccccuuuuccugacucacacaucucuccccugccuagaaaguuguuccuuugaaaagaaaagcauuagagguuacagcgaccagggcccccaaccacccgggccuccucaggggucccagacugccuccugugaaggccguuggcucagcugggagucucucucucucccagggauuuuagccacaucuggaccagcugggaggcagacaguauccugaguguccaagucaccggcaguggcucugagaucucgugcaggacaagcccgccacaggggacuaaacauuaacccugggggagcccagcacagcacccagguccuggcugagcaccaucagugccugcuggacagagguguccccaggcaggccaauccccaggaggggcugaagccagguggccucggcugucccugagcaggucuagagagcggcuccuccgugagcuggcaggccagcagcuggcccagcccugcuuggugucaugugaucccugcacccuucccccacccccggggggcccucuucugccagccgggugguggggaaggaugcaggcccaacacugagagccaugcaugcuugggguaagggaguugccacccugucacacagucggggagacgcucuagcccgcguggagcuggccugucuucucuggucgcuucccgucacagcagcagcaggcauggaaccagaccauagagcuacguggaguacaggggcuguuuaaaccaucugcucagaugguggaggugcaggcuccagagagagcugcccuggggucugggaacaaaguggcagaguaaggccucuaucccuugcccccucacaggacagagaaagaaagcagccaacagcccuggcagcugccccagaacccucugcagcaagaaaggcaggguuccagcacccacaggccacccuaggucacucuguuagcagacagcccaucugggcagcgccugggccccagggcacucuggccgggcugggagcucagagcgggaggagcaggaacggccuagugaacagcugaugcagagaaaacgcuuuccccugagggcaggugcccaggcagccgcuaugagcugacugcuaggaggagaaaagaacaccacgugcuuggcuguguccucaagggacacuccugucccaccccuagcaggcaugcugaugucccugggcucugggacccagucggcagcugugccuguaaacacacugucuggccuucuaacauuugggucagugcagugaggguggcaugggguccccggugagcaggggcccccacaccccaaugucuccagggacacagcccagagcccugaagaugaggaugggaaacagggccugguggugucuggugagugugucaccugaucagccuucucagagugacaggccagcaggaugccgugucccuggcugacagaaggaggaagccacaggccaaacccagacucccucuggguagaauagugagggucuugaggaacccuacggggccugccccagcccugccaucuccccgcucaggccaacggcaccuccucccagcaucagccuucuggugcagcuccggacucagacgccuuuccuuggaaaccguagcuaguggcccccugccccauggauggcuccaggaacucaccggccccucccaaggagaccuggcugagggcugaagcggagugaggagagggcucuagccugcaccucggccugcuccgccccugguccuccccgggccuguguguggaaaggcucacggcagagccuccgugugcgugagauuguccugggggaccucccaagccccucugagcugcugcucaggucccagucaccagaggucaccccggggugcuugccaccccccugccagcaccucacaguucuggcccaccagacagcagcucccugucucucgcuggcucugcccagccccuggcccucggccuuggugugucaucuggggagggcagcacuaccugucacaggcaacagugggggucaagagagaaugcacacagcucggugaccggcacugggaccugauggcgugguaccggacaacaccugacaucauaucccccuggggccggcgacggaugcugggcuguaaaaaccugagggaaacuugucugaggccugccuaaggcucagggaccuagccgagggacacuguaaagagaggcugagucacccugaaacccagugggugggagcagcuuucugacuucagcuuuccgcuccaauacagaagccaaacguaaaacgcaucacagaaggcugcucgcucucuacagagcccaggcuccugcgacagugcggggcccacgcugcugugcccuucuccguccuacagagguggggacccaugcccgaggacaggagccgguggggcgugugcuggcugagccagaggugagagcccaggacuucucaagucaugagcucggaccaugagccccaucaagggagguggaacgcaagggccucguguccguguccgugacccuccugcccucgggccugcccuccagcuccagguggguggacccaacccugauccccagcgcacagacaaagcaucaagaugacaggaggccagcccggggugugggugggccacacuccugauccugggcauggcagcccacagaggcggccucagaccgggacgacacgcggugccugcccaccaggaugcucccuggccucagaaaguggaggcugggaaccaaccagugcugagccccgcaaaggccggcccaucucuccagaaacccucccugccggccugugcccugcuacucacugaugggaaaaucgugccucaagcaggaggagggagaaccagaccuccaggucagccgcaagccuugggcauccagggucccuguccacgcccagccccugacagucaggugaacacagggccaggcccgggaggggcguggcugguggcagcugaggaggaaggugggcuggucccaagggggugcagggcagccccaacuuuaaccagcuacagugcccagcacaugcgggcacuuccugggugcaaggcccuuuggacacccaucacguuuaauccuccuaacgcccugccugauggacaaggaaacagccugagaggaacucgcccaggucaggagccaggacguggcagccagaacagggauuugaacccuggccuguugggacccacccaggccuggcgcugccucugccauggucucaggcuuggagcagaguccagccccuuguggcacagauguggaggaggggccagagacaggaaggauuuccucaggucacacagcaaauucgcaggggaggguggcagggccagcuuucuagcaccugcaucuccgagagguuuguggacgugcccugggcaaaaggccuacaagacaccaggccagggaagugccaugcugaaggugccaggugacgcacccgaggagcccagggcacuuggaagggucaggccgcuccccuggcaccuaaucagaaaaccucauuguggcagcugcuaccuguccacugugccaagugcugugcaggcugcuccucaggucucuugucuaacucgaggguccucaccagaacccuaacaggagagcuggcaucauguccauuuuacagaugaggaaacugaggcucaggagcacgucuacaucugcuagggggcugagcuggcaucccagcauagcucucuucucuccagagcccaggcucccugccccucgguugagauggacaaaagucuccaggaaugacuacaggggaggcugccaaagcaugcaagcuuccccauggaggaaaacgccaaaacccuccaacgcagguguccugccccgcccgccaagccacuguugggcugccaucccacugccucccccgcccgugggcagccaaggugugcggaacugggagaauugggucugcucaaagcucagcuuguccugcaugaggcugcaugcaucagugucugccccuuaacaaucaaauggggaacacugcucugcuguugcuguauaucugggaacacagugauucugggccugcaaggcuggaaguccaacccugggacuggguggccacagcaugguggcaccacgccaugggagccaucugggcggccaaccagcagcucuugggaaccaguccuugacugccugggugcagcuuccugaaaccgcuccacuggcucguucagagccugccugcagagggccagugauaaaucuccccacucuuuucucauuggcaacgcagacagguccuggaaaugcccaauuuccagguuaagaaucagaccccagcucuggcaacgagcagcuugauaucucccagggccauuccugagccucccgggaaacaggccagcaugccugagcaucccccgccuggagaaggaacaaagacccaggaccagccagccuggucccccucuucugggggacccucccgaguagagcaagaggggaaccugaggguccugggggcugccccuucagagucacccaggaagcucuccuggaagaccacagucuguacacaugcaugcagggacacacacccacacagggacaggcccuuugccuuggggucuucagugucaaagugcucaugagcccuggggauuaaaccgaagaccugcacacagugugaucaagagaucaaacagugggaagacgcgggaggcugaagggagaugcucccugugaauacagagaagcccucuucacuccagcccaccugcaacugcccucaggccuugggucagaauccuggcccugccacugaccagcuuggucacucugugcaaucuaauucaccucuguugccucagugacuuuaucugucaagugagcucuuaacagucuugaccccaaaaggagaugaugcaaauuacuuagccaaggaccuccccaaaaccugcuggcucuuauuagcuguuaucuuaaaccugugggguccaguucugggcuugcuuccuccagguagcucuccccagcguccuguggcccaaagcacuuuugccuuccucugagccauaagcuucccuacugcucaccugaccucagggcuucugggcugccugggcuuccucugacuccugguggcuccugcacacaguaggugccacagagaacacagcccaugcuuaaauccuggcugcggcccuugcuggcugcacggguguuuaggucagagacuucccuucucugacccccuagcuuccuagaaggugguguuggcaccuacucuguaggguuggucuaaggcagaugaagugaggggguggcccacaaccugcacuuuuugucuggccaaagcaacagccuguccagagaugggggcacggaccaggucaccuccagaaagcaagaacugugcaggccaagcugggucauugguggcuuggcuuagaaucgggaagauaagcggaagcccagaugugaggagaucuggcagcccagagggaagcaccggguggaagcuagguagggaaacagggaugcgggggaaggcagaaacugucuggugguuuccagagaggacagggaccaagugcgcagcgucagcucuggcaggccacauagacaccaggaaaccagccccaggacgggggguguuggcaggagggacagggacuuccccgcccccucccuugggcccuugguaaauggucauuguguucaguuuccggcaguggccuccucuccugccaggauccugguuuuccugacccagccagaagcuuccccuuugauuucuaaauagcagucgaggucuggaucucagugcugaggcugggcaaggagcgccagggccagagagagggaagacaagacccccaggcagggguggggcucagcucugccucucccucaguuccucagggacggagagagggaaccugcacggccacugugagcgcuccgccggacccucccagcacacaaagcccgagcugcugccagagguaaugaaagccagaugagcgcugggcuggugucagccucccacccccacccucccaggggucccucuccagccgccaaugaggaccagagcccuggauagaugaggguugagggaacacgucugguccggccaucugccaagcucaggaggaaagggucucucaggcgugugguguucccccaccaagagcucugcccaacacugggcggagaaacaagucgcauccaggcccugucuagguaccgggacaccaagaggcacgagacucaggcuaacaaucgccagcaaucacaacgcgccacagucuaaagccaugaagcgacuggagacgcagcaaggcaacacgaugccgcacggggacucaggagguucacugugaaggcugcagcccagccaaagcucugaugggcccugagcccccgauccaggaauggccucugugcaggcccugugcccaggcagagcagggcgaggggggcaucucuggauuccacucccucugcuguguagucagcagcagucaggugggaggcagauggcaccacccagagacccagggcacacgagaaacaagcccccgcccucaccuagucacccuccccuccauccaucacagguacaccacucccuucucugaauccuacccaguccuuaccgauucaggguguuggcacucuuuccaguuaagcagaaacaagucuugcccgcccugggccugggccacccuccuccccucaccaccaggacaucuggucccacguguuggaggccugcugcuccaccccaucccccgaccccccccccaccccgcucugagcagccccgaugucccuggucaccagauccacaucugccccaaguagggucugucuggaaggccccuauggucucaucaccucugaggauucuaggauuuggccuucccgaccacuuguuccacaccugcaucguaaaggcuaacgacgcgcugcgggcccugggugggaacugagugaaauaaggcacaggccaccgauguaaacagggacagugccgcagaaaaagguccaccugggcugcagcggccuuggugacagcaggcccuggaacgguauugaggggcgcaaaaccccagccguggucccuacuguuggacggggcgcggcggcagcccccacugcccacccugcuggcugauuucugcagaaggccccgacccccaccuauggaggagagaggagggaggcggcccgcugggaucgcccggccccguccggggcucgccccgaccugcccagcucugccgcggguggggaggcuccgacgcaccccccgcccgaccgccccagcucacccaccuccgggcgcggcaggucggggucuagcugcgugaagcugugcagcaccaccgggcagcugucggggacgcccaccuccaggcgcacggcgucccacacgcugcggcuccgccgggagcccggaaacagcggcucggcgccgccagcaggcccggccgccucggcccacaugcgcugcaccauggaaggcucgcagcgcgggcgcggggccggcccggcgcgcggcgggggcggcggcgcggcccgcgcggcugggcuuugccaccgcugugagcccgcggcccggcccugcugaugucaggcuggggggcggggccggaggggaagaggguggggccggggaggggcggaaccggagaguccgagggacgcgugcgugcgcgcgcccgcggccccgcccucgccgaggucagacccggggcgggaccgggagccuggaggggcggggucugaacaaagagggcggggccggggaggucgaggggugcgcguuggcugggucucccggaggaccggcugucacgugugucguggggccuuggguaccccgguuaggcaccguuugcgugucacgcugcugcagugcguguguugcguagggcugaaauguguacgugcugaucauguguggggaagccgcccuggagucagcuaccccgaauuccagcaaagccucuccccaacucuguggccuuccacaaguugcuuaaccccucugagccucacuguuucuucaucuggaaaaucuggguagugaaaaugacuuccucaaacaguugcggggaggaugacauuacguaauggacaugaagcacucagcacugagcaccugcaccugacuacaggcucaggcggaguuuggagaggcugaccauguguucagugacccugucagugcaauuggaaauccugaguguggggcugugugugcagugggggaaagggucagagaguggggcccuaccuuuuuggggcaaagccccacacuauccccuuacagacacccucagaggaggggaagccagggaggugggggagagcggaaggcaccaagguuggggcugagaggcaucugacaaggaggaaggcaucaagagugacaacgcugggcagagcacauggcugcguggccugucagcuggggcugcuuguggcuuggacaucccuggucucaggguggaaguggggcugcuggggcugaaggggaagcagggacagggacauccucaacuacucuuucuggaagccagugaggaaggaagacagccuggggcuuaacagcagggccaggagaauggaugaaugaaugggacccuuccucaugccucacucaucacugggccugcccuggccucagccuucagucuucauggaggccagcaauugcugccagcagcccuggccaugccaaccuccccaggucugguccguacuauugggccucaguuucuccaucuguaaacugagagggcgggaccagacagcacauuccacgagcacaucuugcccccuucccaagugccaauccucagacacccacgaaacacuuccacugugacuggagugaggcggcaguucauccguucagaacaagacccccaugugcacacgacuagaagggccuacuucacaaaaauuauggugguaaguugcagcuggguggaagcucuacugguuuucauuuuacuucucugaauuucuaauuucuaaaaucaguauuuuaauaaucagcucuaugugauaaaugcuguuuuugagacagucucacugucacccaggcuggagugcaguggugugaucucggcucacuaaggccuccgccucuuggggucaagugauuuuccugccucagccucucgaggagcugggauuauaggcaccugccaccaugcccagcuaguucuguauuuuucguagagacaggguuucaccauguuggccaggcugaucuugaacuccugaccucaagugaaccgcucgccucggccucccaaagagcugggauuacaggcaggagcacuacgcccagccuguuuuuguuuuuuuuuuaagaagcaagauggguagauuugauuugggauggagaucccuagaggcuguuuaggaagccuccaagccguuuggccagggaggguaaugugggugaggcguauuucgaggcaggagguccccacagggccacaaagaggugaccgagacacugcccucggcccuaagcuccuccucccaucccuuucuucuggggccaagcucccaaugccuccggaaacugaaaguccagaagcugccugccacugacuuuaucuccucugcucucuuuaucuccuucgcugagugaugggccugggaacaagcgcccacccguuuuauagcccagaaggacaagugacucaugaggacauagaggaaucaccacuauucuggccuugaagguccugggugcuggggcgagggguggccccaaggaggcuggaguggugaagaguaaagaauucaucacacuaaaccccccaacgcggcuggccuggcucccucccaucugacuauaucaucuacaggagccagggcgggggagggcguuacuuagccagucccucuggccggugucuguuuuuacaaaguuccucuuccugccuuguuccccuaccuuugggacucaccucccaacuucugggaagccugaucacugcucuggcuguacaugagacacacacacacagacagacacaaagauacacagagaugcacacacagagacacacacauagagacagagacacagacacacacacacacacagagacacaaagauacacagagaugcacacacagagacacacacagagagacagagacacagacacacacacacacacacagacacacaaagauacacagagaugcacacagagacacacacauagagacagagacacagacacacacacacacacagagacacaaagauacacagagaugcacacacagagacacacacauagagacagagacacagacacacacacacacacagagacacaaagauacacagagaugcacacacagagacacacagagagacagagacacagacacacacacacacagacacaaagauacacagagaugcacacacagacacacacauagagacagagacacagacacacacacacagagacacauacauagagacagagacacagacacacacacagacccacagagacacauagagacagagacacaggcacacacacacacacauagagacagacacagagacacagacgcacagagacagacacaggcacacacauuuagagacggagacacacacacagagacauuggaacagagacacacacgcagagauagagacacacagacagagacauaccuacucagagacauagagacagacacagaggcugggugugguggcucaugccuguaacccagagcuuagggaggcagaggcaggauuucuugagcccagaaauuggagaccagccugggcaacauagcaagaccccauucuccacaaaaagggaaaaaacaaguuugagauagacacagacacacacacacagauauagagacauagacacagauacacacacauagagacagaaacacagauacacaugccccccuaaugaaggcacagauaaaguucccugcacaggauguguugcccaaugcccucagaucgggcgggccugacucugccucacacuguuagcaacugggguuggcauucaugggacgccuccugcaugcaagacccucuccugaggccuccuguaagcuguggggacacccuaaccaagggcaaggccauccugggacagcgugugucaccaguggaggaacgcagcaccacucacaguguucuccucaaaacccaaaccuaaaucaaggcaggccucugcauauaacugccauuugugggauuacaggggacagagaaacauguucaacacaccacaagggugcaauccacaaauccaggcugugggaaccucuaugggacaaacaacccaguuucuucaacaaauacauuucagaggaaaaagaaaggggaaacuagacuaaaagaagggucagagacgucuaacaaaugcaauguguggauuuuggaucaugaugucagcaagacaacuguuuaaaaaaaacaacuauaagacauguggauugucugaacacugcuacauauuggaugacauuagacaucuuuuuaggugugagaaugguguugccgucacuaguagaguuacaucuugggcuaucuguggauggcaucacaugccugggauucauguaaacaucuccaggggcgggcagggaguggggcagugagaggugaacaagaguggcccugcaccgauggucgugaaagcugggggucuuuaugccauuuucucuauuuuugugucuauuuggaauuauccauaauaaaaguuauaagaagaaaaauggccagacgcaguggcucacgccuguaauuccagcacuuugggagguugagcuggguggaucacuugaggucaggaguucaagaccagccuggccaacgugguaaaaccucaucucuacuaaaaauacaaaaaaauuagccuggcauggugacgcgugccuguaaucccagcuacuugggaggcugaggcaggagaaucgcuugaaccugggagguggagguugcagugagccgagauugcaccaccgcacuccagccugggcgacaaagcaagacuccgucucaaaaaaagaagaaaaaggacacagcuugagacucacccucugaugccucugaggcucccagcaguccuccagagagggcuacaaacuucugaccccgggcagugacuccugccaggcucaccguuuccuguauuacucucugugggcacaggggucacugauggcaucuucacuacaaaagggguugggggcucugcuguggggacugaggccgugggcagcuagaacccgaguccggaugcccacauggggcuaucagagauggcugggggcaguccaggugaacuuggguggguuugacacucaaggccaaugacaacccugugcuuggcgguuggagccucugcugggaggaacuaaggacucucgagaucacuaagcacugcccggaagugggggguucuuaugaaucggcauugaucccuuccucccuccugccccagcucacgcccccccacacccccaccuagccuucccagguucccaaccuccccccgggacgugcaccugccuuuccuugggggcuacaaccacaagccccuggagagcacggcugcacagaccuuucggaagucgggacgcugcucgcagaggaacuuuaaaaggcaggcugugaacugacagcuggcagccagaucccacccacacauguguuuuguuuggcuugcgaaguguuuuuaaaauuuuaagccaacaguaaaaggucaggcgacuucacauaaaaacccacauuucccucuucuccuguaacucugggugaccugaccacaccgggucuguguucccaagugccgccggaagcugacugcagcugcccccuguagccagggcauguguggggacugcucugacaacugucccccacucccgcagugcccagugcccgacacccuggggagucacugccaccccggaggggccaccaauucaacaugugacaacccgaaguggagggaagcagaggaggaagagacggagggggacacacagauggaaacugagcccaagaaccaagagugagccugaggaccacagcgagggacagcgggagagggaggcagcaggcagacggaggcgaggagcgauuccuugggcaucuuaagucacucucuggccccugagcagcugucucguuuagggaaaagguguguucaggcugaaucucuguggucccucuucucccugcucccauacccagacaccgcggccaguggggucuugaucccgcaaagccccccacugcccucaggcagaagaccacuggcuugguguggccccagcuccccacuccagguucccucucagcagaacugcugcagcuccuucuucaugccgccccuucugucuggcuggugcgucccuccuuccacccauuccuuggccaguacauccuuggccgguaccugagaggcagaucauaaaagcugccccuguggaccuucaagucgggacccaggccugccuuaacgcagggccccagacagugggcuuugggccuggggugcaguucugggggcugccggacacacagcaguucagagcgggaacugggcacagggcagugacugggugacuguggccuuuggccaucaccuuuuccaaccugggcuuggccaaggccgggaggaauggcagccagguacccugacucaggucaggcccugguggaaaaccugucaccuccuguugggcagguggaggucacugaccccuuucugucucuugugaucuauauuuagagccuggggaggacaugaaaagggugaggccuggacacgcuccuuggucauuucccaacacugacgucaccauuccuagccugccuagguccugggguggcccucugugggcgggugagcacacaccuuggcaggaggugacgcagcuggaccacgcgugggaacucccggcacagcgggcgggccuggcucagccccaccuccccugccacuggguuccuggcaaccucugguggcuucuuccuccuccuucugccgccaggaugcagggguccccacaggcgagaggcugaacucagagcuggccaggugagaagcgaagcaccgaaccacugaaaucuccaggagaccacacuggguggcagaugugacagcaacccucugaccucacggggcgcugccgucccagcacaaccagaacaaggugugccgaugccgggagcagugcaaacggcccuggacggggaugcagagggcuccggaucagccuggggcucgcuguggggcccugcugucaucccuuggaaauggguacacccccggcauauugagggggaggcacgcagaggaacaaacgugauaaaugcauccaugggcugcaaaucgggggccgcucggacagcugucccccacuccugcagugcucgcugccuggcacugugaggagucacugccacccccgaggggccaccaauucaacaugugacaggccgaaguggagggaagcagaggagagaggaagacauagagggaaacugaacccaagacccaaaagugagccggaggaccacagcgggagagggaggcagcaggcagacggaagcgaggagacagggcgcagaggggcugcggggggugcugggcacaccuggcugaggaagggaccaaaggcccagagggucccauagucucagccuaguaccuguccccaagcccaggggcccugaucacaaggcagcaacgucuaucccacagcugugauagguggggcacaucacaccccgaggggccccggcauccaugaucuccccuccuggaggguggucagccgccauccuggccccggacuccuuggaaaugcuccacaaagugccagcuggaaaugucacagcacagggggccuugggaugagccagccccaaggggccauucuuuccuguggguuuggggaacucuuuuaagaucuggagugcagauucggguuccagugccugcucugugucuuccuagccuuaguuucaccuccuggggccucaauuucuccaucaguaaaauggggacaguaaccgucauagcaccagcucucaggcuucucaggggagcagacagugaagcagugcacagaaguccuugguaauccaagaagcacccucuggacggagcugccaggacagcccgcagccacccuggacugacccguggggcugggggcagcuggggaggccaagcgugugcacacgggcaccagcagcagagcagacccccagucuccucucucauacccgagaugggagaugaagacuccccugugaguuccaaacuccuccaaccaguucuggcagggaagaaagggaguccugggaaagcaacucccaugccuggggcucggcggugacccacccagccccuccccggcagaggcacugguugcccuggaaacucaccucggugguggccggugcuggcagaggugccagccaaggugucgggcuuuggagagcggcacgacgggcgacggcccuucuccuggcggucaccacagagacacaggcaaagaacacagagcccuuccucccccugggcacggcaggccuggcacaaaccuggccugcuucccgggccaugguggggcgagagccagguggggagugggcccugcgggaggcccucugccagugugcucgucgccugcgugcccuaguggaguggagcacccgagugccugggccuggugucacccgcguggcugucauaccugcugcugugacaggcaggaccaggaauucccgcuuguaccaggccaugggccagccgaggacgaguggagaggcugccccaagcuagccuagcuuucucccuuaauucuccaaguccccacucccauucccccugugucgggggccuggaaaccaccacacagagccagaaaggugacagauacaaguaaccaaaucaaaacaggguucggucagcagagccaccaggcggaugugagucuagccagaggcacugggaggcaggcaggagaccccacucacuuguucuggaaggcuucccugcccccuagaccugagcucuuccaucccuggcacccaggcacgagauuuccuuucuucuuuuuuuuuuuuuuuuuuucccugagauggaaucucgcucugucgcccaggcuggagugcaguggugcgaccucggcucacuauaaccucuaccucccgguucaagugauucuccugccucagccucccagguaucugggauuacaggcacaugccaccaugcucggcuaauuuuuuuuugagacaucgucucacucugucacccaggcuggagugcaguggcauggucucggcucacugcaccucugccucccggguucaagcgauucuccugccucagccuccuggguagcugggacuacaggcgcaugccaccacacccagcuaauuuuuguauuuuuaguagagauggggcuucacuacauuggccaggcuggucucaaacuccugaccucgugauaugccugccucagccucccaaagugcugggauuacaggcaugagccaccacacucagccacuuggcuaauuuuuuuguauuuuuauuagagaugggguuuugccauguuggccaggcugguucgaacuccugaccucaggugauccaccugccuuggccucccaaagugguaagauuacaggugugagccaccgcacccggccacaagauuucauuuuaacugggcgcaggggugggggaugccaaugguuuguuucauuaaguagggugguaaaaaauaauaauauuaccaccacuacucccaccauucagaaaaaacaccaccaaagguaacaagaaagggcugccaucagaaagaagggcaggcuugaaaugaguacauuuggcuuuuagaauaauuuacuagagugacuacuggaguuguaaacaaccaccaccaccaccacaacaauacaacaacuuacuaccuugucccuguuuuucucauuuugcugcaaaccagacauuggaagccaucagacgcauccaacacacccgucugacaaguggaaagacugagccccagagagagcagggacuugcccaagaucucacaggaaaagugucuguccagcugcucugcaaagcuugcagacgcuccuuccauccugaccugggggccagaacacucagagccccaaccccaaagcccagagaugccagggcgaagucagaggccaagagucucagcuacuuccuuaccuuccugggaaccuggccggguggaugcccagucccuggcugcaaguggagggcacagggcagggagcagaacagcagaggcggggaggagagggugugggcaggggcuguggagugcccccacaggcacaucaggcccuggggcccggcuucccgcccagacacugccccagcagcaccucgcucccagcccugcuccucugagcaucucacauccucuuccgguggcuuugugggccuuaggggacccagcugagcagacaguucagggccugggagcucugccacccucaggguggagacucucaggggaugugggugggcaugugggggugggcugggcuggggugggggagcaucagagaaauggagcuagaggguuucaggggggcccugaaaccuaccucccuguacucacccuguggccagaacaagucaccuccacuaaaaucccuccaccauuucugucccacccagaagagaaucccaaguccucaccugcccacagcccccuccuacuaacuccagcugccaguguccucugcugggaaccauguucuucccccuuggucucaggacucggcccccagucagagcagccuucuccaacaccccugucuuaaugcagcaacaccaucccugccccagccacccauucccuguucuuuuucaucuggcacacuuccuccucugugccaggcuccaaggcccuguccccugggaaagucaggcaucaccacuggccucucuugcgcacagugacucaaccuugaccuucgaggaacaguagagccaaccaggcugugaauuggucagcccaggacugaaauucugauccccagggacucuggaacccugggccaaugauuuagcaucucugggccuuaguuugcuccuuauaaaaugggcacaagggcgcuggaggauuccacaagaacucagcaugggcucggcucauggccgugcuuggcggaugugcaaugaucauuuccaguggggauugaggaguucaggugccaaaggguuacaugccugccccggugccaggcacauaacagacauuugaucaauguugguggaugcugccccugugccaggagugccauagccugacuccaucccuggcagcaagguccagauggcaguccggggucugcccagugcucagaguguggcuuguaacuggauccuagcagauagcuuggaaauguuugcugauguagaagcacacacagauggguacugcaaggcaggcccggucccgggagaggggaccagcgaagaggucacugucuggguacacacuauuaacgggagagacgcccugugcagacaggcaggaucugggugaggcaggcggcagggguugguauccgagcagggauccgaggcuguccccagccucggccucucaccccgguguugcugacugccuggccaugugacugugggcauuguguggugugguucggcugccacuccagguuuaacagggagcuuaccacgugguuugaggggguggggagggcuuucccugagccucgguuuccuugucugcaaagugugaccucgcagccuagccccguagaagggcucaguggccgagaagguguuuccuacagugugcgcauguuugguuggguggggggcuuaaagaggcccuggaaagaagcgcucaacuuucuuuuuuucuuuuuuuuuuguuugagacggagucucgcucugucacccaggcuggagugcaguggcgccaucucggcucacugcaaccuccgacucccggguucaagcgagucuccugucucagccucccgaguagcugggauaacaggcaugcggcaccacgcccagcuaauuuuuguauuuuuaguagagaugggguuuuacauguuggccaggauggucucaaacuccugacgucgagauccgcccgccuuggccucccaaaaugcugggauuacaggcgugagccaccgugccuggccagaagcgcucaacuuucauagugggggugggggaccaguagggaaguggcagggaaccaggccacccugcugguguguuugugagcuaaugccuuugcuuggacaagcagcucccggguaccaggcccucugcagggccuugcaucucucacacaagcuuucugugcuauucuugaauagcccacuccagcccagcuucccaagccuguuacccccauaucuccccugcccccaccuccagcacaggucagccuggccucagggccuaauccuggggcuccuccuuucggagccagggugggcagggcuacccggggcagugggcacugagcuugcuggaaaggccaucgagggacugcugacacagucaggcugcaggaggagcagcaccagcugccacgcagaaaugcaggagucccgaggagguggugcuggcaggaggggagcagcagggccaugcaccccuccucccacccacguggucccuggcccugccucugccgccagccugggggagagcagggucuuuguucccugcuggccaggccgccacgugaugcgccacaucacugucacugccuggaacgaagacugccauggacagccgaggcgcuggggccugggggugaggccaguuggaggagcuccaccugcagccuccccaccgcaacucuggcugccuucaggagcugggccuagugagggccauacauggcacaaacauuuccagcuacugugcaugaagcuuacgacgacccugaccccaggcuucucccaggacacacgaccuaccaguggucccacgaugcucugcccagcacgccggguggccugggauaaugcaccuggccacacacacaagcccaggcuagcaaaacccaacccacaggcaccuuucuagguaggggcaggcccuggcugggugugaggcccauuguuuacaaacacugugcagcugucgcuaggagcugugacucagagccagagcagugacuccucgcgaagcuguuuacucggcaccacauccuguccaggaagcagauagcagaggccgaggccuggcuuuugcuccucuuuccugcugcuaacuugacucagggagcugcuggccagacucgguguccagcuggggggacacuccagcuccccucccccuggcuucugggaaccugaggccccgucaagucgcucaacacacauucaggcccagccggcucugcuagguagugaugcuguggucgugcaggagacagauccugccccuggaggcugcaccuaugccuggcauccccucccucuuuggcucugacuaggagacucccagggacgggggcaucacugacaccugucacugugcagcccagaggcaaauucuugccacguucagaagccuggcaggcaggaucaacuccugacaccccuucguacccuagagccuagucuggcgccgccuuuagcacaccucaauggggacaaagcacuuuuccagacagccucugccagaaagaugaggccacagucaucaucucuguuguaaaacugagaaaacugaggcccagagagggcgaacaacuugccugaugucacacagcgugucagugccaaggcaggguguaaguccggcccccaaggcugcuugcuuuccucuacucuguuccaaauuaaggaucacaaguagauuuguuccaggcagcacacagacuugacgcugcugggacccugucccugggguggguggucuguccccuguaggaggccuaggcuggggacucugacuuccauuucugcugaucacugcugccuccaaccuggcgccuaaaccagagucaacaacccucugauaauuucuacuacgcacugccaugccaaugcggguaucauuucaccaucaugauaugugacgcagguuuugcaggugaguuugaggaugaagcucagagauggcacaaagcucauccaaagccacacagcagagcagggcuuccaauccugucugacucucagguuugcgcucccagucacuccuuccugcaaacuccuagcaggaagacucuuuaugacuuuucauaaagagucaaaggugauuuuauccucacggugcccuucuaaguucagggugcaaguaucucaaugaccuccaguucacaggagggccccugugugugguggggaggcagagccgcagaaugacuuguggaaggcuacacaccccaguggggaggaccuuuccccugcuccaggcuagggagacccggggacucccaggagcagcagagccacaggacacaccugccaaggcauguggaaggugggccacccuggaguggggagagaaaggcaaagaggggcugugcuuauuuuggcaguuggggcuuggcaccaccccaggcaggacaguaauucagcaacuggcugauucacccaccgcagggcuccccugcacuggcugccugcccgccggccccuauuaccagcccacugagucacgcagguugccaagaagcugaggauccaagaauccaggcccugccccagccgcucccauuggcuuugagcccagcaggacccagcccugccaagggcaccgcagcuccccuccccaacccugccugcccccagguccagcuccaggaggaacccaacgucuaacuguaaggauccaagcaguggcugggagcuggggccuacagugucaggagucuugggccaaacccucauccugucacuuccuggcuggguggagcugggugagccaggcagguuccuuucccuugcugagccuugguucuagcccaucaacagggaacaucucugccucaaaaagacugcaugcugaaaugaaacacuggaugggaagcacucaagauagggccuggcacaugcuccgugucaaaaaaauggcaccccaagguggcauccucugcagggaagaaccagaguucuuauuuugaauucaaggccagcugauacuucuguaaaaugcaggugaaauguugcagcaaugucaacugccauagaguuucuaaacaauguccauuucucuacugaaggagaugaggaucaguaacagaguuuguagccugcacugucugcagaccacagagagggcccggggcacaacuauauucacacagccagaccacgcgaauuuacugaacaccuacuaggugccgggcacuauucaagugccagcgauagaccagggaaaaacacaacacauaaaaaucaccuuuggccuaggucauaauaaguaaaaugcauuuuugaaaauaagaaugcuccagaaggcaaaaacagaacagggaaggcugauggggcccauggggcaggagcaggugcuacaacugcagacaggccaggagggcugagggggcagcgcggguauggauggaaggagggacauuaaaacauuucaccuuggccgggcgcgguggcucacgccuguaaucccagcacuuugggaggccaaggcaagugaaucacuugagcucaggaguucgagaccagccuggucaauguggugaaacccugcaucuacuaaaaauacaaaaaaacuagcucgggugcgguggcucacgccuguaaucccagcacuuugggaggccgaggcggguggaucaugaggucaggaguucaagaccagccuggcuaacauggugaaacccuguuucuacuaaaaauacaaaaauuagccaggcgugguggcggcgccuguaaccccagcuacucgggaggcugaggcagagaacugcuugaaccugggaggcagagguugcagugaccaagaucgugccacugcacuccagccugggcgacagagcaagacuccaucucaaaaacaaacaaaaaaacuagcugggcaugguggugcgugccuguaaucccagcuacucaggaggcugaggcaggagacuggcuuaaauccaggagguggagguugcagugagcugagauagcaccacugcauacuccagccuaggcgacagagcaagacuucgucucaaaaaacgaaacaaggcugggcgugguggcuuacgccuguaaucccagcacuuugggaggccgaggcgggcggaucacuugagcucaggaguuugagaccagccuggccaacacgguaaaaccccaucucuacuaaaaauacaaaaaauagacgggugugguggugcaccuguagucccagcuacucgggaggcugaagcgggagaaccacuugaacccgggagguaaagguugcagugagcugagaucgugccacugcacuccagccugggcgacagagcaagacuccgucucaaaacaaaacaacacaauucaccuaccacgggguccuuucaugccccccauggcggggaguuuguaagcuccuugagagcagggacucuguuccccaggguccugaugccuagaacagcaucuagcacacagcuggcucuccauaaaugccuagaugaacaagugagcucgaugggccagacucuaaaauauucggagguucuugugggaagaucaccaggagagcuccuuggaagaggugaugaggcuggagaggagccugagggagggcagggggccggagggccagggaagggcggggcgccucugcucaccuggcucccucccauuaaagugcuuuccccccaggaaccaggcugagaagagaggcagaggcaagccaggcgggggaagagcgaggaggaaggcagccaggcuuucugggaagcaagagcccuuuuucuuagaagcagggcccuggaguuucccagaagccagccugcccugggacgguggaggcggugguagguggucagguuggcccugguuuaaccuaggggguuuucccuuccuaaauuccuggcccaggaacaauucuuggggaaugggucucuguucacagguaaguagaaguugcucugcugugggcagagaccccuccccaaggcacagccguggcuggugaggaugggggaugggggcugagcccacagucaggccccuguguccagcaggcccuggucgcccagugcgcucgggccaggggaaccaggacaaacgggcccuugugguugggaggcugccugccgugccagggacacugugugcccggugccgccaccagccugcugccugccugaaggggcugagggccugggaaguggggcuacuguuuccaaagggaaccuccuaagcugcccuggccucuggagagggcacagggccuuggcuggcugccaggagguggcagggcuggugcccgcugcccucuuucucacaguccuuugccugcaagaaguuccccagggcuagagaagcgcaaucccuugggacucuagggcccugggucugagggacacugcugugucccacccuccugccacccacugucccguuaaucccugggcuuggcuccuuccuuggcuucuccccuggaaggcgaggcucaagggccucuccuaucugccucaccugggaugccugacaaaggacagcaagguaccagcugcccuccccugcccagggacccuccaagagcuguucaggucuccaugccagcaucauggugggcagcugggugugccaggcaguggcugagcaguucccagccaccacaacccugugagcuggguccggcugucaacccagugacacaugagaaaacugacacucagcccuccucauggucacggcuccggccugggccuggugcuuuguuuguuuguuuaucugagacagagccuuguucugucacccaggcuggagugaucucggcucgcugcaaccucugccucccagguucaagcaauucuccugccucagccucccgaguagcuggaauuacaggugugcaccaccacgcccggcuaauuuuuguauuuuuaguagagaugggguuucaccguguuagccaggcuggccucaaacuccugaccucaggugauccaccugccucgacuuccaaaaugcugggaguacaggcaugagccaccgcaccuguccaggucuagugcuuuaaaaaggcaaaaugcaaacccccacucccucccacacucacuguggcaacgugcugucccuccccaggcaccagccauguguccccacacgcagccacacauaccccuucauauaugugcucccucagccacugucaagcuugucacaucugagcacaugcaugcugcagacauacagggucacccaaaggcagagagaugcaccugcccccaacacacgugcuagaaugcacaugugccccaccgcaucccacagcacacagccgcugccccugcaggcccagaggcccuggauacacacccugcucccugcauaucugccagacagcaaucuccucagggcugcggagaggggaggaggcagggcuccaugcagggacuccccgaccccagaagcugggaaggaaacaccucauggaguccugaagaacggcaagcggcuauuucgagggggcagggggaccaggcaggcggugccgccagcugagaccuuccacacugggcacuacccaccugcccacuacccccagcugucaccuccccagccacccagggccuggggccagguggacugcuucacccuugaacuccaguccugucaacugggcagcagggccuggaacuuggccucagggaagaagggggucgggggagagugggaugcguggccugggcaacuuacucgccuccucggggccguaguuccccuaccugaaaaaaaccuguggauucaacuuagggccugcaagugucccugcccuccacccacacccuggcuccccaagggcagcgggagcuggugggccaucggccaucucccuucugcgaagcggagcagacauuggcugccaucugcggagggccugcccaugcggugccaggggccucaggaacaucucauacucccccacauccguaggcccacagaggaggcaauggggguacagaggaguuaaggaacccacuugucuggguccccugaggccaagccagggcucccaucccaccucccaggcuucucuccccuugaccucuagacagcccgaacuucccugcggcugcuguuccuggugaacaucgugacagaugacagcacuagucaggugauuaaucagcugaucacuugaucaucgggacagauaagugcugcugcagcuauagcccagcagggguggggugggguggggugggagcgggaaucccuuuggaauggauucaggucaggugguggcagcccccaggacuuaaauaccuucugccacccuccccauggucccacccuccccacggucccacccucccaguuuugaacuuacauuacaggcaaagggcacccccccacacacacaucugggaucaggacaaagucccaagaggggcgggugccagaggugggggaaguuccuggacucagggccucugguuggccaagggugcuuucuucuuucucuccacuggacaagcccaccccucccugccuuccucccucggaacacaaaggucagaugggcacaccugaccucucgggugguguccagcagagagguccugcacccuucccaugggagcccuuucuggacccuaaccuagaaagagggaaggacuggggugcccuccagcaggcagugggucccggccccccuuauccuucccagaaggacugggcagcucaauucaguuaauuaugugcccaccaugcagugcagggaggggaggccaacgugggggaggggguggggaagguccuuagugcagcacccacgcaggguggguggggcugugugccugaaucuucccucccaccaacuggcuuccugcagccuguuccuuggugcugggcugggggcucgccucauccgcccgccuucuuggcguggcauccggcaagaacgugggccggggcugcacgcaccuugggcugugggccggcagcuccccgccacugucugugcugcccucugcccugccccuccuccuguggcacuccagcuggggguggcugggcagaguccccaugggaucacccugagcccagccgacgacccccaagugaacauacgagcccaguacccaacuccggaggugggcacaccccuugcccauuugacagauggggcaagggaggcucagaggggugaaaucaugacccagggucacacagugagcaaaugaccagggucagacuggcauccuggcuccaugagagcaccgggaguuccugcagaguugucaccaacaguccuacccucacugccauccccagagagaacaucugaggcaaccaggucucauagccuucccauccccaaaguccaacccacugggcaguguggccccaccugccuuuucccaccauucuacugccccacccucucccagggucuggggcuccaccucgcuccuuccaggcuggacaccccucauccauguucucaccucggcucccgcagugcccaagucugggugcagggugggugcccacaaacuaaggcagccccuaugggagcccaagggcagggcuuucuuacacccucacagcaacugcggggaccucagggcagacagggaggcucagaggggaccugugcugcuucuaggaugcccagcaauaagcgcugagcuggaauuuggacccagguguccugcuccaaagccaccugccucaccugaggaccaggggccugauggccgagguggaugccgacaugugaggaggaagggcaguggcggccugguccugguccccucacucuccugccccaaggccccaguaggugacauaauucacagggcaauguuuaugcacugaacgguaaacacacaggcagagggguagaugggccaccaauggggaaacugaggccagcgagaagggacacacuaaggucacauagucagucgguaucaaaguuggcccagaaccacaguccccuguuccaagggcuguacccagcccaaccacaaccuggcaugccauccagccccaggccagggagcccacggcugcagggcggcaaagcacacgguaccacacgugguaccccauggccccacacacucuggcuggcaccgagccaucgcugugcuuucugaccuugcguuuucugacauucugccacugucaacucucacucagguauccaggaagcggccucuguugcuaggggacuggcuugaugccggguggcuggcagaguggggagauggggaggggggaguggacuggggugucccucaggaaggauccaggggcagagucuacuggguccugugucaggguggagggccaugagaaguaucugaggaaacucagcaggucaggccccuuccuccccaggcucuaaugaagguccuggacccuggucucugcauuuucucuuucagccucagagucuucuuuuugggccaggggugggugugcgcugguggggguuggaagugagccaucggaaagcccaucggaaagccccagcccggagccuuccugcaggcaaguauuuugggggccagcaguugccaagcaacugcucuggguugccacgggaacacucccuuuuuucuggggcuugucauucuuagggggaugccacaaugcuucccguucccuuuccucuccacuuccucacccuggcuuggcugcccugggaggggacacugggaguccauaagcucacaccccaccccuaugggggggcccacauaccccuggcccuaagacucuuugaggcuccagaaucaagaacccccaaaaugcaaagcccagaguccaaggccuucauuagagcagggagacgaugaaaggggcucauuagcucuguuuaugucuccuugccgccauuaaccaccacuuggggccuagggccucccagccccgcccugcccagcagccgggcccagcccugaccguuggaaggccacuguaauuggaaggaaugugguccuggugccuggcccuucccaggcuugugugcacacggggaggcgccauugccaagcugccacuaccuagcugugggaguuccuuccccuuccagugccucaguuuccccaccuggaagugaggauggcaguggcacuuaucuugcagagugcugagcagauacaagggacacuuuagcacaaggccuacaggcuggcugucaucaccaggcaccucugcagcaggggacagagggaaggacucuguggagaauaguccuguggcuagcgugcaauggugacugaccacgccacugauggcagaguggccacugaauccagguccccaggcucgcagcccaugccuucuccacaagaucugucugccccauaccccugagccuuccacagaagccagggugcuucccacaggccaggcacccagcgccagccagguguacagaggccaguaucugcugugugaaucaaucgcugaaccaacugucaaggaccagcagccucaggggcgggccugguagcucggugagcgaggagguggugggagggccuugugcggguagggaggugacaguaagaaauggccucuugcuggaugcagugucucaagccuuuaauccuagcaguuugggaggccgaggcggggggaaucccuugagcccagguguuugagaccagccugggcaacauggugaaacuguuucuacaaaaaaaauccaaaaauuagcugggaguguuggcgugcaccugccgccccagcuacucuggaggucugagcccaggaggucgaggacgcagugagccgugaucuggccccugcacugcagccugggccacagagcaagacccugucucaauaauaauaauaauaauaauaauaauaauaauaacaacaacaacaacaauaauaauaauaauaauaauaauaauaauaauaaaauaaaggaauggcuuccacucauuccacuccugggccagcggcccgcugugcacuccgcucccuuucgcugaugccaugugagcagcuccauggcggggaccugaccccugcuccucagccccacacugccucgccccuuuguauaucaaaggcgccucugaggggcugugcugacccccaccaggagcagcaggaccaccucaggcaucccagcuccccugaggcagggucuggggcugggguuggggggaaggaccccucaagucucuaucugcacagacagcccacccgugcccagggcugccuuccgagcacccgcagaccugggccugcaguaacaggagagcuaucugcaaaccgcagugucaucagccgcacggccucuggagaggccugagaaaggccggcucagcuugcaggcgaggaaccaaacgaaaggcaaacuccuggccccugcagccucgcagguccccuaucccuccucccugccuuccuuuccgccccgcugacaccacggucugcaaaccaugguccuccucgccaccccugucaccuccuccuccgccccccgccggccuccgacgcaaagucgccacccagucaccccgccucggccccgccugguuugauuuccucccgugugugucacccaugagguggccgugccccuggccuguuuacagcugugcgcaagcuccucgcgacccgaaagcgagaccuuugucugcggcagcuccgcgccgggcugggcggccgcacgggagggcacagcgccaccugcuggugcugccgccagagcgcgccaagcugaggagcaggcgggcuccgcucacgcccccacacccccuggcugggggcuggguuccugcgaugucuuccgacuccccgcugcuccccuaguccccguaggcacgcggguacccggccuuugggagggggaucauucccaauacuccuguuacggguugaacugugucccugaacaaaaagaucucugguacccgugaaugagaucuuauuuggaaauagggucugugcggauagaauccggaugaggucauacuggauuagggugggccuuaauccaaugacugcuauccuuaugauaacagggaaaauuggacagacacgcacaggcggacagacacgaacugaugaaggcacaguuugcagucacacgucuacaaaaccaggaacgaaugccaaggaaacuggcagccaccagagguuggaagaugcaaggaaguauccucuccuagaaccuucagagacagcauggccuugcugaccccuggauuuuggacuucuggccuuuagaacugugagagaauacauuucuguuguguugagccacccagcacuuugugacagcagcccaggaagcugacccgauagacacuggucccagucaucacccucugugccaucaccacaccuccccuccacgaaucaaccacgaccacaggacaccuccuucuggaaucucucugugcccacgcacuccccagaugagcacuuccccuuccccuggcaacuccccggauucuuguuacccccaccccccgccccggcauggccugggcccaggagacagauacgaaaugaaugagugaauauccaccuuugcuacuucgucauauucagauguucguaaaaaucuguauguucgucauauucagauguucguaaaaaucaaguggcagcagugcuggggguuaaggaaauggggagagugauggcagaugugugaggggagacaaggggcacuuccagguacucacagccacccugggagcugggacagccaaccaguguguucucaugcucccagccccugaggcucagagaggggaagccaucugggucaccaagcuccugccucuugccaguucugugaccccaaacuagccauugugccuuucagggccuccccagucuccugaccugcacaauggggaugguucuaacgucuacuuccuggggacaucaccacgcuaaugugagacaauacuacaaaaccuguuagcugccucacagacuuagagauggaaggauuaggaaggaaaagggccuucagagacugcaggguccugcugaccccuggauuuuggaccucuggccuuuacaacugugaggaaagaaacuucucacaggggcgagacacagcccggaauacaagucggacaggcugggcacuggugcugugaucuggggaaagucacucccuucuuggucugguuuccucauuugcaccaugaacggguugaaaaugaagcaaaaaucagauaucggcccccuguggcauaugggagcaucuuccaaugggaacaccuuccaauggcucccaugauguuuguuuguuuguuuguucguuuguuuauugagacagggucuggcuccgucgcccaggcuggagugcaguggcaugaucuuggcucacugcacucaucaccucccagguucaagugauuuuccugccucagccuccggaguagcugggauuauaggcaccugccgagacacccagcuaauuuuuguauuucuuuuuuguagagacgggguuucaccacguuggccaggcugguguugaacuccugaccucaggugauccacccgccucggccucccaaaaugcugagauuacaggugugagccaccgcgcccagccuccguuauguuuagaaucaggccugacugccuccucucagacacugucccaggcagccuccacacuggccccagagaucccugccuccugguacauaaguugcugagugauccccuuccuccgagggugauuggauuuagugacuggcuucucaccaacagaacacagcacaggugaugugaggucacuuccaagauuuacaaaaaacuaugacuucugucuugcuuguuugcucuuguuuuccuccccaccuucaccccucacucuggggaagugaguucugaugccgugagcugccugcccuacagagagacccacauggcagugaaccaagggagggcccccaccaacagucacagaagaacugaugcccucagucaaaacugaauccugccaauaacaugagaauggccugggggcggguccugcccaguccagccauggaugagaccccagucccagccucccuugagaccugggggcagaggcacccagcugagcugcccuggaucuggguccacagaaacugugugaugaucaaugucuguugcuggaagcuguacauuaggguaguguugucacauagcuguccacaggccccugggcugccccucccacccccagcucacuugggccacacuggccuccuuucucacuccucucuggccaaacucauuucugccucccagcccugccugcugagccuucuccaucacacuguccagacucgugcagggcuggcccaugcuuugucuucuggucacagcacagauguccccuuagcgagaccucucagauccccacccagcaggccccagcccuccauggcagccccggcauuauuuucgcugcagcacugcuuuuuccuuucugugccuguuugcuuuugugcccuguccaucgcccccuccagacugccagcucuggagggcaggccccccugggucacuuucagagccacacccaagcccaacgcugcccccccacaacccagggugagugcuugggcacaccugcugaagggaaagaggaagcucuuggagcccccucccgccucugagcagcuaacauuguggagagggaugcuaguaauggggggugugcauuggguagaggccggggucccccagagggacccugccgggcucucccugacuccaguugcuccaaugaguacagugggcacugccucccccugguggccggcacuagcacagcagcagcagccucaggcagaaaacccagaaaacaaaacacacaccuuuguuuggguguugucaagguagcagcucuccugagucccagggggucaaaggagcagaaccugcaggcuccagggguaauucaaggcgccucagaagcuucauuugcuccccucuuucccucugcugguccugggguguccaguucacucgugaggccuccucacuccaaccagggcaacggcucuggccccacuuccaaauaagaacccugaggcuccaacaaggacagucuugucccacaagaguuguccagugcuuggccacgcucugcaccaccccaggcccucagcccuucagcccccccggcuucucuugcucagaagaaccuccaagaagaaggcauuuuccacagaccucgguggguagugggggcauccccaguggagaccuaaggccgacagacacgucuacgagccugugggacccuuggagucacccaggccaaacauuccaauuuauagagcaggaauuugaggcuuccuuuccuacagccccguccacacugaaggggucuuuuccugcuuccaggugaucacagcggugaacacagaaccccacaaucuguccucuccaggcugccccagcccagacagauccugggaaccuuggagaauccccgcccaucaagcuggcguguccuccccuugccccccaccccgugccauggccccaggcauguugcuggguacuggaugccccugcccguggcagaguagcccccgcccucuuucuucuuucccccagucacuuccccagcgucccguccuacucugagccccaggaaguguguggugugugugucugcgugugugugagcauguaugcgcaggccugcgccuguacgugcgcggagaagcccaggcaaaugagcccacaugggagaugggcagggguccccaggaucuuagaggcugucauucccaaagcaaaccccacgggaagggugagccgagcccuuccuggccuaagaggccggaacccucccuucaucucuggacuccgccaacuucgugugccccgggcgagucccugccccucuccuguccucaguuucccuacugucccgggcgggguuggacgcggagcugcguaagcgcacgcucagcguggacgcggcgccgggcucccuccccccggugggugugggcuggggcauacgguccucccuccacccgcgacgcgaggcuggggacggcgcgcacucaccuggcaaucuaccaucauccucagccucgguggcacaucgccggccccagggcgggacccggggcucgcagaggccgcucgccugggcccgcgcgcggcgcaggggugcgcccggcugcggggcucauggcgcggccuccgguccccgccgggcccaggacucugcggcccucggggccgccccggcagccgccagcgccgcucccauugucugcgccgcgccgcgc

SEQ ID NO: 21352 - RNA, 16834 nt, Homo sapiens
gggcucaggagaagauggaacacagagagguaagaugggguuccugcaacagcccguguugcggggcaucauggguuacccggccugaggucaccuuuggcaccgguugguuugaaaugcuggcggcuggaaaggagguguuccuguuccuggcuccaaccugggugaagccgugagagagccuucuacuuccucccgggagcugagcagggagugggcacccggagaccuccccaguuccucucugugccucugcuuugcuaccuguggcauugggacaucaggggaacaagcccuggcucccaggccccuggcugccuucucauguggcuucgugugaaccccuauucggcguagcuuuuguggcuccuggacucuacuuugggucccagauguagagagagcagccugauuacccagggcugccagggacagcuggggcccgagagaugguggccccuccucugugucuugacugugggcaaguuacuucaccucucugggccucaguuuccucacuagaaaauagggguaauaguacaggcgugguggcucacaccuguaaucccagcacuuugggaggccaaggcagguggaucaccugaggucaggauucaagaccagccugacgaacauggagaaaccccgucccuacuaaaaauacaaaauuagccgggcuuaguggcgugugccuguaaucccagcuacucaggaggcuggggcaggagaaucgcuugaacccgggaggcagagguuguggugaaccgagaucgugccauggcacuccagccugggcaacaagagcaaaacugucucaaaaaaaaaaaaaagaaaaagaaaaagaaaaaagaaaauggggguaaugaccaccgcuaccgggugggguggcugggaggagugaugugguaauauaugcaaagcacuuagaauagaaccuggcacccauuuaccgugugaacugucccccccgccacauccuucucuaacgggcggaggacaggagccuggccuagaugaguggccucggaguuuccaucuggcucaggccugagcucuaaggggagagaggcuuccaaaacccugugcgagucaguccugggugccgucccuuccuucgccuccaucugcagugagcaaaggcugcugguggccgcugcaccccauggcuguucuccacccucugcuuuccaccggcucugcagccugggccgagccaguggcccccagaggaugagaaggaggugauccgccgggccauccagaaagagcugaagaucaaggaggggguggagaaccugcggcgcguggccacagaccgccgccacuugggccaugugcagcagcugcugcgguccuccaaccgccgccuggagcagcugcauggcgagcugcgggagcugcacgcccgaauccugcugcccggcccugggccuggcccagcuggugagugaggagcugagacccccucaggacagaaggcucuaggcccaucuggccccuggccuuggcccuggccacuguggcgagaccaccucauuuccugccuauagaucaguaggggaaggaggaaaggccacagugggggucucggcucugggugagggacuccugugcucgauacccccgugcacagagccuguggccucaggaccccggccgugggcagagcagcucagggcucggcaccuagaggcucuccggaggcagcugcauguggagcugaaggugaagcagggggcugagaacaugacccacacgugcgccaguggcacccccaagguaaggccccacagucugauggcaggagcacccuggccccuggucugacagggaaaugcaccucagccauugggcucauaaggagacaccauuccagccugcagccugauggggaaaauacagccccaaaccccagcugggugaggaaggcauggcuguagucucuagugugacagagaaggccuugcccuggucuaaugggauccuagcccagccccagucccaacucccagcaugauguccagaacugggccucaguccuugucugacaagaagacuuggcuguggcccugauaugaugacggaggcaggaccuuagccuugaucuaaugggggaggcuuagcuuagccccugcccugaucugaugggggaggcuuauccccagcccugaucugaugggagaggcuuagcuuagccccugcccucaucuaaugggggaggcuuagcuuagccccugcccugaucugaugggggaagcaucaacccugcucugaugggggaggcaugaccacagcccugaucugaugggggagaguuagccccagcccugaucugaugggggagaguuagccccagcccugaucugaugggagaggcaugaccccagccgugauaugaaagaggaaauuugaccccagcccuuguuggucagauggaaaaggcuccccugacccaccaacuaguccaacaagggaggcuugacuuuaguguuuggccuagagguuucacuuuaacccuguuuugaugggggagacccggcuccaguuccuggucugaugggggaagcuguggcccaggccuggucugaugggccugugcuauggcuccauaggagaggaagcuccuggcagcugcccagcagaugcugcgggacagccagcugaagguggcccugcugcggaugaagaucagcagccuggaggccaguggguccccggagccaggugaggccuugagacacagggagggcggagcagggaagagcagggccugagagccgccguccuucccacagggccugagcugcuggcggaggagcuacagcaucgacugcacguugaggcagcuguggcugagggcgccaagaacguggugaaacugcuuaguagccggagaacacaggaccgcaaggcacuggcugaggucaggccccagcccuggcccucuccuaaggcuggcuuguucccauaccacccucagcaggggugugaagggaggguggccguguaaaagcaggacuucucuguugagacuucaugcggaagguggcuccgggugaccugggcugcugcccccugccauauaccccacgaaccuggcucuacguuguccccucugcaggcccaggcccagcuacaggaguccucucagaaacuggaccuccugcgccuggccuuggagcagcugcuggagcaacugccuccugcccacccuuugcgcagcagagugacccgagaguugcgggcugcggugccuggauacccccagccuucagggacaccugugaagcccaccgcccuaacagguagucagaaguuccucccccuucaaagcucuccuucuuuuuggggggaggccggaagcacaaacaacucugaugaagaguucaagaguuccaguccugccccagcacccacuagcagcgugaccuuggcaaacugacauuccuucuucaaaccucaguuuauccaucuguaaaauguggaugauauagcaccuaccucauaggguugcuguguugcacgugaugugcuaagcacagugccuagcacagucagcacucggacagcguagcuuguauuuacauaaauaaccagaauaaugcuuaaagcacugguguuaggaagcucgcagcccuggaaagcuugauacccagcacugggcagcuuggacuguuagaaaguuuucuaggcugggcgugguggcucacgcugguaauuccagcacuuugggaggcugagguggguggaucaugaggucaggaguuccaagaccagccuggccaagauggugaaacccugucucuacuacaaauacaaaaauuagccgggcgugguggcgggugccuguaauccugguugcucaggaagcugaggcagagaauugauugaaccccggaggcggagguugcagugagccgagaucacgccacugcacuccacccugggcgacggggcaagacgccgucgcaaaaaaaaaaaaaaaaaagguuuucuugggccaggcaugguggcucaugccuguaaucccagcacuuuggaagacugaggugggcggaucaccugaggucaggaguucaagaccagccuggccaacauggugaaauccugucucuacuaaaaauacaaaaaaguagcuggaugugguggcacaugccuguagucccagccacucgggaggcuaaggcaggagaauugcuugaacccaggaggugagguugcagugagcugagauugcgccgcugcacuucagccuagguaacagggcaagacuccaucucaaaaaauaauaauaauaauuuccuuggaaaaaaaauaauaaaauuaaacuaaaauugcugggugcaguggcucacaccuauaauccuggcacuuugagaggcugaggugggaagauugcuugagcucaggaguuuuuuugagacccagucucaaaaaaaaaagaaaaaaagaaaguuuucuuggcugggcacaguggcucaagccuguaauuccagcacuuugggaggcugagguggacgaaucauuugagcccaggauuucuagacgagccugggcaacauagugaaaccucaucuuuagaaacaaaaaaaauuagccgggcgugguggcgcaugccuguaaucccaucuacuggggaggcugaggcaagagaauugcuugaaccugggaggcagagguugcaguaagccaagauugcacuguugcacuccagcgugggugacacagcaaaacucuuucaagaaaaaaaaaaaaagaaagaguuuucuggucuggcucaguggcucauguuuauaauccuagcaguuuaggagggugaggcauguggaucacuugaguccaggaguuugaaaccagccugggcaacaugacaaagcuccaucucuacaaaaaauacaaaaaucgccgggcgcgguggcucacgccuguaaucccagcacuuugggaggccgaggcgggcggaucacgaggucaggagaucgagaccauccuggcuaacacggugaaacccugucuccacuaaaaauacaaaaaauuaaccgggcgugguggcgggcgccuguagucccagcuacucgggaggcugaggcaggagaauggcgggaaccccggggggcggagccuacagugagccgagaucgcaccacugcacuccagccugggccacagcgagacucugucucaaaaaaaaauaaaaaaauaaaaaaauuagccagguaugaugguacguaccuguagucccagcuacuugggaggcugaggugggaggauugcuugagcccagggagguugaggguacaaugagccaugaucgcgccacugcacuccagccugggcaacagagagcccgucucaaaaaaaaaaaauuaggcugggcacggcagcucaugccuguaaucucagcacuuugggaggccgagguggguggaucaccugaggucgggaguucgagagcagccugacaaaaauggagaaaccccgucucuacuaaaaaauacaaaauuagccgggccugguggugcaugccuauaaucccagcuacucaggaggcuaaagcaggagaauugcuugaacccgggagguggagguugcagugagccaagauggcaccauuggaauccagccugggcaacaagagcaaaacucugucucaaaaaaaaaaaaaauuugcaaaaauuagcugggugugguggcgggcgccuguagucccagcuacucgggaggcugaggugggagaauggcaugaaccugggaggcggagcuugcagugagcugagauugugccacugcacuccagccugggugacagagugagacuccaaacagagugagacuccgagcagagugagacucugagcucugucacccaggcuggagugcaguggcgcgaucucggcucacugcaagcuccucuucccggauucaugccauucuccugucucagccucccgaguagcugggacuacaggugcccgccaccacaccuggcuaauuuuuuguuuuuguauuuuuaguagagacaagguuucaccguguuagccaggauggucucgaucgccugaccuugugaucugccggccuaggccucccaaagugcugggacaggugugagccaccgcgcccggccaaaaaaguuaauuuucuuaucuugcacugagaucugucuccuuguagcagcagccaaaucaucaucaacaaauaaucugagagcaugggcuuugaagcuguaucccaccgagauacagugagagcuggaaaggccagugccugucuccacagagcacugcuacagggccgacugaccccauuccauugugagcagagcugagaagaggaaaugcaggcucuggauggagcccucucaccuggccuuggggaaucgaggaauauuuucuuuucuuuuuuuuuugagauggagucucgcacugucgcccagacuggagugcaguggugcgauaucagcucacugcaaccuccgccuccuggguucaagcaauucuccugccucagcuucccgaguagcugggauuacaggccugcaccaccaugccuggcuaauuuuuguauuauuaguagagacagaguuuugccauguuggccaggcuggucucaaacuccugaccucaggugauccaucugccuuggccucccaaagugcugggauuacaggcgugagccaaccaugcccggcccaaggaauguuuucuagaggagguggugucuuggccuugaaggacuuacacgggaguacuuauggccaaguagacaaguugaggaacgcagaagaaacagcuuguuaaaaggccuagaagucaacuacucaaggccaccccauauccuguccccuggcuaaacaccccagauacuugaguuguccuuuuuuuuuuuugagauggaguuuugcucuuauugcccaggcuggagugcagugacacgaucuuauugcccagacuggagugcaguggcgcaaucuuggcucacugcaaccuccgccucccggguucaagcaauucuccugccucagccucuugaauagcugggauuacaggcauguaccaccacaccuggcgaauuuuuauauuuucaguagagaugggauuucuccauguuggucaggcuggucucgaacuuccgaccucaggugauuugcccgccuuggccucccaaagugcugggauuacaggcgugagccaccucgccccaccucuuuuuuuuuuuuuuuuggagacagagucuugcucugucgcccaggccggauugcaguggugugauuucggcucacugcaagcucugccucccggguucacgccauucuucugccucagccucucgaguagcugggacuaacuacaggcgcccgccacugcgcccggcuaauuuuuuguauuuuuaguagagacgagguuucaccauggucuugaucuccugaccucgugaucugcccaccucggccucccaaagugcugggauuacaggugugagccaccacgcccggccuuuuuuuuggggggggugggggacagagucuugcuuugucgcccaggcuggagugcaguggcauaaucuugacucacugcaaccuccgccucccagguucaagcgauucuccugccucagccucccaaguaguugggauuacaggcgcccaccgccaugcccggcuaauauuuguauuuuuaguagagacagaguuucaccauguuggccaggcuggucucgaacucccgaccucaggugauccaccugccucagccuaccaaagugcugggauuacaggugugagccaccacgcccggccucaaguuuuuguuuuguuuguuuuuuuuugagcuggagucuugcucugucgcccaggcuggagugcaauggcacaauauuggcucacugcaaccucugccucccggguucaagugauucuccugccucagccuuccgaguagcugggauuacaggugcccaccaucaugcccggcugguuuuuguauuuuuaguugggaugggguuucgccauguuggucaggcugggcuugaacuccugaccucaggugaucugccugccuuggucucccaaaguguugggauuacaggcaugagccacugcgcccggccgagcuguucuuucuaagcuucucuuucuacccuggaccccugccuuuguuuacaaguucucucuguguguaacccccaggcccagacucucccuaaaugauacucuugggccugcuucguguccucaaaagcugcuagauccccacugcuuucucuacccuuugagggacaacccucuagugacgugacacaugaacuuacuccguugacaaaacacguuucauauccauugggagagguggggcagagcugggacucaccuccacuguucagauggggaaacugaggcccagggagcagguggguccggacaggaagccaggcuuccugcucccugucccaagcucuuauccuugccacagugcucucuaggccccacuucuaggcagcaucucgucaugugcuguggcucugugcagccuggcuaaggucugaggucugagccuaugucccugccgcuccagcauguggaggggagagccaguugcucugcccuggaaagagguggcugccacagagaagugugcauucugggacaacguggcuccucaccugggaguguccaggucggaggccuccuagggugucaucgggguccaaggguacccuuuggggggcucauggugcuugggagcugcaggacagucagcaggcuccagucuaggcacucuaggccgccacacugagugagguuccucagguaacugcccuggccucagguggguacggucuggguucagccaccuccuggagaggguggccuuccuggggucccaggacaccuuggugguagcagugggaagauggcaucugacaacgccccccgcucacucuccccacagggacacugcagguccgccuccugggcugugaacaguugcugacagccgugccugggcgcuccccagcggccgcacuggccagcagccccuccgagggcuggcuucggaccaaggccaagcaccagcguggccgaggcgagcuugccagugaguagggaaggagcuucagggggagcaggagaccccugcuucaggccugcccugagucccggcucuggcccugcaggcgaggugcuggcugugcuaaagguggacaaccguguuguggggcagacgggcugggggcagguggccgaacaguccugggaccagaccuuugucaucccacuggagcgaguaaggcuggccuuuguguggucaggggugaccuugggcugcgggguggaaggcugcccaggucggggcucguucugcaccccacccuucagccuggccuccccaauacaggcccgugagcuggagauugggguacacuggcgggacuggcggcagcuauguggcguggccuuccugagacuugaggacuuccuggacaaugccugucaccaacugucccucagccugguaccgcagggacugcuuuuugcccaggugcucaccaccuccgcccucugacuuggugggacccuggggcgucagggccaggaaggccuucaagaccgaugcacugcguguaggugcagagacugacgaccagagaggagggcuccaggaauaagggcuccuagccgcucucucagggcugcaucuggaggccuggguccuuguccugacugcccugccucaggugugacccuggaaaagugccucuccucccugggccucuguuucuccacuaguaucaaugaggacauugaaucuguuucucugggucuuucuggcucuugcaucuguugacccugggggcuugggcuguaaucccaggggcagaggaggugccauggcagaugagaugggaggcgacugguccacaacccugccccuaccccugcaggugaccuucugcgauccugucauugagaggcggccccggcugcagaggcaggaacgcaucuucucuaaacgcagagguguggagggaaugggggcuaugugugagggagcagggcuggggucccgggacuaagcucccccuuuucucccaggccaggacuuccugagggcuucgcagaugaaccucggcauggcggccugggggcgccucgucaugaaccugcugccccccugcagcuccccgagcacaaucagccccccuaaaggaugcccucggaccccaacaacacugcgagaggccucugacccugccacucccaggugaggagcucccuugcccuagacugcaugcuccucuguggcggcuuccugacuccagauccaggcgguaucugucugucugucugcauugcucagcccgcuaacccucuguccaucucacuuuggguugguguguccauccugccagcucuugcgucugccugugcugggcacugugucuacuuucucccuacaguaauuuccugcccaagaagacccccuugggugaagagaugacacccccacccaagcccccacgccucuaccucccccaggagccaacauccgaggagacuccggugaggggcuggagggacuaguggcuccuagggccggcuggggcuggcagggccacccagcugugggguggcaggccugaagggaaagagagaaggaagcccagcccugcccugagcuccucuauacucacagcgcaccaaacguccccauauggagccuaggacucgacgugggccaucuccaccagccucccccaccagguaccccauccugcgcaccuucauguuugagacguucgucugcuugcuugaacauuuguguauccauucauacauuacucccuggcucccuggcgggugcgcugacuggcucucggggucugauuuacuaaacccacauuauugagcuccagcucuaugccggcuucuaggaguccuuacugcagggcuuuuucgagcccauaggucgggacagcccaggacugggcaugggaggcuuggaguggcucuggguaggggcccagccagugcccuaggggacuucauauacccucucuuccuuugcaggaaacccccucggcuucaggacuuccgcugcuuagcugugcugggccggggacacuuugggaagguagugggcugaagagggugguaugggacgggauugggggccucaucacaugagccgggaggaccugaucugugggggcgguaaaggcucccuggucuggcccaccuggagcacaaccucucucuggccccagguccuccugguccaguucaaggggacagggaaauacuacgccaucaaagcacugaagaagcaggaggugcucagccgggacgagauagagaggugugugggggugccgcagggcacccaggauggcuggccugggcuguggcauccagagggcaguugaagguuccuggggcuuuggagaggugaccccguggggccagccagccugcauucucuuuuggcaccugcaguuguuaacuguguuuccuugggcagguccccucuucucucugucaguuugcucuacuguaaaaugggggcauugguggcugugcacguucagagcuccuugugagccccugacauauagaaaccaucacucuauggccaggcgugguaacucaugcauguaaccccagcacuuugggaggccaaggcaggcggaucacuugaguccaggaguucaagaccaaucugaaucacauggugaaaccccaucuauaaaaaauagccagacaugguggcaugugccuuuagucccagcuacuugggagggugaggugagaggauugcuuaagcccaggagguagagguuauaguuagcagagaucuccagccugggcaacagaaugagaccucaucuaaaaaaacuaauuaaaaaaaaaaaaaggagggggaggcugggcacaguggcucaugccuguaaucccagcacuucaggaggccaaggugggaggauugcuugagcccaggaguucgaggccagccuggacaacauggugaaacccgccucuacaaaaaauacaaaaauuagcugggcgugguggugcacacccagcuacucgugaagcuguggugggaggaucacuugaaccucaguggcggaggcugcagugagccgagaucgcaccacaucacuccagccugggcaagaaagugagacccugucucaaaaaaaaaaaaaaaaaaggcugggcgcacuggcucacacuuguaaucccagcauucuggaaggccgaagcagguggauaacuugaggccaagaguucgagaccagccugggcaacacagcgaaacccugcgucuacuaaaaauacaaaaauuagcugggcgugguggcgcacuccuauaaucccagcuacucgggaggcugaggcacaaaaaucucuugaacccgggaggcagagguugcaaugagcugagaucacaccacagcacuccagcccaggcgacagagcaagacugugucucaaaaaaaaaaaaaaaaugaaaagaaaccaucagucuacuugccuggcacuuuggcugagggcccagugagccagggguguugugcagggcacagggcacagcccagggaaaguuuuccuucccucuaauacucuugcucucuccuguagccuguacugcgagaagcggauccuggaggcugugggcugcacagggcacccuuuccugcucucccuccuugccugcuuccagaccuccagccaugccugcuuugugacugaguuugugccugguggugaccucaugaugcagauccacgaggaugucuuccccgagccccaggcccgguggguuccaucccuccugccugccucuuccagcaaacuuugccugguucccuacacccacucucuacauacugcuuucuccaagugcccaacagcaggggagcaggagucagaggccuugguuuacauccuggcaccaacugacagcauuugugauccuggguaucagcuuaugaagcugugcauuagguuucuuuuuuuuuuuuuuuuuuuuuuuuuugugagacagagucuggcucuuauugcccaggcuggagugcaauggcaugaucucggcucaccacaaccuccgccucccugguucaagccauucuccugccucagccuccugaguagcugggauuacaggcaugcaccaccacuccugucuaauuuuguauuuuuaguagagacgagguuucuccauguuggucagguuggucucuaacuccugaccucaagugauccgcccaccucggccuuccaaagugcugagauuacaggcgugagccaccacaccuggugagucucagaucuuuauuugaaaaauaggcaugauuggccgggcaccuguaaucccagcacuuuggaggcugaggcggguggaucaccugaggucaggaguucgugaccuggccaacaugguaaaaucuugucucuacuaaaaauacaaaaauuagcuaggcaugguggcacacgccuguaauccuagcuacuugagaggcuaaggcaggagaaucgcuugaacccaggaggcggagguuggagugagccgagaucccgccacuucggucuggcgacagagugagacuccaucuaaaaaaaaaaaaaaaaaggccgggcacguugguucaugccuguaauccccacacuuugggaggcugaggcguguggaucaugaggucaagagaucaagaccauccuggccaacauggugaaacccuaucucuauaaaaacuaaaaaaaaaaaaaaaaaaaaaaaauuagcugggcgugguggcgcgugccuguagucucagcuacuugggaggcugaggcaggagaauugcuugaacccaggagguggagguugcagugagccgagaucgcaccgcugcacugcagccugggugacagagugagacuccgucucaaaaaaaaaaaaaauaggcaugaugaauauccacugcagggaccaacacuuggucccuggcaccauuuaagggcccaugaagggugagcuggaaaugcacgcaaccuuggggcgaccuugggacuauuggagcacccccacccucagcaugaugcuugucccagucucacucaucucugacucuggccgggacauccgggauccccccgcuauggccauccuggugccucccugcccugccucccuggugugugucuugggccugaguucucccauaaccaccccugcagcuucuacguggcuuguguuguccuggggcugcaguucuuacacgagaagaagaucauuuacaggugacuuuugucccagggaugcacggggguagggguggggguggggguggaguggguaaggacagaugcugccuccgccugccugggcugcuccaggggccguuacuguucccugggucuaagccccacucagucccuuugaucugcacccuugcccucagggaccugaaguuggauaaccuucugcuggaugcccagggauuccugaagaucgcagacuuuggacucugcaaggaaggugggggccgcccauugggauccauaucuccagccuuguuuacccacccuggccaauaggaugaugggcacauggcaugucccaggaaaucuccucaccugcggaugcccugguuccaccaccccagaccucauuccaggggacagcugggcacacuggcccuuucuuccuaguccuagaggcucguagccccagccugcaccuggcccaagggagagccuguggucagggaugggagaggagacugaguucugccuucuguuuuuuuuuugguuuguuuuuuuuuuugagacggagucuugcugugccgcccaggaugcaaugcaguggugcagucucggcucacugcagccuccaccuacuggguucaagcgauucucuugccucagcagcccaaguagcugggacuacaagcgagcaccaccacaccuggcuaauuuuuguauuuuuuuaguagagacgggguuucacuguguuagcgaggauggucucgaucuccugaccucaugauccacccaccuuggccgcccaaagugcugggauuacaggcgugagccacugcgcccggcuucuuuuuuuuuugagauggagucuugcccuguugcccaggcuggagugcaauggcgcaaucucggcucacugcaaccucugccuccaagguucaagagauucuccugccucagccucccgaguaccugcgauuacaggcacaugccaccacacccagcuuauuuuuuguauuuuuaguagagacgggguuucaccauguuggccaggcuggucucgaacuccugaccucaugaucugcccaccucggccucccaaagugcugggauuacaggugugagccaccgcacccagccgaguucugccuucugugaccuuagccugugagcuuggcucugcaugcagucaaauggcgucauaaccauucccacuuccuuggguacagggcagggcuuggcacaggcucagcucccuggcaucauaaggcuuggcuauugaaguuauugugaauaggccacaccaagcagcuauuggugugccuguugguuugcagggaucggcuucggggaccggacuagcaccuucuguggcaccccggaguuccuggcucccgaggugcugacccaggaggcauacacacgggcuguggacuggugggggcugggugugcugcucuacgagaugcuggugggugaggugagugcuggagccuguuuccugggccucugggugggggugggguggcccgugcauccugcugagcccccaucuccacagugcccguucccaggggacacagaggaagagguguuugacugcaucgucaacauggacgcccccuaccccggcuuucugucggugcaagggcuugaguucauucagaagguaagcacugcggggucuggggcugggcuggauggccgcucaaggcccaugugcccucugccgugggacagcagacccccugccacccauccuuagagcgcucugggccagcgugcuuggggccuguggaugauggcagugccuggggcugaaugcccuaagugagcgccuguccuauugcccagcuccuccagaagugcccggagaagcgccucggggcaggugagcaggaugccgaggagaucaagguccagccauucuucagggugagcggcugggguggcggugguccccugugccuggcaggguagguggcauggagugacuccuggagcugcuguuccugccgucucaggcgccucuccuuugcccucagaccaccaacuggcaagcccugcucgcccgcaccauccagccccccuucgugccuacccuguguggcccugcggaccugcgcuacuuugagggcgaguucacagggcugccgccugcccugaccccaccugcaccccacagccuccucacugcccgccaacaggccgccuuccgggacuucgacuuugugucagagcgauuccuggaacccugagggcaucuccuggcaccucuguccccuucccccacagacuguuagagccucugcucguucacccgugcgcccugccuggagguccaggccuugcuggguacuucugagcccuugggauucaaaguggcagccauggggccacuguugugggcuuugcucagugucacugggcaaagugugucccuucccccuccagcucgcccucuucuaccucccagcgagaccuggcccagaaagggugccgcagcaaggagugauaugguuugucuuuuuaagacuggacuugcuuuauauuaaauuuguaaaagugugcacuggcagcagccug

SEQ ID NO: 21353 - RNA, 16834 nt, Homo sapiens
caggcugcugccagugcacacuuuuacaaauuuaauauaaagcaaguccagucuuaaaaagacaaaccauaucacuccuugcugcggcacccuuucugggccaggucucgcugggagguagaagagggcgagcuggagggggaagggacacacuuugcccagugacacugagcaaagcccacaacaguggccccauggcugccacuuugaaucccaagggcucagaaguacccagcaaggccuggaccuccaggcagggcgcacgggugaacgagcagaggcucuaacagucugugggggaaggggacagaggugccaggagaugcccucaggguuccaggaaucgcucugacacaaagucgaagucccggaaggcggccuguuggcgggcagugaggaggcuguggggugcagguggggucagggcaggcggcagcccugugaacucgcccucaaaguagcgcagguccgcagggccacacaggguaggcacgaaggggggcuggauggugcgggcgagcagggcuugccaguugguggucugagggcaaaggagaggcgccugagacggcaggaacagcagcuccaggagucacuccaugccaccuacccugccaggcacaggggaccaccgccaccccagccgcucacccugaagaauggcuggaccuugaucuccucggcauccugcucaccugccccgaggcgcuucuccgggcacuucuggaggagcugggcaauaggacaggcgcucacuuagggcauucagccccaggcacugccaucauccacaggccccaagcacgcuggcccagagcgcucuaaggauggguggcagggggucugcugucccacggcagagggcacaugggccuugagcggccauccagcccagccccagaccccgcagugcuuaccuucugaaugaacucaagcccuugcaccgacagaaagccgggguagggggcguccauguugacgaugcagucaaacaccucuuccucuguguccccugggaacgggcacuguggagaugggggcucagcaggaugcacgggccaccccacccccacccagaggcccaggaaacaggcuccagcacucaccucacccaccagcaucucguagagcagcacacccagcccccaccaguccacagcccguguguaugccuccugggucagcaccucgggagccaggaacuccggggugccacagaaggugcuaguccgguccccgaagccgaucccugcaaaccaacaggcacaccaauagcugcuugguguggccuauucacaauaacuucaauagccaagccuuaugaugccagggagcugagccugugccaagcccugcccuguacccaaggaagugggaaugguuaugacgccauuugacugcaugcagagccaagcucacaggcuaaggucacagaaggcagaacucggcugggugcgguggcucacaccuguaaucccagcacuuugggaggccgaggugggcagaucaugaggucaggaguucgagaccagccuggccaacauggugaaaccccgucucuacuaaaaauacaaaaaauaagcugggugugguggcaugugccuguaaucgcagguacucgggaggcugaggcaggagaaucucuugaaccuuggaggcagagguugcagugagccgagauugcgccauugcacuccagccugggcaacagggcaagacuccaucucaaaaaaaaaagaagccgggcgcaguggcucacgccuguaaucccagcacuuugggcggccaagguggguggaucaugaggucaggagaucgagaccauccucgcuaacacagugaaaccccgucucuacuaaaaaaauacaaaaauuagccaggugugguggugcucgcuuguagucccagcuacuugggcugcugaggcaagagaaucgcuugaacccaguagguggaggcugcagugagccgagacugcaccacugcauugcauccugggcggcacagcaagacuccgucucaaaaaaaaaaacaaaccaaaaaaaaaacagaaggcagaacucagucuccucucccaucccugaccacaggcucucccuugggccaggugcaggcuggggcuacgagccucuaggacuaggaagaaagggccagugugcccagcuguccccuggaaugaggucuggggugguggaaccagggcauccgcaggugaggagauuuccugggacaugccaugugcccaucauccuauuggccaggguggguaaacaaggcuggagauauggaucccaaugggcggcccccaccuuccuugcagaguccaaagucugcgaucuucaggaaucccugggcauccagcagaagguuauccaacuucaggucccugagggcaagggugcagaucaaagggacugaguggggcuuagacccagggaacaguaacggccccuggagcagcccaggcaggcggaggcagcaucuguccuuacccacuccacccccacccccaccccuacccccgugcaucccugggacaaaagucaccuguaaaugaucuucuucucguguaagaacugcagccccaggacaacacaagccacguagaagcugcaggggugguuaugggagaacucaggcccaagacacacaccagggaggcagggcagggaggcaccaggauggccauagcggggggaucccggaugucccggccagagucagagaugagugagacugggacaagcaucaugcugagggugggggugcuccaauagucccaaggucgccccaagguugcgugcauuuccagcucacccuucaugggcccuuaaauggugccagggaccaaguguuggucccugcaguggauauucaucaugccuauuuuuuuuuuuuuugagacggagucucacucugucacccaggcugcagugcagcggugcgaucucggcucacugcaaccuccaccuccuggguucaagcaauucuccugccucagccucccaaguagcugagacuacaggcacgcgccaccacgcccagcuaauuuuuuuuuuuuuuuuuuuuuuuuaguuuuuauagagauaggguuucaccauguuggccaggauggucuugaucucuugaccucaugauccacacgccucagccucccaaaguguggggauuacaggcaugaaccaacgugcccggccuuuuuuuuuuuuuuuuuagauggagucucacucugucgccagaccgaaguggcgggaucucggcucacuccaaccuccgccuccuggguucaagcgauucuccugccuuagccucucaaguagcuaggauuacaggcgugugccaccaugccuagcuaauuuuuguauuuuuaguagagacaagauuuuaccauguuggccaggucacgaacuccugaccucaggugauccacccgccucagccuccaaagugcugggauuacaggugcccggccaaucaugccuauuuuucaaauaaagaucugagacucaccaggugugguggcucacgccuguaaucucagcacuuuggaaggccgaggugggcggaucacuugaggucaggaguuagagaccaaccugaccaacauggagaaaccucgucucuacuaaaaauacaaaauuagacaggagugguggugcaugccuguaaucccagcuacucaggaggcugaggcaggagaauggcuugaaccagggaggcggagguuguggugagccgagaucaugccauugcacuccagccugggcaauaagagccagacucugucucacaaaaaaaaaaaaaaaaaaaaaaaaaagaaaccuaaugcacagcuucauaagcugauacccaggaucacaaaugcugucaguuggugccaggauguaaaccaaggccucugacuccugcuccccugcuguugggcacuuggagaaagcaguauguagagaguggguguagggaaccaggcaaaguuugcuggaagaggcaggcaggagggauggaacccaccgggccuggggcucggggaagacauccucguggaucugcaucaugaggucaccaccaggcacaaacucagucacaaagcaggcauggcuggaggucuggaagcaggcaaggagggagagcaggaaagggugcccugugcagcccacagccuccaggauccgcuucucgcaguacaggcuacaggagagagcaagaguauuagagggaaggaaaacuuucccugggcugugcccugugcccugcacaacaccccuggcucacugggcccucagccaaagugccaggcaaguagacugaugguuucuuuucauuuuuuuuuuuuuuuugagacacagucuugcucugucgccugggcuggagugcuguggugugaucucagcucauugcaaccucugccucccggguucaagagauuuuugugccucagccucccgaguagcugggauuauaggagugcgccaccacgcccagcuaauuuuuguauuuuuaguagacgcaggguuucgcuguguugcccaggcuggucucgaacucuuggccucaaguuauccaccugcuucggccuuccagaaugcugggauuacaagugugagccagugcgcccagccuuuuuuuuuuuuuuuuuugagacagggucucacuuucuugcccaggcuggagugauguggugcgaucucggcucacugcagccuccgccacugagguucaagugauccucccaccacagcuucacgaguagcugggugugcaccaccacgcccagcuaauuuuuguauuuuuuguagaggcggguuucaccauguuguccaggcuggccucgaacuccugggcucaagcaauccucccaccuuggccuccugaagugcugggauuacaggcaugagccacugugcccagccucccccuccuuuuuuuuuuuuuaauuaguuuuuuuagaugaggucucauucuguugcccaggcuggagaucucugcuaacuauaaccucuaccuccugggcuuaagcaauccucucaccucacccucccaaguagcugggacuaaaggcacaugccaccaugucuggcuauuuuuuauagaugggguuucaccaugugauucagauuggucuugaacuccuggacucaagugauccgccugccuuggccucccaaagugcugggguuacaugcaugaguuaccacgccuggccauagagugaugguuucuauaugucaggggcucacaaggagcucugaacgugcacagccaccaaugcccccauuuuacaguagagcaaacugacagagagaagaggggaccugcccaaggaaacacaguuaacaacugcaggugccaaaagagaaugcaggcuggcuggccccacggggucaccucuccaaagccccaggaaccuucaacugcccucuggaugccacagcccaggccagccauccugggugcccugcggcacccccacacaccucucuaucucgucccggcugagcaccuccugcuucuucagugcuuugauggcguaguauuucccuguccccuugaacuggaccaggaggaccuggggccagagagagguugugcuccaggugggccagaccagggagccuuuaccgcccccacagaucagguccucccggcucaugugaugaggcccccaaucccgucccauaccacccucuucagcccacuaccuucccaaaguguccccggcccagcacagcuaagcagcggaaguccugaagccgaggggguuuccugcaaaggaagagaggguauaugaaguccccuagggcacuggcugggccccuacccagagccacuccaagccucccaugcccaguccugggcugucccgaccuaugggcucgaaaaagcccugcaguaaggacuccuagaagccggcauagagcuggagcucaauaauguggguuuaguaaaucagaccccgagagccagucagcgcacccgccagggagccagggaguaauguaugaauggauacacaaauguucaagcaagcagacgaacgucucaaacaugaaggugcgcaggaugggguaccuggugggggaggcugguggagauggcccacgucgaguccuaggcuccauauggggacguuuggugcgcugugaguauagaggagcucagggcagggcugggcuuccuucucucuuucccuucaggccugccaccccacagcuggguggcccugccagccccagccggcccuaggagccacuagucccuccagccccucaccggagucuccucggauguuggcuccugggggagguagaggcgugggggcuugggugggggugucaucucuucacccaagggggucuucuugggcaggaaauuacuguagggagaaaguagacacagugcccagcacaggcagacgcaagagcuggcaggauggacacaccaacccaaagugagauggacagaggguuagcgggcugagcaaugcagacagacagacagauaccgccuggaucuggagucaggaagccgccacagaggagcaugcagucuagggcaagggagcuccucaccugggaguggcagggucagaggccucucgcaguguuguugggguccgagggcauccuuuaggggggcugauugugcucggggagcugcaggggggcagcagguucaugacgaggcgcccccaggccgccaugccgagguucaucugcgaagcccucaggaaguccuggccugggagaaaagggggagcuuagucccgggaccccagcccugcucccucacacauagcccccauucccuccacaccucugcguuuagagaagaugcguuccugccucugcagccggggccgccucucaaugacaggaucgcagaaggucaccugcagggguaggggcaggguuguggaccagucgccucccaucucaucugccauggcaccuccucugccccugggauuacagcccaagcccccagggucaacagaugcaagagccagaaagacccagagaaacagauucaauguccucauugauacuaguggagaaacagaggcccagggaggagaggcacuuuuccagggucacaccugaggcagggcagucaggacaaggacccaggccuccagaugcagcccugagagagcggcuaggagcccuuauuccuggagcccuccucucuggucgucagucucugcaccuacacgcagugcaucggucuugaaggccuuccuggcccugacgccccagggucccaccaagucagagggcggagguggugagcaccugggcaaaaagcagucccugcgguaccaggcugagggacaguuggugacaggcauuguccaggaaguccucaagucucaggaaggccacgccacauagcugccgccagucccgccaguguaccccaaucuccagcucacgggccuguauuggggaggccaggcugaaggguggggugcagaacgagccccgaccugggcagccuuccaccccgcagcccaaggucaccccugaccacacaaaggccagccuuacucgcuccagugggaugacaaaggucuggucccaggacuguucggccaccugcccccagcccgucugccccacaacacgguuguccaccuuuagcacagccagcaccucgccugcagggccagagccgggacucagggcaggccugaagcaggggucuccugcucccccugaagcuccuucccuacucacuggcaagcucgccucggccacgcuggugcuuggccuugguccgaagccagcccucggaggggcugcuggccagugcggccgcuggggagcgcccaggcacggcugucagcaacuguucacagcccaggaggcggaccugcagugucccuguggggagagugagcggggggcguugucagaugccaucuucccacugcuaccaccaagguguccugggaccccaggaaggccacccucuccaggagguggcugaacccagaccguacccaccugaggccagggcaguuaccugaggaaccucacucaguguggcggccuagagugccuagacuggagccugcugacuguccugcagcucccaagcaccaugagccccccaaaggguacccuuggaccccgaugacacccuaggaggccuccgaccuggacacucccaggugaggagccacguugucccagaaugcacacuucucuguggcagccaccucuuuccagggcagagcaacuggcucuccccuccacaugcuggagcggcagggacauaggcucagaccucagaccuuagccaggcugcacagagccacagcacaugacgagaugcugccuagaaguggggccuagagagcacuguggcaaggauaagagcuugggacagggagcaggaagccuggcuuccuguccggacccaccugcucccugggccucaguuuccccaucugaacaguggaggugagucccagcucugccccaccucucccaauggauaugaaacguguuuugucaacggaguaaguucaugugucacgucacuagaggguugucccucaaaggguagagaaagcaguggggaucuagcagcuuuugaggacacgaagcaggcccaagaguaucauuuagggagagucugggccuggggguuacacacagagagaacuuguaaacaaaggcagggguccaggguagaaagagaagcuuagaaagaacagcucggccgggcgcaguggcucaugccuguaaucccaacacuuugggagaccaaggcaggcagaucaccugaggucaggaguucaagcccagccugaccaacauggcgaaaccccaucccaacuaaaaauacaaaaaccagccgggcaugauggugggcaccuguaaucccagcuacucggaaggcugaggcaggagaaucacuugaacccgggaggcagagguugcagugagccaauauugugccauugcacuccagccugggcgacagagcaagacuccagcucaaaaaaaaacaaacaaaacaaaaacuugaggccgggcgugguggcucacaccuguaaucccagcacuuugguaggcugaggcagguggaucaccugaggucgggaguucgagaccagccuggccaacauggugaaacucugucucuacuaaaaauacaaauauuagccgggcauggcggugggcgccuguaaucccaacuacuugggaggcugaggcaggagaaucgcuugaaccugggaggcggagguugcagugagucaagauuaugccacugcacuccagccugggcgacaaagcaagacucugucccccaccccccccaaaaaaaaggccgggcgugguggcucacaccuguaaucccagcacuuugggaggccgaggugggcagaucacgaggucaggagaucaagaccauggugaaaccucgucucuacuaaaaauacaaaaaauuagccgggcgcaguggcgggcgccuguaguuagucccagcuacucgagaggcugaggcagaagaauggcgugaacccgggaggcagagcuugcagugagccgaaaucacaccacugcaauccggccugggcgacagagcaagacucugucuccaaaaaaaaaaaaaaaagagguggggcgagguggcucacgccuguaaucccagcacuuugggaggccaaggcgggcaaaucaccugaggucggaaguucgagaccagccugaccaacauggagaaaucccaucucuacugaaaauauaaaaauucgccagguguggugguacaugccuguaaucccagcuauucaagaggcugaggcaggagaauugcuugaacccgggaggcggagguugcagugagccaagauugcgccacugcacuccagucugggcaauaagaucgugucacugcacuccagccugggcaauaagagcaaaacuccaucucaaaaaaaaaaaaggacaacucaaguaucugggguguuuagccaggggacaggauaugggguggccuugaguaguugacuucuaggccuuuuaacaagcuguuucuucugcguuccucaacuugucuacuuggccauaaguacucccguguaaguccuucaaggccaagacaccaccuccucuagaaaacauuccuugggccgggcaugguuggcucacgccuguaaucccagcacuuugggaggccaaggcagauggaucaccugaggucaggaguuugagaccagccuggccaacauggcaaaacucugucucuacuaauaauacaaaaauuagccaggcaugguggugcaggccuguaaucccagcuacucgggaagcugaggcaggagaauugcuugaacccaggaggcggagguugcagugagcugauaucgcaccacugcacuccagucugggcgacagugcgagacuccaucucaaaaaaaaaagaaaagaaaauauuccucgauuccccaaggccaggugagagggcuccauccagagccugcauuuccucuucucagcucugcucacaauggaauggggucagucggcccuguagcagugcucuguggagacaggcacuggccuuuccagcucucacuguaucucggugggauacagcuucaaagcccaugcucucagauuauuuguugaugaugauuuggcugcugcuacaaggagacagaucucagugcaagauaagaaaauuaacuuuuuuggccgggcgcgguggcucacaccugucccagcacuuugggaggccuaggccggcagaucacaaggucaggcgaucgagaccauccuggcuaacacggugaaaccuugucucuacuaaaaauacaaaaacaaaaaauuagccaggugugguggcgggcaccuguagucccagcuacucgggaggcugagacaggagaauggcaugaauccgggaagaggagcuugcagugagccgagaucgcgccacugcacuccagccugggugacagagcucagagucucacucugcucggagucucacucuguuuggagucucacucugucacccaggcuggagugcaguggcacaaucucagcucacugcaagcuccgccucccagguucaugccauucucccaccucagccucccgaguagcugggacuacaggcgcccgccaccacacccagcuaauuuuugcaaauuuuuuuuuuuuuugagacagaguuuugcucuuguugcccaggcuggauuccaauggugccaucuuggcucacugcaaccuccaccucccggguucaagcaauucuccugcuuuagccuccugaguagcugggauuauaggcaugcaccaccaggcccggcuaauuuuguauuuuuuaguagagacgggguuucuccauuuuugucaggcugcucucgaacucccgaccucaggugauccacccaccucggccucccaaagugcugagauuacaggcaugagcugccgugcccagccuaauuuuuuuuuuuugagacgggcucucuguugcccaggcuggagugcaguggcgcgaucauggcucauuguacccucaaccucccugggcucaagcaauccucccaccucagccucccaaguagcugggacuacagguacguaccaucauaccuggcuaauuuuuuuauuuuuuuauuuuuuuuugagacagagucucgcuguggcccaggcuggagugcaguggugcgaucucggcucacuguaggcuccgccccccgggguucccgccauucuccugccucagccucccgaguagcugggacuacaggcgcccgccaccacgcccgguuaauuuuuuguauuuuuaguggagacaggguuucaccguguuagccaggauggucucgaucuccugaccucgugauccgcccgccucggccucccaaagugcugggauuacaggcgugagccaccgcgcccggcgauuuuuguauuuuuuguagagauggagcuuugucauguugcccaggcugguuucaaacuccuggacucaagugauccacaugccucacccuccuaaacugcuaggauuauaaacaugagccacugagccagaccagaaaacucuuucuuuuuuuuuuuuucuugaaagaguuuugcugugucacccacgcuggagugcaacagugcaaucuuggcuuacugcaaccucugccucccagguucaagcaauucucuugccucagccuccccaguagaugggauuacaggcaugcgccaccacgcccggcuaauuuuuuuuguuucuaaagaugagguuucacuauguugcccaggcucgucuagaaauccugggcucaaaugauucguccaccucagccucccaaagugcuggaauuacaggcuugagccacugugcccagccaagaaaacuuucuuuuuuucuuuuuuuuuugagacugggucucaaaaaaacuccugagcucaagcaaucuucccaccucagccucucaaagugccaggauuauaggugugagccacugcacccagcaauuuuaguuuaauuuuauuauuuuuuuuccaaggaaauuauuauuauuauuuuuugagauggagucuugcccuguuaccuaggcugaagugcagcggcgcaaucucagcucacugcaaccucaccuccuggguucaagcaauucuccugccuuagccucccgaguggcugggacuacaggcaugugccaccacauccagcuacuuuuuuguauuuuuaguagagacaggauuucaccauguuggccaggcuggucuugaacuccugaccucaggugauccgcccaccucagucuuccaaagugcugggauuacaggcaugagccaccaugccuggcccaagaaaaccuuuuuuuuuuuuuuuuuugcgacggcgucuugccccgucgcccaggguggagugcaguggcgugaucucggcucacugcaaccuccgccuccgggguucaaucaauucucugccucagcuuccugagcaaccaggauuacaggcacccgccaccacgcccggcuaauuuuuguauuuguaguagagacaggguuucaccaucuuggccaggcuggucuuggaacuccugaccucaugauccacccaccucagccucccaaagugcuggaauuaccagcgugagccaccacgcccagccuagaaaacuuucuaacaguccaagcugcccagugcuggguaucaagcuuuccagggcugcgagcuuccuaacaccagugcuuuaagcauuauucugguuauuuauguaaauacaagcuacgcuguccgagugcugacugugcuaggcacugugcuuagcacaucacgugcaacacagcaacccuaugagguaggugcuauaucauccacauuuuacagauggauaaacugagguuugaagaaggaaugucaguuugccaaggucacgcugcuagugggugcuggggcaggacuggaacucuugaacucuucaucagaguuguuugugcuuccggccuccccccaaaaagaaggagagcuuugaagggggaggaacuucugacuaccuguuagggcggugggcuucacaggugucccugaaggcuggggguauccaggcaccgcagcccgcaacucucgggucacucugcugcgcaaagggugggcaggaggcaguugcuccagcagcugcuccaaggccaggcgcaggagguccaguuucugagaggacuccuguagcugggccugggccugcagaggggacaacguagagccagguucgugggguauauggcagggggcagcagcccaggucacccggagccaccuuccgcaugaagucucaacagagaaguccugcuuuuacacggccacccucccuucacaccccugcugagggugguaugggaacaagccagccuuaggagagggccagggcuggggccugaccucagccagugccuugcgguccuguguucuccggcuacuaagcaguuucaccacguucuuggcgcccucagccacagcugccucaacgugcagucgaugcuguagcuccuccgccagcagcucaggcccugugggaaggacggcggcucucaggcccugcucuucccugcuccgcccucccugugucucaaggccucaccuggcuccggggacccacuggccuccaggcugcugaucuucauccgcagcagggccaccuucagcuggcugucccgcagcaucugcugggcagcugccaggagcuuccucuccuauggagccauagcacaggcccaucagaccaggccugggccacagcuucccccaucagaccaggaacuggagccgggucucccccaucaaaacaggguuaaagugaaaccucuaggccaaacacuaaagucaagccucccuuguuggacuaguuggugggucaggggagccuuuuccaucugaccaacaagggcuggggucaaauuuccucuuucauaucacggcuggggucaugccucucccaucagaucagggcuggggcuaacucucccccaucagaucagggcuggggcuaacucucccccaucagaucagggcuguggucaugccucccccaucagagcaggguugaugcuucccccaucagaucagggcaggggcuaagcuaagccucccccauuagaugagggcaggggcuaagcuaagccucucccaucagaucagggcuggggauaagccucccccaucagaucagggcaggggcuaagcuaagccucccccauuagaucaaggcuaagguccugccuccgucaucauaucagggccacagccaagucuucuugucagacaaggacugaggcccaguucuggacaucaugcugggaguugggacuggggcugggcuaggaucccauuagaccagggcaaggccuucucugucacacuagagacuacagccaugccuuccucacccagcugggguuuggggcuguauuuuccccaucaggcugcaggcuggaauggugucuccuuaugagcccaauggcugaggugcauuucccugucagaccaggggccagggugcuccugccaucagacuguggggccuuaccuugggggugccacuggcgcacgugugggucauguucucagcccccugcuucaccuucagcuccacaugcagcugccuccggagagccucuaggugccgagcccugagcugcucugcccacggccgggguccugaggccacaggcucugugcacggggguaucgagcacaggagucccucacccagagccgagacccccacuguggccuuuccuccuuccccuacugaucuauaggcaggaaaugagguggucucgccacaguggccagggccaaggccaggggccagaugggccuagagccuucuguccugagggggucucagcuccucacucaccagcugggccaggcccagggccgggcagcaggauucgggcgugcagcucccgcagcucgccaugcagcugcuccaggcggcgguuggaggaccgcagcagcugcugcacauggcccaaguggcggcggucuguggccacgcgccgcagguucuccacccccuccuugaucuucagcucuuucuggauggcccggcggaucaccuccuucucauccucugggggccacuggcucggcccaggcugcagagccgguggaaagcagaggguggagaacagccauggggugcagcggccaccagcagccuuugcucacugcagauggaggcgaaggaagggacggcacccaggacugacucgcacaggguuuuggaagccucucuccccuuagagcucaggccugagccagauggaaacuccgaggccacucaucuaggccaggcuccuguccuccgcccguuagagaaggauguggcgggggggacaguucacacgguaaaugggugccagguucuauucuaagugcuuugcauauauuaccacaucacuccucccagccaccccacccgguagcgguggucauuacccccauuuucuuuuuucuuuuucuuuuucuuuuuuuuuuuuuugagacaguuuugcucuuguugcccaggcuggagugccauggcacgaucucgguucaccacaaccucugccucccggguucaagcgauucuccugccccagccuccugaguagcugggauuacaggcacacgccacuaagcccggcuaauuuuguauuuuuaguagggacgggguuucuccauguucgucaggcuggucuugaauccugaccucaggugauccaccugccuuggccucccaaagugcugggauuacaggugugagccaccacgccuguacuauuaccccuauuuucuagugaggaaacugaggcccagagaggugaaguaacuugcccacagucaagacacagaggaggggccaccaucucucgggccccagcugucccuggcagcccuggguaaucaggcugcucucucuacaucugggacccaaaguagaguccaggagccacaaaagcuacgccgaauagggguucacacgaagccacaugagaaggcagccaggggccugggagccagggcuuguuccccugaugucccaaugccacagguagcaaagcagaggcacagagaggaacuggggaggucuccgggugcccacucccugcucagcucccgggaggaaguagaaggcucucucacggcuucacccagguuggagccaggaacaggaacaccuccuuuccagccgccagcauuucaaaccaaccggugccaaaggugaccucaggccggguaacccaugaugccccgcaacacgggcuguugcaggaaccccaucuuaccucucuguguuccaucuucuccugagccc

SEQ ID NO: 21354 - RNA, 121836 nt, Homo sapiens
ucguucccagaaaauaguuuauuaaauagaacaccuaaacucauuuacauaauaaagauaucuagauuacuaauuuauuuaguacuucucaacaacaucugucugguucuaaugagacuauaauucagaucuuuagcucuucuccuuuaaauccaaguuacauuuuauaucuuccaguuauuaagaguguuacauauuauuuuauauauuuaguuuuucagaaaguccaugaguuuuaacaguacaacuguuaaaguuucaauauauuacuuuaagcuuauguauaagacauuuuaaaauauccaacuuaaucaucauuuaguaauugaaaguuuaaggccacauuuuaacuauaugguuguuuauaaaagugugcugcuaaugaaggucuuugccauuuaaaagaagguauuuuucuuucuccuuuagcuugagauguuagaccuaauaaaaaugaaugucaccuuaaauaucaguugagagcccagaaccugugacccuuaagcacagaaauuaguauuuuccaaauccugcuauuaaaagugaauucaaaagaaacaacuaagaauccucucagaagcccuuuccuuuuccucucauauacaagauuaauuuuuuuuugcuucuuucugucuuucuuaaugguacgagugcagguaaaugucugaauagauaccagauuaguuuuaaaauucccccaaauuuuaguagagauacauuaaugcaaaaacuauuauucgcauugauuucagaguuuucaauagggaguuucuuuuaauaguucuugucuuucugaaaaauaaccaaugcauaauuuaccccuuuuaagaauggaucacaguuuagggaaaugaauaaaucaaaacccaucugauuugguuaagauucaaaaccaguaaucacuucaagaauaauuaaaauagugacccaauucacauucuaauggcaucugugcuguaaagggaaagacagaugagacuccuguuuagucuucuuuacuuacccuggugucuguggcauucucugaccucauuauuauuggucacucuucucaagaucagaaaugagaauauuuucuucuaaauauacuguacuaaaguugguugcaggauaguaaggauuccgaaacccugcaagucuccugaagaagccaccguuaugcuuguauaugcagaaggaaagugugcaaauggccacaaugacuaucagugucaguacaaccgcaagaggaaugaugcugugacuugguccugaaagaagauauuuuucuuaaaaaaagaaaaacuucaguggcgaugaaguaauauagauacugucauacagcugcuuucuaucuuauuauuucuaagaaaaaucaaaauguuuuguaugguuucaaacguaccuuuuucuggcagcgccucugcagugugaauaucuaaaaucaaauacaaaaauuaaaaugagguuuuucuuuuaauucagcaaaaauaugucauuacuuacucagggaucagcaaacuauggcccaugacccuauuuuuauaaaaaauguuuuacuggaacuuagccacacucauucauugauguauuguuacagcugcuuuccugcuacaauggcauguaacagagaccauauggcucccaaagccuaaaauguuuacuagcuggcccuuuacagaaaaaguuugcugaccuuugauuuauuguaaucaucguuauuagugcucacaaacauacacccugcuuguuuuuuuuaagccaagaaguuucuauucagucccagcacugugcugcaauaaauauagaguaaaauauaaacccugcauacaaggaacucacaguuuuguugggaucuuauauggaguuuguccagcaaugauaaucugccugacucuuuguaaggauuuuuaaaucagcaucuucucaccuuugugaucucaugggucuuggggaaugagcaacagcuucuccauccaaaaaguuagagaguuucuguuuuaaaacuuucuacuguaaaaacacaucuuuuaaguagauguuauaucaaaaugugaacucuucuauuuuugaucuagguaaagauccagagaaagguauagagaaugaaccagaggaagaugaagaaauggauuugugagcaaaagaacugccuugauguccuacugaugcucauucacucugauagacaugaaaaaaaucacaacacuguuacuaauagcaaaaccauacuuuuaaaaccagacuuguucuuuuuuuuuuuuuuuugaggcgaagucucacucuguugcccgggccagaguacaauggcgugaucucggcucacugcaaccucugcccuggguucaagcaauucucuugccucagcuuccuuaguaucugggauuacgggugugugccaucacaccuggcuaauuuuuguauuuuuaguagagauggaguuuugccauguuggccaggcuggucucgaacuccugaccucaagugauccagcugccucugccucccaaagugcugggauuuacaggcgugagccaccacccccggcccagacuuguucuuuuaauauaaaaacaaugccauuuaacguugcauuaaacugucgaaaauauguauuauuguguuuuuaugaagacacuucuuuuaaauugaugcauaucagaugcacaaauuuucagaacacaagugauaauugaauauagucauauaauuuguauaguguacuugggauaaccaucacuuuaaacauaaagauacaucuuuaagaaagacuguuaagaguguuuguucucaggauagaagcagugggcggcauggaaagagcacuuagaaaacuuagaguuuucucuguaguccuugauguagccucaguuugcacaggcacuuuucccgucuguaaaauggggauauuuaaauugcuccacuaccuuggaaagcugcugcgaaggaugaaacaggugucaucugcauuauaggaaacuuuaaaguccuguaagacaugagguguuucugauuuguucuugauauuuaaaagcuagugauaacuugggcacauuauuuaucaggcuuagccauguuuuucuuuuuuuuuuuuuuucucucacacagaguugagacucacacuguggggguuucaaacauuggugcccacaccugcaguguuuucuucuucauucccagcucaaaucagucaacagggccggugauucucucuuccuauuucuccccuccucuuucguuccuaguuuaaucacucaaauuacaaauguuucucuucauauccucaugaguucuacuucaucacaggugucuacagagcacauagggggucugucucuuccaccacaaaguucagcucuuuagccuggcacucugugaaaggauccuacauuaccauccaauuuuauucccaucacccccugacgugagcccuuugcucuaauugaaacacauucuuaguugcugccuuuaaucaggcugggccuuuuccuccucuguuccagcuucuauaauucucuucauccuuugggauccuaaaaccucaugucugaagccuucucuagcaguacaggccacagcaaucccuccuuuauaauacugacaucuagaaauugcuguaauuauuauagacauuuucccaccaucagugacuagaauuuucuagcuuagauuucuaaaauuauuguuuuuuuuaauuacuaaacacuaaguauguuacugaugauuaaguuaaaaugugacuuuuaugacacauuaugcuugcaacagggaaucacaucuucuugucuacagcaaauauacauaagccuagauuauauuuccugaggccaaacauaaaccuuaaaaauucugaguagcagucaccagaaugaagguugcugguuuacauuccuaguucuauuugcuugagggaaaaugauuuuuugcccauuaggugaucaaccugggugacacaagaaaaaucauagucuuugaguugacuuauaaugauuuuuuuucucauaucagagaaagaaggagcugaacuauucucugacuuguuuggugcagaacacaacaauaaugucagaaucuaucugaauacucucucaacuuggauuuuaaaaccuuuaaaugcuaaagaagucagucaacauuaguuaagguagaaucaaaaugaagaauuacucucugacuuuaccuaccugccuccauuuuacauauaaagccuuuuuuuucuugacacggggauagcugccauaauccuucagggauccucaaggcaacacaaugauggggcuugaaguagucugugucuggcuuccgaaugccccaguuugacuggucugugggaguuccaucaaaccacuuuaugguuucaucugugagaaaauugcugacucauuaugaauuaugugcaugguuaucaaacauacuaagacuggaauuaaccauaaaaagcagccccugaauuuuuuuauuuuuuuauuuuuauuuuuauuuuuuuauuauuauacuuuaaguuuuaggguacaugugcacaaugugcagguuaguuacauauguauacaugugacaugcuggugcgcugcacccacuaacucgucauccagcauuagguauaucucccaaugcuaucccucccuccuccccccaccccacaacaguccccagagugugauguuccccuuccuguguccauguguucucauuguucaauucccaccuaugagugagaauaugcaguguuugguuuuuuguucuugcgauaauuacugagaaugaugauuugcaauuuuauccaugucccuacaaaggacaugaacucaucauuuuuuuauggcugcauaguauuccaugguauauaugugccacauuuucuuaauccagucuaucauuguuggacauuuggguugguuccaagucuuugcuauugugaauagugccgcaauaaacauacguguguaugugucuuuauagcagcaugauuuauaguccuuuggguauauacccaguaaugggauggcagccccugaauuuaaugagacucuugaacuaauacauucaacucaguaaauacagugauguacucaacaucaaaagguaggcauuaauaaaguugccucuuuauuuuagguacaguguucuuauuuaggucauuuagguuaucauguuucuuaaugugacaguuugaauuuugaaauauuccauauauauauauaaucgauuuaaagaaaucauuugauaaacaaaacuaaucgaguaaagaaaaauccuuugaaguccuaacaucuucaucauuacaaaauggcucacuuucuaaaaagauuuuacagugaauuucuuuaauaccaagccagccauguaccaaggggguaggggcgguaggagaguccaucccaugugugggcaauaguguauugucugaaaauaauuuaaaacuaacaauacagcuaacuaaaaguuggucugcuuuuuauuaucaccaucugcuugaaauucuaaacaauguuggugauuaaaauacuccuccucgaaaggguaggcucacccccaaccuugguacaccacuguaacaagcucuccauaccaauuaaaauaauuuucuucacaaguaccuuucaauaaccaucaauuacauaaagaaaagaauaccaugcuuccauuuuauuacaaacucugguuuuuaugaguagcaaauaagaauccuaacagcacaguucaucauggaaacauuuccauaacucuauugugcuuuuauaacauuuagaaaccugggauauuuuccaguaaauaugguuuugguaugcaaugacuaagucugugaacacaaaguuccagccaagcaucuuccugcuaaggguaaagauaaacauguuauuguuuguuuuuauuuuugguguucugggauuauuuuaaaagacaaaaggguaaagaaaaggguugcaauguuguuuuuggaagaaauggcuuuaggcuucaugcuauuuuuucucagaaaacguauccaaggagaguuuucuggcucacagaugccauuaucaucagcuuuaacaaccauguauuuauuuauguccucuccucuacccaaaucacuuacuguuaccaucaaauugagcauucaaccaaaccaucuggacagaagaaccaaaagcaaacagcucuucuaggagaaaugcauuuucagccucauccuugauuguuaaaagauuagaaccuauaagagagacaaguagcaaaggaauauuuguguuuacacauaaauauacuuuaaaaaauguuuccuauacuauuaauuguaaagcucagguuuugaaaagugaaaauuuccauuauaaagaagagacuuuaaauuaaaaaaguaaaaccacauuuuuuaaaagauacaagcuugcacgucagaaguuaaggcauagaauauuaauuuuagggaacauucaaaauucauaaugcaaaugcaugcaaaaggaacguuuucuucagaaagugcaguaugcugagacaucaucuuagguuuccaaauucuacacuggacauuguuucauauaguagcuguccuccaaacaagcaauuucaauaguauuuauuuuuucaauaguuuaguuuuuguugcuccuaaagucacuaaauaaugggaugaauaaagaaauccacauuguuuacugaaauggcaagaaggagcacaugaaagcauuuuuaccaucacaaaaacaauuaccuuccuuuuugcaaaauucaugagcagccucaaaacucauacugucuaggacuguagaaaaacuguagcaauuacuuuuaaauuuuauccagggaauagauguuucugagcacaacucuggguguucagauugucuuguuucugugaagaaaagccaguuaugauuucaggguggugacuggguuuauuuauugagauaaauauuacauuacauucuauaaaagaucaagauaaauauauguaacaagauuuucaugguaauacucugaaagauuggguuucauguaaaugauuauaaaacuaggaccaguuuauagcauuucugacagaaauaaucuuuaccuaaacauaacaagauauguuaaggcacagcuuuguaggcuuaguuugggugcugccugggugaggguggcucuuucauguuuacaauuagcauccuaaagguuggaacaagcaggggcuaugacucccagagagaguggcagcugacugaugcugguaaaagagauuuccaaauguaugcauuucaugcagugcuguguaucacagauuugaaaaguccuuacccacuaauaaaccugugaaagaaaauaaugcauucaauaaaguaucauaacauagcauaacauaaaauaaauaagggaacuccagagggacuuuauuucagagagcaagcaugagaguuagacacauccaugcugagaucccggcuccaccacuuacuagcugcgugaccaugggcauguuaccuugcacuugguuucuuuaucuauaaaagagagcuaacaacaaaaccuuuaaaaauauuuuuuuuaauuacaaaaaacuuuuuaaaagacaaagucucacucugucaccuaggcugaagugcaguggcacaaucacagcucacugcagccucaaacuccugggcucaagugauccuccagccucagccucccaaguagcuaggacuauaggcacguaccaccaagcccagauaauugaauuuuuuuuuuuuuuuaacgagucucacuguguuaaccaagcuggucucaaacuccuggccugaagagguccuccugcuucugccucccaaagugcugggauuacuggugugagccacacagccaccuuccuuacaaguugagaaguuucaaugaguuagagccugacacuucuuaagcauucaauaaaugcauuguuauugaaaggacaagauuccaagaaaaggcaagugcuaacaaaaaaaaaaaaaaaaaaaaggagaaaagggaaggacagcuuuuauggaguuuuagaaguagaauuagcuuuuccaagauauauguggcuaucauuuacauuuaauccugaauuguuuugaucuaaaaauauauaauuuguauguuauuugauacaguacccagaauguaaguaaauacaugcacuuuuacuaaaugagagauuuaaaaggaggccagcuuguguuagugaauucuaugcaggaaacuugauuucuacucuugguacuggugauggacagcugugagacacuuaggaaacuauuuaaugcucugaguuuacauuucauuuuuaauaaagggguuaggccaggugaacuuuaaguguaaaugagauauuauguaaagugcagagccagauaucuaguaaauauccaaacaauaucaccaccaucauuauuguagcucuggaauccuaucaaucuuuuauuuaaacaugaauccucaaaguccuccacacaugcuugaagcccauguuucucaucuaauuucccaccccucccuuacgccuaaccugcauucaggcaaaucccaacaucggcuuugucuuacguaagccucguccugucuuccuuccccauuuucauccagcuuuucuccucagaaugccuuuccaugucccauuauuacccaucuacacccaccuauuuaucaaggcccaucugcacugccauguccuucaagaagccuuucuaccuuucuccaaaugaauacaaugcauucuuuuucuugauaacccccauaacauuugcuaccucucuuauaucauuuuguaguucuguuauucuuuacaucaccaaccagaccagaggcuucuugaagagagacuucuuacuauacucauccucauauccuuugcuuagcacagugucuugcauacaguaguuaaauaagguauauuuuugaguugaauagaauugaaccuaccagguggcacaugacaaauggcaccuugcagaaaugacucgcaggcugugcuaugccagcguccguugcugucggcaaaaacgcagucaccaaggagggaggacuccucaucuuuccaaaaagugaaagaagauuuggugccaucagaccagucaaaauuaagaccauucuguggaggaaaacugagccaucauuuccuugccacgacggcuggcagcaucacccaguguuaucugagcaugcuacaauucccacaucgauugcuauuucugcacaccuuuuuaaagaggggcuaggacaucugugaauacagcuugacaaacaggaauaucugccacaaaugagaucuuuuuugauuuuuaggaauucuuggcucccugccacaaugauuuucuagugagcaaucggcgugaaauuggaccaguaccuugucuuuuacagugaaauacauuucagauugaucaauuauucaaacauaaaauugaaaacauaaacauguuaaagaaaaccugguuaaauuuuuuuauacuguugguguggggaaaaccuuuccaagucauagaaaauccagaggcuauaaagcaaaacugacuacaugaaguuaaaacauucuguacuacaugaugcaauaaauaaucaugaaauaucauucauuuaucucucccacuggcaaggauuaaaauuuugagaauaccugguguugacaaggaugugaaaaaacuagacauuaucacauacuguuguuggcauguaaauuggugcaaacucuuggagggcaauuugguaguacuugucaaaauuuuaaguguacgcagcaauuuuacuucuaaaaaauuauccuacuggcacaaggauauuuguugugcauuguuuauaacugugaaaaacugagaagaacccaaaugucuauucacaggagaaugguuuaauaaguugugguauauccuuacaugcugcguucuaaagaauucaugagauuuuuaugugcugacaugugaaguuguuaaagauauauuaaauuaaaaagcaaguuuaaagacagcauguagaauaggaucucauuugugcuugaaaaacaauguacauauucuuccauuacaugaauauguauguguauacauggaaaauuucuagauggcacacaagacaguguucacaauuacuaacauuagggaguagaacuaggggucaggauagacuaguuuacuuuucacuacuuugaguguacaauauuuuauuuaaaaaaaugaaaauaacguauucucuaaaccacaucccuagaggaaaauaaaaccucaagugcuuaauuauaagugguacuaaacuaauuaauaaucacauuucuagacaagaagcaugauucguuuuuucuuggggauucauuaaaugccgcaaauucccaaaugcagugcuugaguuucagcuguguuccagugcacaugcaaggcaguaucgggguacuuggaaauuuucagagaaccuuugaaugguauuaauuuccagacauuaggcaaguggauguuuacccuaaagaggugugcacucuuauuuuguagucauaggcuguucauaagguuggucagguaauugcauaaaccaauuauuuaaguguuauauuuauuaauauuuuugggaucuuuuuuucagugcuaauuucaguggccagaucaugaaggagguagaugcuaaacuuaauuauucaaggaugucucaagggaguuaggauaccuacaucuguggugaacaguccaauccagugggcauauccuagccgguugaggacaacagugaggaaggacuggugauacuggucugugaugcugaccaguugugcuuugugcaucaggcagguuuuuauugcugcauaccaagucauauuugcauuaauuauuuuguaaguucuguuuccauauucuaagguauugggcauuggauacauaucagauguauuuacaccguguccagaaguaucuagaacaagaacagcaacaaaagucauuugcagcaucuggaugacaaaggaagaggcaaagcuuagcauagauccuugucacuaugauccauguugaucagagugcuuucuucuggaauugacuguuucaaaacaagaacacuaucugaaaguguaagugaugcaaaaaaaugagaacacucaggaaauuuaaugaauuguuuuucaaaaacauaaacauagauugaaccauuucuagaagauuucccaguuuugaccauccuuuaucaaauugacugcuuuuugguggaacugauggugaucuucuuagguggguuucacuccacuaacuacacuuggcuuaauccacacugcuguggcagaacuuaaugcuuauuaauagcagaaaggcacauguuacauagucauauauugcauugcaaaccuaauauuacaggugcauauuaucagguaaaauacucgauuacacuuuugagacugauagucacuauuaugcuuaauguuugcauguauaaauucuaaaaggaauuuuaaaaaauaaaguuaauaaauucuuagaaauacacacuguucuuauaaacaguuacuauuaauaugucaccugucagagucaaaguuuauaaauuaaaaggcaagguuuucccacacguugucaagcauuggugcuugagagucugugaguggcugugaucaugugaaaaccaagccuguguuuaugaacacguguuuccucucuaauaugugcauuugccuuucuguuuacauagaacauauguucuauauguacuaggauauguauagaacauauguuaggauauguauagaacauauguucuguauguuauguacuaggauagacuaaagguuuagaaaaccuaaaggacaaaaacaagguaagaguuuuuguaccuucugauccaaagugacuugaauuucuguguacugguuuuacuacauuugguguuggaaagaagcaugugagguguggauaggucaugaggcugggacuuaauccuauuccuggcccuaacuggcuaagagcucuugggcaaauuaaccuuucuaaaccucaaauuuauggucuacaagagaugaugagggucucccuuggagggguguggauggaauugaacgagauauccacacaaggcacacacuauuguauggagacacagaaagcauccuaugaauguugcuucuugcuccacucuccuccuccggucauacuccccccaguaaaaauggcaaagugggaaacugaccuuuaucugaaaccauuaccucaauacagcagcuguacauauggaaaaaccaaaguaaaaugaaucucuuuaauuucuguaaauugugauggaucacacuuuuaucauauuuuuauucuuugcuauuagucugugcccagccuacgugcccaguguaaugguuauucauacaaaaucaaaauaauaucaaaguagcuauuuuaaaaugcuaacaauucauaacauuaaaugacauucuuuguauauguuacccaaaugccaauuugacuguuuuuuccccacugaguuauaugucuguauuuuuacauauauaaauuucuccauauguaauugauuccauuaaguuucaaaacaagugauuuugagcagcaugguuuugccacccauugcccugaaaaagaaagaucuauuggaaaccaaguucuaaacuggggagucuugcuuugcccuugugucucuucuuauucaguuucuuaauuuuuuuggcagauaaaagacuuugggcucaagcccaauguaagcacauauguaucugacaaacagagaagaggagcagaacuugaauauuuauuguuggcuacaauaacuaguguaguugaacaauacuuucuggaaauaauagaaaaaacuauaucguuuguuaaauauaugcuagaaguaugcuaaguguuauacauacauaaagugugugagauggcuauuaccacauuuugcagaugcagaaaucaugaucacagaagauaaguaaccuugacugaagcuuaucuacaaagaagggugggaacccaugugugguaggcacuccggugccuaugcucucaaucaccacuauucuguacuaucucuaaaggaaaaucuacacuguuagucccaaaaauaccaaagagagaaagugaucagagggcacauuccaagaauaaaucaacaucaagguaguggaauagaaucauuguguuuaacugagacaccuugaguguguuauuuuuguuuuguuuuguuuuguuuuccuggagacagagucucacucuguagcccaggcuggaaugcaguggugcgaucucggcucacugcaaccuccgccucccggguucaagcgauucucaugccucagccucccuaguaacuaggacuacaggcaccugccaccacgcccggcuaauuuuuuguauuuuaguagagacgggguuucaccauguugcucaggcuggucuugaacuccugagcucagucaauccacccgccuuggucccccaaaggcuaggauuacuggcgugagccaccgugccuagcaaggaugacuuauguuuuuaagccucaaguuccucaucuguaaaaugggagacuuuuaccuacuucauagaacugucuugaggauuuuguggcauaccgcgcauacacucaaggcacagggucagguacucauaaguguguaaguaccuggcaugcucauauuauuucuuucccuacaaggcucugcuguucccauauuacucuugcuguuacagaucuaguaucauuuuuucaguuccugaccacuauaauguuuaagugguaacugagaaccagaaauggagcuucucuggcacugcuuuuuugaggaugaguugauaguaacauuagagacuucacacguaugccacauuaagaaguaaaauuccuauuccaaauaaguauauauauauauauauauaaauauaugcuaggcugcccagaguuccauacagcucuagacaccaacuauggcuuucuugggugguguggacagggauacccagcauucaguaaaagcaugagcuguuguuguuuuuauuuauaguacucaaggucaguuauagugcauucacacuauucauugacccuguuggcuauuuguaauaguguggcuuuggcauuucacacagaaaccauuuggggguucugcccaucagaucuagaagauugcugcaugccacauuuagccacagagaccauuuucaggguuccaaaaaaggagcaaauaugaguugguuuauuuccuugauucuuucccaacauuuucucagugaccuuuaaaaaucaccugaacagauacauaaucccagaaugaagcaguaaagccauuuaauaugacuaagauagauacauaaauuuggucaucacucaaguggccucggcaguccuuagaaucccacuaaagggcauaagccuaggguagaggagauuaaauaacuaaacuuauguaaagccaaagaagaagugccugacacuguuagccaggaaacuguuagcuacauuagcuacacagcuguguaaaaccaacaugaaagagaaggauggacuuuggaaaugaaaggaauaaaaacccaaauauuucuuaccuugcauuuuuucacaaacaaacccauagccuuccuuuccacagucuucaaaauaccauuuuccagugaaaugaaaauuaggauuacuugagaguaaggcacagagaggaauguguuucugaacuucagugguauugugacuuggaaucuuuaaaauaauacacguuaucaaaaguaugauaacauauagcauuauuauaacauuaaaauuuuuauuaagacauuauuuuuaaaauuaagacaccauuauuccuuuauucgcauuuaauaaacuuauucacaagucauuucauaaccuacaaaauaaacaauuauugugaugaguaaaguaauuauauuaauggaacacauaaaauuacauuaaaaauuaauauauuaauaaaaaacuaauauaaauuuauaccuacaaaauauaggaaauaaaaaaagcuuuaguaaacaaaucuugaauaaaauaucuugccaaagugaucuccaaaaaauaaaucuuaaaacuuacauuuauuauaucaaauggagaccaguuagaauauaccacaggcuuuccauuuagccauguuucauaaucaucauuuuguaaaccuauccacacacugguggucuggccaaaaagauucauaguaaugaaagcugaaaaacaggaauacauuaucuaauuuaauacuguagaaagcauuuggguaaucacugcauccuauuuauagcuaugauuauauuuaaaugccagcaaaacauaauuaugaaucauuuauaggaauuuguuacuuuauccuuguuaagguaaugcaguuucuuucacuuuuguuuuaguuuaaauugacagaaauuagcuggauaaccugagauuucaucauaucauuaacaaaacaauuuccaguguucauuaauuaccuuucuaaacaaaagaggauuuaucugcuauauuuaaacugaaguauauaauugauuaaauaucaaauaaaagcauguagguaaauguaaagggaucuaaaaaucauaccaugcaauuacauguagaucauacuuuuuagccauuuugaaauauaggccaugaauauguccuuauucuuuccacugcuacuggugagagacaaggcuccaaaacccagcaguuuauaagcaaugcaguacacuaacuuuuacagauaucaugaaauaaaaccuaugggucaaacugcaaacucguguaucaucagcaacacaguauuuuaaauguugauuugggaauguuaguauaggugggggggauauuuuaauaaauacuugaauaaaaaugguuaucuuggccugguuggaucuugaguacucuaccuugcuccaccucacuuucaauggcgaccaggguccccccuucuucagcacagaaauguugagcaugcguccaguucuuccaacugcuugggucuuuggggauauucagcagaaggcacuaucaaaaaaugucaaaacaaaacauucauuucuguaucuuucuaagugaauuaaaaauuucccaaagacacugaauaucagcuuugaaaauucuuuauaauuuucuugggcagaaagaacucauuuuucuuucaccuccuccaaagguguuacaguaaaacaaagaggagcagcuuuuagggugaguuaaugacuugccugcauuugcagcaggcaggaacagaagcagggaugcguuuugucuugugaaaugucagaacagugccuucagcacaaugaaaaguaguauucuuccuaaaaaggagccacucugauugcaaaguuuacaugggcacauuuaaucuaaaaaaaaaaaaacaaaaacauucuggggguggcaaugaacagcuuaguucaauuuuauuuacaaacacacuuccuuacuuuaagugagagagaaauaauggggagucaaacacaucagguguuuaaauucacuaaauacuugagucagccauuuggucacuaagucuauugggaagagccagagaagaaaaauaaaugaucccagugggacagaaagcaaggguaugaccaaagaaaccugggaagaaguagaaaugaaggggaagguuggccaucaauguuagagggaacacagaaaagguuguggaauuuggcaauaaaaguugaguguuaugcaagagagaaucaugucugcaucauggcagagguuucuuuucuuuucuuuuuaaauuuuuuuugagauggagucuugcucuguugcccaggcuggagugcaguggucagaucucggcucacugcaaccucugccuccuggguucaagugauucuccuaccucagucuccugaguaacugggacuacaggugcgcaccaccaugccuggcuaauuuuuguauuuuuaguagagaugggguuucaccauguuggccaggauggucuugaucucuugaccuugugauccaucugccuuggccucccaaagaguugggauuacaggugugagccacugcgcccugccacagagguuucuuucuuaugggaugagaaauggaaugauacauacuuggcaggacaggcaggguugaagauaaguuuguuuguuuuucccugaaaguucgaugaaauuuaagaauguugguaggaacagauggaguuuggugagaggaaaagauagaagagaaagguuauaauggaucaggcaaaauuccagagaggucaggagaaacuuuaugcaaaggauguuucaucuggaacuugcuggggauucuucucucauaaucaauucucucaucaaugaacacagauaacccuagucauugauagaucagauccuaagaucucgccacuacaggauaauucuagguuagcguggaaaccuacacuugaaaaagcauccuuuccuaccuuauuuugaaaugauaucugauauaguuuggaugucuguucccuccaacucucauguugaaauguaauucccaguguugaaggugaggccuggugggaggugauuggaucauggggcagaucccucuugaaggcuuaggaccauccccuaggugaucaaugaguucucaguucaugcgagaucugauuguuuaaaagucuggaaccuccucucaccucacccucuugugcuugcucuugccaugugacaugcugguucccuguuaucuucugccaugauuguaagcucccugaggcccucaccaguagcaggugccggcaccaugcuucuuguacagccugcagaacuguaagucaaaauaaaccuauuuucuucaucaguuacccagucucagguauuccuuuauagaaaugcaagacuggucuaauacaauaucuuuccccaucauucuuuaauuuccaaauuuuucaguucuccaccccuuccccaccaucauacaccccuuaaaagcagagagacuaagucuuacuccucuuugaacaucacaccagagaaggccccuaguaaacauuuauuaagcaaaauaaaagacaacagacccuaaaaugguugucaaaugacauugucagucauucuaaauuuagcucagugguucuccaacaggacaauuuugccccucaggguauauuuugauaaugccugcagauauuuuucacuguuacaguuggggaggggauugcuauuggcaacuaauggguagagacaaagaugcugcuaaccauuugcaaagcacaggucaggucagucuuucaaaagaaagaauuaucugaccccaaaugucaauaguguaagguaauucuuuuuaaaacucaguccugaucaugucacccuuuaguuuaaacccuucaggaauuuuccacuacucuuaggauaaaaaccagaaacacugaacuagcuugagguugaguugccaacuaagagagaaaauacauuuucaauucuucugguccuuuuugucuuguuugcuucacaaauaaacugaauuggcuuucaaggaguuuaauuuuauaacaacuauccuuuuaucuauuuccuuucauuuugccucuuuccucuaauuacaaauucuaaagaguggcacauauuaauuauugggaagucuuaucauuuaaugugaauucaccuuguguucagauaguuacacuaaugaaccauucauaaauaccaaugaaccucauugguucaguuagcucaauaaaucucuccagaaaaacaucuccucugcuuccucuauguuugccucagccaggauuuacuagcuugacuacggaaguguggccugcaauuaccacgacuucauuguuucuaaaaauauaacauauuuacuaacacacuccgaaauugugucauuaauaauuaaggcaaagcagcaagaugaaguacagcauccuuaauuuaaaauuguuuacuuacuaauuugcaaaaugugaucaaguuuaaugcaucucugauuauuacugugaauuaaugggguccuacuguauucuaaauggguuuucaauauaaaauucuuuuuugucucaaaaucauuucuagcucaauauuuggaaaugaaauucaguucccuccaaacuugguccuuucccaguguuccuacucacaaugaauggcacggucugcaugcacuuauacacauacaauaagccugaaaccucagaggcauccuuaccuucccacuccaucuccccaacagccauaccauuuggacaucucauuucccaaaaagcccccucacccauccccauucccacugccucauggucucugccaccacuaucuuagcccaaccuaccagucucuugccugcacuacagcaauagcuuccuaacugcucuuaccuuucucacccuugcccuucuuccauauauccuuggcacuacaucuagaguaacuuuuuaaaauuugguccuggucacguccuucuuuaguuuuaaacccaucaaggguuucccacugcucuuaggauagaggccagaaguccaacacgguaucacccuuuccacuucuuuugucucaccuuuggccacucuaguucucuauguuuccuuuaguuucuuaaaugucauacucccaccuugcugcaggaccuuagcacaugcagcucccccuauuuuuaauguucccugccuuucugaccacuucagucagguccucuggcuauacacuuuucuagaaccacauaacuuuccuucaucacguacagcacaguuuuaaauuacacagccauuuuccugaucgauuuacuaauguuuguucucccucuaguguguaagcaccaaaagagaaggggcugugucuguuuuuccucaccacugaauucccgacaucgagauaguaaaugaaugaaugaaugaagugcuccaauuugaauaaauuccaaaaagaggugagaguauuuuuaagaaaaaacuauguuaugcacaaaaucaaauauugacuaaucccaaacuagacagugcaaagcagccauuaccacucaauccaggucuugaauaaaaauauguaaguagaagcacaagaguuaaucacacacacacacuuagaauuucuuccucccacagaucugcugggacaaguaucuuagaugacucauucuuccuggguaaaccccuggucaaaccucuguuacauuaucaaacacagagaaaacuauuuaugagacauuagaaaagaugcuuaauuucuguguaucucaguuuuaaaacccacuuaauuugccaacaaagugggauuuuuuuccuuagaaauaaccaauaaaaauuaguccuaggaaauucacaaacaauaagcaaaguuuaaugggacauaauauauuggaacucauuucagaauugugaaguaaagaagguccaucauuguuaucucccaguuuuccuucuguagcuuuauuuguuaauagggaaaaaccaucccaccgcucucagcuaucaacucuccuauuaacaguuuuucuaauaaucugauaaacuuacuuguuucaagauguugaugacagaugaggcaaucucaaaaauauuucccuuuuaaaaauaaaggaaaguguugagacaaaggagagaaacuccagugguggaauuuuaggcauuaaugcgcaggagaaggcacuguggguggggagacaugcauggugacucugacauugugccaggugaauugccaccuacuuaugaagccugcugugaugauauccuuuguaaucaaaugcuccuaaugccuugaagaaagaguuguggaacuaugacuguugaauugcuggguaaauauuggccacacauuagaauaacugagggagcuuuaaaaaaauacggaugccuggaucccaugcagaucagcuaaaucagaaucuucaggacgucuccugcacuuugauguuuuuaaaaagcucaccugcugauucuaaauauuugaccagggcugaaaacuacugaucuagcuguuaguuaucaauaauuuuuuuuuauaacucugagcuacaugaggguguuuuaaucaugccccagggcuagcuucagaaggcgccuccccuccccgccauucucaugcacauauuuauuccccucucuauuccuuucaugggaagcauucacuugcucuuuugcccugggucugcuccaccaucacugccaccauucccauagauacacacucucuacguguguacaggaggacacaugggauggaggugaacuguguggguaaaaaucaaguuugggggaaggauaauagcaaaaggcugaaccagaaacaacuauuccagguuucuaagaauuauuuaucaaaugcuaaggauuugacuugucauuaauuuccuuaaaauauccucuuuuaauccuagaagaaaaccugggcaauaccauucaggacauaggcaugagcaaagacuucaugccuaaaacaccaaaagcaauggcaacaaaagccaaaauagacaaaugggaucuaauuaaauuaaagagcuucugcacagcaaaagaaacuaucaucagaauaaacaggcaaccuacagaaugggagaaaauuuuugcaaucuauccaucugacaaaggucuaauauccagaaucuacaaagaacuuaaacaaauuuacaagaaaaaaacaaacaaccccaucaaaaagugggccaaggagaugaacagacacuucucaaaagaagacauuaugcagucaacagaaauaugaaaaaauacucaucaucacuugucauuagagaaaugcaaaucaaacccacaaugagauaccacaucaggccaguuagaauggcgaucauuaaaaagucaggaaacaacagaugcuggagaguauguggagaaauaugaacacuuuuacacuguuggugggaguguaaauuaguuaaaccauuguggaacacaguguggugauuccccaaggaucuagaacuagaaauaccauuugacccagcaaucccauuacuggguauauacccaaaggauuauaaaucaugcugcuauaaagacacaugcacauguuuguuuauugcagcacuauucacaauagcaaagacuuggaaccaacccaaauguccaucaaugauagacuggauaaagaaaauguggcacauaaacaccauggaauacuaugcagccauaaaaaaggaugaguucauguccuuugcagggacauggaugaagcuggaaaccaucauucucagcaaacuaacacaggaacagaaaaccaaacaccacauguucucacucauaagugggagcuaacaaugagaacacauggacauagggaggggaacaucacacaccagggccuguuggggacugggggccuaggggagggauaacauuaggagcaauaccuaauguaggugacggguugaugggugcagcaaaccaccauggcacguguauaucuauguaacaaaauugcauguucuacacauguaccccagaacuuaaaguauauaaaaaaauccucuuuuacacaugagaggaggcaugaguuaguaacuaggacaguuguguucaugcuuuuggguuguucacuaucuguaccagaaaugugauuuggagauuagcuaggcauuccuuuaugccuguucccuagagaccaugccaggauaaacuuguucuaacaguugugaaaaacuaauugucacauacuggagugaauucaaaauguaucaacaaccuaaauauaaaugcuaaaaccaugaagcucuuagacaaacacacaggggcaaaucuucauuaccuuggauuuggcagugaauucuuaaguaugauaccaaaagcacaagugacggaagaaaaaguagauaacuggguuucaucaaaauuaaaaacuuuugugcaucaaaggacauuaucaagaaaguuaaaagacaaccuacagaaugacugaaaauauuuauaaaucacauauuggaugggguuuaauauuuagaauauacaaggaauuccuauaacucaacaauaaaaaggcaaaugauccaauuuaaaaauggacaaaggacuuuaauagacauuuuuccaaagaagauaaacaaauggcuaacaagcacaugaaacgaugcucaacuucaucagauaauagagaaaugcaaaucgaaaucacaaugaaauaacaccuaacguguucuaggauggcuauauaauagccagaguuggcaaagauguggagaaauugaaacccucacacacggcuagcaggauuguaaaaugguuuggucgcuguggaagaacauuugucaguuccucaaaaagcuaacuacugaguuaccauaugacccagcaauucuauucguagguauacauucaaaagaauugaaaauagggacucaaacagagacuuacacaccaaugcucauugaagcauuauucacaauagucaaaaggugaaaacaacccaagugcgcaucaacagaugaaugaauaaacaaaauaugcaauauucacacacacacacacgcccgugccacacaggaauauuauucagccacaagaaggaaggcaauuuugauauaugcuaaagcacaaaugaaccuugaaaacaucaugcgaauaggccagacacaaggacaaauauuguaugaguucgcuaauaugaaauaucuagaauaggcacauucacagggauagagaauagauuagagguuaccaggggauggggaacaggaaguuagugcuuaaugguuacagaguuucuguuugggauagugagaauguuuuggaaauagagaugaugguuguauaacauugugcauguaauuaaugccauugaauuguacacucaauaaugguuaaaauggcaaauguuauguuacauuauuuaggaccauaaagaugcuuuaaaaaacuaauugccaaagguuuuaauaaaagacuuaguaacacucagugucuuauugaauauuagcuacaaguuucucauacuaaaaugugaaaauaauuuauaccugguagaaagauuuuauaguuugagaaaauaggaaguauacagaaaguaucaaugauuaaaaaauaguguaccucauuacuauaguaaaguuuuagaguaaauuauacuauucuagaaaauaucucauggugccacugagcucacugugucauagggcuaagcugacauggcaacccuuuuuuuuaaaaaaaaauuauuaaauacuucauuuuuuaaagagcaguuuuagguucacagcaaaguuaagaggaagguacaacuuugggagaccaaggcgggcggaucaccugaggucaggaguuugagaccagccuggcaugaugaaaccccguuucuacuaaaaauacaaaaauuagucaggcgugguggcaggcaccuguaaccccagcuaccugggaggcugaggcaagagaaucacuugaaccugggagauaaagguugcagugaggggagaucaugucacugcacuucagccugagugacagacugagaguccaucucaaaaaaaaccaggaagguacagagauuucccaccugauccacacauacacagccucccgcauuaucacaugccccaucaccccagaaugguacaucuguuacaaucgaugaaccugcauuaacacaucauaaccacccaaaguccauaguuuacauuaggguucacucuuuguguuguacauucuaugaguuuguacaaaugucuagugacaugcauccaccauugugcuaucauacagagaauuuucacugcccuaagaaucuuccacaacuucauccuucccucccugcaacaccuggcaaccacugaucuuuuuacugucucucuaguuuugucuuuuccagaaugucauauaguuggaaucauacaguauuguaggcuuuucagauuggcuucuuucacuuaguaauaugaauuuaaguuuccuccauguguuuuaaaggcuugauagcuaauuucuuuuuagcacugaguaauauuccauugugugguuguaccaguuuauuuauucaccuacuagggacaucuugauugcuuccaaguuuuggcaauuaagaauaaagauguuauaaauauucauggacagguuuuuacauauacauaaguuuucaacuccuuuggguaaauaccaaggagugugauugcuggaucaaaugguaaaaguauguuuaguuuuguaagaaacugccaaacugucucccacaguggccguaccauucugcauucccaccaggagugaaugagagcuccuguuguucggccuccuugccagcauguaguguugucagugcucuggauuugggccguucuaguagcugugcaguggcaaaucacucauuguuguuuuaauuugcauuucuggaguggcaguccuuaagugccaacgugaaguggcaggcauaggaaaggggcaagaccaccagacucagggucagaaaacaaaaagugcgucuuggccugaugcguauucacugugaaguuucagaaaagucacacaauuuuguuagcaucugucuucucauauguaaaaugaggauaguaauucuauauauuuuuaaaauucagugauauaagaaauaaacauacaaucaauuagcuaaggggggacguaacucaaauguccaccaauggaugacuggauaaacaaaauguaguauauccauacaauggaauauuguccaaccgucaaaaggaaguccugucgcaugccagugugggugaaccuugaggacauuaugcuaacugaaauaagccagucacaaaaaggcaaauacugucugauuccacuuacaugagguaucuaaauuagucaauuucaaagacacagaaaguagaacagcaguugccaagggguucagaguaggaagaacagggagucguuuaauggguacaguuucaguuuugcaagauggaaaaggucuggagauuuguugaaugacagugugaguaugugauacuuaacacuaguaaacaguagacaaaaauggcuagaauggugaauucuauauuguguguauuuaccagauauuaaaaaaauuuaaaagucagugccaaaugucugguggguacucaaugaaugugugaaaaauccaaguggccucauuucucaaauuaacaaugggaggaagaucacaaaggagagaaagcccugccaauauaacugaacacuuagauuaaaaauuggcuguccacaauugaagaggaauuucauauuagcauaugaaaugaugacacaguuuggguuuuuuaauuuucuaagaguuaaacaauuauaauuugggaugcauuuuaauuacuuccaccuaaggccuauaaaguuauuuuauuauaaaauaugaagaguggagggagacuaggccuuaauugaaggcagcaucagaaauaauaaaucugguuuaaaauauccccacuggcaauuuuuuuuuucuuaauucaaaucugcauggaagcaccagcuuuaugaggcuuaagaugacauugaccaagcuaaguuauuagucccucaauucacuagugggcagagcucuaugccggcuccaggcagggaaaacacaagaguaggagauggagucuggguccucugaaauuuacagcuuauuugggagcagaaccuagacacacaggcaugcaggcacauacauacacgugcacacacacgcacgcacaugagcacacacacacaugcauaugcacacacacaugcauacauacauauacauacauauguuacaccuaaugaaacauucauacagcacaauaaaugacuaugccaacaguaaaacugaguauagaaacgaggggcaguguccaggcuguuuuugacaaaaaucuuuuguuccaaaagauuuguuacuaaauggaaaacucaaauuucuugaaaguugugacaaaaaaauuccagguccuauggacaacucacagcuuucaaaagccacuuucacuuuuugaacacuuuccaaaauuagugucuacaaaagagaaacaaaggcaacuuuugaaaaacaagcuuaccuuauaguuaaaauauagccauccuuugggacacguuccauguuguuuugguguaucuuucuuuuucucuaugagccaaaccuuuuuucgcuuacagauacuaggcauagaaacugaacacucuucacuaccccagaguccuggaggagaaaauggguuagaaauggcuuaggaacaauggcgauucuuugaaggcauucucuauugaucacuauuuuuaugaggcuaugguuuuucauaauuuauuuuuuaaaaucuagaaacugaacuaaacuacugaucuuagauuucucuagggacaacagcuaacugggcaaggccaacucaguaauuuuaauuuaagaauguaaaaauuuugcaaauuaaaaaaaucuaaauaaauacugcaauuugaaucauagaacugauuaaaaucuuaagaauauuugacuuguguagcaaaagaauacuuuguaggguaacaauuucauuuuaaaauguucaauuucaauguacagagaggaaaaagauucuaaaacaguagauaauuucuacuuuauaauucuuuagaaaauauaauaauuuagaaaaauuaacucaagaacuuccaagaaaacagcauuuaauacugauccuuaaguaaaccagacucacauauagacaugucuucaguaagaaauauccucaaauccuuagccuccgacaaacuaacugcuuuuuuuuuuuuuuaauuuagaagagcuauauuuucagaauaaggauuauagaaugcauuuuauuggcauccaagucauaaauuccagaacagggcagaaugcaugccaauugcaagggcaggcucaguuuucuagaucaggaauaugagcccaaaagauguuggcauuuugaaggaagggcuggaaugcuauuuucaaugcagauuagcugcuauucucccagacgcucaaaacaguccuuucuguaggcuguugugacaccugcugguaaaagcaggcugauuaaccacacggauuuuccuuuccuaacucucugcagaggcccucacacccaaaauuauuuucuguguuuaucccucuccuggccuggggcacagguuaguuaugaaucuguuagaguaauggguaucauuaucuuuuauugguuagaaagaaggggaaugaguggacaaucaaccuaacuacacugcacugaugaggagaauuuaaaaaaccaaucuucaaccuaaaugugcuucuaaauccaacuugcaaacaguugccauucuaaagcaagcagcaauugaugacagguaguaaaagaaaaaagaauacugacuugaaucaaaacauuuauuaaauaggaaaauggaaguaaauuucacagagguuaaaguucuggcccauuauaaauuggauauaggaauagauuuuuuuaaaaagugcuuccauugaaauaccauagaaaaaaguauuugucaggcauauauuucuuuaaaguuucauugggcccauuucuggugcugucuugauuuaugaggaaggacuuauucagauguaaauuauuuccaagaacaugaaugcauggauugaacagaaaaaaauggccauccuuaagccuuauggcagacaaaacugaacacgucaacugaaaagagaaauaaacagaaacuucucauggaaaugaugcaaggaaaagacuuuaagccuccugaaaauuaucaguuuguauuauaaacccaaaaauggguaaguaaaauaaccuguuauagaagaaauaaagccacaucucuggcucugauuauucacaguucuuucucuuccugugucccaguucugguauaucacugguguuccaucucuccagcugugggaagauuaaaaauguuaaggucuucucucauucugcauguccagucuccaacaucauucuuagaguucugagguagggauugaagauauaauauucuauuaaauuuaaaaaauauacucauauguagcauaguaccuauaguuaacaauauuguaucauauacuuaaaauuuuucuaaggugguagauuuuuuuugagauggagucucucucugucacccaggcugaguacaguggcacgaucucggcucacggcagccucugccucacggguucaagugauucuccuaccuuagcccccccaaguagcugggucuacaggugcgcaccaccacgcccagcuaauuuuuguauuuuuaguagagagagaguuucuccauguuggccaggcuggucuugaacuccugaccucaggcgauccgcccuccuuggccucccaaaguacugggauuacaggugugaaccaccgcgcccagcuaagaggguagauuuuauguuaagaguucucaucacaaaaaugaaugaauuagugaauaaauaaauaaaugaauagagcaggaaagaaagcuuuuggaggugauggauauguuuauggcuagauugucgggaugguuucauaagcauauucuuuaaaaaacacucaugucuuugguuagagaagugaaaauuuauaaguuaauguuugaaggguauucaacaaauugaucacuaaaauugaaucuaaucauucugcaaauaaaaccugucaaacaaaauuaaaugcaaaugaaucuagguucauaccgaaauucaucauuggcucuuucuucuugaaguccaauccaccaacuugcaccauacuuugauagcuauugaaagaaaaaaagucagcauuuauucuacuuguuuuccuuuuucacuauuaagaguaaugggguugcugcuaauagcuuucuauucuucaguauuuuacccaauuaucuaaggaagaauacacuaaggccuagcaucuugagaaaaccugaaacuucauuauccuaaaauauuccccccauuacgaagaaaaacuggaaucaaacauggaaaauaauuuuaguuucauacaacuugaaaaguaauguuucuaacucucuaagaagguuuuaaaaaguaauauuagaaaaugaauucauuuucugacaaaaaauuauuggcucauccucucaguuauuuacccucucagugauuuauaauucauugcauaugucacauguauuugaaaaacaauucaagguaucaaggcaucauuaguauaaagauacugauuuuagguauuagucugauugcuaagcuuuaagcaguauaagcuuuccuucccauucaaauagagagacacaauauaggacaaaagaauacuacagagugcccaguguuugacaacuagaaaauuauccuuuugaugaguucauguccuuugcagggacauggaugaagcuggaaaccaucaaucucagcaaacuaacacaugaacagaaaaccaaacaccgcauguucucacucauaagugggagcugaacaaugagaacacauggacacagggaggggaacaucacacacuggggccugucgggggguggggggcugggggagggauagcauuaggggaaauaccuaacguagaugacagguugauggguacagcaaacuaccauggcauauguauaccuauguaacaaaccugcauguucugcacauguaucccagaacuuaaaguauaauaauaaaaaaaggaaccagauuuauaugugucaacauggacacauuucaaaauauguacuuuuuaauauaaaauuaaacuguauaacaaaaaauuggaauuuuaguagauuauaaauucuauguuaacagagugauauaguuaucaccaauaaaaaaaccacuuaaucuaagauuguauuaguaauguuguaguguucagaauaaagguaguaaaaauuaguaaggaaauagaagacuugaacaacaacaacaaaaagaaaauuauccuuuuacauuuuacuaauuuuauaccacuauuaaucacuuggaccuaaguacaauaaaguauaaaauuaaagcacuaugugcaugcaugugcacacgugugugcgcgcacacacacacacauacacacacacacacauuagggcagauguacugacuuaugacccaggaaauugaaauucccucuuuaacuauaaaagaggaagaggaaguaaggguuuuucuaagaccuguaaaucaguauacuuaauggggguguguguguguguguugugugcugaacuguaaguuaauuuuuauaugcuaaaauccuguuaauuugaaggcauuauauauuuaaauuuguacucucguuucuucuguaaagacuucagaagaaauuuuaagauacauuauuuuuccauaggaauuucagcucuccauacaacagaacccaauagcccucuaacaaucuaauuuauaaacagguauuuuuauucuguaaacagcauggcuauuugucauaucagcaauuugagaauaaugcaagauggaacaacuguaauuuuguaucccugagguguuguuucguggacauguucuuacaggcugaauucagauucccauugucagacguuggaauggguccacugagacuggcuguuaacucagugggggaaccacaacaauuucauucaaucuaaagagguuucaugugccacgggacuggaaaucauggccuggauuguucacugccccaauuaaggaccucuaaagagaaauuauaacugcugcauccuaaguggcauauuuauuaccaccucaauuauggcgugguaaccuccacauggcacaucacaaccuguugugauauggcacagaacugaacuucauaggagaugcuagaagauacccagaauggaacauccaaugugaaaauggauguuugaaauuuuagcuuaagaaggccacaacaauagaagacuuauuaacauguguuugcauaaagaaaugugauagagaaguaagcucagggcuuaaaaaaugucauaugaacaugcauuuuauaacaucaacuauguuuugguauuuacaaacagccauuauaguuagcaucauauggaaacagcauuuaccaaaaacaaacaaaaccccacagugacagucacuacauuaauccauaaagcaauauaaggaagaacaaccugucaucuuuuaaaauguucccaucaaggaugacaaaugauauuuuggaggaggacuaauagauuugauauguauuuugagaagcauuuagaaauaaaaauuuaauaauaaugguaaauugccauuucaaaaugacaauacugcauaacaguguaaaaaugucagauaagcagacuaauuagcuaguaguuugugucaaacaacuccuaaagugcuugcagcguuuuuucagcauuaaugugauuaucaagauggcucaaaaaauaaauucacucuaaucaugcuuuauggucuucuguuacucaaagagugggagagaaaauauugacauucuuuuuccaagauggaaacauuuuauuaaaauuuuuauuugcuucagauuuuuaaacuguaucuagcuugcuuguucauaauuaauuuuuuugacacugcaacuaacuguuauuuuuguuuuucacaauucuaaucacugcucuucuuagggaagcuacacaaagcacauacguaauuuuaaaaauauuuaauuacuuauuuguacucuuccuacauuuauaagauaaaugugagacagaagugaguggaaucaccucuacacaucuugcuccucauccuggaaugaaguaacuucuggauugacccauuccagcaggacguucuuaggugugggguuucuuucuuacaaaaugugaacaccacuaucaccaccaccaacaauaagugcccaagguaggcacaaauuaugcagaaauaagaauuuuuuggaaagcaacagcuuucuucuuucuaauuugauauccuuuccccuuggaccccacuacagacuaaauguuugugucccccuaaaauuuacauuguugaaauccuaacucucaaggugauauauuacaaggcagauggcagaugauaaggucaugaggguggggggugggggugucucaugaaugggauuagugcccuuaaaaggggaccuuggagagcuccuuugccucuuccacuauguaaggauacauaugaaccaggaagugggcauucaccagacaucaaaucugccaaugccuagaucuugaguuuccagccuccaggacugugagcaauaauuuucuguuguuuguaagcugcguagucuauaguguuuuuuuauagcagccugaaaagacuaggacaguccccuggcccuguucucaguauucaaauccuauaccuucccauaacuuucuuuugcagcacaguggggagauuaguuagcaccuuacccaugaaacugauggggcauucuacaucaacguggucauaggccaggugacaauuuugccauauaaggcaccauaaaguuugucugauuugaggucagaauccucaacuagaucauggcaguggcuaugaugacucaaacugcucagccugugggguuucgcccuucccuuccaugggaggcauuaucuacgccauccccauuggcuucccaacuuccaaagauuaggagaugaauuaagaggaaaggugaagacagaagaucuacagaaguucccagcagagcuaagcucuguuggaaagaucaaagaagcccuucauuguucaugucugagacgaagcuggcagccauguuuuggggaggauuuuggaacuagcuuuugauguaaugaagacguugugcucuuacaugcccugacacugcuguuccacugucacaggcagcaccguguaggguuuuuaaaugacuggauaaauaagauggccuggguuucuuuccaaauuccaccacuuagcugcuguguaaccaaguugcuuaaccucuuugaagucuuagccuacucaccuguaaaaauguacuaauaauagacuucccacaggggguucuugggaagauuacauuuuaguacuuaucauaguaccugaaacaguuaugguaaguauagccaaauaucagcucuuuuuggguuguauacuuugcaugcguauggauuaguuuucagccauucaucuggucucuuguuauugcccucugaggugaggaguauggugucuggcuaaagaaauguguauuuuccgacaucaugguauagaauugaacaugcucauauugaacauuaugguuuuggcuugaguguuccauucguaagaguggaagggugacaaaauaguguacaaauuuaugauggggaaaauuccacaucuagugguuguucugcaacugagugucuaugggaccaugugauugucaucuaacuucucuuuuucucggcuucuucaucagaauguagcaggaguccugaccugcuuguaccucaugggcuguaugugcaacagacaagauauagagacaguaaauccccaugaacugugaggaaagacauuucuuucucaagccuaggaugcuuuaauacagggcuucauuuuauagucaacuuacagagauauaaaaagaugauagaguuagaaaggauuccugaagaucaugaaauaugauuaaauuacaggaaaagaaaauggcuuuuucuugcuuucaaagcuuccaagggaaaggggagugaggauuucccgccuucaugcccccauuguaauuugcacuuucugugcccuuucuauuuacuacaucauaucacuuccagcuuuaguuuuuaaauuuauguuuuaaaaauugaaaaauaaaauuguauguauuuauuguauacaacaugauguuuuaaaguauauauaucuagccuuuuuaaaaacagagacuguaucucauacauuuuugcaucuuugacaaauaucccagugccuggcacauacuugauaaugaaugcuuauugaaggaacacacugaaaaaguacacuauucuuugccaguuuauuauuuaauaggucuuacauguuucuuucuuacuagcuuaguucugcaaggaauuaaguagccuuucucuacuuuaaguugaaauagaaaacuacuccuuacuauuuucuguauauuagucuuuacaaacuuaaaaauaauguacucuuguaagauuugaaaguuuaaaacugccaggcacccccccagguauuccucaucccucauuugagcuuaauuuuccucuguggcauuuauccacuuauuuuuucuaauauauuauauaauucuauuuacucgaauugauuauggucuuucuucccagacgagaauauaaacuccaugaagauaggaauuugggucuuuuuuaaucacugguaaaaccccaguucuaccagugauuaaaugaucgaaugaaccucaugaaacaaucucgacgugcucaccauuguugcuaacaaagaaugaagagaagggaaaugacugagcaauacaguaaaccuguaccuccauuauuuucucuuaaucucuauaauaggaaaaaaauucucaaaaaucuauggcuuuacugaaaucuauggcuuuuacugaaguuuaaauaaauauccgaagucaaaucgaaaaaacuaucccucccucccucccaagggcaaaagaaggugcuaaacucugaauuuuucguggugaguuauguucaaguaccgcuuuuauuuugcuguggaugaauucuugcucaugugcagaaugaauugugagaagaucacugugcagccagcuacagacaaacucaaaguucaaccauucugaggcaaagguaugaaaaagguauucugcauccugauaaaagagccaggguacaucugaaaaagaaacagugaaaauaaugcugaaaugauaaauagguaugcuaggauugaccccaaauuugagauuuggucacucaacauuaaaaauaauuguauacacacacacaggaauuugaacacacacacacagacacauaugcacauaaauagauauauaacuugcuuuuuuucuuuggucuaucucuuacaagauaccuucacuaguauuaaaaggucggggauagguacauauucuaaaaucgcaugucaugaaaaugauugaugauacuaguccuuaaucauauuaaaugacuacauuuauuaauuauuaauuugaacaaauuagcucuagguugacacaagaaaagagaggcucgauuugagaaauguaacaacacauuaaugguauauaauagcacuuauaugguauauauuaauaauuagaaauucaagagcugccagagucauucuuaccguacugguaccagaacggaaucuuggguuucacaucugcaaagugaaagcaaaucacuuugacugaucuugcuucucaagugcauugucugugaauuacuucagcucuaaacacacuauuuuguccuucaucuuuuaaaacaucacuuuaaaacagguacauugugcuguuuggaauauauggugaguucucacacuugaagaggaagcuccagagaggcuucuaauuaaagaaggaaggacaugagcacuugcugaggccacugugugccacacacugucccagguguuuccacuuacucauugugcaaguaauuccauuugcucuguaaugucaaagugacauuuuuccccgacuauacuugcacuauaaauauucugcaauauuagcugguuaccuuaguucccaaugaacuaacuuggcauccugcauuggugucgccuuuucccauuuccuauagaaacauuuuuugcuaaaguaguguaauuuauuuuaucaugcaauuuguugauauugugguuugggguguuuaaauugggaaaguacuagagauuauuagaaaucaaacauauagcaaagaucuuacuacuauuuuuaccucuugggauuuugcauauccauucacguuuggaaccacaguguaagggcagcaauguuuuguuugccuuauaaacagcacaguuucuugcaucuucuccaaaauaaguguugucuaaaaacgaagagacaaccugcagcagaugaaguucauuauuccuuaaugaugauccccccacaaaguuucaaaagaucaaaaagggcaucccuguacauaagcauuauaggcuacuccaggaagcuucagaaaugucuggaugucauucuaguugaagguuguuucacauuugugaagaacaagcuaaucaauauuuagcauuuuuuucuuaaagaugccuuuuuaaaaaacaaaaacaaaaacaagaaaacaaaaggccaggcacgguggcucaugccuguaaucccagcacuuugggaggccaaggugggcagaucacaagcucaggagauugagaccauccuggcuaacacggugaaaccccaucucuacuaaaaauacaaaaacaaaaaauuagcugguugugguggugggcaccuguagucccagcuacucgggagaauggcguggacccaggaagcagagcuugcagugagccgaaaucccaccacugcacuccagccugggugacagagcaagacucugucucaaaaaaaauaaauaaauaaaauaaaaauuaaaaaaagguaugcuauuccuuucuccagaaggaacaaaucaaaugcaagcuuuggucugaauuugcacauuuuucuaacugggaaaauuuucuagccuuggaauccuggguaaacuuagggacucaagggugugccagaucuugguauuaacuuugauuuugauuacuuugaacauaugcuaaguuuuuugucucuaauaacuaaauucuaagcuauagcuagcuuuaaucaggaaucuaucaggucacuuuccaugagugaccacauaacucauauaauucacauuacggggguauuaaagaaucaaccuucucaauuauuuaaugacuaucucacagaagaauggauguaccacaaguaaaauugggguaaaaauuuggggaaaaaaaggauguuuuaaaauccuuuauauuccuccucaaacauguacacugucacguaauaauucaucuaucuaaaauauauauagccucagguucagaaaauggugugauuugaauucauuuuguccagcagauauuagugagaagcucggccacugcuucauggccuuaucuaauuuauucugacccagauugucuguuccucuccuauuacuaaugaguuuguuauacuaaaacaaaagaaaguguucucaacuucuaugugucacauuucuuuuucgagugcuacauugacuugaaccacccagcugucucauguaguggcugccauuuauggaguaaguugacccugcuaugccuuuucuguuuucugagccuugguuucuuuaucagaaaaauggauuaguggggcugaaugaccuuuaaaaucucuuccuacucucuucuauaaaccucuuccuugacauaaauuugaaaaccaucuugguacggggcuuucucuauuguucuuuacuacuucaaaguuuggcuacugauauuuugccaaucaugagauauuauaacauugugacuuuggagucagacaaccugugugcaaauccuggcucuccuauauauuuuaggcaagccacuuaaucauucuaauacccauggcacugaguuauuguaaggaugaaaugagaucauguaggagugcauucagcucagcgcuuggaacaguauaaggacucaauaaacagcaguugcauuaaauucucacugcaggcucuuaggagucuccccauuucacaggugaaagugaauaaugugauuuuucaugugccguaggauggaucccacuucaaucuaggauacuacuucaguuuuuucccugucauuuugagaaaaaugugagaauuacccauugcaacuggaaaaaaauacaauagugaguucucuguguccuucauagagguuugcaaguaugggaaugaaugaaaaccaagacuuuuuuuuuccuucuggaauaacuugcucuagaaggugauauuucuaaaacuugcauuacuguccuuucagagugagauaaaugaaaaaucauucuccaaaauaaucuucauuucauuaugacauggacaagguucccauacucagauaaucaggugauaugcaggauagggagguauaggguaaagggagucuuguguuauuuuaaagaauagcugcuucucugccagagagacuucauaugggagaugguuuggggggacuuuuuggagguuuuugauacuuuuucaggcugaaauuguacaauggccucagaacaauauggcuagcaaagauuucucaggaccuugccaaauaauucuccugguacuaaggucuggugcaguuuugucaugggagcucuggccaucauuucuagguucucuugguugguuuaccaaguggucccaggcccacuuguuuugaauccaucccuuuucuccaguuugaaaagacuuacaggaguucuaucagaccacucccaugagccggcauucaguggguuucuuuuauuaaauccaauccagaacugccuuucuucuguccuguaaagagaagaaacaaaagcuuugccuuucccaucaaauuuacagcauuaugugaaagguucaaaaaauaccagcauggcacauguauacacauguaacuaaccugcauauugugcacauguacccuaaaacuuaaaguauaauaauaauaaaagaaaaaauauuuuaaaauauuuauguaugcaggaaacagcugaugcuacuggcaggauugaucaagucaacaagcauugaacauuuuaaaugugcaaaacccugugcugugacaugaacugagagaagaauaagccucacauucuauuacucuugguuugugugguuugcucacaggugauauacagguggguaaaagucagcuuuuauugagaacaugaguuucucaucaggaauagcaaagccuuucagucaggacaagaacacaugaaaagaaaauugguaagaaacuuuggaacaucucuagccaagaggaccuuucacuacuuuacuguguguuugcuacuucacuauacuauuuauucuacuuuacuaugcuuugauuuguuguucuuuuguuaaacauucauguauucucugaaagucaaccaccaucaucuucacugaauaaaagguacacaguagguuuuggguuuuuuucagauaucaacacaaauaauucuaaagccagucacccugagccaugguucauuaacuucaguugucaccauugguuuauacuuggugagaagcuccacagagaaucaccuucccuucuaugaggcagaguacaaauguguccacagaauacucaauaaaucgaguaauaaagccuaccugugcaaugaaccaucucacuaagauaauuuucugagaauaauuuugaagaaucaaagauuuaaaauauucagaugucaggacagauacuuuauuuuccuuugugcagagaagcaaggaauuccuucucggauaugucagcuacucugccuggaugacacaaauuaaauucaaauucagcuuagaaauccaagagaucacugaugcccgguuggacauugucaugaugauacuaacuuucauuuaaggcugggagaaggugagaauggccaccuucaguuuaagccaagcacauuaaucucgauggcauaggcugaaaauccaugucacucuccugguguugugaccuuuuucuuuccucacugaauucagaguucuaugucuuuccugcuauauacuggcuccuggaagaugaaaugguauuuacuuucucuucaucaguuuccugaaauuguacaauauuuaauaaacacacauguaugugcauacgugugugugugugugugugugugugugucugauuaauaaaauagaaauagaaaagcagugccauaggaaggaaaagcagcauaccuguuauaccugcuaacuaugagaucugguauguuugcuauaauuaagcaucagauuugacugaauucucugguagucugggaauaaacugaaacauacacaguuauugauaauuuuuuuuuugagacagggucacacugucgcccagguuggaguauaguagcacacaaucuuggcucacugcaaccuccucuucccaggcucaauugauacucccaccucagucuccugaguagcugggacuacagaugugugccacuacaccuggcuaauuuuuuuguacuuuuugguagagaugggguuucaccauguugcccaggcuguucucuaacuccugggcucaagcaaucugccuuggccucucaaagugcugggauuacaggugugggucacugcacccagucaagaauuuuuaaauauuuuauuuaaagacgguucucgcucuguugcccaggcuggagugcaguggcacaaucauaccucacuguaacuuugaacuagguuuugcugggacuacagguguggccaccacacccagcuaauuuugaaaaauuuuuuuguagaaacugagucucacuaugcugccuaggcugaucuugaauuccuggccuuaaguguuccucccaccuuggugucccaaagugcugugacccacugugccuggcucauauuauaugacuuuugugaucagauauugaagauccaugauuuagcuugggacuaaauucugcuagacauuucaagcaugagaacuuacauaaacagaaaugacagugacauuugaucuuaaagcaaacugggaagcagugugugugugguugucauauggcaaaccucacuaaaaugcaaggacagaauaugcaaauauguuuuaaaggaagcuaaaguaaugaagcaaaauguaacuuugaacaauggagacuaucaccuaucccuuggauuugcggccucacaccuggcugauaauccaauuagccagaaagcuucuuaaacuuuucuucagacucagagagucugacucagcagcucuggugugaggccagaaagcucuguauuaaaaggugucccgaccaagugugaugagcagccagguuccugagucauggccucaugucagcauuucccguagggacuagcaguucugugggaugucaauaaguguucuuaaaaaagggaauuguggucaaagaaagugcuuccuucuagaacccuuuacgaugcuaauguacauggcaaaucuccaagauuguacauuguuuugcaaacauauuugaccauaaaaucuccuuccuccccugcagaaugcugcacaagacucacauggagagaugucaaaaacucccagcuuuaaggucauugcuguagauguggaagaugaauaaucugauagauguugcauguuaaucuuuuuaugggaauguccuacaaggaaacuugugggaaaggccagaauuuuccugaaaaaauaguacaggauuuuucucugggauucaggccaguguuucauugagacucuagauuuccagagccugaagcagaguaccuauuauuaugguuguuuucauuaaauaaauauacagagucauggaggugugaugaucacaacauccucagaggcaggaucuuguuugucaugucuauugaauuauccaaccagcuaugcauguaacugugccccuuccacagaagauacucucacaaugcaggcugacugacaagaacauuccaaagugagaggccaaacucggggguggggggcucacaggaaggagacaagaugacugucuucaaauauuugaaaauagaguagauuugaucuguauuugcucuagcucaaacugaggggaggcagauuucuggcuuauuagaaaacuacucuuugaaaccaggcuucugcaauggaaugggcuuucucccaaauaagaagcauucugaaacuggaaggaauuaugcagacagcagaugaccacgguauguggugggagguagcacaagacgguuuagaguucuuacaauuuaagcuugaguuucuaacuccacugaauucaagguucuguaaacuugcaagauggauacagauaagggaaagcuuguuuccucaaaugaaaacuuaggagguuggguuggaauuaaaaaaaaaauuacugggacucuuuuuuuuuuuuuuuccaaacaaaaucuuacauaggcuccaauuauauacaaaauaauuagcgguggagcuggucagagccgcucuggugaggcguggaaggaacuaggagcucugccuacguggcccucucauacuccugggguuccaggauucuugggauccuuccacaacacuuugaaaaccauugggguagauaauuccugaguuuggcaggaaagcucuacaguucugacuugaggcacaaagaaaagauuucaaauaucuaaacaauugucacuuuguucuuuguuuuaugaaaugagaaccugguacaagauaaacauaaaacuauauguauauuuauuuuucuuggcuuugggcauaauacaaauaugggaauuuuaaacaacuacuugggauacucaccccucagaagccauuacugggagauagaauauuugacuguaauuuuucauaauuaacaaguauuuaccaauuaaauuuugaauguaagagcucauucacaaaauucucuuccucaauaugggcaaagcuugcaagaugagcuccaaauucuucgcaaaaugcuucagcuucucuccauguucuuuucaucagaacuuuuucacuaugaaauaccuguauaguaaaagaaaauaaauuaacauuguuauagauaaagucagguuguuaaacucuguucaagaaaguaacaguaauauuaacauaaucaucauuauuauuuauaaagagcuugaucuagugggaggaaguaauauuuacugaauuagaaugugccuagucaucauaaaacuauuaguuccuuuuauccucauaacaaauuucugaggagaauauaauaaacucaguuuuauaaaugagcuuuuugaggaauuuuuuuucacccuaaaucuucugugacuggcauguacuugucccucaguaaauauuugucaagagauaaauaaagucaggccaagagagguuaagaauuuuaggucacacagcuauaaacuggcagagcuagaauuagaccuacaauaccuugcuuccagaguccauaaacuuccaucccaccagauugccuucugacagauuagaauuagcagauugaucauuacucuggcugacccagggcaagaaaugagaaauuagaccugggaccuaggguagcucuauuucuagagucuuuggaucuuaguugaacuggcagugcagugguucagcugugccuaaaaucucugcugcuucucagcugucuucaugguggcaggaagaagccagaugaauggaaggucuucuguuggcuuuauuuaagauuggggaaagggacugaagacccagagcuugcaaucccaguccucuuacccuucuuauuuuuaacugccuggcacuaagccugagccucugaugccagacagguacacccuguggccagcccucaccaggcucuuacuugcugagaccagaaugaauagcuuuccaaguccuguggaccacagcacaaccuuuccaucuuuuaaauuauaugucaaaacuugccuccucugggaaccucuucccgaaucacuauaagcucauaaauccuaccaccaugccuaucacacacaccaugcauuuguugacauaucagggugauauauaguagaaaaggcaccagaccagaaguccuaaaccaggcauuuauuccaacucugucaauaaauaaucgugaucuugggcaaaucacuacauuucacaggccccaguuuacucaucucuaagguuuaacuuauuaaugggcgaggccacuuuugggccuauuauucuaugaauguaauguaggauuauacauguguacaauuuaaaucgagcacauucacagcugcuucaugccaucuacgagcuacaacaguuccagagauagagucugucuucauucugcucugccugugcagagaugcuggggaacuuuuccccaagauuuagugaaccccuauuuguaaaauaaaccaagacaaaaccaccaaacauuuuuaaaaaucauauuucaaaaaauguguuucugacaagauuguaggaacuaauuuaaauguaggaucuaaagcugauuuuaaaaauagaaaugucuucacuuauauauacacacacauacauacacacacacauauauacacauacaaaucaaccguaugcaucaauuuguuugaucuucacaugucuggcaagcugcaaaagcuauccuuauuaguaauauuguaucauucaauaauaaaaacuuuauuuguugguuuacaaacaauaugaaauuauaccauuuaacacccucugagugucuaccuccuucacuuaguguaugaacaauauugacuggggccucaauauugcaggaggacagguccccagaugacccuugcugacccagcucuuccucuuuuucuuggcaauucucaggcagaguguaccaagagugcaacguccugagauaaggaggaacuguccuuaucccuccuagaauaggaugucuuguaauacuuuugcucagugauucagguggcaccugggauauaaaaccccgagagaagcgcuuuggggagcccucagcugucaugcaaaguggggcaugugcagacaagauuccaucuuccugggggugcuuuccugagccuugggggaauggcucaccauggauccuagacuucgguugcuucuugcugccuaucugugaauacaaguugagcaucccaaauccaaaaauccaagcuccaaaaugcuccaaaaugcaaaacuuuuugagcggugacaagaugcucaaaggaaaugcucauuagagcauuuuggaguuugaauuuucagauuugggaugcucaacugguaagugcgaugcaaauauuaaaaaaaacaaaucugaaaucuaaagcacuucugguuccaagcauuucagaaaaggaguacucaaccuguaauaaaguuacuuugcccaucuuguugugugggaauucugucucaccagauucauacucuggcagccaaguuugugcaaaaccuccugucagagcuaggaacuuacgcagaaacugguuagguguuuagaguccucccccaggagugauaaccagagcauggugcccuccuuccagguauuaauauuagcgcaugcuauuucuuuucuuuccuuuuuuuuuuuuuuugauauagagacucgcugugucacccaggauggagugcuauggcgcagucucggcucacugcaaccucugccucccggguucgagccauucuccugucucagccuccuaaguagcugggacuacaggugcaugccaccaugccuggcuacuuuuuguauuuuuaguagagaugggauuucaccauguuggccaggcuggucuggaacuccugacuucaagugagccgccugccucggccucccaaagugcugggauuacaggcgugagucacugugccuggcccugugccugguauuucugcuuaacagauaucaaucuucaugaggaagccuucaauaucaccaggaugugucaauuuuuuuuacuuaaaaauuauuuggaauaugauugaaaggauagagacaggcaacaaauguugauuaagcaccugcugucugucaggcacuguucuggaaaaaaaaagggccccggaauaaaggaauuugggauacauggaucaaauuaaaauaguguugguccuguuaagaauguccauguaaccuugguaucaccuugaagcaacuggccagaccaggcucugacucccaguccaaauagcaggggugaaagggccaucucucuucauacucugcuuuuuccugauuuucaacuggcugcuugcacaaggacauugccuuaaagugccgacagugcuucacuucccagcgaccaaguggaugccuuccucgcauggcaacacagccaccacuguagccuaaaagcagaaaacaagcauuuuuaauaccagacgacuaaaacguuuugugcucagaagacugcucuuuagaguguugaauaauugacaucucauaauuaagcacccagacaagagcaaucaagaugaaaacgaaugucuuauugaccugauuaugucauuucucuucaucucuggagaaaagaaugcaagaugggaaagagagaaaagagagugugaaggcugaaauuuggaccuugucugcuuugugcucagauggcaaaugaugaggaacuaggagcuauuccuaucuggaaccaaaauaucccccauauuucaauauuguacuucaaaauuccauugugaaaaaucaacaaugaaaggugcauagugcucauccucuaacaacuggauucaacaggggaaaauaggugaauaacagauucaagguagaccacaaaguauacaacagaaaaccaaacuguaaaccuuggaagaaugaagagaaugagaugaauucucuaaaugagguaaagauccgggggcagggacaaggcagacaucagggaaaaggaagacagaauuagagagagagaggggcuuuuauaugaaaagcaaaguacugagauuuucccucccaccuucauaguauaugugagauauuggaaaaugugauauacuaguuauggacaaaacuccacuuuuuucuuuguguaugcuugaacauuuuagaagguaaaauguauuuuuccacagaaacaauuuauaaauuaagauucuuaagauugucagcaaaaucuauacaacucauaugacagcaaaaaaaaaaaaaaauacacuucaaauuucagugaagaacaguagaaagcaauucuauuccaaaaauagaauuaaaaugaguaagaaugagcuuguuuuuucuugaauccugggugaucauuuaguuaacuaaauucacauucaucaacaacaauaaaaaauuguacauccgcaaugugcucagcuaggcuguauauuaacugcuugaaaaaaaggaugaagcaaagcaaaccaaaaaccaauucuuaguuuaguguaagacacagacacauaaauaagcaauucuaauaaauauaauguguaaagugcuacaguaaaagguguguucaaaguucuggaggagacaucagaaggggugauggagccuguccagagaugucaguaaaacauuugcaggaagugacauuugagcugaauuuugaaggaugaaaaggagaaaugaguuuucaaggcaugcuuguaaaaagagagugauuauagaugacugacgacuugcgaugauucuguaccugaaggcucuuuaaaaaaugucgucacuugcuacuugauauuuaucuugcuuaauuucccuucagaaguaauggcuucaauuuuuucagauacugaguaccuggcauugugcuugucaucuauguucugauuguuuuaugcucauggaaagacacaagagagggaaaaugaagagugcaaaggagaagaaagaagacaaaggaagacauagagcaucucuuuaggaauggaauaauuugcuaaagaaugaguguaugaguguuugugucuucaacagcgcuggcugcacaaguguguuaggcaccagcaucgccauggcaagaugguucugaucuggaagaacccccugggccucugugaugaaucagagacccucaaagguaaaaauguccagugguaaaagaggaaacacgcuaucccucacauagaagaaaagaaagucaaggaagaguuggugcauccaaaggccaucggauggcucuacuggcccagaacagcuagcugguguuaaagaugcaagguugugggcaggcaagggggagagauuauaguaugcaacugccccugccauuaauggagcuuugcaggccuguugaauaauuucagaaugcagcucacaguccagcuggaucaugaacaguacaagagaugcugcaugcucugugcaauaaaacugaacuggagaaauccauguggaagccccaaaugcaauauacuuguggagcugcucuaguugaaagagaagggaacgcacacauccugcuccauucccccguccuuugaggggccccaguggaaacuccaguuacugcacagcacaggcaggaaaccucauggaaagaacuucggacuuggagcgugaaguuugggguucuagucucagcacaaaucuuuaguaacuggaaacuugaggaugugaauuaaccacaauaggccuugucuaaaauaugugaauaauaauuccuuuucuucucauggguuuucaugaagaucaaaugaaauaaugaacugaaaagcacucuauaaaauaugaagagcuaaaaauaccccugcaauguugcuauuaugcuuauggccauuuucauuacaaaaacuaggguuuuguggcauaaguucugccugcauauucaaagaauuuuucaaaaguuugaaucagcaaguuugaaauguaauauacuuuuuuguuggucuugcauuuugucucacuuucccacaccagacaaugauuaaauagcuuugguuuuagaugcuauaagauauucgacucaucuucauuagugaagaaggagauguuugugaaccacuaugaagaugaaaagugcugcagaaguguuauugguauucuaaagugguuaacuuaauggaacauuugacccaaauuuuaagagucucagccccaaagaagcaguaaagugguauaauaaagggagaccaggcuaagggagagauaaacuaaauuuauaagccuauaucguggggaugcuugcaaagccaaauaauaaggguaagggugugggaaagagcagaggcgaauuuucuuucagagaaguuguucuuaaauuugauaacucacuucccacuggagaagaaaaaugauuauucucagaggugaaucucacauuuuaacagauucuccuuaccugccuuacccccaccccacucacucucuccugcaaacacgaauggggagacuuucugucaauuaagaaauucugauucaccaaguuaucuaugcaaaauuaagugagcugggaaaaccuccacuguccaccucccuguucaaauaccuaaaaacaaacccauugaccaaaacuuuuugugcuggcuuuucagugccucuagacaauuauuucacuugagucugccugcuuauuuucugguucccugcaacaacccuuuacauccucaucucucaaguccucuacccucucaccuucccucucucucuccuucuucucuccucuaacagagaaaagugaagcucuuuggguaggcaaggcaaguuuccugcaaugcuguguaucugccaggcacugugcuaggcaauuuauauggucuuuucccuauuuaacuccagaaacucuucgagacaggcauuagugccugauuaugcaguuggaaaaauuagggcacagaggcuuaguaacuugccaaaggccacaaacguagugggcuugcuccaggauuugaaaccagauuuauuugggucuacugugagacaggcacugugcuaggcaauuuauauggucuuuucccuauuuaacuucagaaacucuuugagacaggcauuagugccugauugugcagauggaaaaauuagggcacagaggcuuaguaacuugccaaaggccacaaacguaguaggcuugcuccaggauuugaaaccagauguauuugggucugugagacaguaucaagguacagagugagugggugggcauucaauaagcaguugaauaaaugaaugaaugaguuccccuaaaauuaugcuccugucccauggagcucucuugcaucccucugauccuguuucucuccuguguguggccacagcauuuccuugaagaucuacugucacauuuucacuuugcaugacaguuacuuauaugauuaugaggagauauggaaauguucuaagggcucucagaaaugagacuggguuuauccuuauuuauaugguggcucauuucagagcucugaugagccuuaaaauggauuggccucucuagugucuacugaugggacaggcugaaagugcagggcacuuucuuucuuuuuuuuuuuuuuuuaaguuuuucuuucuuuuauuauuauacuuuaaguuuuaggguaccugugcacauuguacagguuaguuacauauguauacaugugccaugcuggugcgcugcacccacuaacuugucauccagcauuagauauaucucccaaugcuaucccuccccccuccccccaccccacaacaguccccagagugugauguuccccuuccuguguccaugugaucucacuguucaauucccaccuaugagugagaauauucgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucaucguuggacauuuggguugguuccaagucuuugcuauugugaauaaugccacaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagauggguaucucauugugguuuugauuugcauuucucugauggccagugaugaugagcauuuuuucauguguuuuuuggcugcauaaaugucuucuuuugagaagugucuguucauguccuucacccacuaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugccuuucuucacagaauuggaaaaaacuacuuugaaguucauauggaaccaaaaaagagcccgcaucgccaagucaauccuaagccaaaagaacaaagcuggaggcaucacacuaccugacuucaaacuauacuacagggcacuuucaagaaaauaaaccugacuuacucuacugggaucuuauuuucuuugucacuugcagauuuccauggguuuggaacaauuggguugaacaugccccggagucaucccauaugaaugaaacacgccagggguaucuaggucuagaaacaaaacauuuuucacagagccugaguuauggagggcugcaaaggagugauugaaaguguuuauuuuucucaauacagacaccuaugagccucuaauauaacuuggaaaaguguuuucgaaugucuuaacaaguauagacucaucuauucucuuucaccauagagcaaccuccacuuauauugaaucuuuaaucuagggguacaaaguacauuuuaguuucuaagcauuagcuucuccuugaaugagaagcuaauuuaucaucuuuccauuuaaucaguggcaauaauuaguauggaugaaaaccauuuuuccuguuucaccugaauauuucauuucucuugaaauaccaagugucagagagucccuuuguuguugcuuuuuacuaaaaauaacaggauuuucugguguuuugagaaugggaaauuuggcaugaaagaaaggaaauccaguuaaaauauagguuaauuaaccuuguaguccugaauucaaauuguaaauaugaauuugaacucaaaaaguguuuaauuuacacacacacacacacacacacacuuccuagaucuguccauugaaauggccuagaaacaauaacaaaccacaaacgacgagcacccuuaagcccagacugugaugcugaaauaauaucauuucccaucagaagaaaccaggguuccuugaugcaauggaugcuucuaggucugcagcagaaauuuauaucuugucauaccagauagcaaggacacuaucaaagacuacuaggaucacaucagaaggauucagaagauauuccuugaagagauucccaucacaaggauggggcaauuugagcauuaaaaaggauaauugcaauggacuaaaacauaucaaauauguuuaaaacccuuacuccauaguaaugcuaaaaaaagaaaaacaccacuaaugggucacagaugaaggaugcuaaugcaaaaauaaucauuuugaaagcuaguaaagggaaagaacuaagcauuuguucuguguuuccuauaaaaauuguaccacgggguaacaaaaauugauuaaaaggaauuagcuuuuuauaggacuaucccagcuauaagugaagaaaccccuaaugagucaauggaucuaagaauugaccaucaaaggcugcuaaugucacaaaaagagaaaaaaaaaugggacauuaugugccucuagacagagcacacaacuaccuaggaagugaucuuucaaaaaaaaaaauaaaaucugaauuugaucaauccuuucauucuuuuuaaaaauaaaaaugcguauuuuaugaaaaagaaaauagaguaacacauuaaacaaugugaugugaauacaaucaacaaagcccagacuguaggaaaauuuauaagacaaaacacauuugcauuaacaaauaaaggcagggguggaaauuggggaggggcaggaaacacagagaugaaaacagacuuuaggagaucuaucaaccaauuacaaugugugaaccuucuuuggaucuugauucaaacuaacuguaaaauacauuauguaauauuuaugagccauuuagaaauuugagcauuaacugaagauuuauaaugauaggcaauuauaguuaauuacuuuaaggggugauaauuguauuauuaugucuuuuaaaaaggagucuuuauuuuuuggaaauaaugcugaaauguuuauggaugaaacaauaugauguugaggauuuguuaugaaaaaauaugggaaaggggugaggauacagaugaaagaagauuggucaugaaaugauaauugcugaugcuuggugauguaccacagugguucuacuacugguagauaccaucuggugguaauacuauuugauaaacuuaauacuaaguugaaaaaaaaauggcggaaaggugauucccuucugauuugcuuuuaugcuagugaaaugcgugacaggaaugauaggagggaugagagggacuuugggugguucugaguguucauguagguucgucaauuguagcaaauguacgacuguggugugggauguggggugggugaauauuuugcugguaugacaugaagacagaguccuggcugaguuuauaaaaagcuguaggcuuccuguucaguggucaauucauguaguuagucuuugcuggauuaagauucugauguggggaccaagcuaauggauucuuuugugacaggcaggaaagaaaugugauuuagguagugucucugcaagcugcaauuuaaaagaaaaagggaaacacaggagcuuuuauauugcuauuuucuucaaaaagauuuacauuuucaucuuauucagagacaauuuacucagcgucaaucagcuugagcagccaaacugaacaucauggcauuauuuuugcuuuagggaaaagagaaaaagagcagugucacucaaauaaauuacagcagaaacuuaugaaugacaaggaacucugcuucaauuccagauuuucgacaucuaaauaugccccaagaaacuuaauauuaaaaaccaaagauuuucucuacucaaaauguauuaauuuauuuugacaguuauagacauuccuaacaaaauuccaaaguauauagaaaugauaccuaaacuuuuauuuuuuugcaguauagugugacauggaaguuuauuacucucuuuauuuuaauaauauucauagauuuguagaacaaggucguucuguugagcaaauugugauguuacuuguuuggagcuauggaaagucaccaguuuccauacaaauuuccuaagcugauguuuauauacaaaaaaaucuaauuugucuucauuucacuuugcaugcaucuuucaaaaguauaauuuuaaaauuuaguaacagagaguuuuagguugacagcaaaauugagcgcaaaauacagagaguuccccucuaacaccacugcccuccaaucuccuucacuauagacauccuacaccacagugguacauuuauuaccacugaugaaccuacaaggacacaucacagucacccaaagucccucuuaucccuugcaucaucccugucacucauuucacuuguauaaaagcaaaucuaucaucuaucugucaucuaucuaucuaucucaccuaugucugaauauauugcugcuauuauuuuaaacauacuguuauuuguuggaucaauuaagacuaagaaaaauagaaguuuuuauuuuaccuucauuuauucucugaugcuccuucuuucuuuauauagaucugagcuucuauaucauuuuccuucucucugaagaacuucuuugaauauuucgugcaagguaggucuacuagcaacaaauuuccugaauuuuuguuugauaaaaaucagauaaaaucugauaaaaauucuccuucauuuuuaaaggauacuuucacagaguauagaauccuagguuggagggcuuuuuucucuuaacacuuuaaauauuucaugcuacuuucuucuugcuuggaugacuucugaagagcagucagauauaauucuaaucuuugcuccucuaaagauaagguguuuuuccccucuggcuucuuucaagauuuugucuuuaucuuuuauuuucugaaguucggauacaauaugucuacguguaguuuuucgugcguucaucuugguugguguucucagaguuuccuggaucugugguuuggugucugauauuaacuugggggaaauucucaguuauuauugcuucaaauauugcuucuuuucuuuuauuucuuucuuuuccuucugauauucccauuacacaguuugaaguugucccacaguucuugaauauucuguucuguuucagucuuuuuccucuuuguuuuucaguuuuggaaguuuguaucaucauauacucaagcucagagauucuuuucucaucugugcccagucuacuauaaggucagcaaaagcauucuucauuucuguuaugguguuuuugaucuguagcauuucuuuuuguuuuuuuucuuagacucuccaccucuuugcuuacaggauccagcuguucuugcauguugucuacuuuuuccauuaaagcccuuagcauauuaaucauaguuuaaaagaauugcuugucugguaauuucaacauuccugucauagcugacuggcucugaugcuuguucugucucuucaaacuguguuucuugccuuuuagcaugucuuguaauauuuuuguugaaaaguggauguaauauauuggguaaaagaaacugcaguaaacaggccuuugugauggaaugguaaggugugagaggaggggaagcguucuacaauuuuaccauuaggucucagccuuuuggugagccuguguuccuggacugcacccuugaccagugaaugcuucucaguuauuuuucccugcuuggugggacaggauggcuagagagcuggagcgggguauuuccuuuccaucacgugaaaggauagagcuggcuggaguugcagauuucccuuccuccagauaaguuaggcucugauaaaacuccaguagcagucucugguaaaauagccuuuccugagguggggccuuguuaagaacagaaugcuuugcuauauuucaaaaugguuauuuuuccucucccucugcuggaagcauuaggcaauuuuucucugauauuucacugugauaaccugauagaucaccuggagcuagaacucacaaaagugugggggucccuuaugacugaguccccuacaguuuuuaacccuuagaguugucuguguugagccuccagcaguuuuaucaaugacaguucagauguuccucucccagcacugguuccucuggagauuucugcucauggguuucugauccaggaagcugugauucucuguaucuuuuuauuucuccaguuuggggcagcagugguuugccuugcgauggaucuaagaagaguuguugauuuuucaguuuguucagcucuuuacucauuaggaugguguaacuucuaaacuucuuauaugcucgucugggaacuggaagucuucaaaaguacaggguuuuaaaccauguauuuaacagagagaauguaaacugacuuucuuugaucucucucuuuuuucuuuuucuaauaucaggaggucuaaaggaauuuuuuuuaaaaacauuuaacacuagcuccuaaguguuggggaaauguauguguauaggccacaaucauaccuuccuuuaaaacucugugguuucccagggugcucacauugguggcugguccagcacagaauagguccugcaucuuagaauguaugggugaggaacccuaauagguuagcaaugucacuaucuguagcuuuagguaaaauccugcaaauuauuucucugcaauaagaaagucuaauauuuauuaaguauuuacaaugcaguagcaacuauguaauauuucuuuuaauccucacaacaauccugugagguagauacaauuacuguccuuauuuuaaagaagagaaaacugagauaugaagagauuaaauaacuucccugagaucauagagcuggaauuugaacuuuaguucaacucaguaguggguagguacucuuuaugcauauguuauccugcagugcagucucuuauaucuguuuguaucacccuacauaauaaccucaaugaagaacacuuccgauccuaauauuuuucgauccaaaaccucuagugacuuccuauaccuagagaagaagugaaaacucuuuagcuuguaauauuaagcuguaguuucaauguccuacucuggccuuaucuuuuacaacucuuuugcauguaucuuaaucucuaauuacacagugcuccuaaaauuucucaaaguugccccauauauuuccuccugcugagaaaauucuuuuuacuucuuuaaccacuaaauccuacuauauuucagacauuuucaaucccaggugaaaggccacuuccucuugaacuuuuaugauaacuucaaugggaauuaauccucccuucauuuaacuguuagaguucuuuauuuuauacuucuuacaacacucaccacacauuuuccuguugccaugguuugaauguaauauaucccuccaaaacgcauaugugauaguauuaagaggcagggccuucugggaaguaauaaagucaugagugcuccauccucaugaaugggauuggugcuuuuauaaaagaggcugagggaguguccuagucuuguuuugcucuuuugccuuuccaccaugugagggcgcugcaagaaggccuucagcagacacugaaucugcuagcaccuuaaucuuggacuucccagccucuagaacugugagaaauaaauuucuguuauuuauaaauuacccaauaugugauauuuuguuauaguaacaggaaugacuaagaaucuauauaugaguuauuuauuguauuugcugucaccacucccagauuauagcaacaugaaggcaugcacauuacguaauuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguucuagccgggauggucucgaucuccugaccucgugauccgcccgccucggccucccaaagugcugggauuacaggcgugagccaccacgcccggccuacguaauuuuuaaaugucccuugucauacaaaugccuuguaaaaguucauuaaaugaauggcuuuaauuaugcaauaggguuauagaaagaaaaaauuuuuaaaaacacagagagagacaucucaaagauugagcaguagacugaauacaugugcuuaucucuucucuauccuaaaaucucauguguuaaaauaaauggugcuaugagaaauaaccagcagauuagguacccugaaagauucuuuuggucaaacuaguugaaaugcuggauaaaacauuuugaaaacaucuuuauaaauguauggcugagcuggcacaaaauaaacaaaucuauagagcuugcaaaugaaguaaaaguaugaaccaugguagccaaacuaccuuccuagugggauuuacccuaaagguuucuuuccaauucuggagaccuugagcaucugcuuugauaguugcauggagauuuuaagggaaaggagaugaagccuaagagauauacaaaaugaaaagucuaacagaagaaaccugcauaaaauagaaucccaaauggccacuuuugguaagcguacaugagaauauauucacucagcuguuuguaaggaaacuugucucugucaaucuugggagugaauaauaagaaaagaaauaacuuucuaaagaauuuauaaccacaacccaaacuucaugcagguuagucguuagucaucgaauucaugcuaccuauguguucaagaaaaccucagucagagcuuuuaaagcaguccuuaguugguagugccucaaacugagugguggaaacaaaugcuaauuuucacuggaggagcccaacuucacccugggggugagagaacucccauaaauaaaguacaaagaaaaaucaguaguucuaggcaaaacccacaaaaugaaagagaugagauccagaaacagacccauacaacuucagguaugagauuauuagaaaccaaauacaaaauaacucggauacauuuaaggaaaugaaagagaaucuuuaaaauaugaguaggaaacaagugacuacaaagaaccacaaaccaaauuuaaaacagaaauagacuuucuagaaaugaaauaaauauaguaucuaacacugaaaacuaaaaaauaaaauuuaauuagaucuggcugaagagagaaucaaugaauugaaauaauucaugacuuuauuuaaaaugcauccuugagagacacagagguagaaaauauuuuaaaaauauuaacaaacauggaggagaggcugaguaauuggaaugauaaaaggaaauauuagaaugaauggggagaggcaguauuugaagagauaaugcuugaaaaauuuccagaguuguguaaaaccaaccaucuucagguugcgggagucuaaugaaaaggauaugaaacugaagguguuccagaucacagaaggaaugguacacuaguauaugaauacaucuaaacaaauauucauugcaaagauaacaacaacaaaaucauggcuaacagaaaugaagcaguucagaauuuucaaaacuagacagcaacagcaaauuauaauccuuuuaaagaugaauaacuuugauauuguugauuuuguuaagaaugcauguugaauagcuaguguaacaaauaaaaaaauagauuuagauaauacaauuuucagauaaguaaaggggaaagaaugaaaugagaaaagaagaaaaagauacauucaaaagauggcaagaaagaagagaaaacaugacuaaaaaaugcaggauaaauggaaaggacauaauaaaauggaagaaauaaauccaauucuauacauaaucacaaaaaauauaaguaaaccaaacuauacaguuaaggacaaagaaugugugaauagaguuuuaaaaauuuaguuauaugcuguuuauaagugauacauuaacucuaagaacacaaaaacauucaaaguuagaaaaaaauuuaaaaaauguacuaggccaauacuaauuuuuaaaaaguuacuguagcuacauucauggacaaauuaacucuaaggagaaaauaauuuugaaagaacaagaggaucacuugggauacuacuauaccgauuuugacaccacaggugggauaucacaauucuaaacuuguauguuccuaauaaaacagccuaaaaaguauguaauacaaaaauucgacagaacuacagggagaaguuuacacaucuaccaucauagugggagguaucaaacacucucaauaauugauugaucacgugggcaaaaaauauugaggcuauagaugaucugaacaacacauuuaacauaaucuguugacauagaugaagcauuucagguagcaaaagcagaauauacaaucuuuucaaguacauaugggauauauauauauaaaaagaacacaugcaaggccauaauaccaacuuuguauuugaaaggacaggcaccaaacaaaccguauuucuugaccacagugcaauuaaauaagguauugacaacaaaaggaacuagaaacaccugcauuuugggaaauuaaaaaaaaucuucuaaauaauuuauggguugaaaucauauucauauuggaaauuggaauguauucuaaauugaaaaauuauaaaacucuacuaaaucuugugaaauacaacucaagcagcacuuggaaggaaguaggaagccucaguagucuuauaagcauuacagaaauugaauuagugguuuuuaaauuuccuauauaaaacauaaggcaaauucuaauaaauguuuacuguauauauaguucuguagagaauaaaagugaacacucuccaauucauucuaugaaacuuagcauaaucaugaaaccaaagcuguauacaaaugaagaaauguggacuaguuuucccuaugaaaaaagguugcuaaaaucauaaaccuaccacucaaagguuaguuuguguaccugcaacauaggcagcaccuaggagcuuuuuaaaaaaugcggauucuuggacuuuaccccagaucuacugaaucagaauuuuaacuucaucaaaaucuacaggauauucuuauguacauuauaguaggugaagcuuuguacuagcaaacuaaacccagagauguauuaaaauacauaucacuaaguuaaguuuacccaacaguacaaagcugguuuacuacuguaaagcaauuugucauauuaagagaguaaaggagaaaaccuuaggauugucuuaguagauucagaguguugaguaaaauuuaaaaucuguuaauaauuuuaaaaaagagcuccaagaaaacuaagaauaauagaaauuauauucuuguauuacugcucucuuuucagcuacauugauucuauuuuuucuauuucuuuuucaauaccacacugcuugaauuauguuagugccauauuggcagggaaacagaaaaugagaauguagguuauguuuauuaugguauuucgaaucaguagacgaaagggugaacuuacuauauaguguugaaauugguuacuauuuagaaaaauuaaaaugagcuaucuccuagaacauacuuuuaaaaucucagaucaaucaaaauuauacauuuaaaaagccaaacuauaaaaauauaagguuauauuuuuauaaucuuugguugagcaaagccuuuagaaaauauaaaaaucuacaaagcuaaaaugaaaaauauaaacuuuuuuacuacaaaaaguuuaacauuuaugugugacaaaacauaccauagaaaaauuaaaaggcaaauagcaaacauguagaguuuauauuuagaauauaaugaaauuuccacuaaguaaugagaaaauagaaaguguccaaaauaaaaauagaaagugaucaaauuaugugaccauguaguugaaaaacaaaacaaaauguauagaacaaauaugaaaaauugcucaaauaacuaaaugaaaagguagacauuaaaagaauaguaaaacuuuuuuuauucuaucaaauuggcaaaaauguaaaagguuguuacauucaguauugacaaaaaugugggaaagcugccacucucaaauuuuguuagaugaacuuguaaacugauaaugccucaguaagauguacacuuuuaggccaacaugcucauaguuaugcacagcgacaucaacauagagauauuuguuguaacacuuuuguagcagaaaugaaaaugaauuucacccaauguccuucaacagggucauggcaaagcaaauuaugaguccuacauacuaugaaauucuauguagcuguuucaaaugucgacuaauaaauauugauguggaaaguucucuaagacagauugcuaagugaaaaaaaucaaauaacagaaacaugcaauccuuauauccauuuaaaaaguacauaugcauaaauguauuuaaaugcaaugcauagacaaacaccagcaggaucauaccaaacaguuaacagugguuguuucugaaaagggaaauguauugauguugggaaggugaagagaaagauguaacggaguacuuccacauuuuacuuagcacacuucucuauaauuagagcaucuacauaauuuaccauccaagccagaaaaauuuggaguaaaaauaccugcuguuaauugcucugggacaccagacauaaauuagaacuguucugggcaaaugagguauauggucacauuaucuauaguaagaauauauucaugauuucaucguugaauuuuaaaaaucgguggagcuuugccaaccacugucuagaguugggauuagcaaaccaccuuggacuggacuuuuguaauuaugagaaacaaggcuuguguggccacuuuuauauuuuagugugaggccacacuaaaggggagauauaccucccccuguggcuuagcaaacacuuuccuuaccuugguauauagagcucugaggauggaauagaccaauuuguauaaagagcuccgggccuucagggagggaagagccuggggccccuaagccauuuccucuagauacaaacuuaguaacucuuugcuguugucucuggcacagcccugauggagauacaggcaagcaagaacucacccugaaguagaagggcuguugggucuaggcugucaaccucagcuuaauacaagggccugaagcuuguuccacagagacugguucuaguguaggcuguggcggaagacaucagcuucucugguacugaccaaccuggcacaguuucaugccuugggauucagagcugaacaccugaggaugaacuaguagagcuguuaacgcuggaauccuggcuaagguaccccaggcagugacugugaacugauuggauguacccauaugugcccauccaccguacuuugaaguuuaacugaccauucugaacugaguaagcacuugagauucuuagacaguggggggugcagguggggagaaagacauuaggagggagaagcuggacuugcugcuaauaaaggcaguggugguccugagcgaugaauuuauaccuuuaacaugucaaaugacucauacggauuauacuuuuaaaaaugaccauugggccaggcaauuuggcucaugucuauaaucccagcacuuugggaggccaaggugggaggauugcuugagcccaggaguucaauaucagucugucucuacagaaaauacaaaaauuagcugggugugguggcgcaugccuguggucccagcuacuggggaggcugaggugggagaaucacuugagcccaggaggucaaggcugcagugaaccgagauugcaccacugcacuccaggcugggugacagagcgagaccucgucucaaaacaaacaaacaaacaaacaaacaaacaaacaaauaaaauaaauaaaaacaaagaucagccauaugucacccccuguuaaccuguguugauccuuguaauugauuuaggcauuaagaaaacauuaagaaagaaucaaaggaggugggccaagggguggaaggaauuuggaguaaagaaaacagggaggguuggugaugcagcacacucuacucacgcggcugguguguguuccaguguguguacugcaccggcucggguuucugcccuacuggcuuccaaguguauucucccguaucauuuugguccugaagagcuauccaaaaauaacuguccuucauuuuuaccacacuacugaucaaacugguaauaaaagccuguucaaaccuuaaaaggggaaaaaagaagugguuacauuaaguuucugggcaauaaaaaaaugucauuaaagcauaaugaagugcacagaauggccccagaguaagcauuucucaucaauucuuuagaacauggaacaggaaaacacccaaagacccugaacauuacuaauaaaugccgaaugucagugcaauucccagaacuauaugagugagcagaaucugacucuugcauauggggcuuaauucuugcacagaauagagaguccagcuccaguuucaaagcauaggugguaaaguucacauggccagcaaugcauuucuuggaguacgauguggccuauuuuguaauuaggccacacaccacacacaccaugccacaauaugcacgggguaaaggugggcaggagggaggaggaaagauauuaugcuuuucugaaugagcauuuacuaauacagaguucacacacacccaccuaccucacuugccuggugagaaagaaacagaaauuaaaguagcaauuuuaugucucccaaaucaguguguucauaggcagagguaggucucagcuuauucaaauguguuuaaaucugcauguucacugaagaaaaaugugaaagccuaggaacuaaucuaaggccguacauccacuaauauacuucccaaacagcugaaugaauuacuguucaaugauugguggcagugcccccuuuccaguaugaaugcaucaaaagcagaauauagaagacucacauacaugcuuccacaugcacaccuacuaagaaaaacaugacuauuaaaauuuaacuagcauugaaccuuucagcuaaguugaaacuaucuugagaaagcuauuuuuagaacauacaaaguuagaagaagcacauuugaaacaguggcgacuucugggcagaccugcugagucaauggaaaaggaaaggcugaagccauuacccaggaaaccuaaggagaaagcaaauuagaucuuuucauucaauuuugguggcuuuuuucguuacugugcauccuuaacuugcuaagggaagcaaaagcaaugaggucauuuaugaauagaagagucucaaaggaaauaggagauaaaaagagaaaagaauaaaaagaaguaaaaauuuuaagugccuuacagauauuauuagcaacauuuagagaucuuagguauuuaugguacucaucuuugcaggggauauggauuuucgucauacuuuaguaaauauuuucugcagauacucuauuaauaaccuaaauagcacacauuugaaacaagaaaaguucuuuuuuuaauccagaucauacuggcagaaccuuauauaaaugugcuucaaaaggaacauauagaagacuaaauauugccuacaugcuguuguaauuuuccuuacacuucuguugguucaugcucucaauaauauacgaucugcuuuucucuaucuccucugaggcagaguaguaauaccgggucagggaagugcugggaggagaagggcggggucccugguuagggcuccacccccagccucugcccccagaccuaggugaggacaagcauuucuguuuucaugcccaaauguugcauuucccaagaccacccuggcuugccacacccccauccugugcuuguaaaaucccccgaggccuuagcuggaagacagacaagcggcuggacauccagaggaacacaccgguggaagagcacaccgacaggcacuggcagaugccggcaggccgucgacaggaagaacgauguggaguuuggccagaagaaaguuaagaaaauaacuccacuuacaauagugcccccaaaauacaugggaauaaacuacacaaagacuuguauacugaaaacuuguauacugaaaggugaaagacuuguauacugaaaacugcaaaauggugcugaaggaaauuaaagaagccacagagaaauggaaauaaaucccguguucaugccuuggaagacuuaauauuguuaagaugcucauacuaccuaaagugauguauacauucaaugcaaucccuaucaaaaucccaaugauaucuuuuucaaaaauagaaaaguucauccuaaaauccauauggaaauucaaggaacccugaauagccaauauaaucgugaaaagaaaccaaguuagaggucugacacuuuuugauuuccaaacuuacuacaaagcuacaguaaucaagacagugugggcugggcauauuggcucaugccuguaaucucagcacuuugggagacugaggcaggcagccugcuugagcccaggagcucaacaccagccugggaaacauagugagauccugucacuacaaaacauaaaaaacauuugcuguggguggugguguuagaugccuguagucccagcuacucgggaggucgaggcgggaggauggcuugagcccaggaggucaaggcugcagugagcuaugacugaaccacuguacuccagccugggugauagagugagacccugucucaaaaacaacaaaaacaaaacaaaaaaccagugugguacuagcauaaacacuaacgcauaggccaguggaauagacuaggaauaaacccuugcauauaugucaaaugauuaucaagaauggugccaagacuguucagugcagaaaggacagucuucucaauaaacugugcagggaaaacuagacaaccacuugcaacagaaugaaguuagacccuuaccuuauacuaugcacaaaaaugaacucaaaguagauuaaagaccuaaacaugagagcuaaaacuauaaaacucuuacaaggaaacacaggaaaaagacuucauaacauuguauuuggcaaugauuucuuguauaugauaccaaaagcacaggcaacggaauaagaaauuaauaaauuggacuuuauaaaaauuaaaaacuuugcacaucaaaggacacuaucaacagaaugaaaaggcaacccacaaaaugggagaaaguauuugcaaguuguacaucagauaagggauuaauauccagaauauauuaaaaauuccuauaacuaaacaauagaaaagacaaacaucccaauuaaaaaauggacaaaggacuugaauagacauuucuccaaagaagauacacagauagccaauaagcacgugaaaagauguucaacaucaucaaucaccaguggaaugcagaucaaaaccacagugaaauaccacugcacacccaauaggauggcuauuaucaaaacaaaacaaccagauaauaguaagcauuggcuaggauguggagaaacuggaaccuuuaugcacuacuggugggaauggaaaaugguguagccauuauggaaaagaguacagugguuccuuaaaaaauuuaaaaucaaauuaucauaugauccagcaauuucacuuauaggcauacaugccaaagaauugaaagcagggacucgaaggguauuuguacauucauguucaugguagcauuagucacaauagccaaauggugggagcaacccaaauguccauuaauggaugaauggauaaacaauauguguauauacauacaauggaauaugaauuagccuuaaaacagaauuuccagaaacgaaauucugacacuacaacaugcuaaaugaaauaaaccagacacagaaaaacauaauuccacuuauaugagacauguagaguaguuaaacucacagagacagaaaauagaauaguaguugccagggucugggaggaggggagaauaggcagcuauuguuuaauggguacagaguuucaguuugggaagaugaaaaaaguucuggagauggaugaugguagugggugaacaacaaucugaaugcaguuaaugacacugaacugcacacugaaaaaugacuaacauggugaauuuuacguuuauguguguuuuacguauauuuuaccacaauaaaaaaaauauuaacugcaaaaguguuuuggggagauaugacaguugcaggaaaacgguagagcuguaaaaaugcuuuaaaauaaugcacauuuaagcuuaggagggguauaguggcucacaccuauaaucccagcacuuugagaggccgaggcaggaggauugcuugagcccaggaguucaagaccagccauggcaacauggcaagaaccugucucuguaaaaaauuuuaaaaaauuagccaggcauggugguacaugccuguagucccaacuacuuggggggcugaggcaggaggauuacuugagcccaggaggucaaagcugcagugagucaugaaggcaccacuacacuccagccugggcaacagaguaagacacugucucaaaaauaaaugaaaguaaaauaaacuuaggagaaaaugagauauugcagaauuucucacuuuuggcaaaauucacaaaauugaaugccauuuggauuauuuuguaccaauauucuauggcugauugauucaaaauuuagacauacauggauuuagccaauuauccauuauaauuuuggaacucaacuuuugcauucaugcuuugucuggaagcaaaguggccaggccugaaaaaauuuuguaacaaucagcaagcaaacaaaaauuuguuacucaacaauaaggaucuguuuuucuuccccucucuauuccacaaaguguuaaaagucuuagaccaggagcaguugccugaucacaaaagaaauaaguaauuuguagcaggugguucuaauugugcccaucaaaccugucauuccauugugcagaagaguggaaaaucgauuagcaacuacaagcuuggguacugaagagugacaggagugucuuaaacaggaaaucaguaauggaagaaaaugauuaccauggccacuaguggacacuccuggaucugagacacuuuccaucuacugcccaaccuucucagacaaaagaugcuguuugcaaaaauuccaacguguauggugaaucaaaagcaguacaguguggacccuuguuucuucccugauggacucugaaugauuaaaaaccaagagcauuggcccuuucuuucuucaacucaugaguccuguguuggaguugcugcuuugaauguagacauguuuuggggguagcauaaguauauguuaacugacuuggacagaugacacauccugcucaucuguacucccucagggcuuggcgggugaccaggcagcacaccagcacagggcaaucuggacaggcguaggaggccaagacugggauaaaaacaaacuucucuaugccauaguucugcuuuacagauggaccaggcaugagcgcuggcuacugaauacaguuuaccagagaaaacauuuaaaguauucacaacauagucuuguauccaguuuuggggaaaaugaaacagauuuuuuucccagauacuuucugucauuuguaugagguccccaaaggguucauggaauaugaagcauuuguucuaacagauuucugccuuagcuugggucacuguggcacuauggguuaucuguaaugucacugugaguuuauccauuuauugugcuauucuaccuucuucacuuauuucuugugucuauguucgaucucuucagcugcuggguuucagaaagcacuggacaauaauagcaugccuuuuauuucuuguggauagcaugucaguguuuaauauggggacucucacaaaacagguauucaaaaaaaauuuucuaauaaacucuuggcuauuaauuuuuuguguggucagauaacauaugaaaaauaauuaacacagugccagguaugugacaggcacucaaugaacauuaaacaaaaaaauaaagaauaagacauaaaaaacaggugaaacaauuggacuuauuuucuuugguaaaaaacauaauuaaauuguaauuaacaaaagagcguauagcuucauuggucagccuccugugaaguccaguguugacucacugacugggggacuuccaacccaagguguucuuggaaccuuuugggugaguuaacaaauugauaaaggcuuucuucugccuguuagccaaaccugggaggagaaagguagaacuaaaaacaaugcugagauacaucaaagguagugcuauauuucaacgggaggaucuccugaaaguaaaauguuucaccaggugacuuagucugccaaaugcuaucaauccauuugagugugugugugugugcgugugucuguuuguguguguguguaugcauuccugugcauuguuuggaacagaagcuggguaagaaggcaagaaagaggguaagaggaggaaggacauacuggcagcuuuggauguugacuuccaaugugggaggagcagagaaaucauacaggaauuccucuacaaauuaggcuuauaugggaagggucucuagguaaaaccaguuguccuauuugcugguauucagugaauauuuuuaaaggcaauggcccagguaaauaugcaagugacuugcuuugcagguguaguuuccuguggcaccacuggaguucuaccccgcuucugucuuccccaggaggagugggucucccagguguuccagcccccacuguccuccuggcaucgauacuaauaugaggucaccuuuacucuugguauuuuuauccccuacagguauuaugcaucgguaccauggggcagauuguauggaguguaaaaagggcacagucucugugccagcaucaggaaggcauaugugcacagagaagucucaaucuaaauaaaauagauggaagaagugauggugaaggauuugaauauccuccacauuuuauagcuuuucugcuaaaaacacccccauacaacucacauacauuacaucaaaaaaauacuuguuaaauaauguguuuuggcugggcgcgguggcucauaccuguaaucccggcacuuugggaggcugaggcagguggaucacuugaggucaggaguucagaccagccuggccaacauggugaaaccccgucucuacuaaaaauacaaaaauuaccagggcgugguggcaggugccuguaaucccagcuacucauggggcugaggcaagauaauugcuugaaccugggagguggagguugcagugagcugagacugcaccacugcacuccagccugggcaacagagcaagauucugucucaaaaaaaugaaaaaaaauaaaauaaaaaauaaauaacggguuucauuucccauauaagcaguuagaagauaaaaucuaaaaacaucugaauauauuagaaaagcuggauaauuaauaaaucuuuacagauaguaaaggucaccuuaaauuuuauuauuuauuacucaaaaaucaauucuggaauaacauaguauaauuuaaauucaucucaauaaauaacuuaaauaauuuaguacuuugauguauagcacaauuuagauuuugaacaguuaugauuguagcuagauuuuaucauuccaagaguccucaugugaaagccgucuuguuucuguuaaaaaaaguuuaauuuaccuguuuguaaugguuacaagugcaggaggacaguaauaaccgcuggaagcuuggucaaagcuucgaaggacugugucaauuuuguaacagaauccaccaugucucucccaucccuuaaaaagaauaaaagggaaauuaaggacacaaucucauuuaguuaaauaccaagagauauuuuugcauacucuuuuaccaccuacauaacuuucuucucuuacuccuuuaaaacuccuugaauuuuugucuugauauuuuuauauuuauucuauccaguaaugccauuaacuacacccacuucuacauuuauuuaauuuauuaucuuaaaaccuaaaauuuuuaauuaacuuaaaacguaaaaccuuaaaaguaaaugaaaauaaagggcauucauucaagaucucuaccucucucuuucucucucucucucucucucucucucugucucucucucucucucucugugugugugugugugugugugugugugugucucucucucucugacuuacagaauuucauauaaauggucccgacaggaggguagaaauuaaguguuggcucuagggucaggaugcauggguuugaauucuggcuccacuacugugcaaccuuguuuaauaucauaguuuuuucaucuauacgaugaggauaauaauaguauuuaugggguuguucugagaaucagagaaggacaauacagauagagauuuuagaauugaacagaggggaaagagaacaugaacaaagagaauauauguaucuagauaauauuagagauuuuuuucaacuuucauauugauuauuucauguuaucccucugagauucauugagauuagggacuuggauaaagucaaacuaguggaucaguugggccugaaacccaauucuggaacaguccaggauggucuuguuuggagcauaaugcuuccaaauagagaauggccaauauauguauuuuuucuuuuucuuucuuuuuuuuuuuuuuuguaaagauuauuccuaaauuaacuggcuggccuuuuggaggggaagaaaguaagcuuuggcacucagacaaaaaugacaaacauguaggucuauguuuuagcccugggaacaacgaaggguggcucuuccuuugaaaucaugcaguacagucuauggccacaccacccugaaugugcccgaucucaucugaaaucacacaguaugguaagacauacauucauuaguccucuauauuuaaacugagcuauuuuaguucuuuuuuccccaauauuauuaaaucacaucauuuuuaucuauuuuaauuuauucaccaguuuuaaaacacucuucauuuuaugcuaugccaauucuugccagcuuuugaucaguuauaaaaugauuucucauaaauuucuuggaaaagauguuggucuugcaguaaauuaaagaaaaccuuaauuuagagaucagcuguguuaguucaaacauaucauuaacugagguaggaagcacaggagcucccacauccagccaucuaggaucugcucugaacucacuccccuucacuucuauucccaaucuucucucugugaguaacugacagcuccauacagcuccuucaugcaucccuccaggguaggagcagggauauuagacugcuccuguacuuggaaggacagggagagggaggcuggcaauuugaccuuuccgauaauguauucuucuucauuagcaguuuuuagaucauaggcugcuuagcaaaacaaacaaacaaaaaaauccaauaacugaaccagcucaagaaaagggagggaaaaaaagaucuggcauagaauaaucagaaacacagacuuguuacuucaagacuuuguccacacaaugaauacgggaaggauaacugauuauaucaguuaacccuuuguacacuaggugccauuucauuuuuaaaugaaaggaugguggugacaaaacugaaggaauugcucauauuguccaaucccaaaaaagugacucagaaggaaaaacaaaucacuucuuuugcuuugaaauuaucaagauugauuuuacaaauugauuuuucaagugcagacuguuuagagaauugcauugaagcaacuuucuaaaaaagagaaaacuuucaaaaccauauucauagacugaugcauaauaaaauuacuggaaauuuccucacaaagcuagagaauuggcuaugaacucagaaacuuuaaauacugguaaugcuggcuggaaaagggaagccaugaacaaaaguuugaauagaacaucaguucuguauuugcaguguaaaaaguuaauuguccuuucaacaaaaauaaaacacgcugaguuucccagaaagccacaguaagacaaauccccccacccucgccccugccccgucuucaauauuucauaucagguagagauuaaucagagaucagcuauaacuaauucagagauuauaaucauuagauaaaauggugacaugucagcuacggcauaucuacuauccaacuagaguaugaaguucacauguuuacacauugauuaaugaauaaaaugaagauucuaaggggaugggucauuguucaauugcaauacaaauaacuggauuagaagagaaaauaauuaaagcauaguugcauaaagaccaggucuggaaaacuguugagacugauaaagcauaguucacucugacucagaggaacacaauuguuuuaugacaucucacuugaaaacuaggaaaaccauaagucaggcacaguggcugaagccuguaaucccgguacuuugggaggcugaggcaguagaucacuugaggucaggaguucgagacaagucuggccaacauggcaaaaucccgucucuacuaaaaauacaaaaauuagccaggcguaguggcgcacgccuguaaucccagcuacucgggaggcugaggcaugcgaauugcuugagccugggagguggagguugcagugagcugagacugugccacugcacuccagccugggugacaaagcaagacucugucucaaaaaaaaaaaaagaaaaagaaaaagaaaagaaagaaagacuaggaaaaccaagugugagacagggcaucacacaucacaggauagucacuguacagaugcuguaucaggaccauuuacauuuuuaaucucaaaagaaaaguaauccuguguagaagauagcaagacaacauuucucaggacaggaaaaaaaagaggaaaggaaagaaggggggggugcgaggagagagagagagaugaaagagaggagagagagagaggagaaagagaaauucacuucaaauugaugguggaauugauauucuagcuaugaagucccuguaccuaaauugcaauguuaacagcacuuaccucuugacauccugauucagcaucagagaggacauggccugcuuuuuuacaaauguaaaaaagucuuucuucacaauuuuugacuuuccagugucccuccuacggagaaaaauguuacaagagaaugaauacacucugugcugauaccgaugggcaauagcaauucuuauaaaaaaaauaugaugaauaaugugcucccgcgugggauaauguuucaggcggcacucugcuuugucacggaaaggguugacacuuugucuagggaaaggcccuucucuccagcaugaguuccaaggugugcaaucuguaacugggugggcaggagagagggagcaacuauuaacaacuggugcuucuugauagcugccaugugcuaggcuuaaugcagggcgauuuucauauauuaucucaauguuccagugagguagggauuauaauucccauuuuaaagguuagaguuagcauuuuacaugguccuagagucaguaaaaauuggagcuaggauugauaccaaggucagccuggcuuuccauuaagcuguucucaauuuuucuaugaaaagaugggauagagccaugguucucaaucucgagugugcuccagaagcaccuggagggcuaacugaaaccuagaugauugggcugcaugaccagugucucauuugguaggucuggugggacuugagaauuggcauuccuaacaaguuuucaggugauguuaaugcugcuggucugggggucacacugugagaaccacugggaugaagccauccuccugaccaagugagagugcugacgccucucuucaaccacuucuaaguguuacauuaaaugcuuugcugcuuucaugucucuaccugaugcuggggaaauuccuggaagcuaccaugaaacacccuagguaauauuggcauagcugaaacucauguucacccuucaaugaucccuccaucaggaauucgaacagcaccaccccaucuccucuuuauaugcuaggcagauaccuucaugucuuucucuaauccuauugaaggcuacucucagaucuuucauuaauaaugauauaauaacugcuaacauauuaaaauuuuauccucccauaggauuuuuuaauaacacaaaucagaaccuuaggcuaaaguuacacaauucaaauuccaggugguauuucacacaucuagaauuuuaggggaauguggagcccuuccaugacccuuagaaaaauacaacguccagggcugauaccuucaucuguaagaggagcccugcaucgcucccccauggagucuuccagcaaacaauccaguuacaggauagugucaggcauacuauaguuaagaacuguuagaugaauggaagaacaaaugaauuguuuccuaggcucucauauucaaauuugugucaacugugauuggggaacuuguuaauuauaauaauuauauucauacuaaguucuacuccauggaaauaaauguuaauuuuuacacaucuacuauuuaaggagcuucugagcuuccagaaaaggggccauaaaauauuacacuuacggcagcauuguccugacauauccaauacuauuaauaccuaucaucaaucucuuaaaaaaaaaucucuguccaaauauuggcuccuguucuguaaacuugcagagcaacauacccaugccugucaauaagaaaugaucaccuaaauuauaucaaaacuaaugaaccaauaaaucagcagauacuguagaauaaacuguggugggccaggcgcgguugcccaugccaguaaucacaacacuuugggaggccaaggaugguaaaguccaggagucugagaccagcaugggcaacaugaaaccccaugucuacuaaaaauacaaaaauuagccaggcaugcuggugcaagccuguaaucccagcuacuugggaggcugaggcaugagaaucucuugaauccaggaggcagagguugcaguaagcugagauugcaccacugcacuccagccugggugacagagugagacucugucucaaaaacaaacaaacaaacaaacaaacaaacaaacaaacauugugguggauuucagcagagcuagacccaggacagacauuuagagguauuguuucuccuuuauauggggcugagagacacugccuuagcauguauaauuguuacugcacuguacaauuguaauugucugugcuagcauuaaaagauggaaccaugaaacaugucacaaaaguuaagugcuuagaaaugcuuccuguuuugcuggcauaauuacuuugucaagccacaucaguaacauuuaauaaacugccucuucggagaaccugacagaguauccuggugguuagaagaacauggacaucuaccaaaucccaacaacccccuaaaacucagccaguguauucagcagcuaucuugaucaaagagauuaagucuguuuuaggcauaauaaacuguucaaauggcuugggauuaagcuaauucuguauaaucagaugcuuuagauaaaugagagacuagaacauagggaugaaugugauguucaggcuacugggaccacuccauccacaugaggaaaaaaagcaagauuugccacugauccacaauuuucaaagagguuacacauacuguuuaaauccuuuuaugugaauaacauaauggagcuuaaaaaccaucacucuccagaguaaucuuccaucccucaguucuuccccucaucuucaucacagcagucaauggcaccaccauacaccaaaaccaugguugcucaagccaaaagccgaccucucucucacccccacaucuaacuuagcaacaccuucuguucuccaaagcacacuuggaucuguccacuucucuucacagucacuacccuaagucaacucugguguagccuccaaacuggcuuuucugcuuccauuuuauuccucuccuaaccauucucuguguagcagccacaguuaauuguaaaauguaaaucaggucaugcccuuuguuuccuugaaguacuuuauugguuccuauaccacagucuagaaaccuggcauuuuagaauuccuacugcccaucucuuacgaccuccucaccacuggucuccuuuuugaucauucaacauggcaagucuuggucugccuuugggccuuugcacuugcuacccucugcauguucugcuuagaauauucuucccccuucucucugagaguuuuuuuuuaaguccaagcuuaaauauuaacuuuucagaaaugcuuucuguggcuguccuguccugccccaacccaagcuuuucacuaucaugucacauaguuccuuggagcaaucauuacaacuauaauuaccauguuuuuucuguguguacuuguuugcucucuaacauggaaggcccaugaggaacagggacugcaccugucuuggucucugccacagcccaaagcuccaacacagguggccuucaguacaagaccagcaaagugagcacugaacaaaugaaucaacuuacagacugcucugcugagacacacagcuggcuucuauuuggaaaaauguggggcucaagugugugccaauuaguaaagaugacugaagagucauuagaccauucaaaggaaacuggaauuuuauugcugcucaaaccaauccauguuucugaugcauuuucuguaagagauaaauguaaauuacuuaugggauccuauuauuugcaaaggagauaacacccuggaguuauuacuaaaauauaccacuucacaugugauuucuucuuuauuucuuugcaugaugaaaucuguuuaagucuugguauaaaaugucuguuuaaacauuuucccuucccugcuaugguuugaauguuuguccccuccaaaauucagguugaaacuuaauccccagugugguaguauugagaaggaggccucuaaggggugaaugggucaugaaggcucugcccugaugaauggauuaaugggcuaauggauuaacuaguucucaugggaaugguacugguggcuuuauaagaggaggaagagagaccugagauagcacacucagcccccucuccaugugaugcccugugccaccaugggacucugcagagaauccccaccagcaaggagauccucuccagaugugguccuuugaccuugaacuucccagccuccauaacuguaggaaauaaauuucuuuuauuuauaaauuacucaguuucuuuguauucuacuauaaucaauagaaaauggacuaagacauccccauaauauccagaucugcuugauauaggccuuauaagugaggcagaaugugagcuaaagccaaugcaacaacaaagccuaagcaaguuggauuccuggggcucugguuucugcuagaaccauguauguauguuaagcagaucugaaaaaucugguuuugcuucugccuagagaaaggaaaaauaggaaggcccacuggauuaugaaaagggcaugaaacaaacaaacuuuuaaugauagucuagcuuaaagauaggaguuuuuuuuuccccaacagauguuggugaggaugcaaaaaaaggaacacuuauacacuauuggugggaauguaaauuaguacaacauuuauggaaaacaguacugggauuacucaaagaacuaaaaauagaacuaccuuucaauccagcaaucccacuacuggguauauacccaaagggaaaaaaaucauuauaucaaaaagacaccuguacucauauguuuaucacagcauuauucacaauagcaaagauggaaucauguaaguauccaucagaggaggguuggauaaagaaaauaugguauauauauauacacauacacauaccauggaauacuacucagccauagaaaagaaugaaaucauaucuuucgcacacagguagcacuugaggcgauucugcuaagugaaauaacucagaaugucaaauacugcguguucuuacuuauaagugggagcuaaacaauggggacacauggagauacagagcaggauaaaaaacacuggagauuccaaaagguagcagaggugaggcugaggguugaaaaaucaccuguuggguacaauguucaccauccaggugauggggccacuaagaggccagacuucaccacugcaauauaugcauguaagaaauacucacuuguaccucuuaaaccuauuuuuuaaaguauuuuuuuccuuuuucuuuuuucugccauaggaaaaaaggagcaaaaccucuuaaaggcauugaaauggaguugcugcaaaaguaauuaaaacuugacagccuagguaggaaaggacccuauguggcugaaagagauguguaagugcccuuguugagauaagcagcccacaggguucuuuaaucccaaaugcaaaugauuaggaaaaauaacagagaaggaugcauguuuuuacuccaaacuaaaauguaacaauugaaaaggucaucaaaggagauccuggacauuuuuuuguauuuuuaaaaaacugaaaaaugaaauaaauaauuucaguauuuuucagcauaagucuaugucaaauacaugacacagugaagagcaggccaacucugagggacucaggcugugcggaagccaggagccuaaaauuccuauacauggggaacagucugaacaucaccucaccaaauaaauuacccauguucacuggcuaaaauuguuuacaucuaauuauuugccuaagggguucccuuuauuauguggauuacauguuaacaauacacuacugcuaucuaguggccauaaagcuaaauuacagguuuagguuuuucauuagaaguuuuaggaaaugaacuuuccuacuuuccaaaaauuuaaaaaucaucuaauauauguggcauauaugaagauguuacaaaguuucugaacauguauuuuguaaaaauccaauaaauuugaacuccugaauaacauuuagaaacuuuaaauauaugugcaaugaauaaccacuuuuaaauagcuuaaauuucuuuucaacuccacuaauaaaaguaguuacuacauuauauuuuaugccuuuuaaaccaaaggcagcugggacucaccaucuccaaggaggguuacaagaaacuccaccucugcuaaugagguuaugucuauuaaugcacuguuaucagccugacaagaacgcagagccucaugccaggucuuuucuucuuucugaaguuuguagcaauuacgauuguagggauuccagccaggcucacaguggguagcauaauauuuccacgcaucuuuuucuuuuuaaaccaacaaaaaacaaugucauuuuccacaauuauuuuaacauuacuuauuacagcuuauguaaauugccauuaauaugauuacuuuaaaaaugugaaaaacagaaauauacaaaaugacauauaucauggaauucuagaucuucagaguugagaagggucuaaucuaugaucuagauuuagaucuaggaucaaaugaaccucaguauuucauuuuccggaugagcuagugaagguacaaagaaguaaggagaggagggauggcagcaagauggccgauagagacaccugugucagaggccuuugaacaacagcaacuccaucuuguuuaggagcuggguaaaauaaggcugagaccuacugagcugcauuuccaggaggucaggcauucuaaguuacaggaugagacagaaagucucaucaagaaagcuugcuaauaaaacaagcugcaguaaagaagcuggccaaaacccaucaaaaccaagacggugaggaaggugaccucuggucauccucgcugcucauuauaugcuaauuauaauguauuagcaugcuaaaagacacucccaccagugccaugacaguuuacaagcuguggcaacaucaggaaguuacccuacauggucuaaaagggggaggaacccucaguuccgaaaauuguauaccccguucccagaaaacucaugaauaaucuaccccuuguuuagcauauaaucgagaaagaacuguaaguguaaucagcugagcagcccaagcugcugcucugccuauggaguagccauucuuuauuccuuuacuuuccuaauaaacuugcuuuccuuuuauggauucgccuccaauucuuucuugggguuuggaucaggaccccuuucugguaacaccugggaucucaucccugccacaggaacagccaaagcaaugaauaaaugacuacauuuucacgaaggcagcugaaggagagugcuggagcacaucaagggaguagcagaaacaacacggagcacagaaacccuugcugcccccacccccaccaucucccccaacccccguuauaagcagcucagagccaggagagacuucucucuguaaggaaaggaagagcaaggggacccuagcagccuccaacaccaccagggucaccuacaguucuugccacugaggaccccugcagcccccacaggcacuaagcccauuugagggagcugccuggagucuacaggacuaugcuugccucagagaaaguucugaugcugcacccugucucucuguggacuaugggucuauugcgcugcacaauguugaaaaaagaaccacugcuagaaugucauguucugcuccaguagugaguagccacagcaccccuccauccuugaggcuuuguaaccacugcaccacuucuaccucguggcccaccauccccaugccaagcugcuguggggcucucacucuaccugguguggccaaguugccacgagcugcuccaucuacccuuccugguuguugcugugcugugccccucagagccugagcuggcuuaucacccugccuccaaagaaauggugccuuggccucccagaguagucauguuccccagugugugugcugaaguggcacccugccucccagggaaucccuacccuggcugcccaaaacagucacaccccaggcaccugagcugaaguggcucucaaauccaggggaaacagugcuuuagcugcccaaagcagucauaccccccagcaccuaagcugaagcagccccaucucaugggggaaugggugccuuggcugagcugagcagagcagcugugccuuguagggcuuggcugaugugguacccugcauccaagggaaacagcauuggcaaggcugggacauccugcccuccaacacaaacagcuguagcaccuugccuuccuggaacuggacuagucccacaaagccugaacugcugaggcaccccaccuucccagggagaggagucaucauuuugcugcuccuugacccccaggaaacaaaccacagguauaugccaccauuccuggguccuugcugcuacugaaccugaccucacagagccugagauacugcugugucccaccaccccaggguccggagucaccacugccuggugcuucauccccuagagcuugaguugccacugugccauacugguucugcuucccaaguuacagccgugcccuguucccuggagccaaaccuccagaguaccccuucuuccuuggagguaaauauauagucaaauucagaauguucaaauaccguaaugguggucuguaaaucauuuauaucucuacuaugaagauuaaagucaaaauugucaaaaauagauugggcacaguggcucauggcuguaaucccagcacuuugggaggcugaggugggaggaugacuugaacccaggaggucaagcuaugaucaugccaccauauuccagccugggcaacagugcaagacaccgucucuaaagcauaaauaaauaaguaaauaaauaaauaaccaagaugguaaaacauaacuauagcuacaauaaauuaagaaaugcacgauauuaaaagauguaaauagcgacaucaaaauuuuaacuauuggggguaggguaaaaaucuagagugauuguaugcaacuaaaguuaagcaguuaucaguauaaaacaguccauuauaacuauguuuuauguaagccacaugguaaccauaaagcaaaaaaaaaaaaaaaaaaaaaacuauagcagauacacaacugauaaagagaaaggaauugaaauuuagcaccacacacacacacaaaucaccaaaucacaaagguaaacaauaagagaggaaggaagaaacaaagaaucuauaaaacaagcagaaaacaaugaaaaaaauggcaguaguaagucuuuaccuaucggaauaauuacucugaaugcaaauggauuaaauuaucuaaucaaaacacagaauggcugaauggauaaaauguuauaggagucaacgagagaaaaugagcagagguaggaaaaaggauacaaguagcagauauguaggaugaacaagucugaaggucuacuguacagcaugaggacuauaguuaauguaguguauucaggauuuuugauaaaugagcagacuauaguugcucuugucacagugggggaaauggguaacuaagugagaugauggauguguuaauuuguuucacuaagauaaccauuuuacuaucuauauauguauccuaugacaucauguugaauacuuugaacauacacagucaauuuuauuuuaaaaaauaguaaaaaaguaaaacaacaacaacaaaaccaaagaaguaaagagacuugacagaggacauacaaugaaagcagaguguuggggcuagauauaaaauuuaacagagcugcucauuuuugaaaccuuuuuauauuuaaaagaaguauuauggaauacaauuuaaaugguauuccaaggauuuuauacauaguauguggguaagguagauauuuauccccagcugaaaagagccuaaaacucugaugacuuccuuuaaaauggggaugacaaauagguuucacuuugaaaauaagucuugaguguccacgauguugcucugggcugauauggacuccagguggggcuuucaggaacacagugccaugauguuuuggacauuggagggcaguggugaugcacaugcuuauuuuggcuuuccuuucucacgagacuguccccaaucugaugauggcauuuuuaccuuauuuuauuaaccacaacgaggugccuccauuaagaacgaaucuaguuaaacuaaauaugauuucacugcuauuugggaaacaaaacauucuuuuaaaauuguuucuaggacucuggcagcaauuagaaucauggccaaagaguguuagaacuuuguauaucauugaccccaaugguuuucagccuaaaaaagcacucaugaaauccuuuuugaacuuggaauuuuaggcugcgcgugguggcucacgccguaaucccagcacuuugggaggcugaggugggcggacugccucaggucaggaguucgagaccagccuggccaacauggugaaaccccgucucuauaaaaauacaaaaauuagccgggcgugguggcaggugccuguaaucccagcuacucgagaggcugaggcagaauugcuugaacccaggaggcggagguugcagugagccaagaucgugccauugcacuccagccugggccacaaaagcaagacuucaaucaauccacagaagaauguguugaacuugaagcaaagcaaauaauccaaacaagcuaacuuaacuacucccauuucuggucuucugaccucaauuagcagauagaaggauaaauauaacagaaggaaagaaggguggcaggagggaaugcaagauggcauaagaaggaaagaaagaaaaaaugaaaagagaaggaacggagaaaggaauaugaaagaaggaagagagggagggaaaaggacaauaacaggugguagcaauuucagcaaauuccugaaauaauggaaaaaucucuacauaaaaaaaugacaaguugcuucuucuuuccccagcuuguaccccauauucuacaaaacuucuaggcuuagcuauuuaaaggaaaaugaaaguuaaaacccaauucuaagagacaauauuuaaaaaugacaauucagcuuauuauuuuaaaucuagaguuuuuucuaauuauuuuuguaaugauucuuuaaaaaaugguuauacuuuuaucucuacauuuggagcuaagacauuaauucucagagaaacuaaaaagagguuauagaccugaaaaacagaaauaauuggacuucugguacuagacugugauuagauauuauuuaaguauuaacuccaucuaaaaguucugcauguaauuucagggaggaagguguguuacuaauaagagauucagaguguggcagaaaaucaaugaaguaaauaauuauauaaaauuguuuucuaaauuauguuuaauuucuaggggaacaauaaacucaaaacuagaauagaaaaagaaauguaucuuauuucucuaauacagaaugacuaacagugcaaauuuuuuaaaagagaagaaaauguuugcuaugcucagauuauuucaguuuuuaguauaaaccuaaaugcauuuguuaaaaucacagucccuuugacauaacagauauugucuaguuacacaucuuuucauauaaauauaaacuagauuuagcuaaguuuacauuaugaauuauuagcaaaaaauagagaaauuuacauauauugagaggacaagucaacaacaccuaagaacaacuuaaaauaaaaacgcuuaccaacuauuucaugaucaaugugguuuagauauuuuuuacauauauauggcaagguggacucacaaucccgacuccuccaggcacuuggcauaaaugaacuaaauguuccacagugaucuucaacaaauggcucaaaauuuaccucugaaaauacaaugagugucuuuaauauuagaagcaaaagcaguuaguuuaauauauauugaaaugugguuuucagcaucgggggacagcguuucuauuugucauauauaguaaauccuauaagauguuaucuaugauuuugcaguuacaguccaggcaugucaauuaaaugauuucccaaagauuccaaaagacccacuuuuauuaucuuaaaguagagagauauuuugcaauuuguagcuauuuuuaaaacagcagacuggaaucuuggcuuacacccaaauccuccugcaacuuuggcuaaaaagcuuaucuuccuggucccuauuuucuuguuuggaaaagcuugccuuaaaggaauucagucaggcuaaaaaauguuuauacacuacucucaaaaaagcauguccuaugugcaugggaaaugcugcuguguaagggugcaagaugaugccacgugacgaaggcaaagaaaacacugcggguaccugggcuccaauucagauaguugagcggcguuccaucagaccacugccagccagcguguucauccagcugauugaggcccauccacaccuccacuguuuuacugcucaugugcucugaaaugaaaauuauggagcuucaaaaaaaaaauccaguguuacacaucuuucuuguucuccuauuccuggaucauggagucagaaacuaauuccagucaaugacgggaaaggugcacagaaugcacguggugcuucugagugauaaagcaggcucccaccaucuugagaaacagagcaggcucacugacagcuguuuuucaacugugaaugcuucaugcaaguacccagaaagguugccuuucaggguugucaaucuagacaagggugcaugguugcauacuugaggccaucuuacuugagugagcucaugaacuuaaagguuuaauaggguggaggaagaggugugcagggucagucccagaaagugaacagaggcacaucuucaaagguaaaacggugugcugaaguagaucagggagggguguacagugugacagccaccaggagaugucugcucaacaggagggaccagagugucucgggggaucccuagcagguugggaccuaaggcugugugcagugcaaacuggaggcugcuuccacagcuugaggugggagaaguuuaauggcaggcuggcucuguggccccuccucuuaaccaguccacuacaacuugcaguuuaaugcaauaccauuuuuguuauagauacuaugaauaaaaacaugcauugacaugcagaaagacauaguuaucaaaauuaaagaauuaugggaauuuuuccucaguuuuucuuuuugugcaccuaaauuuuaaacauuauuccagaauaaauagguacuacuuaugcagcaaaauuucggggggaaaaaaaccaaaaccuagugucagaaacauaaugaaaguggcaauuuugugaugcuuugaaauguugccauuuacucguuuaaucuauaaaggagagcauuguucgcuuacaauucaccugauucagagcccaauuuauuuuuagucagacgcagggguccugccuaagauuaagacccugacggauaaggguuauaaacagggugaccguaugcccccauuuuccuggaaaacucaugguucaugcugguauuuccagaauaauuauuaaucacagucccuuuuacuaucaaaagaaucucaguuuggaugauagacuguaugauuacccagguugugaaggucauuguagucauauaacaaggcugcagcauccucagugacuagauauuucaauacaauugugaaaaacucaaagaaacuaacccauuuaagaaaagagaaaaaggugcuuuauaauuuugagacucccagaaaucaauaaacagaaacagcauacuauacacggguuucacccuuccaaguuucuguggcauucauauggaaucucuuucuaaugucuauuugauuauuccuuucaauagcaccauucgauugaaucguuuagcaggucuuaugaugauaagaagugaaauggauugacagggcagggagaaauuuucacguuucacauccaggcaagugccaagugauauuuuaaaaucuaguuaaaauauuaaaacguuaauuauucuuaucuuagaauuuuuuugaauacccauugugcaauuguuuuaauaaugcagauaaaaaauaauugugcaauuuauaaccugugucugaaggcacaaaaaaccaucuauuuaccuuuaggacuaagcuggcccacgauacuguaauaagaaacucgaauuuaaauuccuuuggauauuucucggcauucaugacagcuuagauaauuccuuguaccauaguauauguucaccagaauuagcaagaaacauuagacuauuuucaucauuaaaaaauaccuugguuggaacagguuucugucuuuaugaacagacuucuguuuuuccaaacaauucccaaagacuaauuauagaacugagguaguuaaaucaaagucccugacaugucuuauuuuuuuaaaugguuauucaaauuugaugaauaaguccagaccuucucaugagaaauccuggcaguuaagauagauaauuguaauucauaaauggcauguaaacuuuuauauaaaaaccauuucaggcuuaaaaugauuuugaaaauugauguuuuccugcacuaugacuuacucaaaucaaauucaauaauaauuucugacuuuuagggugggcacacauugcucauucauuucuuacaauccuucuggaagauauuaacaacuuacaaaagcuuuuaagugugcuuacuuuuccauccagugaacccacuucugcaaacuuauagagaaauaauuggggauguaugcacaaagguuugugcagggaugguuuauaauaccaacuaauaaauacauaacaaaacaaauaguuuuaucaauaucucuaauauauuaccacuaacuuauacuacuauguaaccauuaaaaauuaugauguagaucuauauuuacagauacgggcaaauguucauuaaaugcagguaaauaaaauaaccagauuaccaaacuguguacguaguuguuguuaaaugguuaacacacacugaguguuuguuaugugugccaggcacuuuucuaugauuucaccuguauuaaaauauguaagccacaccaggaauuugcauuguuauuauuuccacuugguagaaggggaaauugaggcacagagcgguuaaaucacuugcuugaguaacccugcuacuuaagugguagaggcaggauucaaacccaggcagguggcucccugcuccuaaccugagcaggugguuaaaucacuugcuuguaucacugugcaauagcugccauguuuuuauuuauuuuuauuuuuuauuuauguauuuauguauuuugauaugaaggcucguucugccacccaggcuggagugcaauggcaugaucuuggcucaccgcauccuccaccucccagguucaagugauucuccugccucagucuccuuaguagcugggacuacgggugcaugccaccacguccggcaaauuuuuguauuuuuaguagagagaggauuucgccauguuggccaggcuggucuugaacucuuggccucaacugauccaccugccuuggccucccaaagugcugggauuacuggcgugagccacugcaccuggcugcugccacguuuuuauauaauaccauuuuuuauauauacuguguauguacacaugcauuuauauguuuuugcagagaaacacaguugucucuggauuacagaacuaugggaaccuuuuuauugguuuuucuuucuauauaccugaauuuuacaaauuauucuaaaauaaacauggacuacauaugcaauaaaauuugaaaaacauuggcaucaaaaacuguuaaugaaagugacuaauuuugugauauuuucuaauguuuccacaaguuuuuaaagaggugaauguacacacauacaaauacauuuaaucuauaaagaagaaguaagaggagaguuuaggcaauaagcgaaacauaagucuuaguuuaucggcacaauucuuuuaacauauuauugucuauacuguuaguuaacauauaugugcuuuugcuuuucccacuaaauuuuaagguuuuguuuuugggacccaccagaaggccuaugauguaccugcacauggugaaugauauguaagauuuuguuuaauuaauaaaaugcuuaaugauuuauuaauggaaauggaauggcuaagaucuccagaagagcaagcaaauagcccuuaaauuuagaaaucuuccugauccacuuguuagaacugcaacucuccugggucccuugcuguggccucaaauucucuucuccaaggaggagaaaauaagaaagacaucacuggaugccaaauggaaucacucaagguucauggaaaaauuuugggugagaguuuugggccauauuauggaaagaaaaauauuuuuuaagaacuuuuugucagaauauauuuuuguauaugugaaaacaguuaacaaccaucuuuuauuguaucaauaucaaugugcgucauccaccuacuuaccccuuaugaaauuuucuucaguuucaucuguaauacuuaacagcguaccuccuugcaucuggcaugaagaaugugccucacuccaagagagagaugaaagcagguugaacugguagcaaaugugugaauugagguccuucucccaaauaguaucacaaccuacuucugcagaggcuggaaacaauggccauuaaaaacaaccaggucuuauuuuaucuauacagcaacauauuucuaagguaagucugaauggaauuauuccaucuugcaaucucuaaaacuucagggccuuaucuauucuugauuaggucuuuaugauaaaaucugcauuguuauuccauugcuaagauaugguuaaacucuuucaugauuuaccuaaagaaauauaagaaaucaccaaugaagaagcuaugauccuuuccagaguaauaauaggaaccaguuuuaagagaaggaaguagaagcgaaguauuugugaaaauaagaucuaaguucuuuugucauuuagaacuuuauauugaaaacuuguaacuuuaaauguucauuuuaguagauacaaauguuauuucaaaggcauuucucccuaaauacaaaaugcuaaaauaaaaggauacaguaggaauaugagucaauaguaaacacaaguuuucaaauaaacaucaagcacaggaacacugacauauaguuuaagaaaguucuuucagccaagaggaauagaagcaagauccacuuguaagacacuggccgaagauugcauagugugcucaaaaggaaauguaauaaaguaugaaauguggagcugaagucugaaguuuuuuuugaaauaacagaaaauuaagacugaguuugggugcuuuugcuaacauuuaaaaucaaacuccaaggugaacuaaguagccacaauaaugaccggaaaccaaacucagacagagaaugucagaauacagagaaugugagccauacugcagcaugacugaaaaugacugacaggcaaccagcugaagucuaggauggccuuucccaaagugugauucccaaaguaagacaacuuuaagaggcuccccaagaaaaucuggacacaaugcauacauagcguucucugggaaauucacaaugaacauuagcauauucaaggcucugagaaguucuguaguaaagaaacaugcuuacuguuaauuuaguguacuucaaacuuauuugacaauaaaaucuuuuuuguuugguuuuuuuuccucccucauaacaguuagaugguccccuugggaaauguggaaaguuuauuuucaugucugguugcaacacacauuccagagguuuuaaaucacauauaaaucuaagguugucuauagaguuuccugacugauacauguguuuauagaaggauccaagauuaaaggaaggcagaagacaaggcuaucaccaaguaacacugaagggaaggaaaagaaagaaaggaaaaagagaagggaaauuuucaguaaccauuuugcccagguggcugaaauuuccccauugagauggaauccuuaaagauuguuuucaguuaaaauccuaggccuucccugagaaggacaauauacuacuacguguuacgagacacuaguucagccauacucauccaccaugacagcugagaccaugaugggggagcggggguguguucauaguuuuggcaugcauaagaaucauuuaggacagucacaguggcucaugccuguaauucuagcacuuugggaggcugaagcgggaggaucacuugaagucaggaguucgagaccagccuggucaacaaagcaagacccuaucacuacaaaaagagaaagaaagaugccggguauggugucucaugccuguaaucccagcccuuugggaagcugaggcggguggauugcuugagcccaggaguucaagaccagccugggcaacauggugaaaauuuuuuuagugcugacaugacgccacaaguagaaaauucgacaccugaccucgugauggguuuuggucaauacuuuguuucaugcacaaaauuauuuuaaauauuguauaaaauuaccuucaggcuauggguauaauguauauaugaaacauaaaugaagucuguguuuacacuuggguccugugcccaagaaaccuuauuauguauaugcaaauauccuaaaaucagaaaucuaaaacacuuuugggcccaagaauuuuggauaagcgauacucagccuguauaagaauuuguacuucuguacuggcagacacaaguccuuucucugcuucucuaggauaggcugcaugucccuccaggaaucucauuuguaaguuuuaaguaacaaauggaaugaaaauguugucauagacacugugaugugcugcucucuaaggacugcuuuggcagaagagucucuuugcccuuucacucucccuucccaagggcagcugacaccaugacuggucaauguagugguauacuuagccccuguaucccaacaaggggcaacucugaagggucaccccagcuugagaacucugaaaaucaaaggcuggugucucagguauguuuauuauucuugaaaaauucuaaucuaagggcuaaaauccuauuguuauauucuuuacaucuuugauuguguuuauaucaucucuucuauugcuaaauuaugggcuccagggaagcaauugugucauauauaacuuugagucuccuauuaugugaugagagauuaccagaaucuuuuucaugguguuauaaauaggugauuuuuccuuccuaaacuacaccuccuuuuuaaugaagugaagugcauacguagaaugacuugggaaguguuucauccucuucuaauuucccacuuagucucauccacugaaucuagccauuaauguauaccuuguuuaaggccaucaaugaccccuguguugccaaauucagcaacuguuaguuugagacuuuaucaaacaagccccuucaucagcacuuggcaggcugaguucccucuccgugcugauuuacucucuuuucuugacuucccaugccuggcuacccuuauuccucccuggcugcccccuuucagucucccuugcugauuuauucuucucuacucaaauuaaauguuggaggccuuaagacuuggcccugagcccccuuccuuucuauucuauacauucuuucuacacauggcuaucuaaccuguucucauggguccauuuccuauaacuuccaaauacauagagaccauuacaucuaccuaccuaguccacaucucuacauaacugacucacauguaacaugugcaaaccugaauaguauuuaauuuucuuuuccaaauguauaucuccauaaacuuagcuaugcaugucagaaacauggagucugaauuaaugucucacuuuuucuccuagccuccaaguucuuaggagugagaaguccuacuccugguuaaaaaccuauaugugauucuugaggucugaccacaggcaguuacaaaggcuuuaccugguaggccucaugggggaaagcugccccuaccccagacuuggugcugagcuggcacacugcaguuucuaaagagagucauaguuaacgguucaggccccucaagcccaucgugcucuguguuauuugcauuucuggugcaggugccuuccauuccuaggucucuuucuaugugaggccuugggccaagguccucuucaggugccucugcugaggcugggauggagugggaaggaggggaaucuugaagacacuuuuuccccacccugacucagugcucaguacuuuucaacuccuagcucuuccccucaccuuaccccaacccagaaucuauacaacugaaaagccuuuguuguuguuuaguguucucucaauagugagcugagcugaacuccacaucugugcugauccacugacccucgauggcugugcuguucccuggggaaaaauggaacgggggagguggcgaauucuucuuuuagucucuuuguuauaccauuguagugagugaucaacagcuuaacaccuucauuuuuggcuuguugcuuuaaucagcuacuccaacaccugacagcucugcugucuccagcccagcuaagcuccugacaaccagguccuguucaguuuaucuacaaguuagaucuucaauaaauccacauuuuuccaauccccuugcugccaccuaacugaagccaccacuacuccuggcccagacuauugcucuagccuucuaccuggucuccaggauuugccuauugcucccuuccaagccauucaguauaauagagccagaguaauccuuaaauauauauuuuuaaaaucaucacuccccugcuuaaaacucuuuugauagcuuucuuuugcacuuagaauuagguaaguccuuaccuuuaugacacucauggacucugucugcccuuucagagugucuuguuucucucuucuucauucacuguacucuugccacauugucuuucuuagauggcaauaaccucuuuccccccucaaaaccuucagauaucuggccagugacaugcugagggcuggggguggaggagcagucagccuggacaggugggcguauuuuaucacugacauuguuuggaaugguuagagcaugugccuggugacucaaaagcaugcugucuuuuacuugguuuuauuauuauuuuuuaguucuauuuaaaccauauacccucuuuauugccugcaucccaugcugaccacucccucuccccuuccuuugcacaugucuguaucaugcaucuccgugugaauaucucauuuccccacuuuccauuuugacaacuucuacucaucucuugggcuacaguucaaauacaacuuccucaggaaaaccuuccaugacucccaauuuuaacuucgguuucucacuuguaauacuguauuuucuuaagguagaacuuaugacaaacuguaauuauguauuaauuuggguauuauacuugaaugugaauuucaucagggcaggcacuaugacuuucacauuucacauucacgguuauaaccccaggagccagagaagucccuggcacauaguagguguucaauacauauuuguuaaaugaauaaauggaugaauggucuguggaaauggaggucaaggucaggcaugcauuguuguagaagucaagaggagacagugcccugaagaagguauagacaauucuuuugcgaauucucucuauuuagaggaugagagagagagguguuuucaggaggcagaaauagggaugaaagaauugcaguauuuuuaagauguuauuucaagacucgcacaggucuaacugcuaaggaaaagggcccagcaaagaagcacccaggggugugcacuggaaucaccuagaaguuuguuaaaacacagauugcugggcugcacuucuagaauuucugauaugauggucuagggugugacugcuacuuugcguuucuagcaagcucccagggaauuccaacgcugcuggaacggggaccacacauugagaacaacugagauacagguuggagaagguuggauggggcgcuccagagcccagguggggagacuuggcccauguaggaggaggaacaucauccucgcgcauagaagggaggaaauaaagaugggcacagaugcagguaggcuuaaaggugagagagcaggaaguugccaaacugucugucugauggaucuuuuugccauuaugagguaggaacugaggucaaauaaugagaaucagaaaggagauuggaagguaggguuagaaguuagaggagaauagagagguuggcagggucauuguggggugugagaacugcaugacagaaacauauagcauugcugagccauguugagggcucaggagagagcagccauaccuuuguuguaucaaucugcuuguuugucuuuuuuguggagggcgggagcgggggcaggcgggcggcgacagagucuugcucugucaccaggcuguagugcaguggcgcgaucuuggcucacugcaaccuccaucuccuggguucaagcgauucuucugccuuagccuccuaaguagcugggauuacaggugccuaccaccacacccagcuaauuuuguauuuuuaguagagaugggauuucaccauguuggccaugcugaucucaaacuccugaccucaagugaucugcccgcuucagccucccaaagugcugggauuacaggugugagccacugugcccagccuaaaucugcuuuauuauaucacucgagcaacugaucagaauuauauaaaaauaagguucaagggcaaucauaucauuucacagguugguaucguaaaaauaucucaaauuaacuaagugugauucugcagcucuguaaggcacacaaccaagagaguccagaauggcccauaauugccucuaaacaaacccagagagauuccugugugucauccuuuuugcugaagauguuuuauuacauccuucaccgcuaguauauuuguauauguguuuaugaauacuacauuuaaauuuugcucauuuacaaucaacuuuuuuuuuaaauguagcaucauuuuacauugagauauuuaaaaaaauuucccacauaagaaggaugagauacagcaguacagaccuuuacuuuauuccacucacucuucucuguccuauccacuuguugaccccauggaaagagcuaucagcuugcucagguuucaaucuccgacacgucauuuugaguuauauuggcuaccgggagccaaaaguaacaagaaaggaagaaaacuggcacugaacaaauaaacaugcucucugcugguugugguaaagggcaggagggcuggaaucuggcaggcugucaagcagaggaagcuucugagcuguacaaggcugaacaaauagauggucuggggaaugaaaagccuggagcaccacugaacccaggcuuccacugggaaacugucauuggaaguuucccaguggaaacuucuuaagguuucagaaccuuaagaagaauauuguaguuuuuuuuuugaagucccuaguauuagagccaugugaaguacguguuaacuuuauuaguauugguucauuuauuugguuuuaauaaugaccucuauuggggauggaaaaggaaaaagaagagaugaugcaaauaauaugacaauaauaaaaauaauaugacaucuguuucaggagucaagggguguagagaucacaugcauacacaccuacaugcauacauuuagauucaaauagagaaggcuggugaucugacaguuauaaaauaauaaaaugcuuucauucugguuggugaauagccacuguucugagcuucucuauuacccccacuacccaggcuucccugcaccccacccccacauuguagcagcuaagggguuaauaucagcagagagccucuggaauucccaacccccacacuaaggucuccauugcgauugaccaauagcccauaccauauuggcuguuaaauguguugauauuaucccuguauauagauguauauugcauagaauuaucuccauauuauugcuugaugaugaauuaucugcaccggggucaccuggggcacuuuucaaaaaugcagaugguugaguuuuacauacugcacccacugcaucucuggaagaugggccaggauaugcauuuaaacuaucucccaggugauucuagggcauugugucaaauacagccugcauuuucuggcauacagcaaaccugucuucucucuagaugccaaguuccuuaaagggaggauccuaaguccuaaaacucuuggcauucaccacuaugcauagcuuagugcuuguugacuuacagcagagaggagaaaucauggauucagaaguguaugcugaaaauauaaauuggguuugaugcugcugcugcuauuguugcugcugcuucuggcugcaaugguuaacccuugugaguacuuacugugugccagauauuaugaaaagugccuugaaugccucaucuaauugaauugcacaauaauccuaauagguacugcuauuaccuacauuuuaugucugaggaaacugagacucagauagauggagagagcuucccaaaauuucauuguugggaggaagcaggacuccaaucuuggccugugugauuauuucaaagcuuauacucuuucuuauuugcuaagccauacuagcucuuggauuagaaaacaauucuacagauacuuuauaagucagauucuuugggguuaaucucuucaacuugcuuuugcuucaaauuuauuuguugcauuuuauauauguggaggggaggcaggcaugggagaugaagacuguaaaagcuguacucugacucacagaaaccaagggaaaggaaauugaauauagaaaguaggaggcauauauaaacauucucuaauacuugguaacaauuggaaacuuuuuagcuaaauaaaaauaaaaugaaauaauaaggcacuaacugaaaaaaagaaguuagaacauugccacugccauugaacuuugaaaaucaaguuaagaaaagaaaaaaaaugagguuauagccagaagguaaauaguaggaaagggagucaagacgagaauccacugucaagaaauaaugagggcaauugcgauuuuagaaagaucaucaaggggccagcuggugccugggcuugacaaugggcgagacaagcagcagccuggauguggagaaauuaaagcagcucauaagagauaguggauugaaaggcuaacugggcuuuauaugcaaucagguuuguuuugaaguauccagccaagaagcugggaucaaugagaucgcagaguauuuauaauuugauucugguuaaaacaucauuaugcacugagcuuaaugaagaauggcuaauuaacaucucuugaauguacggcaaaaagaauauauauuagaauugucuuuucaaggcaaaaacaaaccccaaaucaaaaucuguguuaauagcaucaggguucuuauucagacuucaauauaucaaucccagugcuuuuguuuagauacagauaacuuucuaaucaucuuugauucauucaugacauauagagaagacaaaauuuauucuuacugggaucagggcaaaauccccacuuuucaucucuuucauaacggcuugucguggcacaccacaguaagucaucuucccgaccuucacggguacauucaugaugccacugaugguuauacuggaagggaaacauacacggcaucccguggguguucccuuugauuguaugcaaaucuaggagaaagaaauguacaaagucagauaaguaugaugucagcuuuaucuuuggaaacugcuauauaucgaaagcauuuuuuauggacugaaacccucuuggggcagauacucacuacagcagagugagcccucagguccucacugucuccugucaguagaggugugagacugagugcugggcucagaggaagugcugauacaugguuugcuuaugcauuuaucuacuuguuuacuuacuauggugagcugucacaguaacauucauauuuguggauggaugagaaagaaacuuuaauggagauuuaacuucauaauaccuuccagucgccaaacacaucagccauuagcaucuaaagcucaauagauucauaggcauuuauuaauuuauucauucaauaaauauuuauugaacauuuaauguacucaguacuggggauacaacagugaacaaaccagcaaaaguuccuuuauguggaacuucuaucaaggagagagaaagagaaagcaaauauacaaguaaacauacaguaucauugcagguagcggugccaugaugaaaaauaaauaggaugagaagacagaguggggugugugugugcguguguguguguguguguguguguguguguguguguguguguaugugugagacagagggagagagagagagagagagaaagugagagagagggagagaugggguggaggggcacagggcacuacuuuggacaggaugggcagugaaagaccucucugaauaggaacugggugaccugagagugcaggucuuuagaaaagaggugauccagcagaaggaacagcaaguaaaaagaaccugagacaagaacaagugagggggugaaugaagaagaggaaggaggcccucuggguagggagccagggacguacuagagugucagugcacauagagcugucuccccgccauacugcgggcuuuggccucuacccugagggugggggcaagucucuugcggguuuugaaugggaaagugacaggaucagauuuacauuuuuaaagaaccacugaugcccuguuugcaaaggggcaaacagcugacauagggagagggugaagcgagacagcuggcuggguggcuucucaguggucuagagcaagucgaccaugcagacguggccugcuggcugccuucucaggguauugcaauacucggccauucuuggccuuaaucaggaaucaacaaaaacuuuucaugacucaacuggggcugccaaugguauguccuggggcaaaaggaccagcaguggagagccccaccucuuucccacaauuggcaggggcugaccugagcucaugacaugucaccagucaccagccuuagcaguuagggcuauuuaggaaccguagguauuucaggacaugcccuuuucuuucaguccccuuccuucuacuccaaagcauauguuccccagaaucuuccccugcaugcaccaugaguguggguauguggcuaaaaaguuaacauaaagcaaaauaucaaguuccucuucagaacuguagauuauucagagugcugguuugcagcacuugcuuuauuuuagugaguccugaaaaugccuggcccuuggcucugucucuuuuuaaucauuucuucuuuaggaguuccuugcucugcuucccaggaccguacagaauucuuaggagcauaugcucuugugaaagcauaauucuacagagcagcacgaggguaggggcuccaccuguccuguggaccuuuguaaaccaggugccuaguccagugccugaugaaugugggguggauuuguuagcagugcuauacaaaaaugcgggaugaauggauggauggauggauggauagauagauggauggauggauagagugagcuaccaaacaaaacgcugagggacagguuugagauuugaauuuaacuauguaacuuucuuuuuuuuucuguuuagaaaugacaaaaauaaccauagaaaaugaaauuccccucuaaaccaugcuuccccaccaaccaugcuuggcacacaccaaauaacccccgacaauagucugucauuucucuucaagugacuuguaacaugauuaaucacaugaaugccagccagcaucaggaggcauuggagguguccuggacacauaccuccauagguggggaugaguuuuuacaauaagagaaauggcggcaggggaggagagauuauuauauuugucaugacaaaagucuucaaagaucuuuuccuuccaccguccuuuucucucucccuccugucugcuuauucuuucugcucccuuccauugauucccagagucaguuaaauguuuuuccucccaauaccuuuaaauucugagaaguucugcuucuuuagcagaauguaguauguccauucugagacucucauaacccuuuuaccauaagcaaggaagcaacuaaaauguauuuagcagaagucccuugaggguccaggcuucguguacuucuuucacguaaugcuuuacaaaucuuuacuuauaggcaaaccuuaaaaaaacaccauucccugagugcuucuuuaaauuauuuuuaccuuuguguagauauucacaaaugucuccaccaccugacccauaagaaauccacuuaugaauauacuuccgugaggccaccacuguguugucaugcgccaccuggacagaguacugcagcgggccugugaucaucuuccuguuacagcgccaccguaaggaaacgaggguggagucacauucauauaagcuuaauggcugcucuggggcggagaaauucaggcccaggcaaccacugccuccuauguuaaagaggccaugguuugaaacccauuuccacagcaugugcuuguuugcuugcuugcaguucuccagggucagaaccgauuuaccugcuugaaugcauuucuugagacucucacuuuggauaacaaauauuccuuuaucugaaacaaaaaucaaagauguggcaugaaauuuucauauauaauuaacuagcgucaugaggaucucagugugcauaucuaagugcgauaugcgacaguugccagccauuucccacagaucuggaguuguugggcaggguccaccugaagggcuguauuugcauaaaacagaggaguuucuugggaagcauaaaaggucuuacuggagcuaaugggagagcucugaucuaagaccuaauuggccauaugggaacaaggguuaccugccaauccacucaggucuguuacugacagagaaggugugcucacacaauugguuagagagagggauugguaauaauacucagggcucccggggagggacacugggugccaauggauaugacaacacugucuuucucagacaagugccugaauguuaggaacacagcugcugaaucaagagccacugaaugaaacucucuaccaucaaguuccuauagaaaaccgaaaggcuaucagugaaaugcugcuuugugaucugauacgggauucaauacuggucagaauacaauguuucucaggaguacaaggguggagguggggaccucuugcuauauggggauagacucuuaguaggagauggcuugcuggguggggcaggcagaagcagguagaugcccaggccacuagcuauggcaccacaccuugaaacacgagaggugacggaccaccauuacgguggcagaaaccagaggccacauggacaggcggagaaagcagguguuuugugauaugccccuaagcucuccuccccggagcuggaagaagggauuugggugaguuucccguggaaaagcugugggacccagcuggggaauacauguuagcugccagccugcuaccugacuuaacccaaguugcgggccuggaaggcaccuaguacucaacaguuaugaacuuguuuucucacaggcuuuuugaagauggaaacaaagucucauuucuuuggucuaaguauggagugugcugggcacaugguggaaauucagucagugcuugcuguugaugaaacacaccggcugcugcugcuucagccuuuggcugcuuaagucaccucaguucaugucuggugaggcccaggcgcucuuuuguucucccaguagcuagguuccccucuucuauuuuacuuccugucuauucuucaaaacucugaagggacaagauaggguucccuccaaugucugggguuuagggcgggucauguaauggagggcagaacagguacaggcagaggcuuuggagagguuugggacagugcaggacgggccuccucauggauccacgagggaacaaugcuucauucugguaaacguucuuuugguuucuccaaaguuaaucagccugaggagaacugauuuacaguaaccaaaaucacuuaagauacuguuucaaaaagauugucaauguauuaauaaaugguauaccucaucuaauaguugaugaccuuaccuauagccauagauuugaggaguugaauuaguugucagagaauugcuuugaucaccauacauaagagcaaaagagagggggugggguggggaaaaugaaugguuuuagggagauuucauuuagaucaggaaauuuguuuuccuaaugagggccuugucugcaugguuauuaguaauagugauucaaaaucaaauccaccucucgucaaugugauauggaguccgauaauuaaccuucuguccaacucuccuuuucacuuuuucaugccuggguagaauguuuaccuuaauuucuguuguaaccuacuaaucacuuucuagcuaaccuagaguucauuaauuuuucauuaaaggauaauuauuuuacuauaaugguuuuguaguucagcuucuaccuaauauauauguucaaauguauuauaagcucugcaacguacugacugugccucaguuuauacaccucagauagguguguagacgaccuggcuagugguugagagcucuggagucacguggagcugucacagaccugcuguguaacuuugggcagauugcuccaucucagugagccucaucuuuccuccuugaacugggaauauguaugguacugaccucuuagggauguuaaggauauuccauugaguaacccaugaaaagcacaccacauacuaccaugaaaagccuuaggaaaugggagcuaucauuauuacuuuauuccucugacuuccugauucuuggucuauagauccagcugcagaccugguugaaccuacagagugcuaaucucaucaucccucaaaggcuucucuucuuacacuguuagcacaaaagcuuauuuuuacugcaguuucugcagcacacagugggugcagacauuuuaguuuuaaacaauccugagacaccacgcuaucaucuuuuauggaggaaaaauacucuccaaacaaccagauaacaaaauauuugccuccuuuguucaaauaugugugcaaugaugaauuaagagccuucaucuguugauuuucugcauuacccaccuguaaagucuacacuguagguuuuuuaauacgaaagagaaaaauacaugguguugacaagcaguguguagaugcgggaauggcuggucugugaauaaauagacaugaaaauuacaaaccuaacauuuggggugaauaaauauucuguggggcggugaguuugaaacaaggucuugcucugucacccaggcuggagugcaguggcacugucauggcucacugaggccucggccucccaggcucaacugauccucccaucucagccuccugaguagcugggauuacagguguguaccaccaugccuggcuaauuguuuguuuguuuguuuuugguagagacaggaucucaauauauugcccaggauggucucaaacuccugggcucaagcaauccucccaccuuggccucccaaagugcugggacuacaggugugagccaccaugccuggccaauaaugcuuuuaaacuuccaaauuaauaaauguuaagagaaaaagaguggcagaaauuggaacuucuguagucacaccagcaaucauaaaaauaccuuuccaaagcagaacauauuagacacaccuaauccauugcugcuuaauuuuggggugcuacuuauauuuccacaccagcugccuuuaggaaauagcuuuagaaaaguucuucagaaugugccauaggcaaguagcucugguucaccaauaauaaucaacaugcugccuccaaauauacuaaguuaaaaaaugacuugagcccauuuuuccauuaaguuauaauagaauaugauccuagcacuguuaaucuccauaaauucacugaaaagaauuacuuucaaauagacugugaggagacuuaauauagguaucaauauucugauuguuauuauaugcacauaaugucucuaacaaaacuauaaugugaaaauaagccaccaauccuuagugugcauaguuguuggauuuuuuaaaagaugaaaaucaaaugugggaggaaucaagauugauuauacaugucaaggacaucaguucugcuugaacacugauuaagugauuaaugaaguacugccagaauuacuaaaucucuuugcaggaaaauguuauuauacuucccuucauaauuauaaguuuaggaggagaaaaaggauucauuuauuagaagaaacauuuuuuuuuuuuuuuuuuuugagacagagucucgcucugucacccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguucuagccgggauggucucgaucuccugaccucgugauccgcccgccucggccucccaaagugcugggauuacaggcgugagccaccgcgcccggccagaagaaacuuauaagcuaauuucuauccuuuuuuuuuuaaauaaaauccauggaagacagugguucuacuuucuacuucugaguuccuuuaggaggagaccauuucagauccacucuuuggccccauaagauaacguguacucuucuaaggagcgggaggagaauguuucauugaucaacuuuuaaaccgaaguuuagguuauuaccuuuaugacugcauauggaacauucauucauucaacuagcuuucauuggaugccagcuacuucauagacacuggguaagaugcuagagauagagagaaauuauuugccuaaauaucuguucuuugaaacuguauauauuuguucuggaaucaugggaauuugccuagcuaaugaaaagaagggaguuccaucaguuccaaagaaaacauuauaauugcauuuaaaauaagcccuuaaugguggggcgugguggcucacaccuguaaucccagcacuuugggaggcuaaggcaggcgaaucacuugaggucucuacuaaggauacaaaaauuagcugggcgugguggugcgugccuguauucccagcuacucgggaagcugaggcacaagaaucacuugaacccaggagguggaggcugcagugagccaagaucaugccacugcacuccagccugggggacagagcgagauugugucucaaaacaaacaaacaaaaaacaacaaauaaauaaaauaaguucuuaaaaacaagugauaacacuuacaagugggagaugaacaaugagagcacauggacacagggagggaaacaacacacacugaggccuguggcaggggcaggggaagggaaagcaucaggauaaagagcuaaugcaugugggcuuaauaccuagaugaugggaugacaggugcaggaaaccaccauggcacacauuucccuaugcaacaaaccugcacauccugcacgugcaucccagaacuuaaaacaaaauaaaauaaacaauuauuuuaaaagauuuaaaaaaccaagugauaacaaauaagagaaagaaaauaaacccaaauuuaagacccugaacuggcucuucaacugaugucacaugugagguggacaagaccccucagugucaccagacucugagcggggagugugcacacacauguacuugcccacuuucuagggaggacaaagcagggcagugcuggaaggaagacggguguggcagaggagacucacuucacccauaaacccugaaccgugaacuucagagcuggauggaacuguaaagauuauuuaacugaaccacucuuucacuuuuuuuuuuccaaauccauuuuugucuuagaaguuuuauaucuaucuacuauauucaguccagguguagcuuuauuuacaugcauucauuuauaacuuagaagaaaauaaacugcuauagauuguugccaaacauuuugaaguaggugacuugaaauuucagacaacaaagaucuaucaacugcuugauguggcaugguuuaggaacccugcagacagaaggauauauaugucauaguguuugccugcaaggaagucacauucucccugggaaucccugaaaugcacagaaagaaauuauacccuaaugccaaaauauauuuugacauaggagauauaagcaaaagggggugccaugagguuggagucuaaagccuggggccauuauuacaguuugaucugucugugugaacagcagacuggagguaccuagaggaaguuucuccugaggccucugcacuugaccaucugcaccccuucugaucaccucuacuugccuuuaguguucccuuuagcuuuagacagcucuucucuuagaacuagcugagugaagguuugaaguguuaaagugaguaagauaagauuuguacuguuaagccuuugugaaguuuccgcauuuuuaacaaaaaacacuuuaaagaaacaauaaaacaacaauuuuaaugguggcauuuuaggcaaacaaaggacuuucugguauucaauaaauuacaccaugaagguguucaccuaauccaacuauacacauaaagucagucucugugcugcuccauuaagggaacuggaaggaaaaguuccagugcaugguucacaucaagugcaaugcuuaagacaagcuauuagaaagccacagcaugcaggcugcaacccaauuucaaucuccuaccccaguccauagguuugaaauugcuucuauuccaucuacccacagagcuagugcugggcucaagcccuuccugcccggcagccugucuugacucuguccauuuccuugcuguucugacauuauuagguuucagcagggaugcaguccagaaggaaauggggagggcaucucuccucuguaaccaaucuggaggugagcagcuucucucuugagauguacugaccuuuuccagcuucacaaauuuggguuugucuuuaucuguuccaucuagugaacaauggauucagagcugauuacguuccuaagauuacucuguagcaggaaggaauacuguaagcugcugaaucaaguccuauucauggccgagugaugcagaaaaucuguauucuuaauaugaccuuucaaaccaauaagugaggaauuucucaugcuugcagcaagcagcaugugcaugguucuucaaagaagagauccacggaagaaagugaaaagugggccagcccuuccuaccucucucucugcauggaaaugugcauuuuaucugaaaucaucugaguuuucaugugucucuuauucugaaacuuuugaguuccugucaguugccuucuauuaaucaacuaaaaaguuacccaaguacauuuuuuaaaaaaccucuuuguccugucucagaacuuucuucucuuucccuguccuagcauuguccuuaacucuuagccuucuuuauucuccuacagcuucugaaccuagauaaucaccaucuccacagggccguggaccgcucuugcuaaaucuuuuuacauguucucuuccauuuucucucuaaucucaccuaauugccucuccaaguuucaugaggcacacaauagucuuucucacaugagggaaaaaugaaacccagcauaaucagugccaccggacugcaguucugugaggcuucaaauugucuguuaccaaccccugugccaggagggguuaacccuuucagacuguccuugccacucccuggccauucccguucccuccucuguccuccugcucuguccucauuuagcaguugcugacccuggcagaaaaucucucuuccgugauucuuugcuagaccucuguaucuuaccaaugaauuuuuaaacugaguugaaaacauuuuucuuccuuuuagcuuuuagucuauucucccauuguuuugccuuuauuuaacuggaaaguacuuaacaaacauugcugguauaaaaaucauuauucacaacagcucugugauuaucuuauugacucuguugaaaauauaccaucucagucaaaagggugccucauuacaaagugcaaguuagggcaaggacaaaaagacagaacacuguuaagaugcccucacaaaugccugcauauuaaagcccagggggaaaugauucaaagacugggucacaaaaaccaacaaaaccagaaaacaacuccaucaucaaccaaaacaacuccggaaaugauauggcauuacugaaaacaaaagugcuuacaaugagcuauccaucuuagccgccuugggaguaugcccauuaaaagaaaaaucauuuacuaaagugcaagguagaaauguuaaaaaacaaacaaaaaaacaaacaaacaaacaacuuuuagugguagauagaguguuagucccuguaucgguuugcuacuaggguugccauaacaaaauaccacaaacugaguggcuucaaugacagaaauuucuuuucucauaauucuggaggcuggaagcgugagauuacaguguggcagggaugguuccuuccaagggcuaugagggaaggauggauuccuggauucucuccuuggccccuagaggaccaucuucucccugugucucuucacaucaucucucuaugcauauuucuguguccaaguuuccccuucuuaugaguauaccagucauaauagacuagggcuacccuaacugccucauuuuaacuuguuuaccucugugaagacccuaucuccaaguaaagucucauuuuuauacgaauuugguggggggggggggaacaauucagaucauaaccaucccuaucauucuuauucaggcugucuacaucauuugcaggguccagggugcaaugaaaauacgugguuuuggcuggacauggggaagucaagucaaugucccuuucccucaggcccacaggagauugcaaccucugagcuauaacgugcuuagaauacaguaccuggauugaggauaugugagagguucccacucagcccucgcagaacccacagaagugauaucaguacaguggugacaaauacugccuugcacugccccgaaaugcuacaaggcauccacucccagggcccaggccuccagucccccaacuucaaugcaaccugguugccacugugugcagcaggcagcaucaauuguagggcaggaguugggaggaggcagcugagaacccgucccgggagguagacaggggacaccaggcagaauugaacagaggcuccaaaccucuggcucaaguuccauuguuccauuggacaucaugcgcagcacacaaauucaaagauagaaaugauuaugaaucccaagaccccaaaccauggagcuuuaaacccuaaguggaaggaaggcccuucugaguauagggcccugugcaacugcacugguuacauccccaugaagcucuccuuguuugcauuugaacaagauuaacauuauguaaaaaagaccuuggcaaacuaccgagcacuucuuucagggcagaacugcuuaaaaccagaagaguaucugccuugguuuucccaucugcacaauggguuuaauaguaaugcuggggcuggguguguaguucacaccuguaaucccagcacuuugggaggccggggcuggaggacagcuugagaccaggaguuugagaccagccugagcaacauagcaagaccccuucuuuacaaaaaguuuaaauuuuauaauaaaaagaaaaaaauaauagugcuggccucacaaggccuugauagggauuaucucagucaugaugaucacuuuauaaauauuaauaaaaauaaaagccaaucuuaacuuugaauaugaauggugccaaagagcagcaaaaugaaaaaauguguauaguuaaauaauuacuuugaguuuccuguuuauauuuucaugauugaaaaguucucaagagcagaauaccaaaagcuagaagugguaacacuauuuuauuuccauauuucuuuggaacuguaguugucuaaaaaguaucauaaauuaaaaagccaaguggcuaugacuuuucugucuuguuuagcucugugucacagaacccaaguuacagauauucuaaucauaauuuucuaauuuucuugaguggcuuuauaaaauguuuuucccuaaaugacuuaauauaguguuuauaugguguucuuuuguuuauuuuaugaacaauaauauuucuuuuugcuuugaucaauucaaaauauaauuuaugcuccuagcuauguguuggaacaucuccaaaaggcucucaaggauaauuucuaaaaaaaaauggagggaaggguuuauaaaugucuuaaaucaauuacuuugauagauuacaugaggauuugcagcauuaggauugaguucagaagaggcaacacaaggggaccguuucuucagaaaacuugauauaaauaagcagauuguuaggucaaagaaggggagcugcagggacaacuaagcuaucuguguggccccaucuuuccugugaugggcuuggaaccugcauuguguggcaucaguuacugugacaaccaacaauaggaaaagaguuagaggcuuaacaagaaagaguaaauaggaccagaaaaacuggacaucuaugcugacucacaaaggcuugccaggaaaggagccaggcagagaagguaggaugagaaaaguaugaaggggaagaaaugcgagggaugacaaacagaaaugggagaaacggagucaagaaggcuggcaugauucagggccaggaagggcagcuaaaccacuauccgaucacgcuuuuacugaaauuccguuuccagauuaguagaauggcucauugccuagggacaucagaauugccuagaacaauacauaaaucaguagcuuugcacauuucugcuuuaggaaaauaucacucccacauguggaaggagggguuuggaaaaggaggaguugcagagaacaagaggcuggccuccuauucuuccugcugugaaaccaaaucgcaugcuucugucaugcagcaggauacagaaugaaccacaccauggggucacaaggcuauucagggauccuuugcauuagugcagagugcuugguucgaauccccaugcugcaagcuccugugggcacaaguuacuuaacccuucuucaucuguaaaagaaggguauguauuaauguugccuaccuguuuuggugaggagacaaugugucgauguaaauaaaacaacaaagaguaacgacuccccagcuguuagaaaauacuagaagcaguagaggggcauuuuuaccuuuguauuagaaacagaagcuaugcaggaaaucucagggcuacagcuucuccccacugccgccuccagguaguggcucucaucgcccucuuucagaagguggcagcuaccccccuuccucgccacuggggcccucugcccugaaccauucuuccccccauucaccauggcuuugauaccagcagacuccccgcuauucuccacaccccaaagccacuuuagcuuccauacagaugacccaacacucugacucgaugcuuuccccacugcagguuguggcccauuuauggucuugaaaucaacugaauguguuaugaccagcgagacaaaacgaaacagaauggaacagggggaaauguagcagcaugucauauuagguaaggguauuuuuuaaaaaaugaaacauuguuucaguuauacauauguagaccuauaugcuguggguugugauguaaaauguauuucuuauugugguuugcugacaaaagagucccaaacucuacucgacuuuagcuuugcucuggacauugggcucccugaccuccucugcugugaggaccuucuuuugccucuucuucacuuuggugaccacucccacaaacacagcuuggaucuggucacuaccaagaauagguccaucuccaaaacuuggauuuugcacucuauaaccacuaccucuccuauucugcaaucuucccucaucuaacuuucacuaacuguuuucuuuuguuguuguuuuuaaauauauauuuuccucuuuuuaaacccuguuucuugaacccaaacuuucugcuccucaaucuuccuauugggacugacuuagcucagcuuuaacuauccagacgguuucuuugcugccuuccagaauuacccucuucaaggugauaggagacccucuucaagucccagacugaacauggcacuucuaaacuuaaacaugcaaucugguuccccuuugugcaaacccacagggcccuucucagcaguacccaauucacucagccagacuuuuuccagaagcagggugccuccaaccaaacucuuccucaucucucucaugcuuccaacuauagacaugucacugcuucuuguuuugccugggacccuacucugguggucuauaccauccacagcccuggaugaagcagcauccaucccuguguccaccuccugccucuaccauggccaauuagccaggggaaggccuucgacuugagggcagagcacaggaacuagcuagcaugcugugaagaauguaaccagaccccucuccuaggaaauuaagggacucuucccaggaagcuaagggagcuacagaggaaaguccuacuagucaaagccaaagaaacagucaacagaaagaacaaccaagcaggaaccaccauagagccccagagacagagagaaacagauaaaguaaugcuucaugucaguggccagugccuguuucccaggaggccuggcugcccugaagaaccuguccugggucccccuugagauccugggaccauuacaaccaacuccacguuugccugagugaccuucagugggccucuuuccuugaauccaaaagagcucagaagggaacuuucagcucacugaacuuuuacuguugccugacacgugauccugggccuuugcacaugaaauacauguucccaggaaugcucagucuccuuuuuccuauaugguaacugccuacuuauccuuuaggaaaacaaaugucuuuuuaugagccuccagcuccccaggccagugccuccucugcaugccuucagcacuuugcucaucccugguuaucauaagaccucucucacuguuuuguaauuguuuauguuucuguaucugucccuggacucucagccucuuggggccagugucauauccuacucauguuuuuaccuccccaaucuggagguggguagcagauucuguugguuuccuucucacacccucuaaccuggagcucacucaccugcagacaguccucgugcacucccacugacuuucuguggcucucugccugggagagaccaggagcaccagggggugaaugccccaggagugaccuuagucaauaagaggcgggaguugguggauaaauacuucagcuuccugcccguugguggguccacugaguucuauacaguuccucaaaggguccuuugugaaacugagccccaguggucugugguggcuuucuucccucucuggucucauguccucacucccuuaccaugcuuucuagaaucaccuccaaaaaaaaaaacuacuugcacccuaaggaaaacaugucucaggaauugcuuuuggaugaacccaacuaaaacagguagauaaagcacauauugccugacagauaaugaacaacugaggccaucagccccuaccccucuuuccgucggcgcagcaugucgagagacaccccguacacccaacccuguuucacuuucuucuccccagauaggaccugauggcaagcacacugaccacacacucaucugcacccucaccuccuuugaucacuggucauuuagaagagccuccccugaguguccccaggcacugacacagacuuagguucuuuccacuccugcucugggaagcugagcacuacagaaggaaacucuccuacgauauauuagugggggaccauuucacauuuaucauuuuucaacccucaacaaagcuucaaaacccuuuuacuugcccccugaucauuuccuuuagcaaugacuaugcccaguuuucaccaggaugcuccauccccuucuucuuucuccccgcuguccacuuuguaucuggaguacuugagugagugaaguuagugugucuuagcacuugcuagaagaagggcucagauucugaucagggaaaacaaacuaaaaucaggcuccuuggaauaaccagcuagagcaaaggucccccaccuuuucugccccaggcacugguuucacagaagacaaauuuuccacaggccaauggggugguggggugggggaugguuuugggaugacucaagugcauuacauuuauugugcacuuuacuucuauuauuauuacauuguaauauauaaugaaguaauuauacagcucaccauaauguagaaucagugggagcccugagucuguuuuccugcaacuagacggucccaucuggggugacgggagacagugacagaucaucaggcauuagauuaucauaaggagcucgcaaccuagaucucucacaugcacaguucacaauaggguuuaugcuccuuugagaaucuaaugccaccacuggucugacaggagguggagcucagacaguaaugugagggaaggggagcagcuguaaauacagaugaagccucuuuuguucacuguugcucaccuucuguuguguggcccaguuccuaacaggccacaaacugguagguggccuggagguuggggaugccugagcuagagguaggaggagaugaguuucagaccugccaaguacagugcugugcaccguaguaaguaauuguuauggggcugucaaccugucaaaaugucuggauuggccagaggaagagggugccauggugagagagcagcaaaaggacaacacuuagauguguacuauuacuagcuccauuuuacagaugaggaaacugagcuacugacuggcaaaauaccuguccagggucacacggaugguaaauggcauagucaggauuugaacucagaucgucuagcucugaagcccgagaacuuaacuacuauauaauacuguaucuacugacuuuugaauacagaauuguauuacuccauuuucacacugcugaaaaagacauacccaagacugggaagaaaaagagguuuaguuggacucacaguucaacauggcuggggaguccucagaaucauggugggaggcgaaaggcacuucuuacguggcagcggcaagagaaagauaaggaagaagcaaaagcagaaacccuuaauaaacccaucagagguugugagacuuauucacuaucacgagaauagcaugggaaagauuggcucccauaauucaauuaccucccccugggucccucccacaacacgugggaauucugggagauacaauucaaguugagauuugggugggggcauagccaaaccauaucaagaauuauugauaaaucauuggaaaaucaucacaguacaauccaucaucugccucccaaggcuggcaugcuuguaauacauaucagaucuacaaauaauacauaucaaacaauucagauaaaaaaugcuguauguauaaucugcugugcauuauuacauagccauuauuaguggauuggaaaugaaaaugagugugcauuuuucucucaguugcucuguggaugucaaucguggcuaaagugagucaaugugguacagugaacacagcgguaaacugaggcaccccaaagcauggcuaacuacaugguagccauaccucaacuuccacaucugaagaauagagggcuagaguagacaaugucucagguucuuuucaauguuaagauuuuguuuuuccauuuuguauugacaguaaaaacuugacuucaaaccuguccagcuuacacuugaaauucuacucaugcaggugacuggagucagggagagagccugugccugugcgaggaaugguacauaaccuccgugcuccuuggaaaaucagcagcagcauuuucauaucugaagaaucucuaugccaacuaugucaaccuuuucagaugugcaaauugcaccuaguagguacaagggcuagcagauggcucuaauuucagagugcccuugacuacuaaaaagaaggcacugaugagaauuugucucaggccaguauuugguucugcuacauauagaagggauuagcccuucacucggaggaucaccagcacauacucucuguguggcccaguccaacuucuguccugugggcugcugcccuguucuaccaccuagugcccaggcaaaacccacauuuuaaaaugcaaaggaauaaccacugcaugguaaacuuagugggaaggaaucauacauacuacaggaucagaugugcauccacaggagcaauuuucugaauugaccaagaagguaagagcaucucugacuuuggucacuuuagaauaagaauggucuuguucuaccugccccugauuaagccuccagggagcuuaggaaacacagucuagaaaagacuaccucaaaaauguagacauauucuacuguggaggaaaaaaugugaacgcagauauugaucacaucuuguguuaccccuucucuccaaacuuaucuccaaaggcagagaggauggaggcugucuggaggcuccuccuggcauauuuaacucccuccugucccccuccuacuugcauauauggacuucugcacuuaggcgcaggcuucucugccugagguggcccauucucaaaugcgggccccugcaggccagaaaucucuccucccucucuuuacacaaccuucugagucucauguguaguaggugcucaauaaguguuugcugaauugaaccccguuuuuccacugagagagacuaaggcauaaaggcuucagaucacgcaguucauggagccacuggggcuucucucccucaccuggccugauguuuucaggcggggugcggugggucaggccuguaaucccagaacuuugggaggacgaggugggcggaucacuugggcccaggaguuggagaccagccugggcaacauggugaaacuccgucuccaccaaaaauacaaaaauuuugcugggcgugcgggcgcacaccuguggucccagcuacucgggaggcugaggugggaggaucgcuugaccccgggaggcggaggcugcagugagccgagaucccgccauuacacuacagccugggcgacagagcaagacccugucucaaaaaacaaacaaacaaaaaaaguuuuccuuaaggaagggauggacuggggaggccuggcuugggggucacuccuagguggcgacgcagacccugagcgcuugcuuugcaaggggacgaacugagccaucuuuuugcuaucauuuauccgucccaaauaagcagcucucagaaaguuuccguuuugaaacuucuccgacacuccuaucccgggcuggcuccgggcgccagagccgagaggaguuaccugcgagaccaagcccccccgcccccgccgcccgacccccgcaggagccaggagggugccgggccgcgcaaguggggugcugggccuagacaagaggcugcaggacaccacccgcuccccccaugcucaggacugcugacacacgaaccccuacaaacgcggccgcccuugcccgccagcuuggccccuagcuucgccccuucuuccucuccuucgaccaccccgaccccccuccccaacguaccgauccaguccccgacccugggagacucacccugccacuccaggagccgcucggggguaagcgccgccgccacacccucggcgcagccccgcggcgcccccagcagcagcagcagcagcagcgacggcgacagcagcaucgcuaaccacugggcucuccgggagccccuugucccgggagccccuuaucccgggagcccagagccgcgucccaagcacccggccccgccgcgcggaagcggauccguagccuccuccgcgccccacccccuccgggggccuugccagcccagagcccuggagacccacuccgcc

SEQ ID NO: 21355 - RNA, 90950 nt, Homo sapiens
cuccagcuccacagcagccucccgggccggcuccuccuccuuccaggucuccucccagugccgccgcggcucucaggccugaggugcggcgcucaccccggcaguccccagccucagacgcugcguggagcggcggagccggagggaagcaaaggaccgucugcgcugcuguccccgccccgcgcgcucugcgccccucgucccuggcggucgcuccgaagcucagcccucuugccugccccggagcugucccgggcuagccgagaagagagcggccggcaaguuugggcgcgcgcaggcggcgggccgcgggcacugggcgccucgcuggggcggggggagguggcuaccgcucccggcuuggcgucccgcgcgcacuucggcgauggcuuuuccgccgcggcgacggcugcgccucgguccccgcggccucccgcuucuucucucgggacuccugcuaccucugugccgcgccuucaaccuagacguggacaguccugccgaguacucuggccccgagggaaguuacuucggcuucgccguggauuucuucgugcccagcgcgucuucguaaguggccgcacuuggaacuggagccggcccccucccccaccgcgcgcacccacccagcguuucuccauugggauugauuuccgagagaucccggcgucugucugucucacccauccuaccucucagagugguuuauauccuggguggaggaaauauuuggggaaaugaacucccuuugguacccaucacccaguuacaccccgcuucucaccucuuaaaauugguuaggggcagcgggagagcuuugaagcagaccugugcuuaaaaaucggggaaagugggaaaucaacaaaggcuggucuugccggacuccccgccuccugugccagugucgaggauuuggucaauaucauccccgaacuucuuuuucuccucuaccaguuaggcuucuugguagccuuuuucugcuuuacaggcuuaacgcccguccuuuucagucucccuaaacaagcccucccccacucuuuccgccucugucugauucuguuucuccuuacuccuuuugcagacauucugaugacuuaaaaugaccauacuguccuauugaauucauugugucuuaucucugggacugucagacauuugcacauuugagguugaacagaugaauugaaugugucaucuguucuuuuuauagugauucacuauuuaggucauuguucagaaggaacaaggguguuugcugaguuuucacucgcugcaggucauuugaauacugcaguauuuaauaauucaguuauguuuucaaguugccaacguuccgcguugcaagggccgucaggauuuauaacaguuauugccauuauuguguuagaaauugucuccgacuuuacugaaugcugacaucauucucaccaccccacccccauguuagcguuaggaguacuguuuuaaugaauguugacuguuuuuuuaaugauguuuaaaucuuguuuucaagagagaaacuguucuuagggugccuucuaaacgcuuagaccuuguaacaacauauuuuuguuuccauauuuucuguauaagauaucccuucggggugaaguggaggaaaauuuugacgguuaguacguggauaggaccaucuucuacuacacacaugccuaauuugaggguggucucaaugguuuucuaugacuguuaggacacucagcagaauuuagucuuaguguuuuucugaauguuacugaguaucauucauuuugguaacaaccuuugcagcaauacauagauuagaugcaguuaauggaaacuuuguuaguggagacauuauuuuauguagcaagcuuaguuuuauuuguuguuagcaguuacagugcuuucugugagaccuggagcacagauuuuccaacaugauaaaaauaaucauuauuuaggcaacauuuaccaauuucacauuccauuuagucauuuuagucagcauuaucuuuuuauuuauuguuuuuaaccacaggggugaauaccaaacguuaucuuuaaacauuuuuguuuccagauacuuucaaguguauaccuucaugagacagaacauuuuaguugcucccaaggguucaaugugagauauaauuuguagagaaauucuaaugauuuugaaaauauaugucuucagucaaaaauuagcauuuaaauacuucaggccaggcacaguggcucacaccuguaaucccagcaccuugggaggccaagaugggcagauugucugagcucaggaauuugagaccaaccugggcaacauggugaaacccugucacuacaaaaaaauacaaaaauuaaccgggcaugguggugcacaccuguaauccucgcucugcgggaggcugagaugagaggauugcuuggaaaguugagguugcagugaauggagauugugccaccacacuguggccugggcgauagagagagacugucucagaaacaaaaacaaaaucaaaaacaacaaacaauaacaacaacaaaauaaaguugauggcaguguuuuacaauguuacuguuaauucuucagcagugcucugaguuuaguguaagauaaaugagaggcugauaaacuuuaaguguuuuuuuuuuuuccaugaaaaaugcagugauguugaacucuucaugauauuugcuacugcugauuacaaaccagggugacuaaucuuuggccagucauuauaaucaaugaauguguuaugaccucacagguuuacaugacuucacucauagaccuuuaaugauaaaguaaaauugaacuuggguuugguugcauauaauauuuugaaauauucaucagcaacuuuguuaccgauagacuacagagcucuagguauagguaacuuaaaaaauggaaaccaaccuugaauuuuuuucuuuuuucuuuuuaaacaaaacguauauaaacacagguuuuuacuuacugagcuuuucagauuuaacaaaaauuuauguaaaauuuugcugaauuuucuagaagggcacuuuaaauuuaacaagcauuggaauccaagguacuugggaugccauuuccaauauuaccaguuggauuuauuguuauuugguauuaccauaaacuuuuaaaagaaaaaaagccacauaaugaaaaaguauuugucaauucaagagcgccuuucuucugaggggagaaggauuugugaggagcagugguugugacguccacuccuguugcuuuuuccaguuuugguguccacauaccuuggggaagcuguagaauuauuuuaugccuaauuuuucucuuuauagaaaauuauuauugaauuaucugcauaguucauaguuuuguugugaaaauuaaugaaucaauauuuauuaaagggaaggacaaaguacuaagcaaaauguuaaggcggccccucaaaaaaucacuccagaaaugagucagguucgaaguaaaaauucacaaauauagugauuuucaaaauuaugaaaaaacauucgcauucuguuuuuuuuucuauaagcauuuauuuaugcuauguuguaaaacuuacauaaaauuuaaagauuguaugcaggcuaauaauuagagucauacuuuucuuguggagacuaauuggaaaaauuaaaaauuacauccuagguuuaauuauaaugaugacaucuuauuuugguaaacauauuuuauaauuugcuaagcacuuauaucucauuucauucuauagcccacaccaccggggggaaguaaggggaagcagauauacucauucuuacagaugaggaggaaauggaggcagaaccguuugcagucuaguuauuugaguagguuggugugaguagaggguaaggaagggaaggauccgaagacaggguguaaaauucaaaucccacuuuuauuaauucaaauauugaauuuuuaaagaaaauaacugaacaauuuuaaaauucauucuucaaauauauguuauacaguucucauuuuauguauuucuuuauuuuaaaauaaugcuauaaugaaugacacuggauucuugccuuuccccccauuaaacgcuaauggagccuuaucuuacaguuggcaauguguagauguguaugccuuagaagcagaagguccuucaaugguucucaguccuaacuucauguuugcaauaucuggaaagccuuuuaaauaaaacucuugcccuggcuguaucuuaaaucuaaaaguagaucucugacuugauauuccaguggccuggccugugaaucauuucucguugacuagccugucuuaacucaauuugacuaaaaagucuucaccaagagauguuaguugcaccucuguuucuauuaaugcuggcaucauuuucucugucaccuuggaaauacuuucauauuccucccucucauguucuauuuuucuguguuucuccuacuucaccaccuuaauaucagucagugauuagucaacaggcagaagcuccuagaaauucuuccuuuuuaagguuuucuugauuccaucucugcuuucuacuccuuauuucaguguaguuaugacaagcauagucaguggcacucagguccucccccaucccucugcccaucauuuggcucuuaaacgugcagaacaucuugucuguuucuauucauuuuaucuuucuguaacauccuuuuucauccugguauucuguugcaaaaauuuucauaauaaagcuuccauugccagcaagaaaguccaaaccgcuuaacauggauuaaggucacuugcaaucugucccaaccuguguguauuuuuaaaacuucauguaccauuucuacucuuaccauuuuaacccuuuucacaacacuuuacaaaaugaugccagcucauuuuuuauaaacuucagaguagcucugauuauauuggcugauuuuucucaucauaaauaauauacauguauauuaggggacauaaaacuaggcuauaauuuuguuauuuagaaagcaaauccuauauuacuucugauuaaggacauaugauguuucauagagcauuaugaaagacaagggaaaauauguggaaauuguaguuacugcuucuguuuuacaguaguuguugacuggcauuuuuguuuuucuuuugauucaaaaaagcauuuuuuaaaaaaugaaaaguaaaucugaaacuggaauuguagcuuugaaauaacauucaguacuauuucauacacauuuauuucuauauacauguaugauaguuuuucagaaguuccuuuuggugaaggcucauuggucaacucagagucagcuaaauauauuaaacaugcuuuaucuuagaaaggucagugcugaaagcagacaaacaaguuaguuuauuuggaggguuugaaaaauggacuugucauuguuuggcagguugccccuccuugguugucaaggucacauuccgugaaucaacugcccuucaaguacaguuuggauagggagugcauccaaaggccauccuccugauugguuccucugagccucuugucugucucccucucacugccuccucugauaccucucccucuguaucgcucucucuuuuuucuuuuucugucucuuguccuuccucucuuuuuccuuuccucuaucucuuuucuuccuuuccauccaucuuucuguccucucucccaaacucaauccuuuauauuuuagcacuucuuggcauggauguaaaccuuaauuuugaagucccagagaguuauuuaauggcaguguuuccagucauuaaaaaaaaaaauguugaggauggggauucugaugauguucuuggacauacuuuuuggagggaaauggagucuaucaggagagaguugcgggcauaggaaauuaagucacucagcuucagauuuacacugcuaaucagugaaaacucuugucaaccuuaccucacccuguguauucuccccaccucgccaccauugauaagaaauguuuaagcuggcuuuucuacccuucuuucucuuuuucuucuucauuugaguuaaucacuugaccauuaauggcccuuugaaaacacugaggaaagaaaagcccuuuuaaagacagaauuuaaguuuuacauuuucuacucuucuagggaauaacuuauuaauggcaucaauuguuuucaggacgaagaugauaauuaaaucccaucaucuuguauuuucgugguguuucagauuuucuaaguuugcauuuauuuauuaucaccuucagaaaguuucuuuuuaaaguaauuacagugggcauuguuauugccauucgauagaagggaacagagauucaaaguuacugcuucaauugauuugcaguguuuguaaauuuuaauuccaaacuguuuccauuagauagugcugcuuagaucacaaacauuuuuuuucuggucugucaguucucuuacccuaauuaagcuguuguacacuuucauuagucauucuuagaugaaauucaaguaacaauuauuuuuauggaguguuuuauuaacuuuguuuuuuguaguauguguugcuuuuuuuuuuuuuuugagauggagucuugcucuguugcccaggcuagagugcaguggcacaaucuuggcuugcugcaaccuucgccuccuggauucaagcaauuucuggcuaacuuuuguauuuuuaguagagaugggguuucaccauguuggccaggcugguuuugaaccccugaccuuaagugauccuccugccuuggccucccaaagugcuaggauuacaggcaugagccaccgugccuggccuguguugcuuuuuauuccuuaauuuuuuuauauagcaucuuuuaucaccuuguacccaguuuucuaugcaaguauuucuuuuucacuacacagcuuccucguaagacuuuaacauaugucuaaggucauuuuacuuucucuaucucuucauuguucucuuuaaaaaacuuaaauaucuuaaugauaacuuuaauaucgagauggcauuuuggaugaaaaacuucaucagcuuuuuucccucacaaauuuagcauguagauauugacacauuccuuuuauauuauucugccauuucuguagcauuucaccaguaugcaagucugcacaugaagguaugcuuaggaaaacuuaaugaacauccauuuguacaccugauuaccaucauuucaugccuauaaugugcagauagccugaugaaaagcaacaggcuuguuccugguauuauucaaggaacucaugcuaugugcugccaauagagugguguuuucauucagagaaugcuccuacugggcucuuuuucucugucuuuguugaaggccuucuccuaauaacuuccgagcucucucugucuuauagugccaaguaaagaaaguaucugaaacccaaaauuaaguagagauguuacacaaggaaauuguuuuaaggguaauuuaaauaauuggauguuuaauagaggaugcuuucugcauucuugagggguucagacguaguggaaaugacuuauuuauauauggcuacuuuaagauugagacauagcuauugaauuuacuuuguuacuccacuguccauuuaaacuuuucuugaguucuuauaauguggcaggugcaaaagaugaauuagaguacccuacauucaaagaagcaauuuaucauaagguaggcagaauaguuuugaccaaaaaguuauaaaauauauuguaagacagggguccccaacccucgggccauggaccaguaccaguccauagccuguuagggaccaugcugcacaucaggaagugagcagcaggagagugagcauuaccaccugagcucugccuccugucagaucagugguggcauuagauucucauaggagcaaacccuauugugugaacccugcugugaagugugcaugcaagggaucuagguuacaugcuucuuaugagaaccuaauaccuggugauccgaguuggacaguuucaucccgaaagcaucccccucuauguccagggaaggaaagguuggggaccacugcugugagcuacuauuugaagacaacccagaagugauuuuugcuuguagguuuccaggcaaagcuugagaaccaguucuccuauccugauguagaaccugguaugaucuacaacacuaagaacguguacauaccugugcuuguauuacucucauuaggacuacuguggcaaugucccaagcaagcacuauucaagauauugacccucaaaagcaaacuuaccugaacuguucuuuuguucuaguaugcacucaaaaaucauuuaauucugaugaaaagggguaguugugugauuuuggggucaaauuuuagacccguagaaaaaaaauuguauauguaauaaauuuacauauuauaauuuauacacacacacacacacacacacacacacacacacagaguuucacuguguuaaccaacucugcucuagaaaaagaaccgaugggguuuugaugacgagcugcucucuuaguuaugggagguggggacucucuuacucauagcauuuuuuuuuuuuuuuuuuugagacagaguuuuccucuguugcccaggcuggacugcaguggcgcaaucuuggcucacugcaaucuccaccucccagguucaagugauucuccugccucagccucccgaguagcugggauuacaggcucaugccaccacgccuggcuaauuuuuauauuuuuaguagagaugggguuuugccauguuggucucaaacuccugaccucaagugaucugucugccucagccgcccaaaguguugggauugcaggcaugagccacugugcccaaccucuuuuuuucuuaugaaagacuuuugcugaaugaaaacuaaguucauuuucuacccagaaucauuuugccgugaugggagagagccaacauugguguuuuacugaugccagauaugacugcauggagcucuauuaaauagggcgugguuugguugggaguuacgucuuuauuuugaauuuguggauuuuuaagauaagugucagaaagcaggauucuuuguaacccugcaauucguacagccagcuuuugucuacuguagaugagauuuggcagcuacuacccagaauaagaaauugauuuuaaaaguucaagugaaugcauuccauauuuaagauguacauucguucuaauuucacaaaaaggugaaaagcaauuguaaauguuuccuuugccagaauaauuuaagugacuuaguauuuaaugaaacaaaaugauuauggugauagcauuuuaggacuguuuuugucugccuguauccugcuuuauuuccuccuauauuucaaucaguuucuugagauuaaagacaaaaaucuuuuuuacuuuaucuucuuucucuucuugacuccuaaauguuguugucccugagaacucacucauugccccuccucuuucgacgcuuccccuggcugaauaaccccaacuguguucugauacagcauacugucucaggcagggcuucagacuacaacuggaugacucacagauaucucaaacaaacauauuaauaauugaauucaugguuuuucuguaaauacuaauuuuauuuuauuucuugagacagggacucauuguuucacccaggcuguuugcuuacuuuguagcacuuguaaucacagcucacugcagccucaaccuccugggcucaagccauccuccugucucaggaccccagcuccacccccaaaguugggaccacaggcgcaugccaccacacccagugaauuguuuuauucuuuguagagaugggggucuuacuauguugccuaggcuagucuugaacuccuguaaguacuuaaucugccuucugcuucucugcucucuaggcuuuucucccaucaaugcacucaagaaggaaaucuagguggcauucuugaaugucuuuucucucauauucaggccuccagcgauugcuguuguacuccagauguuuuuuuccaucugucaccuaucuuuccacccacccucuuacugcagaucacacucaccugcucccugagcugcggccaguccuuugcuuuccuuguuccauuuuuuucucccucucccuuaaugcuuuccccauagggcauaacauuuaguuuucuuuaguagaugauuucauucuucuuaaaaaacucaguggcuucaaaugaaccuugggauaaaauacaaaguuuaaccauggccaaaaggcccuauuugacuuaguuauugccaggcuccuugaccuuaucuugugccacucccggcuuguccccuccuucagccauaccuuucuuuguagcuccuggagauucaauucuuucuugccagggucuuucuaccucugccucacauauucccuccaucucuucauuccacuucccucauccccaccccccacuccccuccauccucaauacacaaaugcuccuaggcacccuccuucugauccuguacaucuuaauguuguggugaguuccuuagaaauaacuucucugucuacuuuaucuaaaagagaacuuucuuccccauucuuuaaagaugauuuccuuagagagacuuuccuuuaccuagaggaaaucuuuccccucucauccuuagagauaacugcucugucuaaagaaggucuccucucccuauucccaaaaaucucucucagcuaauuguuugcuuacuugguaggacuuguaauaguaauuuauuuauuggcuaguuucuugccucuaagggaauguaagcuaaauuccuccauuaagagcaggaaucagccaagcacaguggcucacgccuguaaucccagcacuuugggaggccaaggcaggcagaucaccugaggucaggaguuagagaccagccugaccaauauggugaaacccugucucuacuaaaaauauaaaaauuagccaggcgugguggugggcggcuguaaucacaguuacucaggagacugaggcaggagaaucgcuugaacuggggagguggaggauacagugagccaagaucaugccauugcauucuagccuggguggcaagagcaagacucugucucaaaaaaaaaaaaaaaggcagaaaccaagguuguuuuagucaucugguaucucuagcacuuaggaccuugcuuuauguagaggaagcacucacuucauaucuuuuaugaaugaauagaaaacaacaaaagaaaacaucucuuuaaaauuaaaaauuuuacuccugauuauugugucuuugguuuauuuuaccuuaaugacaaagaaauugaauagugguccuaaucuuugaccaagaauugauuagauuaaucuugugauaagaaauuuuuuauuaaauagucaacuauuaaaaaaaauuaagccuaggcaauguggcgagaccccaccccuacagaaaauuuaaaaaaaaaauuagcuuagcaugguggcauaugccuguaguucuaccugcucaggaggcugagguaggaggaucgcuugagccaggaguuggagguugcagugaguuaugauuguaccacugcacuccagccugggugacaaagcaaaacugugucucuuaaaaaaaaaaaauagaauaaaauaaaaauuacagcaauauuucuaaugcaagauaauuuuucuaaaugggaaaaucauauuuauaauuauacuuuggaauaauuuacuuagaauauuuuuuuuuuugcucaacauucagaauauagaaaaugcauaguaauucucucacacacgcacaugcacacacacacacaccagaacaccaaaacaaaacuuuccugccucuaggcagcauacauuuuuaagagcuuuacugagauaugugacauacaauaaacuguacauauuuaaaguguaugauugaccugcauaaauuccuaaaugaauguaacccugaacuugccuuauaaaguuaucaggaaaaauaaacuauaucaaauaauguaugcaugcaagagacuaccaaaugaauaaugaagauuaugcccucagugaauagcaaaugguuuuaaaaaauauuuauagauaauaucaagagaaugauugcuccucauaaaucagaagauauugcuuacacuuuguuucauuuaaacuuuggucugccgcuuuuguauuuuagccggauguuucuucucgugggagcucccaaagcaaacaccacccagccugggauuguggaaggagggcagguccucaaaugugacuggucuucuacccgccggugccagccaauugaauuugaugcaacagguaaauuuugaugcacaauuuucuuuucauugauuucauuugauuuuuuuuuugcaauugguuuaguuuaaauguagccauuuaauacaauuauauagauaagcaccucagcuucacagggaaaauuauauaaagacaaacgauuuauuauaugauuuuuuccuacaauuuuugugguagaugaaaguauuaaaaguacguuguguuuccauugguucagaugucuucugccguaaacugauaauaucaacccacagaaauuugggguaaaccuguuaggauguuuuuguaccuuuucugagaauagggagcucauaggcacagaaaggcauucugcugcuucucugucaaccaaauugaagcaugacucacuauuguagaagaucaaaucucugaucaugaauauauccaagccuuaggcugugcuauaaaaagcaguugaggaggcugggcauaguggcucacgccuguaaucccagcacuuugggaggcugaggcaggcagaucacgaggucaggaguuccggaccagccugaccaacauggugaaaccccaucucuacuaaaaauacaaaaauuugcugggugugguggcgccugccuguaaucccagcuacuuaggaggcugaggcaggagaaucucuugaaccugggagguggagguugcagugagcugagauugcgccacugcacucuagccugggugacagagggagacuccaucuuaaaaaaaaaaaaaaaaaaagcaguggaggaaucuuuugcauucagguggacuuaggugacguaaacauuuaucaagacuuuguugggaaaauuauauauuaugguucugauaacaggagaauuuuagggauaauuuucagugucagaauugugguagcaaggagaaaaauagcauguguaagaugagaaauaagcuuuacauuuuugccagugaaauaaaauaugcagaauucuguacgcauuuauauugguauauuuauauauauuugugaaaucuuagauaguccuuaaggaaauagugugacauucuucuaguacaauagucuuacaaaauuuuuuauugauucugauuugcuggcuuugacagagugcuuuaagauaaaccugcagaaaauuaauccuuuuuuccauauuguuauuuccugccaguacuaaaauauauugauucugggaaauaugucagugaaacaggaaucaugauguggacuguuccauuugacauugugaucagugccaaaaugauuguuagucauuaagccagcuguuaaugggaaccagaucacaugcacauguuuucaggguuuuuuuuuuccauuugaaauuaucuacauuaaacucuguuguuguauuuuuccauauauggcuaauacuuggaaaacuccaagaguuuguaaaaaggcccaauuuuaccauaaauggagaaauaccugugacucagaauaugauaguuuuagggcauuuauugucuaacaaaauaugagaacuaauaaaaggaaaccacaguuuagauuuugauaggucgaacucuucagauguuucuguacuuaacacuguagguuuuugugcauugcaagauaauuuauugcuucagauaauuuuuuguuuauugaaaauaacauuugcacaugguaaaacaaauuuuaaagagucucaaaggguguacaaugaaacauacaacucacaucagucuucucagaagcaaucacuuuuuuuuuuuuuucuuuuugagauagggucucgcucugucacucgggcuggagugcagugaugugaucauggcucauugcagccuccaccucccagacucaagugaucuucccaccucagccccacgaggaguugggacuacagaggugugccaccagcccggcuaguuuuuauguauuuuuuuuuuuaaagagaugggguuuugccauauugcccaggcuggucucaaaacaucugggcucaagcagucugccccccucagucuccugaaguccugagacuacagguuuggcccacugugcccagcaugaggcaauuacucuuaacaauuucuuuuauccuucuagaauuuucuuacuucuauauauguaugcauccuugaaaaaaaggcaacucaaaaaucugaugccucccugcaccguucuaacaauagaaaucucuuguagauauuuccuuaucggcauaugaauuuaccucauuuuuuguaaaucacugauacuauucuauuguauauguguacuuaauuugcuuaaauuauauuuucuacuaguggauacuuugguuauuuccagucuuuuauuaugaacacugcuguagugaaaagguuauacacaaguauuuguacaaauaugugaauauaucuguaugauaaaggagauuuuuggaucaaaauguauguauauuuaaaguuuuguuagguauuguauacuuucccucacagaaguuuacaccccuccaguuguguuuugaaacccauggcaaccucauuuauuagcauauuuuuaaaucuucgucaguuuuauaggaggagauaguaucuguuauguuaauuugcauuucuuuaauuaacaguaagacugagugucuucauauuuguuuguaagccuucaguaucccuuuuccugugagcuacuuuuaguauauuugcacauauuuucuguuaauuugugauuuuuaaaaaaugaaucucaguuuauggcacuccauccuuucaguguuuaggccagaaucuggagcuguguuugacauugaaucugucaguaggucaaaauuuaacugcuucuuaucaguccacugcuaauauccugguccaagccaccacugucucccaccuggacuauugcccuagauuucugaauuagggcauugccaggaacgagauggcacacuuaaauugagguauuuugacuauuuacagaggucugugcagguaccuggggauugaucguauaucagcacuaguuaaaaugugaccucuaggccugaaggcagcgauuaccagaaucugaagacagaauacuagguguagagagccacgugacaggagcuguggcuuuuuucagagggcaggagccagcccaaaaugaccaggggauuaaaacaaugagcucacucugcuuccucccuuugauucucugugcugugccucauaaacaguaggcacauucccacuucacccuugccugggcuguguuuccugccuggaacauucuuucccuaaauauccacugaguaucugcuucaccaucauuuugagaauugcucagauauuaucuucucagugaugaccaucucauuuaaaauuccaacucccucuucucaccuuguacuuccauccucuucucuauuuuucccaguaauacuuacauuguuacauguuauuuauuuguuuuuagugaaugucucuuucccucaauuagaauguaaguuccaugaggaccguuuuuuaucuuuguucauugcugagacuccagggccuaaacauugucuggugcccagcacaaguuagugcugaauaaauugaagagaugaauguacgauaagagguuuuuauauaguaaggaaauaacuaaaguccuuuagugguuguagauguguauauauauauauauauauuuauauguauaauacauauauucuuauguauauguauaauauauucuuauguauauguauaauacauauauucuuauguauauguauaauacauauauucuuauguauauguauaauacauauauucuuauguauauguauaucuuuugucccuguuuaugauauuucuguaauccuuuuguauaacuucugagaccuccccaguggaaaaacaauuaagacuucauuuuuuuacauuaguauuuuuauucaaaugguguuuauuugaauguaagaggacaacauagauuuaaauaauccagucaagaaaauguauaucuaaaauagccacauuaaacuauaugguauugaguuucaaggaagaaaugcuuauagcuuaucgcauccugcuaaacuuucuuuaugucucucucccaaggaacucuucaucccaucuuagcccaaacauauaagcaucccuacaauacaaaugccuucucucuuuuuuauuaucucaagggagacagaagcugagcagauaugugggguuucugaaggcagccucccuggggcucaaacccugguucugccaguuaccagcuguugacguugcacggguuacuguuagguuacccucaucucccuagugcaguauucucaucaaccugcuccauggguguggauuacaucgcaugaguuaauuuacauauaggugaagacuucuaaagugcuuaggacagggauuggcauguugaaauggcucaguaaacaugagcuguuucaugucgcuauuccucccuuuugccuucuuagagacccucccuauuccuucauuugcuucuguaucccugcuacauucucccuuuuccuuucuuccccaacuuugaaguguguuuaaaguuuuuucccugaaaaacuaaucaaaaacuguuuucccuugaacauguaucuuuucuuagucagucacaucuuucucucuucuuuccuuuacauccaugauuuuugaauacauauugugucuucaucacuugucaugcuucaauccaauagaaucacuguuggguuguggcaccgacccaacccagcagugauucuaacugcgauuguugacagcagccuauuugccagcuucaggggaugcuuaugguuccucaucuuuuuggacugcucuuuuacaauucaccccauuggccauucccuccuuaaaguuucugcucuucgucugcuugaaaugaucacauccuuuuaucccuccuaaacuugauacuauuguuaaaccucauggugucaugaaaaggaauaggccuuguaguuagacagacaugggcucaaaucuagccucugucauuuuuucuaacauuaccuugggaaaauuaccugccauucuacauuguauaauacauuccaggggugaucacgaagaguauaaauugguuaguuuauuuacuuuauuguguuucugagcccagaacagauuuuagugcuuaaaagugcccuguccucauguuuuuaauauuugggaaguaauuuaguuuaugaaacagucucaagaaaauuagcuguaauuauaugaugugggagauauuacaacacuuugucauuauucacauuuuuuuaaacuucugggaagaccuuugguaugcccaugugacuuuuucuggcccauaaaacauaaggagaauugugucauuucuggguggcaggguuuaagagcuggggcauuauucugccccuucccagaugucacagggaguagugauaguugaaaugguagaacuucugucaaccugaggccugugguaaggaagacauaaagcuuagacucuuacucauauguguguggacaaaaaaaaaucuauuguucuuuuuaacuacuugagauuugggggaugcuuguuacuauagcauaaugggaacuaaacugaauaacacauauagggauauuaaaauggaauauuaucaauaaucaucugcuggaaaaugguuauuaaaaccacuuucuauucugcaugccaguuuggucuuccuuuaaguuucuagucugacuuacugaguaucugagugacuaagugacuagguaucauugcuuaugcuaaaaauggccccugacguuaaguugcauuuggauugggagaaacuauaaauagacuaaguaccugauagggaugucauagcuuugggguuccuugaguauagugacacaaaacuggcauguguuuuguggcgacucuggaagcuauggcuauggaguuguugcaaaagauaucauuucuggggggcaagaggcuuugaagccagaaugacuccugcgucuaccagguuuuguuucuucauaucugagccgucaccuggcggggcaaagagaaguacucuggacagcuggguggacaguuguauaggaaaguucauguaaggauucucaccaaagagguaugucugguucuguccugcuggaaagcugugguuguguccuauauccuugcaaguagauuggugcuucauauggccuuugauaguuuugugaguuugaaaguuuaguugagccuuaggaagccgcagaugauguugcaucaacauuugaagucuguaauuguaugaaauauucuaggcugguugcugcauagucuguuucuccuuugaaaaaauagaauaguaacuauauuccuuccuacaaaaaagaacaaaccucagcuagcucuagaaucacaacaaaaauuuuacaguaaagugcuuggagauacuacaaaugcuuggcauuaaguaauauuuuguaaaaugguccuuuccucucccauucaccuuuuaagucagguucugccauacugguagucuuagugcacugaguacaguucucuuucuuauuaagcugaauuuuuuguugauuuuuuuuuucuuacugauguuauaguauguuuguuuuccugaguagacuauaagcuaucuaaaggcagggaacacauuuauuuccacucaccauuuauuccacuuccauaugguggguugccuguguguauguuccaugcaaguuuugggcucuucaugaaaaguaauagaaauagacucuagcuaaauuuaacagaacaagaauuuauuggaaggauguugguaacuuaacaguuaucugaaaaaauaagcaggaaccaagagaagcuaacaaaagaacaaccaguggauuuuauuguugcugguacugcuauugcugaauguggaguaacaccaugagaauaauuucuuguccaucaugccucuuugcaucauuuuauagagauuuaaaacuuuuauaguagugucuguuugggugagucuaagucucauaucugugaaagaccuggaaagccugucuuaucuuacacaacuaagaagauuaugagcuuguagagggaacuaaaagguauaggauuaaaagggugccuuuuucuccuuuugacuggaaaacaggguaauaggaaggaaacauccuuugcaaauaacccuuuuuaucuguugggcuaauuaguaauucaugaacuaauuuuacuuuguguuuaccagugacgucccuggauguuagauaguauaucauuuauuaaaaggccauguaacuguugcuugucacgugcauuaagacauacacuaguagcuaauuaagaaaaucuggauuuugcuuuuaagguaucauaacacaacuuucuuagcuuuuaaagaagacagauggacacuuuagaugugcuuuccuauccuguaacaugauuuuggugguuugaguuggggguaagagagaggcuuucaaaaauguauuugagagaucagucuaaaaguuauuuuacuguaauucugaaaaguagacauaaauagauucauaccaaaauaaaggaggcauaacuggaaaguaucuaacuuugccuggggacuuugaagaaggcuuccuagauuaguuggugacauuugagcuagcuaaugaaaaaugagaugaaauuccuuagaugucgaagaggguucuagcuugagaaaacaguauguguaugcugaguaaaagaaguuagggacugauaaucaaguaauuccaugugcccuacauauauauauauguaugugggcauaaggguuauacgugugugguggugggguuaugguguugagggcacgaugaggaauaaaacuggaaguagcugaggaaagauauaaaugaguuuuuaaaaacauacucuaaaggucuagccaaauaaauuuaccauuaaaucuuaaugcauauagaguauuauauuagagauagaaggaucuagagccccauagggacaucuuggacuccugguuccuuguagauuucacaugaacauugcagaugaacuaauacuuucaguacccgucuuauuaauuuuccuagucacuuuuuugguaaaaugauagaaguuacaugaaauaaugaauauuaucauauacauauauucaaaauauuauagacacgacuuuaaaaaauguggaguuucaugauacaaaguuuaauuuaguagaagguacaauccaggauagaaaaguuacucgcugcuuugauuuuugaauaauauuuaugcuuuagugagccuucaggaguaaaaaggaaaccuuaguccaaaauuuagauuugcaaaaguuaucuccaaaaugugcugcccuguuaauguucuuucaagaucuugacucuggcuugucaucuuuauuuuucuuuuucccccagauuugccugauagaauguauaaacaaagccacaacuaagauguuuuaaaaaguuucuuauuuuauauguuuaugcaaugauugaaauauuacaacuugcuuuugcuuuugaaauagcaguugcccucuuggauuuguaaaccuuuucauccagugacucuucauaauuuauagauuuuaagcaaggucugcauaaugacggaauaguuuuuuuccccuaaauugaaagaauaaugugaacuuugauauguuguggaauuagugaaaaugaaacaguuauuuuggguaugauuucuuuguuuuagucuaagaugauugauagguagaaaacucacaaguggaugauuuaguuuagggauuaaugaucuauguauuuucaguaguaaaguuauuccaaacuauaauagauugcgaugcaaaacaauauugagacuauucauguagcaaaccuagacugcucauguagucuguuaucuguuuugccuucauggcugcauucguuuccuguugcuauugucguaaguuaccaaagauaacacaucuguuaucuuuaguucuggaggucagauguccaaaauggauucacugggccaaaucaaggugagaaacuguuuccuuuccauuuccagcuuguagagccauuggcauucuuugucuugugguuccuucccuuaucuucaaagccagcaauagcuaccggggucguucucaugcugcauuacucgaacauugacccuacugccccccgacccuugugauuauaaugaguccacccagcuaauccagacuuaccucuuauuucaagguccuuaauuugaucacuucugcaaaguccuuuuugccuuacaagggucacauauuuaugugucaguuucugggaauuagaaguugaauaucucagggauauuauucgccuaccacagugcccuuuuauguauuuucuuuuuuaauuauuuguuauuuuuuucuuuaaaaaagagaguuggggucuugcuauguuagaccaggcuggucucaaacuccuggccucaagugauccucccaucucagccucccaaagugcuaggaguacagguguaagccacaauugauauugguuauacugcaagcuaugcugaggcaagaaccaugcuuauauaaguaggcauugcugucucucuuguucuuuuucccuuggcagcuuugguuauaaagaaugcaaacuagauuuagaagaugcaggcucagauucagacucugauacuuauuaacugugacguugggcaagcaccauccacaauuuccccaucugucaaauaagcauaauaccuaccucucaggguugccauguagaucaaaugagguaaugucagucaggcaugguggccugguggcucaugccuguaaucccagcacuucgggaggcagaggcaggaggauugcuugaguccaggaauuugagaccagccugggcaacauaaugagaucccauaucugauuuuuuuuaaaaaagguaaugucuaugaagguauuagguuggugcaaaaguaauugcgauuuuugccauuacuuucaaugcuuuguaaacaagaaagcauuauaccggugaagaaaggauuguuuauguugugcccauacuagaacuguagggaacuaaauaaauacggaaaaggaaagaaauaaagauaauuguggauauucuuaaauugauuauagcuugauuugcauuuuaacuucuguuauugugacauuugagaaaauccucuucuuauaacauguuuuccuuuucuagggaagcagaugcuacugacagucugagccuuggccauguuucuuaguaauguguuuuuuuuuccacccaaaaagauagacugcuaauguacauugagaaaagagaccauguaucacugcccuacgaaagucucuuugcuuagaaaugaaggcuuaccuaccuguuuaauuuuuuuuuuuuuuuaaaggagaagcuccuaccuuuauauuccaaauacagugaauggaugucaccuaccacuaacuguuucugucauacagaagggcagaggucagauuacucuucuuccuacccagaacagcuugcuggaaugcuugccauuuguuccuagaagggccuggcuguagguugagagcaaaccuuggcuaugccaguucuguggucaagaaaaaugcuguggaguauuuucuggguauaacuaggcuuuguauuuaauagagaauauaaaacauuuagcuguuuucuagcuucugcaguacaauuuccaucucguugcaauuaaaacacucaggcagacccuaaacuaacuuccuuuaaguuuuacuuccuccuauugaugaauuuucugucuuccagaguugugucuagguaucucuacaguugcaacuguccuguaaacuaaaaaguuaaaaagaaaaguaguuucccuucccuuguuaauacaaaacaaauuuauacuaaggauuuuuuaaaaauaaaaauguuucuccugauauaaucuguuauccccuguuacagaauuacacagagagcugguaagcaauuuagaaaucuuuuagucuaauuccuuuacuacuaacugacugacagucauacaguuagucaguauuuuaauguuuucaguauuuuacugaaaccaaacucacaagcucuuuuaaaguuucuuccuuucccugcucacuuugaccugacucaacccauucuuuaggacuuaacaugggauuggcuuuuuuuuuuuuuuuuuaauccccaguaaagagguuuugucuuaaaauguuagaugcuuucaggaucauuuccuuuucauggcuagaaggaaacaaaccagcauugauaaagcagugaguauuuucaaaaggccuguauucuuugugcugcacuccagcaggaccacuggaauugcucauggaagaagagggagauuuugauucuuuauucgcugugguaguaauaacuaacuaacucaaugaauaccaaucccagugaaaugagcuucauuccuguuuuccucugguucugcuuuucugacucuuuuuguuuauuuuugggaaacagcuguaucuuauuuuauguaaaagauguuucuggauaguucuauauaaauuaauaacacuuuugcauguccauggauuaugguugcagaacuuauuuuuguauauauaaaugauuuauuuuucaaauacuuuggauuuagggaacuuggucucuuggccauuuuaagucaauacagguaaguuucaagagacaucugaagacacuuuggaaguuuauaaagcaaauuguccuuucguuaauaguacuaguucuaauaucuuaccacuacuuauuauuugucagaguuucuuaaaucaauuaacaaacuguauuuccuuacuaagucaacgaaaucauuaaccaccaguuuagucuucaggaguaucuagaauuuuuauuuuuuaauuaguuauuuuaugcaauauucuacucuaauaguuuaauucuauaacauagaauagagguuccuaggaaggucagugcuuaaaaaaagaaggaagagguuccuaggaacgcuaaugcuuaaagaaagaagagcuugugugauuaaaauuuuuucuugaauuuuaugaacuaaaacuccuuuacauguaagagaugaaaauguaaacaaaguuaauuaagaggggaugugggagcuucaaacuaagcuuuuguauaugaggauugaaggauauuuauccacacuacuuuuuaaaaaaccuuuaaaacauuuuauaaauaaugcauguccauugaugaaaauaugagaaaaccagaccuacuuaaaucucaccacucaggaaaccaagggccauaggauauacuuuuguguguguauuugugcauguaccuuauggccuguguauauucucugugugugugugucuguguguaaauauacaaaauacauaaaguuauaauuuacucugucuccuguuggacauucuguuugacaugcuuauuagucuuaguucauauuacaaaaaguuuuuuuaguuaauuuuuaaaaauuaaacuuagaagucauaggaauguguguuucaagauuucugauacauauuugccaaauaggaaaauacugacacaagcagucuuugaacgaaauuugauacuaucuuccuuugccugacaggugaaacauauaucuuguuuuaauuuacauuucugucauuucugguaagcuugagucuuuuuucauaugcuuauuagcucuuucuggguuuuuaaauuuuguuuucuauuauccguuuucauucuugaucuauuauauuauucauuuuuauucuuggucuauuacucuucugacacaucuauuuuuaauuaauuuugaaaaagucauuuuuuauauauauauacauuucuguucaaugcuacagcuacuuuuucuccugacaaaucuguccuuuuuaaaaacaguuuuauugagauauaauuuaccauaacauugaccuguuuuaaguguacaauucaaugaauuuuuacuauauuuauagaguuuuguaacuauuacuacagucuaauuccagagcaucuccauuuacccuaaaaagaaauguguccaacaucagucucuccccauuuguaccuccagcccuaagcagcuauuaauuuacuuucugugucuacauauuuuugguuuuggauauuuuauauaaacagaauuauaugauacauagucauuccuauuguagcauguaucagugcuacauuccauuuuuauugccuaacaguauucaacggaaugaauaaacauuuuguuuauaccaguagaugcacauuugaguguuuucugcuucuuggcuauuaugaauaaugcuacuaugaacauucaugugcaaaucuuuguggggacauauguuuuccuuucucuuguauagaugucuaggaguggaauugcugcgucauaugguaaucuauauuuaccuuuuuuaaaaacugucaaacuauuuucaaaaguggcuguaccauuuuacauuucuauuaguaauguaugaggguuucagugucuccguauccuuguggacacucauauucugucuuuuuuauauuauaauaaccauccuaaugagugugaagccauauuuuauugugguuuugauuugcauuuacccgaugaugaauaauguugaacaucuuuucuugugcuuacuggcuguuauuucuucuuuggagaaacaucuauucaaauucuuugcucauuuuucauuugguuguuugucuuacugaguuguaggaguuuuucguuuuuuuuuucauauuauuuaggauacaaguuuuuaauccaguauuugauaagcaaguaauuuccccaguuuugaggguugucuuuccacuuuuuaaaugguguuuuuguagcacaaaaguuuuuaauuuuaauuggcuaauauaucuacucuuuuaucauuaugcuuuugguuuucuaaaucauugccuaacccaaguucaugaagauuuauuuccuuguuuucuuuuaagaguuuuauaguuuuagcucuuacguguaaaaaugucugugaucuauuuugaguuaauuuucugguacaguuugagguaugguuccaaauuauuuuuuuugcauauggguaucuaguugucccagcaucauuuguugaaaagacuauuucuuugccacugaauuugcuuggcaucuuugucaaaaaucaguugacugugaauguacaggugccuuugauguuaaaauguacuguuuauguacuacuaaaaauacuaaaagugucaccauuauaaauauaucacuguugacuauuguacacauucagauuuuaggcauacuaauaucugaauauuugcagcucugagucaaugauauaccuuauuuuuuuuuuuuuuuuuuuuuuugagacggagucucgcucugucgcccaggcuggagugcaguggcacgaucucggcucacugcaagcuccgccucccggguucacgccauucuccugccucagccucccaagcagcugggacuacaggcgcccgccagcacgcccggcuaauuuuuugcauuuuuaguagagacgggguuucaccguguuagccaggauggucucgaucuccugaccucgugauccgcccgccucggccucccaaagugcugggauuacaggcgcgagccaccgcgcccggccgauauaccuuauuucaaaauagcauuggguuacaaauaaaugcaugauaacaguaguugucugaccuccaaaucauuuucucucaaauuucccuuauaguauuuauugcucucugaaaauauuuuauauaauuauauauuacuuuucuccuugaaaagcaaggacuuaucugucucguuuaaugcuauauuacuagcauauagacauaggagguacccaugauuuaugauuuauuuaaauaaauuaauggauaaucuaagauauuucuuccacuaaccuguccauuuuuaccuaauaaauaagcauacuuuauuggauauuuuuuuucaagcaaauuuguuauaggaaguacaacuaaacaagugauguuugaaguaaaaagcugcuuaagaaagucugugaauugucuaugaaugcagggugguauuguuuugauagacauuuuuucuuucuuuuuuuguuuuuuuuuuuagcaaaaaguaaguuaaggaccugaauuauuucauuauucauaaaagucauagugauaaauaggaaccaagugacuaaaaccacauuuagcuucaaaauggaaguuuacucucuugcuuuucuaaugauuuagcauucuuguucacuuuggccauuucacaaaaaggugacauaaucuuguuccaagggauauucuuuuggcaugaaaagaagaaacaaaacauuuugcuuaggguaagaagguaauuguaucuuaaaaauaagcacugcccauaauuguccagcaaguugagugccaaauguguugacaaugccuuuggaaacaccggggaaaagaguuggcugcuaauaaggaguagagucgaaagcuacgacaauccgguuuucucauuugcuucuguccucaagcaugcagucaugggaguuugauaaaaugcaaaugacaaguuuccaaaccuggcaaaauaaacaugaaauuuucaagucucuagugauuuacuugcuuauuaacuucaaguuucucuagcaaaguuuuccucuguauuuuugaaagugguagcauagagccuuauguuaauuuauauaauacagagcaauuucuucucaacuuuauuagagaaagagauuuaaagauuaugaaauaaaauaauauuuaagauuuaaguuauuuaaauacuuuauuucgauaauuaaauaaaauuauuuuauugugugagauacucuuuuuuucuuuuuuauuuaucugggugaacagagcuaaucuuccaaugggguuugugacuauggacagaaaucuuucuauucuuggcuguugccggagaaagcauuucuuccagcccuugaguuucugcaguugucuguguccuguuuccuuuucaagugugucagcauaguccaggcuaucugaggagguccaacaucauccuaaaugcugacuucagggcugugauucaaaauauuuacuucacucaugugccucaggauagcugccaguuucacccaggucaugaaugaacuucuugucaguuugucuggagagcaggcuuucuuuugcauucucuucacccagucuauuuacacuuccucugggugaaacuucuauguaauguugaaucaaagauuuuaagacuuggucuccaaaaaaacaauuuugauuaguaaagacaaacuuccuaaugagcaaacuucuuaaaaagaugguaacaugagguuguaacucuguugcaggugaaggcauugaaagcacuggaugauguuauucuuuuugaagaccauugacuaaguuuugggugccaauauacgccaaugcauuauauccaguuauacuggacuacuuugguuuccaaaaagauaugucaaauuuguacugauuuugcaugaauuuucuagcuuaagcuaacccugauguccacaaagacagauauccauaacuguuaaggcaagggauguuuuugauacuuuuuuaaagaaauaggaaacagaacaugguagcuuugcaagccuaugcugcuugacagugcccagcagcauguugugccaccguauacaaauuuaaagaaaaguaacguuuguuaagaaaaacauucauggagguaaauuuucaaagugguacggagagauuggauaaccuuucacaaagaagaaauuucacuuuucaggaauauaauaauugagaaaaaaugcuuagcauagaaggcaacucaaaaaucccaucaagcccagucuuagcauggcauaaaagcucuugacaaaagugggaauguaaauuaauacagcuacuauggaguacaguacggagguuccuccaaaacuacaaauggaacuaccauaugaucuggcaaucccacuacuaggcauuuauccaaaggaaaggaaaucaguauaucaaagagacaucuguguccccauauuuauuggaacacuauucacaaucaccaagauauggaaucaguucaggugucuaacaacagaugaauggauaaagaaaacaugguguguguauauguauguauguguauauauauauauguacaugcauuauauacauuauauauaguauauuuuauauauauauauauauuuaguguguacauauauuccugucuccugucuguguucaggaauauguauacacacuggaaaaaugugguguguguacgugucuguguucagccauaaaaagaaugaaguccugucauuuauggcaacacggauggaacuggaggauauuauguuaagugaaauaagccaggaacagaaaauuaaacacugcauguuuucagucauagguggaagcuaagaaaaaguugaugucauagaaguaaaauguagaagauacuagaggcugggaaagguagggagaaugggaaaauagagauuuguuuaaagacacaaaauuacagcuagacaggaggaguaaguucuaguguuuucuaccacuguaggguuauuauaguuaaaaauaauguauugucuaauuucaaauagguagaaggaaggaaucgaauguucccaacacaaaaaaacgugcuaaauguucaaggugaugaacgugcuuauuacccugaccugauaaguauacauuauauguauugaaacaucccuauguaccccaugaauauguaaaauuauuauauuucaauuaagaaaaaagggcucuuggccaggcaggguggcccacaccuguaaucccagcacuuugggaggcugaggugggcagaucaccugaggucacgaguucaagaccagccuggccaacauggugaaacccugucucuacugaaaguacaaaaaauuagcugggcgugguggcgugugccuguaaucccagcuacuugggaggcugaggcaggagaaucgcuugaacucgggagguggagguugcagugagcugagaucgcgccacuguacuccagccugggcgacagagcaagacuccaucucaaaaaaaaaagaaaaagaaaagaaaaggcucuugauaaccacucccuuccugaccauucucucuaguuauagugaacaacucacaauucucuuaaaaaauucaagauuacccacucuucugccucuuugcacaagguuuucuuuuggcccagaaaacauuuccucacuuguacuguacccuuacuuuccuauaacucuuuacgggugccuauacuauuuuccaccauaauugcuuguuccuaugauuaucucuuguguuagagaaauguucccauaagaggcagacuaccauuucaucauggguuagcaucaugaacagacaaacacaccugaauuuucaguuaggauuugaauccagaguggagggaauaaaguuuccgggcaagaggaccuuggacacaaaugccugcagguggaaauaagcaugacuuguuucagagacuagggacgaaggauaagagaacucuuccgcauaaaaauaaguauaucagccaggcaugguggcuuacaccuguaaucucagcacuuugggaagcugaggcagguugaucccuugagcucaggaggucaagacuagccuggacaacaugaugaaacccuguuucuacagaaaauacaaaaauuagccaggcaugguggcaugcaucuguagacccagcuacuguggcggcugaagugggaggaucgcuucaguauaggagguugaggccacagugagcugugaucacacuacugcccuccaaaaauagaaauauuccuaaauuugaaauugagggagauguaggggauugauuaaauaaaguauucuauggcuguauaaugggauacuacacaacaaugaaaaugauacuauaggucugccuuuauaagugccauauuaagggagaaaaacguacauauauuuauaaaaugauaauuuuaauguuaucuuaaauauugacuuaauaucaauuuuacauauaaaaaacaugcauguauucaugaaacaagucuuuaggauagauacuaauguguuaacagaggucauuucuuuauggugggguugugguauuuagaucugucuuuauggcuuuguuuuauguuuugguuuguuuuguaaugaauaagacaucuauaauuagaguaaauacaauaaaguguuaaaaggguaagaagguaccauuggucuuguacauauauuuuguacuuauugauugcugugucuuaaaaauuauugugaaaauuuucaaacuuauagaaaauuucaauuucaguaauacaaugaacaacgaacaacacacuuguucaccuagcuucacccauuguugcagacauuguuacacuuaucccuaaauacuugagcauguaucuccuaaaaacuaggacauuuucuuauguaaguacaauauagucaucacauguuagaaaugaaucauuauuaugaagaauauuaacaguaacaauguaauuauugcugaauuaaacauuauuacuguuaccuacucuaguucacaauucaaauuuccacauuuaucccaauaaaguccuuuguaacuuugaaaaaaaauugucuggacauaaaauucaaucaaagaucacaucuugcauucggucgacaugucuuaguggucucuuuuaaucuagaaguguuuccuacucuuuuugucuuucaugauauugacaauuuugaggacucuaucccagguguccuguaggcaaguaaacuuauauugguaagaauauagugauguucgaucuaucccaaugcaucauuuuguuuuugacacuggaauuuuaguguacagaaauaauuuucucaauagugagggcugaaguaauaaaaauaaauguuugauuguagugugccguauugaauucuuuuuucuaccaaccaaaucaaguuuccuggauucuaauucuugcauuguuaugucuuaggcacacgucucagucuugucuuuuauagcauuuuacacaaagguguuucauagcauuuaauuuucauaauuaucuuuaugccccaccgaaagaucuucugggaauaggcgaucauacguauuuguuuaauaguuaauuaucuaacaguugagcaacuggaaaacuuuauuuacaauugcuuuuucaaucauguguauuaugauaauggggcuaauaauaacacugagacacuucugggucaucauguauccuauguuucugauuacuugaaagucucuaauguauauaaacuguauaugagaaaaauaaccaguggaauauuugauuaaucaaagguguacuauuucucaaccuagcuggggauaaaaauaaacuguuauauuaagaauaguauauuuugugucuuaccacucacaauauucuuuuuuaggcaauagagauuaugccaaggaugauccauuggaauuuaagucccaucagugguuuggagcaucugugaggucgaaacaggauaaaauuuuggugagucuucuggauauuuacuuacaggugauuuuagucaguuuauguggagacacagaagguuuuauauuuucaggcugauaguaaaauucaguaugcucaagggcacaggguauaacaacauaagauagcucugaucaaaggccacucuguccaaggaggccaucucucuugcccuucuugaacaggcuuucacauuuuuucacccuuauuccuacuuuguuuuaccugccccacuugacaguuccuaucaguuuauuuccaccuagccaaguauaggaauaguguggcuuuggcuaacaagugcuuuaauacuuccucucucucucucucuuuuuuuuucuuucccugagacggagucuugcucugucacccaggcuggagugcaguggugcgaucucggcugacugcaaccuccgccucccagggucaagcaauucuccugcugcagccucccgaguagcugggauuacaggcaccugccaccaggccuggcuaauuuuuguaguuuuuaguagagacaggguuucgccauguuggccaggcuggucucuaacuccugaccucaggugagccaccgagccuggccacuuccucucuuugaaaauacgacacgauguugaaguggaauacagaacaaagaaaaaaaaauaacaaccuuccuucaccucaucucccccuaugccacuguccauuccucugcuccucuucucaguuucugaaauguuuucuaugguaaccaucguaguucuuuacuucacauucccuuuccuaugucaucauugacuuucaggucacugaaauccacuagcauuuauacauaugugcauacauacacaccauuauguuuuguuuucucugcugguauuuauuuuuaucuuucuugcacugucagcauuauucagaauggucaacaucccuuuuuuuuuuagaacuaaauuuuucuucucuugguuucugugaacuguauuuuccugguuuuucuccuaucuuacuggcugcucuuuuguagucuccuuuaauggcugcucuuaacguucaguuuccaaauauugggguauccuugaucucuauuuagcuuccuuugcuuccucuaacuacaacuuuuaccuagagguuccuagccuaacccauggcuguaaguauaauccccaaaucuauaccucuagcuuuuaauucucccuggauccuuaaaggcauauuuccaggcuaccuauuuggcuuccaaaugaacauggccaaaauaggacucuuguuuccuuccaucaaagaagaaaaacaaauaaaaaacuauuauuauauauauuucccaauuuuuuaggaggccuggguuuccacccuauucacuagugagcacucacaaucugccucaaaaauauaucucaacauuuaucaguagaucuacauguccgcuauuucuacccugcaacaagccaccaucauuacccccuuggaccacugcaacggcucuucucauccugcugcugcuucucuuacccuaacugcaagaaggaccagagugaaccagagcauuuuaccuucuugauuaaaacagucaaguggcuuucugucacucucugcauaaguaugacaagcucauacugccuuaaaaacaucuccaaaaacaagucacuggcuaugucuuuggccuccucucacuccaucucacauacuaaagccaggcuuaucuuuauuucuuauacauuccaaauuauuucaguuaguaccuuaguguuuguguuuccucugcuuguauaaguugucuuuaugauuucuacuuggcuagcccuuugucauucagauuucagcugucacucagauuucagagacugcuccgccuauuuuaauuauuuacguaguauuuauuguugccuuuauuuuuucaucuaauuaugcugcauagggaaggauuugcuuaggaggugaaguuuuagcagacuuuaaaggaugugccacauuucagcaauuggaggugaaggaugggguuaagaguggggauguucuaggcagaaggaggugcaaagaagcaggaguaaggaaaaggagcaagccacccacucuggagcgucaaguacguguagagaaguagcugcuaugaccuacuuucacuguuuucaggguauauauacaauaagucaguauugauguucugcagugcuuauguuagcacuuugcuucaaaaaguauuauagaaaaucaauuaaaccuuuuucacuaaaugaauuguuacacauuugguagauuacuauguuguuaaagcauucauuacucuacugcucuaugugguauuacagucuagaaugcugaaaacaaaaaggucaugguuuauuuggaaaguaaauaaaauaaguacugcgcauuauuuuacucucuuaauaaacuauuugcuguauaauuuaggggguauauuccauaugcaugaguguuacuuaguucaaaagcuaguuuggucucuaccuuuagcauagcauauuacaucaagaaauauacuaccugaaauaacaauuuugcuaacuauuuugaaaaaaaaaauuggacuacaaauauggccuucagaauaaugugagaaaaagacuucacuuaauaucuuuauuuaccacuaugauaagaaauuuaagguauaggauagguuugauuaauuucuaugaaugcuuugaaaguuggccaggugugguagguaugguggcucacaauuagcgcuuugggaggcugaggcaggaggauugcuugaguucaguuagagaccagccugggaaacauagugagaccccguuucuauaaaaaaauuuuuaaaaauuagccaggcaugguggcaugcgcauguggugccagcuacucaagaggguaaggccaauuauuugagcucaggaguucaaggcugcagugagccaugaucacgucacugcacuccagccugggcaacagacugagaccccaucucaaaaaagagaaagugguauuauauucugaaguaguauagagcaucugaaacacuaaauuuuuagaaaaucuucgugucguggacuaaaccuuugauuuuaggccugugccccauuguaccauuggagaacugagaugaaacaggagcgagagccuguuggaacaugcuuucuucaagauggaacaaagacuguugaguaugcuccauguagaucacguauguauaggauauuguaccagcuuuuaagaagaggggugggaagccuaguuuguuaaaaauaugugugugugggugugugugugugugugagagagagagauauuaaaagauauagacauauuaugaugauaacaaaaugaaaacaauccuacuaauguaaagauauuacaaaugugaaguaaacagguuuacuuuuucuaagaacucauuuucaucuuccuucguuaguauaauaauaguuacuaccugauuuuaagaaucuguauuuuugaugacuaacagucaaaagaugcuuaguugaacuucucuuaacagagaagauguagaccccacaacuaaagauucugauucaguaggucuaggucaggccuggguaccugcacuuuuaacagacucuacaaggcaauucugauagauaccaaaguuugagaacuccugcuuuauauuaauaaugauguugaaaauaaagaauauuaugucuuaaagagccaaaguuuauauaggaagaugaacauugaacucaggagucuugacucugaauuuuccugcucuuaaucagaauuucuuuguuaaccugcuaccaagcccaccccuuuuuggugauccagaggauuuuaugcucuuugcuaauauuacuugaaauuucaaaaggaauuaauaucauggcuaaagaugacuucaagcaauuauaauuuugauuaugcuuuuccaaaaucucuacauccucuucucuuuggagauuccaguccuuuugugccccgcuacccuuuguugaauuggcuacugcuuuagaucuuccuuguaccagaagcauaaaaauagguuacugaaaugcaguauaguguuuaugccuagagcccuuaggccauuauuuuuuguguuccacuggucaccacauaguuuauuagagaaaauuaguaacaaaagcacaacauguaagacucuuacuccuacauuuguuuuguccauguuaggugaccugugacaccaggucaaaggaacuauucuguccuccagauucuaaguaguugaaccuacaggaaacugcagauuauuucaauaaacacuuauuuucuuagcccaacacuuugauccuaccuguuauaagugggaagugaacauuaaaagagugauaccuacucagaucuguauuguguguuaggaaagagaaaaaaucagguuagaaagcauacacugcacaggaugagggaaauugaggcuuuauccucagugcuuggaugccaucuguacugccaucuuuauguugguauuuugguuaugguacugucaucuucggugguauguagagaaucugaagauuaaauuuguauuuuuaauuucuauauugcaaaaauguuccuauuugaaaagauaauuuuauagcuacgaagaaugaguuaacccuuguuugccaaguuuguuacuuauuaauuauaugauguacacacacacgcaguacacucuuauuuucauuugaugcaugugggaacugagguucacauaguugaagcaaucuuauuuccacaucucaugggguugagaguggggauauucuaggcagaaagaggugcaagaaagcaggaguaagcaaaaggagcaagccacccacucuggagcaucaaguacguguagagaaguagcugcuaugaccuacuuucacuguuuucaggauacauauagaguaagucaguguugauguucugaauggucaaaugaggauuuaaacccaaguuguucuauuccaaaagaaccuuuccucuacauuauucacaauagaaaauguuuuccauuucaguugcuucuguauuaagcacagcuuuucuacaaagaauaccuccugcuuucaugaccuagguuuggauaauuccugauauguaagaauacauggaacucuccugaaaacaugcguucuaacaaugauucccuuguucacagaaugcuuuuauuugguuuaggcacagaaauuauaaagucauuuaaagccauauuuucuaagguauuuaacauccaaaucaggucaaugaacuguggcuugugggccucuuuuugugaauaaaguuuuauuggaauacagccacacccauuuguugauguguuaucuauaaucaucuaguacaguugugagaguugaguugccacacuguguggcuccugagccuaaaauauuuacuguucggcuuuuuacagaaaaaguuugcugaacccuaaucuaaauaauaaaaccucaaaucuuaggaaaagcuuaaagaacagucucaaaaaacagaaaagcaaagugcaugccuuuguuucuaauaggccugacacuuucaguaacccuugauuauuguacaugcuuuuugauucaaccuuugaaauguuaagccaccuauaauaggccuaaauugugaggggcaucuuguucagagaagaagacucaggagcggaagucugagaaccuggguuauauucugacuuugugcugacaauccaccuauagcuauggguaauucaccuaaccacucugggccuuuguuucaucauugguaaaacaccaauucacacaaaaaacuucugagguauaaauucaguguuuuuuaucuguuucauacuucaauaaauuaugcaaacgaauaauugguuuuaugagaugaugucuguuuuguaagacuacacugcuaacuuuuuaauaacuuugcuugucuuguggguuauuuuauuuauuuguuugcuuuugaguuuuuguuguuguuguuguugguuaguuaguuugguuaauugguuuguucuguuuuuaaccugacuuauauggacaccguggacaaggaacuucacugucugucacuaacuuaccuuauuacugauuacauuugcuuucagcuuuucauaacugcaugauaaaaccucagaccuuaggagaagagcauaaaaaacaaccucaaacaacaaaaaagcaaaauuacuuggggaaauuaaguaacuugaccguggcuaaccagcuaguaaauaagagaguauagaccugacaccacaugugucuacaccacuacacugcacuaugucaaaucaacaauauacuuaucauuuccugaguaaugacaaaggacauuaugcaguagaccagauguucuucuguucuaaauugccuagccacuuuuguuccuucugucugcuuucugaugcuaauauuauuugaacauagauuuuucucaguaaugauuucuaguuggcuuuuccuuuccuuuugucauuacucagggaaugauaaagauauuauugauuugaaacaguacaguguaguguuauagacacaccuggguucagguccuacucucuuauuuacuagcugguuggccauggucaaguuaccuaauuucccuaagcaucaguuucccuaucuguacaaauuauugaguaauaauaguaucucuuauaggauugguauaaagacuuaaaaaguuaaugucauguaaaaugcuuuagcauaauaccugacucagaguaaaggcuuaauaaacccuagcugaucuuacugucagaaucaauaauauuacuauuuguaauauaauuaccagacuuaacaaaugggagaaguauuaaccaucugcaggaauaaguaccagagccugcaucaaaauaguuuauauucaacaugaagucuuuaaauuggcaaaagcacucaguuuaauauauaccuguuaagaaaauuuuaagagacagucaugguuuuuagcuggauacucugggaaaccaaauaaagcagauaauuguacaguaugauaaucaaaaaaaggaugucuuuauaaauagcuugaaauaguuccccagaugcaacuugaauaaaggaaauaaauagccgacuugcucuaacuugagguuagagcagaauuccuuagucugauucacuggaugcuggaaaccccugccccacauuuucccacucccucuugguuagaaaaauuuacauugguuuagcauuauacucuugaggcuauuuucuuucaaaaaaaaaaaacuuuaaaaaaauuuagauauuaaguguguaaucuuugggcaguuuccaggcuuuaaaaauggguucaaaauuucugaugggauuauuuagcagaaguucuuagaaguuuguccuugugacugaaaacagauauuuuugguuccuguauuuggguggcaaacaaaguaacaguacagcuuuaauguauuuguaacauuggccacagugagucuuugauaacugaaggauaguguuuuccauuguucucuguuauccucaaaguaaaauaaggggaaaguguucagauucauccuuacauguguucuagguacuguauugcucaugauuaaaauuaauuuaaauuaauuggcuaauuguucagaauuaaucccuuucuaugagaacaacuaaaaagggaacaacuacaaaagaguacaacuauugagccuacuaugguuggaaaauacuugaaaguaucauuuaaagaugguuacuuuaauuagaucuccguacuaaacgugggaggauagcuuuauauuuuacuuuuugaagagcauuaaguucuggucuguccauuuccugaaauucugagcuauguuauucaucucuguuguuggcucuauaauguauguaucuguuugcugcuauucauaauaacaaaggucuuagcgaagaccuagcaaucuuaggguaauaggaagacagaggaauuucauauuggaauuuuuaacuugcagaucacaacuuguuaguguuuuaugaaaucaguguagugggucaaaaccacuauaguuuuucuaaaaaaaaaaaagaaugaaauaaaauagaaaaugucagagaguauucuauauaauaauacaaauauuguuugguaagauuuuaaguuguaucuauauauuuuauacacacaauggguguuggguugugauauaaauuauaaucuuuuuguggauugugguuaacuaaaggguuuaaaauuuaucauuuuaguugguuucuuuguucucuggugacugguucagguauuuaaucuucguuuccguaucugaguaaauggugcugauaaacaugcauacucucuuggaaugugguaauaacuaagugcccgagugaaugaccacucucaaaaauugguacauuaucuuaugauucuagugauaucagauuuucucauguuuuguuuuguguuguuuguuuuuggguuuguguauauuuccaaucuuuuuauuuuagaagauauugaugcugauggacagggauuuugucaaggaggauucagcauugauuuuacuaaaguaaguucuuauuuaagacugaaugagauucacaucuaccuuauugacuagacugugguuaaaaauaaacuggucaauaccucaacuccuuuacagcuguuagcucuuuaaugaaaacaguuaauaaaacgauccauucauuuugacauucuuugucuuauauuauucccucccuaguaaacauugcuuauuugaaauagggagacaucccccaucacucugggaauggaggaaaguagacacucuccucaguaaaugauagguaacuauuaugacuuaauauuaaaauuuccaguuauaugaauuuauagcauauuaaaguuuucuauuuuuaauuaaaguuguuuuucuuacaaaagcuaucaaugagagcuuuauuacaaaauuagaguuacauaaaagcugggaaacauguauguuugccaucuauuaugugccuauaggcacuaagugaagcugacuucacuuauguaauguguaauaauuguaagaaaucucauaggcagggcucuauguauuuuuaacuaaauuaauauucucuucagaauugauauuuuuaaucuauuuuuugaaaauaagacuuccauuuaaauguucaaagguaaauuuucugaaguacuuuucuuuauuuacuuuucuuuuguguguuuauuuauuuugguggugggggaguaugcacauuuugaauaucaaauugagaauauucuuucuagagaagucuaaaaacuauguugauggauuauauguagaccuuccuuagaaagcuuauauguacgcuuucuuagaaaugugagcaaagaggagugccuuaaauguaugaaaacaacugaaauugaaauaauaugaugcauaagaacuaauaaagcauuuucuuauuuuuuaaaaauuuguaggcugggugcaguggcucaugccuguagucccagcacuuugggaggcugagguaggaggaucacuguagcccaggagaccagccugagcaacauagugggacaccaucucuacaaagaauuaaaaauuagccaggcaugggugacaugugcuugugguccuagcuauucgggaggcuaaggcaugaggauugcuugaacugcagugagugaggcugcauugagccauguucaugccacugcauuccagccugggcaacagagcaagacccagucucaauguuuuuuuaaaaauuuuauuuuaucuguauuuguauuuuauuaauuuuuuuucuagacuagguacugauaauuauaguuaacucuucuuacuagguaacuuguuuuuaauacucuaaauuucauacuauauuacucaaaauucagaauguaagccaaagagagauaaaguauauuaauaaauguuagguuuaaacuuguaugauacauuuccaaauagguauuauauauuuuuaaaauauauaauguccaucuuuucuguauugaugccuauacaaccauaaccccagaaguacucucauacugugaaagucauugcuaaauuagguauucacuuucuuaaacacauuucugagaaaagggugucuuuuuagggcagaugacuuagaaguucuuuuacguagccaaggcaaaagauugucuauugaaagcuuggaagggcuauauguacauuuggaggggaaaaaaaauuuaucuuaccuccagcaagaagagauuucuaaaauauugugcugaaacacaauauaccuaggauuagacacuuuuagauaguuaaauauaagaaaugcuaggcaagcauaauuuguauauguauaauacacccugaaaauuuuauucucaacuucacuucuguuuagaucugagacacuaaaaauauuuccuuuagcagaaaauucuucaaugauuauagaaagaaaauuugcuguauagucacaaauuuaauauacaaaauuaagaagugccuuaaaaaaauuguaaccugauaauacuucgcauuaguccucauuucaaauaugugaagcagccaagauccacaaaaguguguauuuucauguauugaaugaauauauuaaaauguuucuuuuaaauuuuauuuuagaaaagauacagugaaaaccacugaaacugaguuagaugaauuugagauuugacuuuguuugcuuuaauauauacuagauagauagauagauagauacauagacagauagauacauagacagacagacagauagauauaaaucucagcacuuuaagaggcugagcugggaagauagcuuaaagccaggaguuugaccagcuuaccagccuggauaagggaagacuuugucucuacaaaaaaaaaaaaaagucuuauuaaauuuuaaaaaauauaauuaaccugguaaugauauaaagauacaauacuguauuguucagucauguauacauauacauauauaucuuauguuuuucauugauuucuauuuugagagauauuuguucuuuaaauauauaucuuuuuguugugugauuucaucuaggcugacagaguacuucuuggugguccugguagcuuuuauuggcaagguagguuaauauuuuuuaaauuacaauuggugacuaugugucgcugauucaccuggcuaauuguaugccuaugacauuuuacaaauuauuuuaaagaaagaaauggaaauacaauuaaaguauauaaacacuccauuuuacacaguguuuuuuaaaagaauauauauaauauauauuaaauauguguauauuccuagaagaaaauaaacugaauauuuaaaaaguaaauacauacuuuuauguuaaauauauuuuaaaaguaauuauauaaaguaauuuauuuuuauugugugugauauauacuucuccaugucuguacucuaggggccaugacauagucauuaggcagugugcgaaaccaaucuguauaggccaacuguggcauucuaaaaguugaagguuuugaaaguauuuugaaguugcucauuaggauauuuaagucauuauuuuauuauuacugauauugagaaugaucucuaaguguuuggggacuucuuaaaaauugaagcugggcaugguggcgugggccuguaaucccagcuacucgggagguugaggcaggagaaucacuugaacccaggaggaggaaguuguagugagccaagaucauacgacuguacuccagucuggguagcagagugacacucucucucaaaaaauauauauaaaauaaaauaaaauuggaggaucuuaauagguuuuuaaaaaauauuaaacuggcauugauauaaagaugcauuauuauauuauucagucauucugggaggccuaauuaaauuaccauuugaacauauguacaauagauuauuguugacagugugaauauagauaacuaaaacuuuauuugcuuuauguuucuuuauguaucauuagagauacacaauuauuuaucucaucaauauauugacauguuuaguuucugcuaaaaagugccauuuaugaggugaacuauuuuguauuagcauucugauauucaagcauugucaguguuuggaagaauuagaaaaccuuugacuggauugauuugaaaguuucaaauuuuacucuauuuucuacacuaugcuuuccugacuugcuucuuuguagaaaacaugcuugcuuuugccuuguggagagggaagcuaaagaaagagauuugcuggaggaugacaggauggaaggagaauaagaagaaaagaaaacuaggaauaagugaaauauugaaagggaaggcaaaggagggaauaaaaaaauagaaaauucaggcaucacagacagggaucagaaugugagacauagcaaagcugaaaaauuggaauuucuaugcauuauacaucuauugggaaauaaaaugauuuagaaaaauuauaauugaguuuuacuguuuuaaaacaaaaauagcaguucuaaaguacauaugagaaaauaggggauauuaacacuuuauaguuagauauagaaauauggauuuauuuuucuucuuuauugcugauuaugucauucaguggaggggaaggaaguaucugaugagcaugccugggaaccaaaacugucaaggaagcuaaauuuugugauucucaguuaggacuacuuguuaacucugucuuuuuaagagauacagcugugaaaauguaugaccuuuuuuuuuaaugccauggguauugcauaaauaggaauaauaauaaauaggaauguguaauaauuaggacacaguaauaaauuaggacagagagguacuauuaauauuauauuuauuagaauuuuauuacaaguugucuguaauauauagcuagcagacucagugaauuggcaaauaguauuuuguuuuaauaagauuaaaaucagcagaugucacccuggauaaguacguuagaaugaauuuuuucacagaucucagaauugucguuguuagaauggagaaaagaauaauguuuuauucagaagaaauaaugaauuuuccucuguucuucaauucaggaaauguuuauugaauuucauauguucuugguaccgcugaagcccagaugauaaaguagugaccuggacagagaaagugcuucugugcuguagauccagucucugugacugaacagaugggaacaggacugaaaauguuagcuguuacacauuucuuucuaaaacagcagaaaugauaagagauuacuguguccauauuguggagacaacacuugauaaaccagcuauccuuucuuggcauggagggcaggcugauuuuuguguagucaucuagauuucuugucugcuuaauaacaagguugugaacaaaggugaacucauccauucagguuguuuccuaaagauguuuaaauuacuaguuaaaaaauaucaauugaaccaauuauucugauuauaaaaguaacaguauuguuucaguaaauuuuucauguuuuaauggauuaguugggugauagccuuugauuuuauuauuccguguauuuaacauugcuuucuagugauuuaagacaaguccuguuuucuuaaauuuuuauuagcagagacuacuuuuaaguacuggcuuaaacagaaauaauuuuaaguuaagaauauccauuuucaaauugaguaugaucaaggagaguuauguacggcuaauaauuagaaguacuaauaucuaauauuguuuuccuucaugcagguaccauacauuaucuguaucauaaaguuuccauuugaagguuauuuauuuuauauauacacccuuuuuuaggucagcuuauuucggaucaaguggcagaaaucguaucuaaauacgaccccaauguuuacagcaucaaguauaauaaccaauuagcaacucggacugcacaagcuauuuuugaugacagcuauuuggguagguaaaaccaaaauuuacucauuuuuggaacugugguacauauaucuuauaucugaguauggucuuuuaaguagaaaaauauuuuaugugaaauagauuaggauuuuuugaaacauacagaauauacaauuucaaauuguuaaugaguacuuugguuauguuacguuucaguaauugaaauugaagacagugauuauuugugcagugauaauaauaauagcuagccuuuaagauaugcuuacuguguucugggcauuguucaaggugacuugguuuguauucacucauuuaauccucacaagucaagcauacuguauuauucucauuuuguaggugaaaacacugaggcacugagacgcaaaauaacuugcccaaagucacucgcuuguaacuugcuguucagagauucaaauggagacagucuaacuccugaaguuuucuucaugauguuaaauaaaaguuuuggucuuuaggacuuauuaacauguguucucucuuucaauuucuuuaugauauauuaaaacaagucauauaugacagaaauaguacuugcugauugagagaauuuauuuguucuuuaugaugaguuguaaauuugguguuuuuaacagacuccuuuguaaaguuaauaagacaauuguaguuuuguaauaaaaauagacuauuugaguauuuaacucaguuucauuuaaaauucauaugucauauauauaugaaucuguuaugacuaggggacaaaauauugcauaaguaaaggaguuucuugaaaauauuuucaaggaaugcuuacucagcaagccugcugaagauaacguccuuguccugaugguucuccccuuugguuuccuguuuagguuauucuguggcugucggagauuucaauggugauggcauagaugguaugaaguacuugaacuauaucuaaucuuuaaaaaaauuagauuaaguauuugaaacauguggcauugaaaauuuuaagcaguuugaguggcugggugcuguggcugcagccuguaaucucagcacuuugggaggcugaggcggguggaucccuugagcccuggaguucaagaacagucuggacaacauggcaaaacccugccucuagaaaaaacacaaaaauuagccgggcgcggugaugcacaccagugucuagcuucucaggaggcugaggugggaggaucuccagagcccagggagguugaggcugcugugaguugugauugcgccacugcacucccgcccgggcgacagagccgagacccugucucaaaaaaaaaaaaaaaaaaggaaaagaaaauaaaauuuuaagcaauuuuaaaccauuguuauggaauauaacagaagaaaugaggaagauguuagcacacuggugagaguccaggcuaggucugugcugaacuuccucuaguggcugcugaaauugagacagcuacacuuggcuucagugccuuuccuuucugcuucuuuuuagcccccaacacuguuagugauuuccuuagcauuuuccuccuugucuucagcaaauucauuccucugggaggaagaauuagugucuucuuucuuuaggcauccuuuguuaccuucugggccaucucuguacgguuauuaccccauccucucauuguccauccaucuuccuucagagcuccguuuaggaaucacagucuuuaccugauuuugaucacauuuuugugccacagccacuucuaccccacuucaguuugcucuguauuauuuuucauuacuguacuacuaaacuaaauguaguuuuucuucauucuuagguuacuuuaucuugucuauucuuguuuaacaauauuacaaaugacuugagggcuuauuugcauauguuugagagcccuccagaauuuguauuuuguaaauuuugauuuuauaguuuaaaaaugcugggcuauuuauuacggaguaccaauuuuucuaaauugauuguuuguuuugaacugaaguaguaaaacuuaaagcuugcugacauagucacuucuggucugcaacuuccaguguuguccuaaaaaaugaauaauuuguuuguuuguuuguuucagacuuuguuucaggaguuccaagagcagcaaggacuuugggaaugguaggacaguuaaaagguauuuuuuaaaaaaucucuaaguuaucuucuauuuuaccagauuucacauacuucuauuuuuccuucacagguuuauauuuaugaugggaagaacauguccuccuuauacaauuuuacuggcgagcagguaugcuuccaaaauaugaucguccucucccacuauaaaagcaguauguacucauuggagaaaauuugcgaaauaaaacuguaaaaaugaacuauaaucucaucaaauagauaauucuuccaacucuuaccauuuuggucaaacuauuaucauuucucuuuugagcguguguguguguguguguguguguguguguguguguguguaguauauaaacaaaaauugguuuacucuguauuuuucauuuugucuugccuuuuucacucaauauuuuaucaucagaguuucuaauuucuuaaaacuuuccuuggcaguaucagaaugguuuaaugauuccauaauauucaauauucuagauauaagaugggcuuuaaauauuucaucuuuguuuuaaccaaaguaauuuggauauuuuggcuuguuuuuguuuccuuuuuuuuuuuuuuuuaggaaaugcaaaaucacaugcauacaaaaccacaaagacuuccuuuuucuuuacugaaaagaaaaaagagaaaagaauucuuuaaauucuuuuuuaaggaugaucaaugccuuauaauuuuauuagaugcaacagaaagcauggcacagauauguguauuauagauauuauaagcgaacuucauuuuuacuacaugaaauaagauauuucucagcuaaaaaaaugcuaguacuuuuuaaguauuagacauuucucugcgaguacaggcauuuuauaauauucucuguuguaugucucaaagaauuauaccauaaguugguaaugaugaauaaacauuuaaacaguagguagagaaaaaucuuucucaaaguuugcagaucugggauucaagccuuuuuguucaguugagauuguugggcuuugggauaggauugacaggcugacugacuagacucaugguccccagaaaccuccucccauuuguauggcagucaagauugaugcacaaccuggagggcccugcaguugacaggcaguuaggguugcugcagggguggucccuuuguuccguuuugacuucuccagcucaagcagcuucuccugucuggugaccauguaugagucuggauccuacugcaugcacucaaugauacuugcuuuauuccuccuuccacuauugggaaguggggguggcuagagaggagugggaagcguggcuuuuagaugaggacaaaccuggguuuuccaugcucaaucuguuauugcauuggauaagguauuugcugcugaaaaucuguuucuuauuuauaaaaauagggaugcugacaacuuccucaugggacaguugugagaaucaaaagaaaacauucgaaucauagugcccgggacaaagugugucucaguaaaugccauccuuucuuuacacuuccaagccaaacaccauaggugacuaaggcccaugaauauuauucuguuacauagucggcacaucaaccuuguaccccaaacacaguauauuuuauuucacaagcucugaacuuguuauuuaauacagaacacaccuuucauuuucccaauuacacuguaucaacccaaaauagauaaugcaggaaucucccuuaucauucucccuugauaucugagccaaucaaauuugagaagcauugcuaacuuuccuuuuuugguuuguugacucauuuuucaccuuacuuuauauuuaaucugucaucucuuuuaguuuuguuuugcacuuucagcucucuuuagagcuuuccuuuuucacauuuauuuacagcuaagcugcucauccuaugcaagccuguggucuccugugguagggaagaggacauuucugcucccugugcauuauaagcucauaauaaacccaaacacauuuguacugugugugauucaaaagcaaaaucauguggcaaguaaucuauagagauaugacacaaaaaugagcuccuuuccauaucuuuccaaacaguaauuuuuaaacaguaguaguaguuacacauaggggagccaauuauuaucuguuauuaauaauuauuaucuauuauccucaugacauaggcauccauauaaaacuuguuggguucaaucacaacauuugucugugacuauauaucuuuguuagugugcuugugucugguauguuuugggaaguggagagaaagggagauaguaggguaggccugagaaggagaauugauaguccuuagacuuaaaugucauauaucaacaacacuggaaggauauacauguaauauauuguguauauacauguaauauauuguguccaugaucuaggaaaacaacaagccucauuaccugauugucauuguguugguagaauaaacaaaagacaagacauuuagauugaagcacuauaugcagagaaaaaaaauaacccuauuugguacauauauuacaaauguuaauugucuaaacuaauuggaugaaauauaaacauuucauuuucaucuuuuuauccagauggcugcauauuucggauuuucuguagcugccacugacauuaauggagaugaguaaguuuaaaaaaaaauguuuccagaaaguuaucuucucauguuuacgaauacuuuacucaaacuaaacauuuuuuucuucuguuuuuguauuccuuuucugcuaaucuuucuguuuaaggaaacaauuugaagcaaccuuaaucaugaauucuagaaaaccucauauguuuguucuguuuuuuuucaguagcuuuuauaacaugaacaaauaaaguaauuuuaugaauuauucauaguuucuuaaaagaauuaaaggaaguuucaaauuugaaaugagugcucugguaaucauuuuguguuucacugugggugugagagaugcagaaagaggaaaagugaguuguaguaagaaagaaaaugccuacuaagacaugaaauuuguucuugcuuuggugagaaguuucuguucuucuaguuaugcagauguguuuauuggagcaccucucuucauggaucguggcucugauggcaaacuccaagagguggggcaggucucagugucucuacagagagcuucaggagacuuccagacgacaaagcugaauggauuugaggucuuugcacgguuuggcagugccauagcuccuuugggagaucuggaccaggaugguuucaaugguaagaucaaaguuuagcagcuacaggucccugauuaucuguguccaccuggaaaaguucuguaaguccaucuguagaagucuacacgagcaaaucuccuuccuggaaagguggauuguguguaagugaguaacacaccaaauuuaaagacaguuugcuauuuuucuuuaaaaaucagagcaaagauuucaauaauggacucucaugaguuauuauucacuuggccucaaauuagaaggucagaaugauuacuuucugaaaggaaccuucauuacccuggugccuacugcuagcugguauguguuucugcauccugcuuagcagcagugcccucuucuguucauuuggcuacaaguguuaaaaaaaaaugcuuccaggcacauugucaaggcaaugcugacuaaugcauaccucaaagguaugauuugccauuaauauuuuuaaagccauaacuuuguuguagcuguccaaaauguucuaagggauguuauaucucccuuuaugguggcauauuaaaaguauaagccuauucguuuauaauaguaccauuuuaauaguugucgauaucuuuaaaaagcaaaguuagcuuuuacuuuagaacucuuuucagaaaccugaaauauagguuacaaauuaccaagauuuuuuuuuuaaucuguuaaaaaccuuucuagagaucacagaauggauaguugaacuaguuuguguaaucaacaguauaguaagccuaugcccccuuaaaaccuaaaggaaagguauacauuaagaagaaaacuuuaaaaauacagaugacuuguuguaugucucaaacaguaguggaaagguaaauguuguuugcccucaagauuucacaccugucuuguggguaggugcugucauuuacuagaugugucaucuggaagauuaaccguagucauuucuuuuucuuuguuucuuucuuuuuuuucuuuuuuuuuuuuuuuuugaggcagggucucacucugucacccaggcuagaaugcaguggugcaaucauggcucacugcagccucaaccucccagggucaagagauccucccacuucagccuccugaguagcugggacuacaggcucccaccaccuagcccagcuuauuuuuuuuaguagagcugaggucuucccauguuacccaggcuggucucuaacuccugagcucaagugauccuccugccuuggcugugcgaagugcuggaauuacagaugugagccacugugccuggccaacaggagaaguuucagugguagggaacaucuacucagagguacaucugcuaccuaaaauagaggcuuaaagauuuuuaccacaaagagaacuuagcauaaaucaaauggagcuaugguaugaaguucauaauaaaaugugaaaagaacacuauauaacagaccaaaucauuacuuaaucauaacaaaagcuacauaggaaauacagggcuaaguuugagguuccaucaugaauaaaguuaaugaauucuuugcuauguagcugggccucugucucccagguuuucugggaagccuggucaugugugaucuucaccuugucuugauguuauuccaguuacuuuaaagaaaguuuucucauuacugugaucuagccaacaucucuuccagcuuucuaaguuuuuguuauaaugugucgucugucaguagaacaaauauagacaacagcuuuaaaaaaugugaaguuuuacaaugauuuuacaaagggcuaaaauauagauaaaaucauccauagaggaugauuauggucucccaagguuucuccuugggucuuacuguagcaaauaguagauugugaaugauaaugucuuuagugaaaaauuaucugagcuguauuuauguauaguauuuaguacauaugugcaaauauaguuacauuauacauguauauguucuauuaguuauguuagaucuuuuguuguuguucauacaugaagacauuaagugucauuguuccuguauuccuauauuccucucuuuccaccuacccccacccuaggcaucaucaagagggauauugaaaacaaaacaauaaaguuauguuccaaaauuuuauauagccccaagguaauuaugugcaguuuuuuaucaguacuuuuccagaaaaagcagaggaaaaaaaagaaaagcaggaaagagcaucuaaaaugaucaaaggaagaaaucaauugcaugaauguguaggauuuuccagacucgacagaugauagcgaagagagaagaugauuaacauguauaaaauaaugaaacguuuaggaaaguuacagauaauuuuuauuaaacagucacucaacguuggagccaucuuuuguugcaaaauuauguuuuaaugaauacuuuauuuauuauuuguugagacaggguauugcucugucacccaggcuggagugcagugguacaaucacagcucacugcagacucgacuucccaggcucaagcaauucucauaccucacccucccaaguagcugggacuaccaaugugcaccucugugcauggcugauuuuuguauuuuuuguagagauggggcuuugccauguugccaaaacuggucucaaacuccugggcuuaagugaucugccugccucggccuccaaaggugauaggauuacaagcaugagcuaccguggccagccuguuuuaauaacuacuuuauuaaugcauaugucaguagagaaguuaugcuuaucuuugguuuuuuuguuuguuuguuuuguuuuguuuuuuguuuuuuuuuuagacugagucucauucugucgccaggcuggagugcaguggcacgauaucggcucacugcaaccuccgccuccuggguucaagcgauuccccugccucagccuccugaguagcugggacuacaggcacccaccaccaugccuggcuaauuuuuguauuuuuaguagagauggaguuucaccauguuggccaggauggucucaaucucuugaccucgugacccacccgccucggccucugaaagugcugggaauacaggcgugagccaccgugcccagccgauuuaccuuuaaggcuuaaaaaaggauaaaaagaauacuuuuacauaaguuagguacucauuuuuaaggauaacaaauucuuaguugguguuuacugcaggccaggcacucuucuagguggugaaaaugagcauaaaucagagucuacucaugucuuuaagaaacucagcauccaaugggggcagcauauauguuuaaaaaaaaaaaaguaccucaaugugaucaucacaguguuugagaucccaggcuuaauggucucauauaaaggaugagugaucaaggcaucguugauguuucaggggagccaggagaugaugaggcauggcuuauuaaggagcuaugagacagcucguguacauuaaggaaauugaggcaauuuguuaugacugguacguagggucugugauaggcaagauacgacauguccuuggucucaugaagcuuauguucuauagcuuacuuacuuuguguagucauagaauaaguaaacaauggggaaauccagauagugauaaagaugauggauuuuuuagaaggcaagguaauauaauagaguuucgggauagagagggugauagagaaaguagggggucgagagggguggugcacugcugcguaggguggcuagggaauagcuugcugacagaaugacagcugaucuaaugacagaacgacauugaucuaucauuuggacaaauagaaggaauagaguuguaaaagcucuggagcaaaaggcagagagaauagcaaauacaagcccauaguuggaagcuagcuugguguguuuaauaaacagaaaaaaaggccaggauugcuggaaagaguaaauaaggguaaaaaacuggauggcguggggguggggauggggagaggaaugagauuugcaugguaaacaauggaaauaccagguaggguuuagaacuuacucuaaaugcuuugggaacuaauugaaggauuuuaagauggggaugggugugacaugauauggugaauguuuggcccuuuugaagagaaaguuacaggcaagaguagaagugggaggccacuuaaaaggcuguuuaaggccgggcgcgugguucacgccuguaauccccccacuuugggaggccgagguguguggaucacgaggucaggagaucgagaccauccuggcuaacaccgugaaaccccgucucuacugaaaaaaaaacaaaaaaaauuagccgggcaugguggcgggcgccuguaguccuagcuaaucgggaggcuaaggcaggagaauggugugaacccaggagguggagcuugcagugagccaagauugugccacugcacuccagccuggggaaaagagcgggacucugucucaaacaaacaaaaauuaaaaagaaaagaaaaaaaggcuguuuaagugcaaaaugcggcaaugacuugucuaggguggcagcagcagagagagaagugggcagauugguaauacauuuuagagguagaaaagauaauuugguguuugggguuuuuuaaagauuuaaaauguuauucauuuaucuucuuucaguguaaguugagcaagaucaagaugaagucacaacuuacgaauuucugagcagauuggcuucuguucagaaaaaacaauaccauccauaaauaaauuaucuagaauuuugagagugaaaauaaacuuuagaugaaucuuuugauguguccuccuccauccccuaccccuaguuuuaaugaggaagcauuugugguccagaaaguuuaagugauugguuuaaggucagagccagauuaucuggcccuaaauuaaugucuuuucuguacaguuuugcuugaguuuccuugaauuagauuauugcuuauggauaaagaguacccuacugaacuuugaauuaguauuuaucaugaugaauggguucuauaaauauuaagaucuguacaaauaauuacaaguacugaaacuuucuucucuucauccuugcccucuuccccccuucucucguuccuuccucauucuucccuuucuuuuccuccuccuuacuucugucauucuccuucccccuccucuuuuuuuccccacagauauugcaauugcugcuccauaugggggugaagauaaaaaaggaauuguuuauaucuucaauggaagaucaacaggcuugaacgcagucccaucucaaauccuugaagggcagugggcugcucgaagcaugccaccaagcuuuggcuauucaaugaaaggagccacagauauagacaaaaauggauauccaggugcuuucuuaucaacacauagagcccuuagauuuuucaguccuaauagcaaauaguauuaguuacuguucuugauuuauguuauaaauuauugcaauucaguauuucauauguugaucaaaccucuaaaauauucaaggcaucauucccgucaccuaaggguauaugaagaaaagucagcucucuuuccugggaguguacaguguacucugaguuucuccuguagucuuuaaugaaaugagaagaguauuacagaaguuauaaacaaaaguuaaaugcucauucuaagcuguuuuaauguuagcuaucuuuuuuauuuuuuuaauuauguagaauauauguacuugacuaauaguugugauuuuuuuuuuuuuuuaagacaagguaugucucuauugcccaggcuggaguacaguggcacaaucuuggcucauugcagccuccaccuccugggcucaagccauccucccaccucagccuccuuaguagcugggacuacaggcaagcaccaccaugccuggcuaauuuuugcaugguuuguaaagagugguuuuugccauguugcccaggcuggucuugaacucaugagcucaagcgauccaacugccguggccucccaaaguguugggaauacaggcgugagccaccgcacccggccuucauugugauuuuuuuuucaaguauauuauuuuauuuaauucucccauuaauacaugaguuaauauaagcucauuuuuauagcucauuauuauaccauuucugaauguaaaaagagacugagaaaggcaguuuacccaagguugcccacugcauagguccaguagagcaagcaagaccuuuuucugguucuuauacacuuuggagcauuauaaauggaucuaggaucaaaacagaucuuuucuuuaaaugaaauacaguguagaaaauuuagaugaccuuuguguugaaacacuuaauaugagcucaauauacaaguguguuggucuguuuccagaaauaagacaugaaguggauucucauaaauuaguaguauuuuagaguuuuuuuguuauaaaugcaauauauuuguuauagaacuuuuagaaaauacaucaaagcauaucuuuucaauguuuuuccugugcagucacacacauuuuuuuaaaaaggaaaucaugcuuuuauaugcuauucauaguguuuuauucaacguuucagaaacauuucuuuauuauucuucuaaaacaugaauuuucuguuucccuuuguaacaaauagcugcaucauaucuuauuuaccuuuuuuuguggcauuuuuaucuuucuuuauaauucuuuugcauaucucugauuaugucauuaggacaaaauucaagaaucacugugucaagugugugcacuucuuuuuuuaagguuauuaauacacauggucaaguuaccaucccacucccuccacaggaagguuuuugucaacuuuuuaaagcacucaccagcaguaaaugagucauuguuuucccauacuugugcuucuuuuaaaauaauuuuuaacuguauaacagguggacaguguauuuuaacuaacaguuugugauucuagaaauaaggcaugaguuugauucuuuuuuuugagaugaagucucgcucuguuacccaggcuggagugcaguggcgugaucucagcucacugcaaacuucaccgcccggguucaagagagucuccugccucagccuccugaguagcugggauuacaggcaggcaccaccacgcacagcuaauuuuuguauuuuuaguagagaugggguuucaccauguugaucaggcuggucuuggucaggcuggucucagucaggcuggucucgaacuccugacuucgugaucugccugccucaaccucccaaagugcugggauuacaggcaugagccaccacacccggccaucagguugauucuuaacuauacauaaauaaaaaugauuauuuuuacuaauaaucuaauguauaguuaugagguugauucuuaacuauagauuauuaguaaaaauaaucauuuucauuuguguguauauauauauacauuuguauauauauacauuuguguguauauauauauacauuuguauauauauacauuuguguguauauauauacacauuuguguguauauauauacacauuuguguguauauauauacacacauuuacuucugugaauuuccuuuuugugucucuuuuuucuucuuugcuacugggauuguauuuugcuuuucuuucauucauucauuuuuuuuaaacuuucacagugccuuaaauguugcaaauauuaacuucuuaacucuuuuauguauuuucuaguuugucagauuugcauuuugagcauaaaguuuuaaacuuuuauguuauuuaaucuguuuuuauuuuuuuuuucaugugauuuucuguuuagaaaagacuuccucaaauuuagcuuggguauacugugagauagagcucucauuugacuuuuucugaaucgugaaccaguugaaccuguggcauaugaaaacuaaugcauuucauucuugcugauucgagugcuaucugcuauaguauuuuauauauauacacacacacacauuauauauagaaaauagaaaggaaauuuuacaguaagauuguaaaauccacaggcgucuauaaagcuuuuuccuuuggcaguauguauguuuggcagguguaugauuaucauugcuacuuuuuacuaaauauucauuuaaaagauuuauauccaccuagaugaaagucuacuuuaugauaagcauuuuccacuggugguaguuuguuuacaguuuucauauauuuuagccuuuuauaugaugucuuacaaccucuuaauaguuuugagaauuuguucaaaccuuuuuauauucauugaaaauuuuauagaaugguauauacauuuuaaaaaccauuaucauuauuaacauguuuuuccacucuuucuuaagacuuaauuguaggagcuuuugguguagaucgagcuaucuuauacaggugagcauuuucuguauccugcgguauaggaauauucugaauuauuugaacguuuuuuaauuaagugucaguguuugaauuuuaguuuaauuuucuugaaauaaugauaaaauuugcucuuucuauucaugauuugcuaugggcaaauaguauuauuuuuauugguacauaauaauuguacauauuuaugggguacaugugauauuuugauauauucauacaauguaauuaucaaaucagaguaauuaggauauucaucaucucaaacauugaucauuuauuuguguugggaacauucagaauccugucuuccagccucucuucuaguuauuuugaucuuuuguuuucuuuggagacagaguuucagugcagugggaccaucucggcucccugaaaccucugcccccuggguucaaacaauucucaugccucagccucccaaguaggugggguuacaggcacaugcuaccacaccggcuaauuuuuguauuuuuaguagagacaggguuuugccauguuggccaagcugguccugaacuccuggccugaagugauacacccgucucagccucccaaaaugcugggauuacuguuaugagccacugugcccagccagcuauuuugaaauguacaauaaauuauuauuaacuauagucaaucuacgguguuauugaacacuagaacuucuuuuuuuuuuuugcccaaucuggaguacaguggugcaaucuuggcucauugcaaccuuugcuucccagguccuagugauucucgugccucagccucccgaguagcugggacuacaggcaugugccacuaccacaccuggcuaauuuuauguauuuuugguagagacagggucuugccauguuaucugggcuggucuugagcuccugggcucaagugauccaccagccucagccucccaaagugcugggauuacaggugugagccacuaugcccgccccuucuuugucuuuuaaauuauguucagagguauucuccuguaguuuuaaucucucuaaaaauugucuggguuuacauuuuccuauaagaagcaggaaauuaaccucaugcuuaugucuugguauucucugaccacaaggucaguauguaaugaaaccccaaaugaauauuuuuauuagagcaauauguaugaauuuauauauuucuauuucccaauuucuuauauauccccaguuauucucuguauuucaucaauuccucaugacguagaauaucaguuggcaucccaaguaguuaagauguuuauauaucuaugaucugaguuuauacauggcaggaacacuaacauuagugcuauguagcggaguuugcgaugggucaauuuaauuguagcuauacaauacuuaacagauuucagaucuuuaucauuuugagacaggcacauugacuugagccagcuguauuuuuguauaggauuuaaaccuguguaucugaacucaggaaaacuguauuuauuuuaauuuauuguuuuuaguuuuuaaaauugcuguuaauuguauaauguacgugguaaaaaugcaaacacuauaagaaggguauauaaaaaaaaguuuucccucacaccagcuaauaauuuauuuguuucuucuauuagaaauauucuaugcauuaaaaaaucauauuauguauguauguauguauaucaguagacauucuuuguacuuuuuggguuuuuuuuucucucccacuaaaacuauauguugguuaugucuuagaggucaucccacucauuuucuccacgguagugcagcgaauucgguagauaucucacaacuuauuuagccauucugcuuuagugacugaauucauauaggccagccauugucccacuuugucuggaacugagcgauuucccaggaugcaggaguuucugugcuaaaauuaggacaguucugggcaacuaagacaguugaucaccuacgguuauguuguuccuguuccuuuuacuauuacaaacaaugcuuuuaguagacaugguacuauauauguagugaauaugaaccaaaaauauuucaaucaaccuaacuuuuuaaauaauuuuuuacuucaucuucuuuucccucccccgcuagggccagaccaguuaucacuguaaaugcuggucuugaaguguacccuagcauuuuaaaucaagacaauaaaaccugcucacugccuggaacagcucucaaaguuuccugguaaggguauuuguuuaauaauaguuauuauugugauuauuguucaggcauuguaagaacaauugaaaaugaaggugguagggcugaaauauugcuaaaacaguuucugugaguauacuguuuuuucuauucuuuuuuuauuugaagcaaggucugccucuguugcccaggcuggugugcaguggcacaaccauggcuuaagugauccuuccaccuuggccuuuauaguagcugggacuacagguguguggcaccauacccagcuaauuuuuuaaauuuuuuuagagauggggucucccuauauugcucagguuggucucgaagaccgcugugcucaagcagucauccugccucagccuccuaaagugcuaggauuuacaggcaugagccauugcaccuggccuuauacucuauuuucauguuauaaauuggauuauagaaauagugcuccaaaaaggauaucuaaaggcuguaaagauacucuauaaauuaguaugaaauuaauuuuuaaagaauuaugcguggucaaugaauauuuucaaaaagaaagaaaagcuaauaagaucucaguucauuuauauguaauuccaaacaggcccaugaacacuuacauuuuuaaaagauaucuuguuuuucugauuuaauaucuaugaacaguuguaugaaaaaaauuauuuugcucuaauauauuaauuuucugcuuauuccuuuacuaguuuccaaagaaaaauauaauaauuuuucauaaguuaaaugucugaauucuucucuacuccauucuuucucucaucuuugucauuuguaugcuacuucaguaauuuuugcucuauuuucauuauagauuuuuuuuuuuuuuuuuuuuuuuuugagacggagucucgcucugucgcccaggccggacugcagacugcaguggcgcaaucucggcucacugcaagcuccgcuucccggguucacgccauucuccugccucagccucccgaguagcugggacuacaggcgcccaccaacacgcccggcuaauuuuuuguauuuuuaguagagacgggguuucaccuuguuagccaggauggucucgaucuccugaccucaugauccacccgccucggccucccaaagugcucauuauagauauuuuuuuaaguugucucgugcuuuacuucacaguauuuaaaagcaaaauguagaaaccaguaucuuucucauacauaucaauauaaauauaaaacuaaugaaaaaucuugacccauauacuaccaaaaucaccaugaguagucauucaugaguucccacuuugggaaacacuauucauguuccuuacuuacacagacgaguugcagagaacuuaugaucaaggagaaaaugauuggugccuaaaaaaguuuuacuucaaaagagccaauuaaagauauuguuccugaauuuguuuuugaauauuuuugaauuauuguuauaguuauuaaaauuuugaaacuuucauuucuuuaauuggauuacauuuaaaaauucaguaauauuuggucuucauuuuuauugaacuggcaaugaaguuguuuucaagauuuugcuguaaguuuuacugcuuuucuacccugcauaccucugugaaguugccaauaaucugcuucuaauuauguuaguaauucaaaggcuucaaaugcacuaacuagagcaguaacaucauaugauuuuugaguauggcacauagaaauacauuuugcauuauaaacacauaaaaguaauuaaaucaagcauuucagaaaaucguacuuaccuuugauaccuaaaucaguuuuauuuauuuauuaaaaaauuuuucuuaagaugcugaacacaacccauuaaacugguuucacaaccugcuaauaaauugugaagaacacugcuguaaaggagguugcuaauuaaagaaaguuuugguggguccuuuuaucaaugagacaguuuuuaaaaucugaaccguuggcuaggcacaguggcucacuguaaucccagcacuuugggagaccaaggcgggcgaaucaccagaggucaggaguuugagaccagccuggccaacguggugaaacacugucucuacuaaaaauacaaaaauuagccgggugugguggugcaugccuguaaucccagcuacuugggaggcugaggcaggagaauugcuugaauccaggaggcagagguugcagugagccgagaucgugccacuguacuccagccugggcaacagagugagacucugucucaaaaaaaaaaaaaaaaaucugaacugucauaccccucauuuagauuuaucaauagguucuauaagcuugagagaaaguuaggacauuauuuuucuuuuuuucaucaagguaccaugaaaggaaaugugcuuaaauuacugaaggaugaguuagguuaguguauauaguuucauguuuuuagaauaauauuaagacaugaagaaagauguaaggcuucacaauacaaacuauguaguagaaagaugagaugugggugauaauaaaaauaugucuaaacugaauuauagaauuuauguauguuuuuuauuuuuccacaguuuuaauguuagguucugcuuaaaggcagauggcaaaggaguacuucccaggaaacuuaguaaguguucuaugaaaaaucauauuauuuuaaugauacugcauacacagcacuuaaaaaauauuuuaagauauucaaauaguuacuugaauuguuauuauaauuuuuuauuugaauguuuaugcuuaaagacauuuaagauuucaacauaauuauauucuuugguaacccuuaagcuaauucaaaaauaauacacuuauuuauggacauuaugagcuaaauagcccacagaaugguaaauaugaccuuuagaaguuuaagcaguuacgaaugugacauaaugaacucuggggaaauaugaauauuaugguuuauaaguagaugaucugcugagaagucuguauuuuaugucuuugagcagccccaagcaaucucaggaguagaggugguuuagaaauagugagaaggaggagaaaaaguuuuggucaugcaauuuaauucacacagcaaacucuacucuucuuuuccuaaaaugguugaugugguccugagagcaagauaggcaagauaggaguguuaaauaauuauugccaggguuugucaguauguuaauggcaagugguaaggaauaauaguaaagcagagaagaaacugaaacuguuggguguguguuugugugugaaaguuuacauagggcagccaaguaaggucucccuaggagaaaacuuuucaguagagaccugaaggaaauaagggagcuaugggauguguggaggaguguuugccacagaggaacuggcaguuucagcaggccugaagcggaaaaugugcucagugguugagaaacggcauggaggucaauauggccuaguagaacagaacaugaagcaaaauaaccccggguauucacccaaauuugaaauaaaggucaccuuuuagagaaacuugcgacgcgaauucugguuuuaaagauuugcacucucuuaaacuauuuaaagaacugaaucuuacaaggcaguaauccuaauugcuacauccuuuuacaaugauucuugaugcauuuaacucuguuugaucacuugcuuccugaaggcauauucaucugacaguuugauaugauagcuucacuggaagcaggaguuucaaguggggcaaacuguucauucaucauaguguuuaauaugaugguaugaguacauaugagcaaauacuucuuaaucaaaaucagcaagacucuugcuacuugaauuuaugauggaagucuuaauucacauguuucauccucuggauuuccuccucucagcuuaaauuaaaagauagcauuucuccugucugauaauuggcuuacuacuaucauuuuuuugggaauuauuuaugacauuacuuuagggaaaguuuaauuaauuauuuaauuauuauuaaauauuuuuucagaauuaauauguuguagucucauuacaauguaaugacauuuuaaauuaauuagaagcaauuuacuucuuaaggaauaaagaucucuguuuacaugaaaacucuagaguaggauagauagauguccauaaagaauauguugguuauaaauccuuugguuuacauagauuuccagguggaacuucuuuuggauaaacucaagcaaaagggagcaauucgacgagcacuguuucucuacagcagguccccaagucacuccaagaacaugacuauuucaagggggggacugaugcagugugaggaauugauagcguaucugcggguaagagcuaacuuuucugcuaccuuguuguuccuuuuuagucauuaguuuuuuaucuaaaugauuuucacuuucuguaaauuaguguuagaucaaaaggaaaaacagaaaaauacacaaaggaaauuuagcuuuguaaagugucauaccugaaugauggacuucuacuucuggcagauuggauauuccaaauggccuuuccacaacaauacuacugaacaaauuaugauaaacauauuucuuaaaugcaacugaacuuucaagacaguaaaagaaaucaccagaguccaaaaaaaaaaugagcaaucaacuaaaaaacuccaguggcaaaaaucugaauugugaguuauaagcaaauauaugagcgagaguugcuggcaaaggaugaagccuaaggagagggcaggugguaauugcagacaccagcacaggaauuccgacaguuguauaaggcuaaguguucuuacgacagaggugcauucugauuccagcaagagccaaauguaaaaccuugcugaaggggagcaauccaguaugggccccaggauuuccauagguuaaguuugaucaaauaugaauucauuaaacacacacacacacacacacacacacacacacacacagaagccacuagaagaagcaucagauuuuagacccacaaagaccagcuacagagcacaaauuuguauaaaauguuuaaagaaauaaagggccugggcacaguggcucaagcuuauaaucuuggcacuuugggaggccaaagcaggaggaucacuugaggccaagaguuugagaccagccugggugagacucuauuuuauuuaaaggaaaaaacaaaacaagacaaaaacaucaguaaauauuuagacaacaacauaauuaaugaacuugauuuaacagacuuauauagaaccuacaccuaacaacuaaagaauaugaaaacugaccaugcauaggccauaaaggaagucuaaacaaauuucaaaaaguaauuuuauagaauacauacuaucacagugcaguuguuagaaauccauaacaaaaagaucaacugggaauugggaagugugauuuuuaaauaacuuaugggucaaaaacaagaucauaauggaaauuuacuugcaaccguauuacaaugaaaaugugacaucaaaauguauaggcuaucacaacaguagaauguaaagauaaauguauagccuuaaaugcuauuuaauuuaaaugaaaguuaagaaaaaaugaagguaagaaagaaacaccacaaaauuaagaauugagaugggacauuacagauaagggaggaauuaacagaauauuuugaauaaccuugggccaguacauaggaaaacuuuuagacaaaucauggaaauucuuagaaaaacaauacaacugucaaaagaagaaacagaaaaccugaauaauccucuaaacacuuaacaaauagaauuggccauuaaucuuuacaaaacgacaaagcccagaugguuuuauaggcaauaucuaucaaacauucaagaacaagacuucucaauuuuaaauagcucuuugaaagaaaaaaaaaaccaaaauauuucaaagucaaucugugaaacuaguguaauugguuccuggaguggucaaggauaguaccagaagggagaauuucauucuagucuuacaauagauguaaaaugacuaagccauuauaagcaaauaagucuuagcaguuuguaaaaaaagauacauaaaccaaguuggauuuauccuagaguggguuaauauuaagucuaaaaauguaauuuaccacaugaauagauuaaagaagaaauaugugacugucuuuuuuaagugcaaaaaagguuuuagaguaaauuuuaaaaacuucaagauuuaagaagcaagacaaauaccccaaguuaugacuaugaagaaauagaaucuuacauuuaaacaaaguccaccaauaccuauuaauuggucaagaugugaauuaagaauucuuauacauugcggacggcagugugaauuguuuugaagacuggaaaauaaugugguacuacagaacugacaaauauacuugucacuauauauaagaauaaucacagcaauuucuguaauagcaaaaacaaaacccauaaacaaucaaaauagccuuugacagaauggauaacugaauguauauuuacaugaugaaauaguacucaacaguacaaaauuaacguaggcuacaugcaauagaauggauggaucuuaagaguguaggacagaaagcaagucacagaagacuacauguaauccuauugagaaggaaugcagagggaggaagagaaagaaguauuuggguagcuuaagcaguaucaauaauguucuuauuauguuggguguguguguuugagugcucauguuguuaacaugucucguacuuucgugugaaucaaauaguacauuguaaaacaaaaauugacuaaaggcucuuacuugauaaggauaaucuucuuuuggauauucuauuucuacauaaguauaauuuuccagagaauguuguuagaauugaaggcucagggaugaauacagcuggcuuuguaaugugcacuuauggauuucuccagauaauuuagguugacguuaucauuaauucaaagcguuuccauuucuaggaugaaucugaauuuagagacaaacucacuccaauuacuauuuuuauggaauaucgguuggauuauagaacagcugcugauacaacaggcuugcaacccauucuuaaccaguucacgccugcuaacauuagucgacagguacuguacucaguuuaccacuaaugugauauuuuguuauuuuuuuuuacaauucauauuuuuaaauauuagaggagauuuccuuuaucauauugauagauguuuagucaaagucagaaguuuaggaaucugaauuuucuauuuuuuuuucuuuuugguuuuuauuuuuuugggaaucugaauuuucaagucagagauauuuaaagccacucaacauggagauauacagagaaagacauuucauauacaugaaauaggaaaauaauucaagaacagcaaagugccaguuuguuuacauaguauuuuaguauuuugcuaaauauauuugauaucuguuauuuuugauauuuuaauuuuaaaaagugcauauauaguaaauaaauaauucuuuucagaaaaccaaagaaagcaacaaaauuugauaggugguauucuaguuuuagaaaaucuuauguguaauguauuuaaauauuguuaauucuaguuacuauuucuccuuuuuaaauuacauguucauguuuuuacauuaauauuucuuccuucauaacucuuugcccuaaauuuaguuuaucauuuuuuuuuugucuuucugagaucccauaagcucuuuuuuuuuugguuuguuuucuguauaugugacaguagcaaaaggcaaauuaaaauauuuuuaaaagucuuuucuaauuuuuauauuuuaacaauuucauauuucauccuguacauuaauaaucauaguauaugugccauuuucuaguauucauuaacauagaacuuauaaccauacuucuguguuuauauucuuuacauuuuuuauuuuuaaugaaugcacaauauuauguugauuaauaguuuaauaaugaccaucugagccucuuaaugucugucauucaguauuauacuuucuuugaaaguuaauuguuacuugucacuuuauauuaugugcuuucauauauggguuaugguuauuuucuguuuauaguuuuauaauuuuuuagaaaucuuuuauuaucauuguuaucacuacuuuugauuaauuuuccaaacuccccauccaauuucuuuaaugccaauaccauguuaaaaccagcuaaucaaguaggcuaacuuuugaaacccuuggagggcaagaauaacugcaguaauauuugacuuccuuuuuuucccaccuauucucauucuucauuguuugaaaaaaauuuguuuuggucuccucuguguccuacauuuguuccaucagugacauuauuaaguuuuagguauguuucuuucugcguucuuagcuuuguuauucgcucuuguuuuuauguuaauuacuuaccccaccauuuucaucauuuccuuuucucuaaaauggaugcuucauuucacugguuacguuacaaacucuuccaugcacucucucuuugcugucaaauagaaauacaaaguuuuaauuguaauuuuuaauuuguaauuuuuaauuugcugguuagcaacauuuuuuuaaaagguagaaaagguauaggugaaauuuauuuuaaaaauauaucuauauuaguuuucuagggcugucauaacaaaguaccacagaauggguggcuuaaacaacagaaauugauucucuccuaauuuuggagccuagaagucugagauccagagucagcagggcuaauuucuucugaggccucucuucuuggcuuguagacagucaccagucaccuucuugugucuucacauggucuuccuuuugugugugugucuguguccuaaucucuuuuuaagcaucagucauuggauuagggcccaccuuaaagacguuuuaacuuaauaacuucuugaaagaccauauugccaaauacaguuccauucuaagauacuggggauuaaggcuucaacuuauacauuuuggggggacacaguucagcccuuaaugauauuuaaaauauugucauuuuuacauggaaucacuuaaaaauuaucaguggaauauuuugcauucuguuuuuuacugucuucaaaauccagaauguauuauauacuuuuaacacaucuaaauucaaauauuuagguuuuauuagaaauuuuuuuuguauuuagaauccauguaauucacaguugaaaaaguagauucaaauacucaaguuguucuaaacauacuaaaaguuuuguaguaagagaauuaagcaucagcuuuuaacauuaaacuaauuuaaauuaaauaaaauuuaaaaaucaguuccucagugacacuaagcccauuucaagugcucagaagccacaugaggcuugcgagcgguuacuauauuggacaaugcaguucuaguguuucccuuucugcucccuaauccuuugguguuagagauuuagugcuuucugcagaaagaguuggguuuuuuucucucauuuuuuucauucaaauacacauuaaguuuuuuuuguuuuuguuuuuuuuuuuuuuuuugagacggaaucuugcucuguugccaggcugaagugcaguggcgcaaucuuggcucacugcaaccuccgccuccuguguucaagcgauuacccugccucagccuccugaguagcugggacuacaggaacccaccaccacgcccggcuaauuuuuuguauuucaggagagaugagauuucaccauguuguccaggacagucuugaucuccugaccucgugauccacccaccuuggccucccaaagugcugagauuacaggcaugagccaccguacccagccucaaauacauacuaauuucuuacuuugugcaagauguaauauauauaacuguagagacuugguuuucugagcauggaagacauugcuuuuccauuucugaaacuaucuuuccugacagcauauuuuaauacuauggcugcuucaaugccagcuaaguccuuuuuuuccccuauagagugauaucagccaaauaucucuauauuacaguuuuauuaauauuuuauacauaugucucauugcaaacuuaagauacucaucuaacauucuaacugggaauguuauacauaccuuaucacuaguuaauuuguuaucuguaaaguccacacuuugaucuaaucaagcguugauuuauauuuggcaugauguaaagaaucaccauauaguucuucuaauaguccuuuuuuaaaaaggcuuauagcaacugcuuauaucuagguaauugaauuaauucacguauauuuuuguguuuccuucaaauuaaaacgacaguuacgaaucuuuguccaauauauagccacuugcaagccucauguggcuucugagcacuugaaaugggcuuagugucacugaggaacugauuuuuaaauuuuauuuaauuuuaauuaauuuaacguuaaaagcugaugcuuaauucucuuacugcaaaacuuuuaguaaguuuagaacaacuugaguauuugaaucuacauuuucaacugugaauuauaugaauuguaaaugcaaagaaaauuucuaauaaaaccuaaguauuugaauuuagaugugcuaaaaguauauaauacauucuggauuuugaagacaguaagaaacagaaugcaaaauauuccacugauaauuuuuaagugauuccauguaaaaaugacaauauuuuaaauauuguuaagggcugaacugaguucccccaaaauguguauguugaagccuuaauuccggacauuccuugugacuuggaaguuuacaaucaucauccuuuuuuuaaaggacucuaucuuucuuuuccuuuaaauccuuuucucucuucuuuuugucugcuucugugcuugaagcccuuuggauguuaccaguaggcaaagcaaaaauggccucaucuuuauuuuccauucuuuucuuaauuuuuauguuucuucuuucacauccuauccagcuccucugcuuuuuucccacuguuucucucuuuuggguguuuccauuuugcucuagcuggaacauucuccuggccagaucuaguggggaaaaaguucaggucuuuguuuuuuucaccuacccugauugguuaacuauaaugcuucaaguuccuuuuccuucaucuuuuuccaaaugaccaugcaaugcuggacucauuuuauccaguuucuuuugccccuuggucucucugccugucugaauugcugcugaauaucuacagcuccuuauucuuuuauccucugcagcccuauuuccugauauugguagaggcacaguccauaaugagaaacucuagaagggagucuauuuugcccaacaucucacaacuuaacuagcagcaggguaaaaaugaagccucauuucuuggcuauuacuuucuuuucuacaccagucuucauucaaauaugauaacagcuuaaucugagauaaaacugaaagguuccaaggaacuguaucauauccuaugaaucuuuuucuucuuucucuuucuugacuggcuacacugaccugcuuaaaaauaaguggccauggucucuuuugcauucagguauacaacaaacaagcugaugaguaucugaaaauauauacauguguacauauaggcuuaaccacauagauauugauaaacacugcuuaugccaccugcauugguauuuuucauguagaaaaauaaaauguuuuuuucuaggcucacauucuacuugacuguggugaagacaaugucuguaaacccaagcuggaaguuucuguagauagguaaguuuugcuugaaauaauaauguaguaagaaauuuaaauggaagggcacauuuuucuauucaaaggacuaacauauuuuaacgagaauuaguuauccuggaggguaaugccugauuuucuauaacacuaaaacuaucaauauugagcuucuaaagaaaauauccacuguguuuucacuaguugccuagguugaaagaguuauuaccauucaacuuuggguaauaucacaaaauaauauuguaucauuuuaaagauacacuucaucauaaacauucuuugaacucaaggaauauccuuaccauuuuguaaggcauaugaauuauaaagaauauugugagaauuaugacacgugauuaauuuagcuuuuagaaaaauauuggggaauuacaaaguacauguaauucacuucaguaauagauaugaaugauagugauauauuaguggcaucaauguuuauuuuuauugagagaagcauucgauuugcacccagugugcuauuuucuguuuucuaucaagcugugaaguagucuuaaaauaccuugagacacuguugaacaugucagugcuguguauuuaucucuucuuucuuugaacagucauacuuuccccauguagucuuuuuuucucagucuggauuuguauuguuaacuuguagugaucaaaagaagaucuauauuggggaugacaacccucugacauugauuguuaaggcucagaaucaaggagaaggugccuacgaagcugagcucaucguuuccauuccacugcaggcugauuucaucgggguuguccgaaacaaugaaguaagcaggcugccucuuuaaaaauugaaaugcacucacggaucuuauuaacauuaaugagcuguuccccuauuuagugaagcacaagcuuagcuauucuaccuaaggcuaaauugauagacaauggagugccuaucuuacauaauuccuuuuaagccuaauacuuugcauaaugcauugauaugacauuuuuagaauugcaagcuaagugccuggaaacaagguuagauagauaaagugucuaagccuguccaucaaauuauuugucagaggcuguaugguuuuguaugguaguccucuagggaucuuucagaaacacuucugcauuuccauguggcaauuguacccaauucuggcuuuuuccuuaccuccugguuugcucaacuagauuuauuugcuuaggacaagaaacugaaauauccaacugcgugauacuuuauuuccuuucauauccauuuuuuuuuuuuuuuuuggucuaucaaaggccuuagcaagacuuuccugugcauuuaagacagaaaaccaaacucgccaggugguaugugaccuuggaaacccaaugaaggcuggaacucaaguaagacaauuuaauuaaacggauuuuucucccuggcaaauagaaaagcauauuguugucugggcucauaguaauuuuuaaaaauaaacacuucaaaacaauguccuuaaauugguuucgauauaauaguuaaaugauuagcagaguuuugcuuaguuuuaacuaagauacgaaaacaauugguugugcuccuacacgguuugcaaucagcugcucuuuaugccuccuucacuuuagugaauggaugagaacgugguuuaaacuaaggacugaaauaauaauuuuugcuauuuuacacugaugccuuaauggauccugaaaagcuacucuggcaacuaccaagacugucaauccuaggugagcuagauuccaucacaggccccacacagaggaucaaagugaaggucaguuaaaucaggcuccccuucagaugguggagcagggugcccaggagcuugaaaagaagcagccaauggcuugcuuuccgaauccucuaaaaaguaaacaaaauauaccuuguagaauuucuaguagcaaggacaaaauggcagcauaugcugugugacuuuuucaauagaauuuauuuaaugacuuauugauacugguacuuugaagaucugugguaauacaggucuaaauauuccauauuucuuuaguauguuuucuauuacaagucauuaguauuucuagauguaugguaucuuagggaugagaacuugaacaaauuacccuaaguucaguuuuucacguguauucaauguuuuauuaacaaugagcaugccuuuuauuuucucauauucucauucucucuaacuuucugguuauuauauaguuucugcuuauuacaaguagccagcuccagguuuuguggagugggaggcagaacccaggaaguacuguuuuuauaugucauuugugugauccccaagaagccuucuuuuuuguaccuggugguucaauuguuuuauuuaaaaucuaccaauuuucugccugcaggaauuaggauauuugguguugggaguguuaugagagguguguggagaaauucugguuguggcccuacucaugccuucuuuagccauguucccuuacucuaguaaaccauccauuucuucuuuccuggccuaugaacacagcacauacuuuggugguuagcuucguguuaucaaauuauuguacccaguugcuagacuuucacuggaucaacaaacauuuacuuuugcacuuuuuagaaagaugguuaguauuauaaggagguauaauuaugauuaauaauuguuguuaaauaggcucucuuauggauugguccagguauauuaaguaaaauagguuugauagaaaauaagauuuaguuaucuuuguucaguuuuauuguaagcucagaaaaaccccauuuuagaacauuauuuuuuauuuagacauuggauuugaaauuuugcuaauuagacauugacuagcauuacuaucuuuuccucucuccuuuagcucuuagcuggucuucguuucagugugcaccagcagucagagauggauacuucugugaaauuugacuuacaaauccaaagguaugaaaacaacuuauauucacuuauaacuaucaaauaaauauuauuuguuguaaauauacuauguaauauacuuuaaauauaaaguagcagauuaaauuuuauugcuugacuauagcauuuuaaaaucaauauuuacauuauaagaauaauuuuauugucagauuugaguuuguaaaacaaaauuuaaaauccagaaagaaaauguucaucuucuuggaauuaaguguuaaugaaaauaacuauuuugagguauaagcuuuacacuuguuucguuuguuaauuuuuaguuucacuggguuugccucuguauguucuugguuguuaugcauaauucauuuuuaaguuuuuuuuuuucuuuuucagcucaaaucuauuugacaaaguaagcccaguuguaucucacaaaguugaucuugcuguuuuagcugcaguugagauaagagggucaguaugaauacuuaguugaguaucucauucucaugauugcuuuuuaaagguaacugucaggccuuagccuuuucuggacaauagacccugcauguuuaguggugguuuuacuagggcauuagcuucuguagaaauaaaauccuagguauguuccaaacccccaauacugggugauccucaaaaggaacaagacauggcaacaacaugcacaaaauaauuuuguugaacuuuuacacaaauugucaauucaccuguuacguguacauuucauaagagcaguuuuugugcauguguguguucauuaguuuucuuuuaaaguauuuuuuaaaauuaaaucuaauuuuauuuauuugaguaaugaauaugggguacuuuugaaaaugaacugacuauaucauuuugauauucaugguagguuuucuuuggucauuguuuagagucucgaguccugaucaugucuuucuuccgauuccaaacugggagcacaaggagaacccugagacugaagaagauguugggccaguuguucagcacaucuaugagguuugcaguuguuagauuuuacucaaaccucgugagcaagccaacgaagagaggaacaacuaagcuacuuuaaaaaaaaaauucuauguaauuuuuauguaaacucuacauugguuaaguaugugucagagauuucuuugaauauuuucccuauacauaaauucauuuuuauuugacaaauagacuuguuuaaauaaagcaguuuauauaauuuguuguuuaaaauaaauuaguucuacuugaauaaagaaaugucauugguacuuucucaugggcauuuuguaguucuggcuaaaaauugaaaauaccuauggcaaauaaucaaaacuauuucuauaggaagaaauuuucuuugucauccuucauuaauaacuuuuaaauauuuugccuuuuguuuauacauacauacauauauauauauauauauauauauauauauauuuuuuuuuuuuuuuuuuuuuuuuuuugaggugaagucuugcucugucgcccaggcuggagugcaguggcgcgaucucagcucacugcaaacuccaccucccggguucaagcgauucuccugccucagcuugcugaguagcugggauuacacgugugcaccaccaugcccggcuaauuuuuguauuuuuaguagggacaggguuucaccgacagguuucaccacguuggccaggcuggacaugaacuccugaccucaagagauccgcccgccucggccucccaaagugcugggauuacaggcaugagccacugugcccaaccuuguuuauauuuuuauccugacacauauuacucuguguuagagacaaauguugaguuugaucauuuuugcauaaaaauggucacauuguaauuagagguuaacuguggaaauugcuguuauuuaaaaccuauugcuaacaugauuucuaaaguugauguaggggaaggauuauggaacagauuuuugcccaagguguagauacauuuucuuuuuucuccuuagcugagaaacaaugguccaaguucauucagcaaggcaaugcuccaucuucaguggccuuacaaauauaauaauaacacucuguuguauauccuucauuaugauauugauggaccaaugaacugcacuucagauauggagaucaacccuuugagaauuaagguaauaugcuuaauagcagcucuucauuacaaugauauuucauugccuucuuucuaaaccuguaaaagaaauucauaaaauaaaacaacuauuuuaauauaaaacccacucugcaaaaaaugguuuaguucauaagcaguacacuuaggauaaguucauuuguauaauggguaagaauugauucugugaugucuagugaaccacaucuucauagagugcuuacugagccucaugagauguguccuucagugacucaguuugaccuuggcuccaucacguuguuguuucuucagggcauaauaucacaucaaggguguuuuguuguuaaaauuucuaccuuugggauaagcuauaccauuuuacucaugauuaucuugacuuuuggauauagucaucuccaucauagauuugcacuagaaacuauuacacaauaugaucuaaggaaaggugaagaaacaaaauaaaagauauacccaugauugacaucacaaauguacuguggaauuucaggccauuucuguauguuucaucaguuuccacucuagcuaagcaagggcugaaaauaaugguuagggagagcuaacuuuuuugguacauauuaaagacucuaaucuuuauuuucuguccuuacugcucacuauauacugagugguaaauauucugucauacuaaauuuucauucacuauuuuuuaaucauaucuaagaguuuauaucaaaaugcugauguaaaauguuuuucauuaucauuuaccaccauuuuauuaaugugauugcauuagaucucaucuuugcaaacaacugaaaagaaugacacgguugccgggcaaggugagcgggaccaucucaucacuaagcgggaucuugcccucagugaaggagauauucacacuuugguaagugccauuucaaauaugugcaccauagacauuuaaaaauaugugacuauagaacugacgccaaagaacauuucaaaaauaacaacagcugugcuugaacaacuacauuuauuuuuauaccaugcauuccucucacuuuccuuuuuccuagucagauuaaugccauauuuucuucaaaugagcuauuuuuguagauggcuaauaaaacuaguuuaugucccaacuuugauucuccuacucuaguucuuuaacuguccucuuucugggccuccuccuaaucucugaggcuuuaguacgauacuaaaaaauccagaaggucccaacaaaaauacauuggaauaauaauuagcacuugauuaaccuuuguugaguuagccuauauaauggcuauaauguuuuuaaaggcaauuguuuuucuuuuuucuuuuaauuaacaaaucuccagaucucuaguagagaaccugguauaguguuuuuuguuuguuuguuuguuuguuuuuugacacagagccucacuuugucacccaggcuggagugcaaugacacaaacacagcucacugaggccuugaccucccaggcucaagcaauccuccccuaucagucccccaaguagcuaggacuauaggcgcucucccccaugcccagcuaaguuuuguauuuuuuguugagaugagguuucaccauguugcccaggcuggucucaaauuccugagcucaagcgaucugcccaccucagccuccuaaagugcugggaugacaggcaugaaccaccaugcccagcacuguuuauguucaauagugaucacuaguuacuuuuacaucaccaaauucugugguucuuguuaguccucaaccauucaauugccuaguggcuuugguucacuuaaucacuuccuucuguugacucucauggcuguaaauaccaugugguguagaugcuuugauuuauauuuccagucugaucuucugcauugaacuucagauuccaauauccaacugccuacuagaaacugcuuuuaaauaucuaauaggaaucucaaacaauucuaaauauauacccuuggguuuucccaagucugcucuuuccauaaaguucuuaguugauuuuaguaaauaccaacuucauucucuaacaccuggaccucaugcuugacuccucucuuucucucaaaucucacgucuuguauuucagcaaauugcaucaguauuuucuuucaaaauaccuagaaucuggccccuucucaccaguuucaucacuaacacaaccuaacccaggcuccuuucccuucucgauuggacuauugccagaccccugguuggccucuguauuucugccuuucuccccacuauacuuuguaugcuauagaagccccagugauccuuuuaaauauaggucagguugugucacuccagugccuucccaucuaacucaaugagaaagcaagaggcuacaaugaccuuuaagcccaacaucaacaggcccuuccugccucucugcuugcaucuccucuccuuacuauucucuuucucaaauuuuccaccuugcuuucauugaacagauagccccaagcauguuuauuccuccaugcuuugaaaauugcucuuccaucugccuggaauucuuuguccagauauccuuguggcuuauuuucccauauccuucucauguccuuaaaaguaaaauuaugucagagaucuucccugaccaacccaugugaaauagaaacugccuucuaccucccaaccccacuuuugaucuugcacuuucuguccuccuucagaaucuguuuucuuuaauugagacaaaacuuacacaaaauuaaccauuuuaaugauuuuaaagugcauaauuuaguguuuuuuaguauaauuacaacauugaaccaccauuaccacuauaauuguaaacauuuuugucaccccaaaaagaaaugcuguacccauuaagcaguuuauccauucuccccuaucaccagccccuggugaccacuaaucugcauuccuacugauuugccuauucuggacauuucauacauauaguaucauacaacauauggccuuuugugucuagccuucuuucauguagcauguuuucaagaucuauguuguggugugccuuaguacuccuuuuuuuuuuuuuuuucuuuuuuugagacagagucucgcucugucacccaggcuggaguccaguggcgaaaucucggaucacugcaagcuccaccucccggguucacgccauucuccugccucagccucccgaguagcugggacuacaggcacccaccaccacacccggcuaauuuuuuuguguuuuuaguagagacgggguuucaccauguuagccaggaugcuugaucuccugaccucgugauccgcccgccucggccucccaaaguguugggauuacaggcgugaacuaccaugcccagccaguacuucauuuuuaugccugaauaauacuccauuguguggacauaccaccuuuuguuuaucuauuuaucaguugaucaacauuucgauuauuucuacuuuuugucuguuuugaauguguugcuaugaacauugaugcauaaauuuccauguaaacauguuuuucaguuuuauugagaauaaacauaagagugcaauugcuaggucauguggaaacucuauguuuaacuuuuggaggaacugccaaacuauuuuccaaaguugcugcagcauuuugcaaucccaaccagcaauauaugaggguccuauuuucuccacaucuuugucaacacuuauuauuuucugcuuuuguuuguuuuaaaauuuuuauaaucauccugguuggugugaagaaguaacucauugugguuuugauaugcauuucccuguagacugaugauauucagcaucuuuucaguuguguaucuuuuuuagacaaaugucuauucaaauuuuuugcccauuuuuaaauuggguuauuugccuuuuauuguugaguugcaaagaguuauuuauauauucuggauacuaccuucauuagauauaugauugcacagguuuugucucauucugugugaacugucuuuuuacuuucuugaugguguccuuuaaugcacaaaaauuuuuaaaucugaaguucaauuuaucuaugucuucuuuuguugcuuguaauuuugucaucauauuuuuaaaaccauugcccaauacaaggucaugaagauucauaccuaggcuuuuugguuuuauaaguuuuacacuuacagcucuuacauuuacaucccugauucauuuuggguuaauuuauguguauggugugagguagggguccagauugauucuuuuguguguggcuauccaccugucugagcaacauuuguugaagaaauuauucuuuccccuuaaauggucuuggcagucuuguuggagaugaauugauuauaaauauauggauuuauuucuagacauucaguucuauucaguugaccuauauguauauccuuaauacaaguaacaaauuguuuugauuaccauagcucuggaguucagguuuugaaauagggaaauaugaauacauuuuauuccuuuuaagauuauuuugguuagagucccuugcgauuccauguggauuuuaggaucagcuuguccauuucugcagacaagguaguuggaauuuugguagcaauuuucuugagcaaccuagggaguauugcuaucuuaacauuacauaguucaguucaugaacaugguaugucuuucuguuuauuuauucuaccauuuuuucaacaauauuuugucacuuuuaguguacuugucuugcacauccuugauuaugugauuucuguguauucuuuucaaugcuuuuuauuauuauuauuauuuuauuuuauuucuuuuucagaaggaguuuuugcucuuguuguccaggcuggagugcaauggugugaucucgacucauugcaaccuccaccucccaggcucaagcaauucuucugccuuggccuaccgaguagcugggauuacaggugcccacgaccaggacuggcuaauuuuuuguauuuuuuuaguagagacagguuucaccauguuggucagucuggucucgaacuccugaccucaggugauccacccaccuuggccucccgaaaguucuagaauuacaaaugugagccacugugccuggucuauuuuuauuuuuauuuuguagagacagggucuuauucucucauccaugcuggaggacaguagcauaguuauagcuuacugcaaccucgaaauccugggcucaagcaauccuccugccucagccuccugaguagcuaggauuauaggugcacccaccacaccuggcuaauuuuuaaauuucauuuuguagaaauagaaucucacuacguugccuaggcuggucuugaacuacuggccucaagugacuuucccacuuugguuuccuaaaguguugaaguuacaggugugagccacugcucuugaccucagugcuguuuuaaaggaaguuguuuucuuaauuucuuuuuuggauuucuuauugauaguauacugaaauaugacucauauuugcauauugaucuuguguccuguaccucuucuguacuuguuuuuuuagcuuaaauaguuuuaauuuggauuauuuaguguuuucuauauguaagauccugucaucuacaaagagauagcuuuacuuuaucauuucuaaucuggauaccuuuuacuuuuuuuuuucuuuuugaagaaagagucuagcucugucaccgaggcuggagugcagugacaugaucuuggcuuacugcaacuucugccccccagguucaagcgauucuccugccuuagccucccaaguagcugggauuacaggugcccaccaucacgccuggcuaauuuuuguauuuugaguagagauggcauuucaccauguuggccaggcuggucucgaacuccugaccucaagcgauacgccugccucagccucccaaagugcuuugauuacaggagugagccacugcaccuggccuuaauuuuucuuaccuaauugcacuggcuagaaccuuccguacaauauugaguagaaauggcuugauugcuauugucuuauuucugacauuagggagaaagaaggaugaaguaugauauuagcugugggcuuuuuaucaaugcccuuucucaggucaaggaaacucuuuucuacuccuaaucgucaacaaaugguaccacuacuggauaacauugucaugagguguauauaugugauaugucuaauacagugugaucagcauauagaagguggugaauauuuauuucuuuuggcugccaaccucgaaguuacugauuaaaacauuaaaugugucagaggccaucagcaugcgauuugauuucuguaggcccuccauggaaaaaccauuaaaaauucuguuuucuuuuccauggggauguugagaucugguuauuauaucuuacaaauaucaccauguuauggguuugccuaaagaauauugaguucuagucauagagugaaucuuuuaauauuauggaucuuaucuuucuauaacaaaucacgauaaaaccaacccuuucauuuacaaggaacuacauguguggcaaaagaagaaaaagaaaagaaacauaccaaccccuucacaauaaaaagcauucauagacucaacuauuagccuguuuauuuucaagacagaagaaucuggauaaucucuuuggccaucacacaaaaagaaaaaaaauggcaaauuuucaaauguugaagagaugauagaaugaccuuuucuuauaaguaaaggauuuguuuuggcaggguuguggaguugcucagugcuugaagauugucugccaaguugggagauuagacagaggaaagagugcaaucuuguacguaaagucauuacuguggacugagacuuuuaugaauguaaguagacaggugcagcauuuagcaaacauacccaguguuuucaaauaaauauaaaaggccugauaucugggaaaucaucuaauuguuauuuccaaacagaaagaaaaucagaaucauuccuauucucugaagucgucugcuucauuuaaugucauagaguuuccuuauaagaaucuuccaauugaggauaucaccaacuccacauugguaagucauugguuuaggcaaauagaauaaauuuacucaauucaaaugcuguacauguuuuuauuuuguuuuuuaaagaacgacagcuuaacuuuuuugauaauuuaaacuaaugaaguuauaugauagcauuauaaccuaguuuaauauuaucauuuuacuccuuaccccgaagugauuaaagcuagaccuuuuaguuuagcaucuuguccaguguaagagauuucuuaguauauacuaaauuauauuggagaaauuuuaggaauuuucguuuacaaaguuagaaaguuggaaauuaacugcaacaagugaggcauuuugaagauauuuaaggaguaaaaaugggaucagcacauaguaaacuggauuggauuauuuaaaaaucauuucaagcugggugugguugccucacaccuguaaucccagcauuuugggaggcugagacagguggaucauuugaggccaggauuucaagaccagccuggccaacauggugaaaccccuucucuacgaaaaauacagaaaaauuagcuggguauaguggcgcaggccuguaauuccaacuacuggggaggcugaagcauggagguugcagugagccgaguucaugccccugcauuccagcuuggccuacauacugggcgagacucugucaaaaaaaaggaaaacaaaucaugucagaugcaaucagaagucagccuaucauugggaguuucauguguguaugugcaugcucuugauaucaaaugugaaaccacuaaauuaucauaugcaggaaaagaauauacugugaauuccauuaaaauaaaauauaauauuuacucagauauuuguugauuaagucaauggacuguuuuuaaaacuaaaagcuuuuuuccucgauagguuaccacuaaugucaccuggggcauucagccagcgcccaugccugugccugugugggugaucauuuuagcaguucuagcaggauuguugcuacuggcuguuuugguauuuguaauguacaggguaaguaacggacuuagaaagaaggagagagggaaagcagaagaaaagggaaagggaagaaggaaaagaagaaugaaaaguaagggaaggaagaaagggacuguaaugaugauacuugaugagcauuacuuauuauaugagggaagauaaauuuuaugaaauacaauuuaaauguucuuagugguaauauagucacccaaaaaauacuuuucguauucuacacugaugugacaguaauaaugguuuuucuucaacugacagaugggcuuuuuuaaacggguccggccaccucaagaagaacaagaaagggagcagcuucaaccucaugaaaauggugaaggaaacucagaaacuuaacugcaguuuuuaaguuaugcuacaucuugacccacuagaauuagcaacuuuauuauagauuuaaacuuucuucaugaggaguaaaaauccaaggcuuuacugcugauagugcuaauuggcauuaaccacaaaaugagaauuauauuugucaaccuucuccuuauaaauaaguucagacauacauuuaauaacauagggugacuuguguuuuuagguauuuaaauaauaaaauuucaagggauaguuuuuauucaauguauauaagacagguagugccugauuuacuacuuuauauaaaauaguaccuccuucaguuacuguuucugauuuaauguacggaacuuuauuuguuguuguuguuguuguuguuguuguuguuuuaaagcaguccaaauuuggaccuuagcaaucaugucuuuuguauagguacuuaauguuaauacauauuacacuacaguuuacuuuucagaauacuaaagacuuuauaacugcaugaacuuggauuuuuuuaaucacucauaugguagaauuuuauaaacacauacaugauaccauccaaauucuugcuuuuaauaacaaagguacaauauuuuguuuuaguaugaaaaucugguagauccuauuacacuucuguuuauauuaaauccacaauauuuuauuacauuuuuaacuuguauaaauuuuaggucaaauccuucaagccaaccuauacuaaaaauuaguuccauaaucacaaauggcucuuuuguguaauuguuuaauuucaccugaauaucauaaugcuuaaagccauauggaguuggaaauuauuuccaaagcauauuuauuccauuguuuuagucuggcuauuuacaguauaaaaaaagcauuuuuauuaaaauacuguguaguucuuugagauaguugcuuaugcauauaguaaguauuacauucuuagaguagagcagaguuuuuaguuaguauuaauuuauuuuccuccauucauguacuuuuccuuauauuuccaaaacuguuacugagaaugggucaagaucagugagaaaucuuuacaguugacaggaaccuggaccccuuaccccaacuuuaugaguaaugcuuggaauaaaaacucuuaaggcaacucacugauuuacuucuagcaauagcaugauguuacaggaauauuaccucuguuuaagcaagguaauguguaaaaucagucucggcugucagaauaacuucuaaaagguauuuuuauaagcaguucaaguuacugaaaaccuuuuaaaccuuucugaaguucguuaguauaaauuacuuuucuaggauuauuaauaaaagccacauagguggcaaguuguaguuuuauauggcucuguagaguggugaaccuucuagaggaauauaugauuuauucacaguuccucaaggccuggggaugaugaucaguuauaccuauuuuugugcaauuacaucauguuguacauuagaaauggagaguuuaauagcucuuuaacugcuguccucauuagguaaugauaaauauuucccuuaaauaauugacuauuuugcuguguuuuaaaaaugauugaaauuuaucuugccauaucucauaauuucaugcacaaguugacugagcuaaucuugagaauauauucguaaaauaggagcacauuuaguugagguauacaagguaggacucuagacaaaaccuucuauuuuagcuuuagugaauuucaaaaguaaugggucuuggaguauagauuuuuauuaguagcuugaaagagcuuaaucauaugcaguaaguauuuuuauuaccaauaaauuuaaaauuuuuuaagaaaaauauuuuuauccuagggccaaguguugccugccaccaaucaguaaguuagucuauaacaaauuuuacccuaacaguuuuaccaccuaguaacagucauuucugaaaauauguuggauagaaagucacucuuuggcaaaaguguuagaauuugcuuuugugccaucuauuccuuuuauggcaucuaucuugaaaguaaucuuguauuggagauugaaagaugcuguaauuuagaaauuaacaugauaucuuaaauuaccuuuaugaaauauaguuuuguauaauagcauagauuuuccuucaaaaaaugaacauuuauauaucuacaaaaauauggagaagaguaauuugaaagccuacuuucugaagaaaauggugggauuuuuuuuuaucaugauuaaauaucaaaaaauugcccuaugaaaacuuuaaaucucuaaaacauuugaaauacuaccauauuugugauuuauugagaauaaaaauccauuuugaaauguaaaauuuuuaugaucugauucaguuuuaagaaaacaugaaugaacuagaagauauuaaaaacauuugacauugguaagaaauauugauacugauauugauuuuuauauagguauuuauuucagaauugauauuuugagaaaaauacaugugagucauuuuuucuguuucucuuuucucuuaacgauuaucacuguaauucugaaucugaaagguaaaacaauuagucaaaauauuauugccaucauucuaccuguguuaugaaacuacuuauucauaguuaauucucauuaacacuuacauuuccauaaagaaaacucaaguauuaauaaaagagacuuuacuggcuuaagagggcugugaaagauuuuugauagugaaucaugacccuaagggagagauuugugugauaaaaguauuguauauaauagaucagcgauuuuuguaaggcaaacagaauuuguaaguuggcagaucuuccuaaguugcaaaauguaaugaugagcuugguggagaagaaugagucguucuuggaauaccuaugugcagccacuacccaucucaaugucaccuuguuugcauucuuggauagcuuguauauguaguaguuugaugaauaauuuaaagaaaaacaccuaaaauuugaaaaaugauuguaggaucaaaaaaggcagaugaaauuacuuaauacucaguguuuuggagaguauuccuuuuaguuuguugguuggcugguuugaacgauagaaauaugcagcaugcaauauaugcuuauauuucauuuuaauuucugauauauaaugaacuucuugggagagguacugaaucuuugauguuuuuugucauuguucucaagugcaauauaacaauguaaccaaaucuagauaauuucaaaguugucauuaauuuaguaagccuaauauaaacaaauauuuguauuauuuuuguuagcaggaaagagugauuaagugagguuauuuaccccuaaaugguccauucugcauuguauuucaggcuggaaaugaauuauucuuuaccaguuuugaaacacuuugaaauauccuaagguaacuuggaagcuguguaguauaucaaauuaauuugcuaccuaauaacauagaaaguaaauaucuuuguggucacccacauugggugagacagaaaaugaaucuguucuaaaauuuguaauuugcuaacuugauuugaguuagugaaaacugguacaguguucugcuugauuuacaacauguaacuugugacuguacaauaaacauaagcauaugguaccacu

SEQ ID NO: 21356 - RNA, 192754 nt, Homo sapiens
gagggggaggggaagggagggggccgagcgcucgccgcggcucccugcagcagccccagccgcaugacgcgcggaggaggcagcgggagcagccgcgggagccgggaccggguagccgcgcgcugggggugggcgccgcucgcuccgccccgcgaagccccugcgcgcucagggacgcggcccccccgcggcagccgcgcuaggcuccggcguguggccgcggccgccgccgccgcugccaugucuccggggaagcccggggcgggcggagcggggacgaggcggaccggcuggcggaggaggaggcgaaggagacggcaggaggcggcgacgacggugcccgggcucgggcgcacggcggggcccgauucgcgcguccggggcacguuccagggcgcgcggggcaugaagccggcggcgcgggaggcgcggcugccuccgcgcucgcccgggcugcgcugggcgcugccgcugcugcugcugcugcugcgccugggccagguaagcgccgggugggcucgggcggggggcaggaggcuggggcgggacuggcauugacugcaccugcccgagcguacccccccgggggguuccggggaagggggcggggguccggauccccggauccccggaaggcgacuugcggggaccccggccggccucgcacgccggcgaucgaucccuuuuccggcugcccaggaucgggggagagaggcgggauccgggugccgcggugcccgagccucccggggaaagccuccgcgcgggcuccaggccgucccuggcccggcucuucccggcgcugggcacaucuggcgggcacgggcccggcuuccuagccggaggcggccggagggggcguguuugcggaggucuggggacgcagagccgggcggccuggcugagccuuugccgacagaccuccgacccggccugcaggggcccgaggggcggcgggggcgacagggcagggccaggcgcugggcaguggggcccugggcgaggcgcgggacuccgggccgagggcccuguuccuggggaaaguucccaggccggggaaaagguggccgcacgcuggcuuuucucaaggcagccggcccucuuggcgucgugcuugauuucauggguguuuaauucgugcuuugugggcgcuggcucccccuccccaccccacccucacccucuuuucuggcuucacuuuucagauaaugcugucccuggcguuuuggugaccgaccuuuccccuuccuggcauuuccauaggggcugaggcagagcagcugaaggggcauucccauuucacagauggggaacugagggagagaagugaaauagcggagcacccagcccgugccaugggagcugagccagcgggcacguccucuuagccucuggagccuguugggguuugaacccgcaggggaagcggucuagggcugccuugcugugcguuucugcaaaugaccaucuugcuuguuuuauacagacaccaucucugaggaaaugaguuauuggcuggggauggaaccugguuucagggaaaacuucuccagcgcgaauacaggagagagcagaagcaucacccuggggcagcaaugccgccuagcaggcuguaggagaagggggcuggggccugggggcugcgugacccucggcacccaagggucucuccucgcaguuuccccagcagguucugcacaggcucuccugggggccagaaggcaaugugaccuccugcagagaaccugggaguagaugucaggagacuggcuccagggccgggccacagggcuggacuugcucuucaggcuucucuacccucaguuaaccgcaucuguagaaugaguauagcacccucugcccaauggaauuguuugaggggcuuccacuggccaaugucuaaaagaacuuuguaaauauuaaggguuuccacaugggauucucauuauuaagguacagugccugugggggcugucuucucccuguccauguaaggaaauucagggaagcagugucugaaguuaaaaaagccuuguauuugaagauuucuuguaucaaaaguuuaugcuaaaacaaaaaccacaaaaaacagaaaacccccaaacuuaaagcuucauuuauuuuuaaauguauaauauauguaauuuuuuuuuugcuucagcaaaaaaauuuuaaauuauauauauauaaaauuuauuuauuuuugcuccagccauagugguugcuagcuguguucucaaucagcaaaaaguuucuuggguaaauuuauugcuugcucaauccuuccuuguauuucauuagcauauugccacucuacacuuguccuguauuuagauauuuccuuccucuaugguuuguucuguagaaccucaaaaggacucucuuauuucuuuuuuuuuuggacacauuaugaaauaggaagucuaaaaggcucccagaagaagcaucuucaaaauccacauucagcaguucauuuugauaauggauauuucagggaaucagugcauuuuugagcuggaccagacuuucaagacagcugaaaccccucagagcucuuagaugaggauauugauguccagagaagacagggagcaggcugaggucacccagcaagguauuagagaagacaagaugggaaccugggucaccggccugggccucauauuuucaaagugcuauuuuuuuuuuucccguguuuucacuuugaucuuacuuuuaaugauagggacguaucacugugucuucucaaaauggugggugugaauggaauuuuucaaaguugaaucaauuugagauauuucugaaguuuguuuaggaaacaaguaugugacuaccuuccuaagagcugacugguuuuuugaggccuggauuguguguguaugugcuuauguguguguuauaaaauggaaucaacuauaccagguuaaacaaauggacaagucauggaaaagacacagcucuguuuggacauuaauaagggcggguguggaagcuggaaagcugagaugccggaaggcucagugcuuaguaggcccggaaaagcaauuuuugaacuggcaucucauuccccuuuucuaagacaggaaggacggucagagaugauuccaacaugaggacuuugcuaguugcagugucugacuccucccauucucauagcaguuuugcacaguaguuuugguuuguguguauguuuuaggcaaugugacaaagcaguuuuccuccugccuccuugagaaauuuaauccugacagguucuuuaagaaaucagcuugaugugggcugauuuuaaaagaauaaaugaaaaaaaaaagcuggugacugauagcuguuuuauuggucuuguaguguuuugguuuuguuuuaucuucacuuucuuguuuccuggugaauaauaacuggguuuauuaucucucauggcuaauccuuaagccugauuccuuaccuguuccauccagaguacaaaguauauuuugacuccucuuuaaacugcuuguuagauucucauaugagugacuuuaaauauuuuuguuuugcuucaggacaacgggaaaaccaaacgauuauguuuuguuugcagacaguuuacgaaaacagcaaauugguuuaugguuagaccgugacuuugagcugacuucaaguugggccccacgauaaagauaaccauggaauacccaagcuuuccuaagcagagaggauccuggcuuccaaaugagcaauuuuggucagcaaagggguuauuuagcuccuaaaaguaauuuuugcuugagguuggggcugaggcagaguggcugaacaaccguaggccuggguguagccagaggaucaucaguaauuacuucucaguucauucacuucuugggcuagggaauuauuuugagugcaggauaagaggcaauuuucuguguguuucccuucuaauauaaugccacugaugauauuauaauuaauagguaacauuaugcaugacaggcacugugugcuaaggguuuuaaugcauuauuucauuuggccauuucagaaauaccaagagguaggugcuguucuuguuuauuuguuuguuuuuuuuuuugauagggagucccacucugucacccaggcuggagugcaauggugcaaucuuggcucaccgcaaccuccaccuccuggguucaagugauucucuuaccucagccucccgaguagcugggauuacaggcguaugccgccauaccuggcuacuuuuuguauuuuuaguagagaugggguuucaccauguuggccaggcuggucuugaacuccugaccguaggugaucugccugccuuggccucacaaagugcagggauuauaggcgugagccacugugcccggccuuuuuuuuuuuuugagaugaagucuagcucuguugccaggcuggaguacgguggugugaucuugguucacugcaaccuccgccuccuggguuccagggauucuccugccucagccucccaaguaccugggauuacaggcacgugccgccaugcccaguuaauuuuuggauuuuuauuagagacaggguuucagcauguuggccaggauggucuugaucuccugaccucaugaucugcccaccucggccucccaaaguguugggauuacaggcgugagccaccgugcccggccuguuuuuguuuuuaagagacagggucuugcuuugucacccaggcuggagugcagugguacaaacguaauucacugcaaucucaaccuccugggcucaagggcuccucucguuuuagccucucaaguaucugggacuaaaggcgugugcuaccauuccuggcuaauuuuuuuuuuuaauagagauggugucucgcuauguugcccagucuggucuugaaccucugggcucaagugaucugcccaccuuggcuccccaaaguguugggauuacaggcaugaaccacugcacccagccauguuuuuauuuuaucugagagaaaacugagguucagaacuuaacuguauacuucuggaaucuucacagagaaauaaaaaaaaagaaaaauaauuuacuauagauucauuaacuacuacguggcggagccagggcugaugucuccacugccccaauuuaccauccugugcuguaaaaagucauggagaagguuuucugugugcagcuaagagaggagguggcagacauuuauuuauuuauuuauuuauuuauuuauuuauuuauuuauuuauugagacgaagucucacucuguugccugggcuggagugcuguggcacgaucucggcucacugcaaccuccaucucccggguucaagcgauucuccugccucagccugcugaguagcugggauuacagacgugcgcuaccaugcgcagcuaauuuuuguauuuuuaguagagaugagguuucgccauguugaccaggcuggucuugaacucccaaccucaggugauccgcccaccucggccucccaaagugcugggauuacaggccugagccaccgcaccuggcccagacauuuuuuagacagucuugcuguguugcccaggcuggacucgaacuccuggguccaguugacaucccucuucauccuuccaaguagccaggacugcagggacaugcuaccuuuauuuuggguucuuuguguccuaaacccuguaugaucugcuccauuuguaacacagagaacccaggugcccucuuuccugcuuauauuucuuuggggccucaguuuacaaggcaagucugccuuuguggagauagacuggggucugggauggaaagaccuggguuugggucuuugcucugccacugcauaaacucagcaagucacuuaaccucugugacuucucauuuccuuaucuggaaaaugggacuaacacuuccugcuucacugggugguugagaggaucaaauaagauagaaaaggaauugcuacguaacaccuaaagcaaggcccaacugcuaguuguggcugcugcuguuacuuggagagaagaaaugaggccccagaucauuaguucauaugacaauuuuuucuuuuuuuaagacggagucucacucuguugcuuaggcuggagugcaguggcgugaucuccacuuacugcaaccuccgccucccggguucaagcaauucuacugccuuagucuccugaguagcugggacuacaggcacgcuccgucaugucuggcuaguuuuuguauuuuaguugagacgggguuucaccacauuggccaggcuggucuuuaacuccugaccucaggugauccaccugccuuggccucccaaagugcugggauuacagucugagccaccacgccuggcccauaugacaaauauuuaugaaguguuuuccacagaguaguauggaauaacucugggugugugcaagaugaacugagcucagucacaauacuuuuuuuuccccuaauguuaagaauuauuggcugggcagggugacucauuccuuuaaucucagcacuuuggaaggcagaggugggaggaucaggugagcccaggaguuugagaccagccuggaugacaaagugagaccuugucuauacaaaaaauuagcugggcauggugguguggaccuguggucccaccuacuugagaggcugaguugggaggauggcuugagcccugggagguugaagcugcggugaaccuugauagcgccacugcacuccaacccaggcaacagagugagacccugucucaaaaagaaaaaaaauaaaaaauaauuuauuuuagggggucuuaguaaagaaagacccccaaaaguccaugauuuuauaggucgaaugaggugaaaagugguaucaugauaaauaaauuuguuuaaauaucauaaaaaguuggucuaaagaaaaacauuggguaaauaauuaugugaguaugaugugguuaugaccaaauuguaaagaugaucaguuucuuaagucugggggacaggcacugagcagaggccgugguggggaacaggagccugucuucauggcucuuacuggccacugggcaagacucagauagcaccaaccaaccagucacaguugugauguaggaugugacugugaaugacaucccugcugcccgcuucagagaaagggcugccacuugccagagaaggaauggugauaaugagggacagccagucccuaaguggagaucccugaaaguggugaauaucuuagaccagagaagcccagagcaguuuuuuuaccaccuuguauggcugguuuuccaguggcuuuacuggugcccccucggaggacaggggcuguaggaaguuuguuauuacuuccuuauuagugacagcugcagucauccuauugucucagaauuucccuggcauguaaaugguaggauaagggguggugguaagcagauggggggcauuuugaaaacgaggcagugucagcucccacagaaggucuaauuuuaaacaugcaaauaauuuucaguuccacuuuuccuucuuccuguuagagggaaguuguccccuguugccauuucugaaacuugggcggacaaugucguuauuguguuacaaacgauuugcgucuccagggcaggaguugggugauauuuuucugggagccugugccagggcguagcccaguguuaucucaugguuucugagugaaugagugagugaguauuaaaacuucauaucaacauggagccuauaacacagugguucugaaucuuucuugggggggaaaagaagagauacaagaccccuagagaguauagagaguauguaaaagggaagaauccuuccccaaaagggaaugcacauauuuacaauauuguauccaauuucagaagguuuuuuuaaaauuuuuaauuuuauuguuuuuuuuuugagacacggucucaguuuguaccccagcguggagugcaguggcaugaucuuggaucucggcucacugcagccucugccuccugaccucaggugauccacccaccucggccucccacagugcugggauuacaggugugagccaccaugccugaccaugacuaguguuuugauguguggauuuacuacaauuuauuugaccauucuccuaucaauggacacuuuaguuguuuuaguacaccucccugucccgucacaaaucauacuuuguaauguuucugguggauauuucuuguaaccuucacaaguuuaucuguagaguaaauuucuaguuucaggauuacuggauuggaagaugcaugcauuuaaaagugugauugcuguugucagguuguccuccaaaaguguccccucaguuuguaccuguauccauagguuuggagagugucuguuucuccauaccgucucaucugaaaugaaaauuuuuacauguuugcuagucugaaaggugaaaaauuguaucuuguuuuuuuuuuuuuuuuuuuuuuuuuugagacggagucuugcucuguugcccaggcuggagugcaguggcgcugggcucacugcaagcuccgccucccagguucaugccauucuccugccucagccucccgaguagcugggacuacaggcgcccgccaccaagcccagcuaauuuuuuguauuuuuaguagagacgagguuucaccguguuagccaggauggucucgaucuccugaccuugugauccgcccgccucggccucccaaagugcugggauuacaggugugagccaccgcgccuggccguaucuuguuauuuuuauuuauaucuuuaauuuugaguuaguugaguuuuuuggucauuugccucugcuucuucuucuuuuuuuguuuucuuuuuuuuuuugagacagaguuuugcucuuguuguucaggcuggagugcaauggcgugaucuuggcucacugcaaccuccaccucccagguucaagugauucuccugccucagcuuucugaguagcugggauuacaggcgugugccaccacgcccagcuaauuuuuuguauuuuuaguagagaugggacuuguuccuuaggaaccauguuggccaggcuggucuugaacuccugaucucaggugacccaccugccucggccucccaaagugcugagauuacaggcgugagccacugugccaggccccauuuuuuguuuuuugguuaacucccuguucauuaaaaaaaaaaaaucuauaucuauagauagauagauauagauauaaucuuuguuaucaauuuguauaagcucuuuggaaauuaguccuucgauugucauuuguauugcaaacacauucccccucccccaugccaauuauuuuagauguagcacuuguuccuuaggaacucagagauaaauaagacccuaggguggugaagagagcauagaauuuggaacaagacuccuuuguuggagucuuggcucuaccaccucauuagcugugugaucuugggcagguaucuugaccuuucugauccuugcucuucauauuccaaaaaugcuaauaauaggaguaccucugacacaggguaguuggagaagcuaagugugaucauauuaugcuaaaauuccuuguaaauggcuauggaaacauaaacacagcauuuuauaaaauaccacgagguauuccauuuacugaagaguuacaucagaagaguauuucugauugugccacugcacuccagccugggcgacagacugagauuccaucucaaaaaacaaacaaacaaaaaacuagccagucauuuauaagaaugaguuacagcuauaggugcaggcgguaaauacucuccaagauaucuaaauaaauuaaaaggcuauguagagaacaauguauauauaauguuaccuuuaaagugacaaaaaaaggugaauauagauacuuguguaucagaagagagagguauuccauuuacugaagaguuagggcaaagaccauaauauuguaauuaucaauaauuaugaauugucaaaauuaugucaugaaaccucuuuuuuucuuuuuuuugagggggagucuugcucugucacccaggcuggauugcaguggugugauccugguucacugcaaccuuugccucugagguucaagugauucuucugccucagccugggauuacaagcaugcgccaccaugccuggcuaauuuuuguaguuuuaguagugacaggguuucaucauguuggccaggcuggucuggaacugcugaccucaagugaucugccugccuuggccucccaaaguguugggauuuuuuuuuuuuuuuuuuuggagacggagucucacccagucacccaggcuggaguucaguggcgcaaucuuggcucacugcaagcuccaccucccggguucacgccguucuccugccucagccuggcugggacuauaggcgcccgccacuaugccuggcuaauuuuuuuguauuuuuaguagagacaggguuucauuguguuagccaggauggucucaaucuccugaccucaugauccgcccgccucagccucccaaagugcugggauuacaggcaugagccaccgugaccggcggaaaguguugggauuacaggugugagccaccgcgcccggccccaugaaaccucuuauauuggguuugagauuaaauccacaauggauuguguguauuauauauacacacacagacacacgcaaauguauuaaaauguauaauaugaagcaguggaacuucccugauagcacaauuuaaauauuuccuuuuugacaaacgugcauaguuaaauaaauuaagugaccaccaggugugacugaagaguggccagugucuauuccuagccccgaaggagcacagggauauugacugugucccuuaaaaaaaacaaaacaaaacguagggcuuucuuuguauugguuugaacauuucucuuuaucuugugaccuggccaacucuggcuauggcugccuccugucucucgguacauuuucuguggcggucaagaggaguuauuuuaagccaccaaugggaaaguuuaaagacauaauccuuggcuguaauugcgggagacgggaggcugagagucugugcugacuugccaccuguuuccacggcagcaaggugauugugcauuuccugcugcuggcugaggggccagcaaauuuucaugucguugugucauggggaaguuuuccugucucaaugagagcacaccgugcuuguggucuuguuccugugaccaggacauggagaacuauggggagauuguucugggugugaagggaaauugcuggccagugcuuagugcacgggcuuuggagucagagccaacuucuccaccuccuaccugugugaccuugggccuauccuucuaaugcuuggagucucuucuguccucaucuguaugauggggauaacaagaauaccuacuuuauaggauugcuguggaggauuaaauggaucugcaugacaaaugcuuagcaugaaaaaaucccucaacagauauuggcugcuauuuuauuaucuuauugugcugagacacuggcauaauuuacaauucaaaaauuaaauuuuuuuaaucuuauacuguaguuuacaaggcccuuucacauauaugagcuuguucaauccucacagcguccuugaguuugucauuguuauugccauuuaaaaagguaugacucagaguggcuguaauugacuuguccaauucagguuucaucugucuuuugcagaauaauaaucauguacguucauaguauaggccaccucuuuuuuuuuuuguuuuuuaagacauagucucgcccugucacccaggcuggagugcaguggugcgaucucagcucacuguaaccuccgccuucuggguucaagcgauucuugugccucagccuccugaguagcuggcauuacaggagcccgcccaccaugccuagcuaauuuuuguauuuuuaguagagacaggguuucaccauguuggccaggcuggucuggaacuccugaccuugugaucugccugccuuggccucccaaagugcuggaauuacaggugugagucaccgcgcccaaguauaggccacuuuuaagaauuacucagaguuagcuuauaagaggcgaaucaguggaguccuccaguuugguucacacauaauuauuagguugaaccauauaaaguuacuguuuuugguccugugaauauuaguauuuauauaugguuccaaucugauauguuccagaaaauacacacuuaaguaaaguuuggaaaaccaaaucauagacuuacauacuguaaggcgguguauuugaaacugggauguaaaaucaauuuagugaguuaugaccugcauuaaaaaaaugguagaauaucagaguuugcugguaaguauuguaaaaauaccagaguuugcuggugaguauuguccauuucaguuauauaugugcgcacgugugugugguguguauguguguauacuaaauugcauauaaaaugaauuucuuaucauggguucaccuguugccagaaaacacuggaagucacuguuccagggaauggaaugguggaagaugccuggugggggauggagguggauucuguuuccagacacaguaaaaaaaaccaguauaaaguccccaauuaugcauugucagugucucuauguguagcuggaaaccauuccugcagcagguaagcaggaagaaccaaauugucgagaggcacuucaggaagggaagugggccgacugaaagcuuuggaggccugccuuuaaguagcugcuuuucuggaaacuucagggugaccagccuagugaacaagcuaugggucagcguuguguguuccuuugguaaauggauuugguagagagcuaacacuacugcauuuguaguuuauuuguuuguuuguuuucuuuuugagacgagucucacucugucacccaggcuggagugcaguguugcgaucucggcucccugcagccuccaccuccuggguuuaagugauccuccugccucagccuccugagaagcugggauuacagaugugcaccaccacacccagcuaguuuuuguauuuuuaguagagacgggguuucaucauguuggccaggcugguguugaacucccgaccucaagugauccucccaucuuggccucccaaagugcuggggcuauagggcugagucaccguacccagccugcgucuguaguuuaaaugauaacuuaaugaccaccauccaguagcugaggcucuaagagggaggucugaauagugggugacucagcucagcccugccugaccucuagcucuaggcugugcugucucuaggcuccggcacugauuugcaugggccugaaugaaccuucuggagauuguuagcccaacuggcugaaggauccugauccccagguuaauuugauucccaucaaacaguucauuuuuuuuuuuuuuugagaggcagucucgcucuguugcccaggcuggagugcgguggugggaucuuggcccacugcaagcucugccucccggguucaagcaguucuccugccucugccuccuggguucaagcaguucuccugccucagccuccugaguagcugggacuauaugugcaggccgccacacccggcuaguuuuuuguauuuuaguagagacgggguuucaccauguuuuccaggcuggucgugaacucuugagcuccggcaauccacccgcugcagucucccaaagugcugggauuacaguugugagccacugugccuggccuuuuuuuuuuuuuaauauaaaaaaauugaaaauacagauaaaaggaaacaaaauuaccuguaaucuccacucauccagguuaacuccugguaccuuuuugaugcgauuucuuugucuuuuuaaaugcauguucugucuauuuauacuacaauaggauaaccuccuacaugugcuuuguaacuuacaucuuuuaauuuuuaacaguugaggugggccgggcaccguggcucauaccuguaaucucagcaccuugggaggccaaggcaggcggauugccugagcucaggaguuagagaccacccugagcaacauggugaaacccugucucuacuaaaauacaaaaaauuagugguggugcacgcuuguggucccagcuguuugggaggcugaggcaugagcaucacuugagcccuggagguggagguugcuugaguccuggaggcggagugagccaagauugcgccacugcacuucagcuugggcugcagggugagauucugucucaaaaaaauaaauaaauaaauaaauaaaauaaaaaaacaauugagguggaugucucccuagggguaccccaggaagccacaggauaaaaagcaggcaucuugcuggagggucucuguugcucaguagaaauuauuuuguaauguuuuuugaaaaccacaaacauggacauauuauggacuggauaccacauuugcaucaggauuuuuuuuucaaccaguacaguacauaacaaagaaaucucuacccugcagacccucugggggugugagagcgcuccuugcuauucucagggucaauguauggcaaucugugaaggacugacaauauauugcaaacguuucccccugccaguaaauauucuucuuuuguauaacuguuagcuguugcauccauuccauuauguggagguaccuuaauuuaucuaauaaguccugugauuagucuuauaguuuguuuucaaaauuuuuuuugucacgauaggcccuauucaguugacuuugugaucagcucugaacauauaaucuggugauugccuuaagauaaauugaauaauaaaaguaacaauaguagcuaccaucgguugaauauuuaucaucaacuguugugagcacguuguacauauuaacucauuuaauccuaugacguagguauagggaaggaaacugaggcucagaaccucugccagcuaguugugggcuuccuuugaggcacaggggagcugaaugggagggucuacauaggacagggcgugucugaguccaggaaggacagcuggacuugggccagucucacaggugggaaggcugucuuucugugaggaugggugacuuguugaccuuugauccucagagcccugaugcagcaggagugaaaugauucccagagccacagaaaacaagaguaucuuugucuuggauuuuagauccuggagcuaucaggugguaagaaggcugucugacccagauuaagugaugucaugguaucauguuggggugugggccuuccuguuguaaauuauuugggauuucauagagaucgaagucauguguggaugacaugacuucaggaugucccauuagaagaggaacgugggggucaggcgugguggcucacgccaguagucccagcacuuugggaggcugaggcgggcggaucacgaggucaggaguucaggaccagccugaccaacauggugaaacccugucucuacuaaaaauacaaaaauuaacagggugugguggcacaugccuguaaucccagcuacucgggaggcugaggcaggagaagugcuugagcccgggaggcacagguuguggugaccugagauugugccauugcacuucagccugggcaacaagaaugaaacuccaucuccaaaaaaaaaaaaggcugggugcgguggcuuacgccuguaaucccagcacuaugggaggccaaggcggguggaucacaaggucaggagaucgagaccauccuggcuaacacggugaaaccccaucucuacuaaaaauacaaaaaaaauuagcugggcaugguggugggugcauguagucccagcuacucgggaggcugaggcaggagaauggcgugaacccgggaggcggagcuugcagugagccaagaucgcaccacugcacuccagccugggggacagagcgagacucugucucaaaaaaaaaaaaaaaaaaaaaagaggaacuugggaaagagcaugggcuuuggugucagcagaagcauguguccaguuccaugcucuucccuuauagcugugugacccugcuaucugcacagggacuugagccucucagaaucuguuacugcaucuggaaaauggaaaucuggaaaugucacugcaucuguagcaacaaccaggccauuuuguuacuagguuuaagugagggaaggcauguaaggcacucaguccagaucauggcacuuaguaggccugagcacauuugcucccaccucagugaccuccuuguuaacacgacaucuccugacuuuggggcugcagagugaugcagagcacuggccaguguugccaugcacccagggugcagggagaccugucuugcagguguucaaacaacuuuugucagccucagugucagggacuuuuguugcguagagcagucaccaaauccuauggugagaagagaaaucguuggagaugggggugcagggguggaagcucuuauuucagaagaccuguugugagguaagacucagacccucagcuucuauccggccacagaguuugggaccagccuuucgaugucuuuuggaagaugcacauggaaugcuuagccuuugcucuucccuggaaccuggcuuaggcuuugcaccuaucccaccaugugguuggggugagugaggacaacuucuuuuccuccagaacaugguuucuccaucucagcccuauugacauuuugggcuggauaacucgcuguuuugggaggcuguccugugugccccguaggauguccugcagccucccuggccucugccugcuaggagccaguagcgcccccucccccacagacaaaaaugucuccagauauuggcagauguccccuaaagggcaaacuacccuugcuguagguaauacuugcuuugaaguacugguguggauggccuaugcccuggcagucuuacuaggugggacuggcuguccucucauucucaugggauuggccucaugcugguagcugacuuccuccccgugagaccguaggucuaaacuaacaagguuuacacaugugacaaacauccagguugccagggcucaaaagaggguucacaucgacucccuucucauucacugaguccuuuuucgggagcuuuggccgaguuugugcugcgucugggcaucuaggugucgaguucuucccuaguguuuucagccucggcuuccuccucuguaaaaugggaguaacugauacuuuuccugucugggugggaaaggaaccccgugcuaaugugauugaugguguggugcuaagcucugcugcaagggaugugaaguugagggaaagguuuaccauuuauuaggagcuuugagaccaaguuccuuccacacaagagauaugcccugucaaagggagaucccauugcaaagagauucacugccaaguucccccucccacuagcucccuggagcaauuuucagcuuuuagaguguuuagaggccucaggguguaaagcgagagagagaaugccuuccagccagcgagagagaaugccuuccagccggugacauugagaauagcaggaaagaggcagaagaagaaacugacuugaagggugaugccagccaggggugaguggagugagguaggauuugcuuucugaaaacugggaugugcacacaaccuaucaagaauacuucacuuugugaggcccaaaaacagcuccuagcacaguguagagcagacuuggucagaacuucaauccuugauuuuuuuuuuuuuuuaacccgaauuucaugagguuuuucugagacauccacuggacugucauauaccgugugcugggcucucauuuuauccuuacaauuauuauguucauuuuaaagaccucauguuagcuagaucaguagggugacuacaguuuacaguaaucuacuguauauuucaaaauagcuagaagagaacaauuugguucuagcauaaagaaaagacaaauauuuaaggugauacauaucccaaguacauugauuugaucuuuacaaauugugugaauguauuaaauuaccacaugugcuccaaaacuguguucuugaaaaaauuaucacgcccauuuuagagaugaggcacagagagguggagggacuugcccagauccagguauguggcucuccuguaaucucgcuucuauugcuuugugaucagcagcaacuuaguagcuuucaaagcuucaauuuucuugugugccaaauggggcuaauaaauaccuuagaggauugugaucaagauuccgugaaaaaauguaugcagugcccccggcaaggugccuggcauacagaaagugcucuguacgcaccagcugcugucauuauuauuguuucaacuaccagugaucauaaaggaugccugcuuugaugagcuuuuccaggaauauggacuggucugcccugaucuacuugaauaaucugucucaggcccuauucgguaaauacauguaggaggugcagcugccagggaagggagggauguuaccuggagaggacagagucugaaguucaggaaauacagcaagagccuuccucagggaugaaacaugugaucuuauggucugacuagccucaagccagcugagcucauugccaugcaacuugguaguuaaugauugcuaguaagaaguuuaaaaggaucauccccucaaagaaugucagaguuggaaaagaccuuagggacauuaggcuaggaaagacaauguccuagugagugacugcuugggcccuguauagaagggauucucagaucacuugggauguccuggcucagcaggaggcuaaggugggaucaauuagugaugucugccauggccacaagagaggcaaggaguggcacaugugcuguuuauuugcugucuuuggcugcagcugaggacacugaggcccaagacuugcuugcuuacuggacgaucacccaagucauuaaaccacaaaaaucucuuuuggaaggaaucuguuaagaaugucugauuauaagaguugcaccuuugagcaaguauuuuuugcuugauagucuucagugaggaggaacugucuucaaagagcacauucugucuuuuggcaauucucccaauuagaacuuagaccacugagguagaaaggccuuagaagccccuuuaagugggcucuucucaacuggggcugcaccugagaagcuuuuggaaaauaccaguuggaggcucccuccccagaccaguggauucuggauaucuggguguauggacaccucuugcccccauugguguuuuauuuuccaagcuccucauguguuguuaauauguagccaggguugagaaccacugagaccaaaacucuuuggaaacagagacccagaaagggagaacaugauugucuauggguauguagggcuaguggcacaaggagaaggaaaacuaggggggaaaaggccuuuaucaaaugccacccauaugcuagucucuuuuacuuucaugccgagauucuucuuuuuuuuuuugagucagagucucgcucugucacccaggcuggagugcaguggugcgaucucggcucacugcaaccuccgccuucugggcucaagugauucucuugccucagccuccugaguaucugggaguacaggcuugugccaccacagcuggcuaaauuuuuuguauuuuuaguagagaugggguuucaccauguuggccaggcuggucuugcccuccucaccucagcugaucugccugccuuggccucccaaagugcugguaugccuggcccuuuuuuuuuuuuuuuuuugagauagggucguguucuguugcccaggcuggagugcaguggugugaucacagcucauugcagccucaacuuccugggcucaagcgauccuccuaccuuaccugccugaguagcugggacuacagaugugugccaccucuccuggguaauuuuaaaauuuuuuuuuuguagagaugggggucucacuauguugccacagcuggccuccaaguccugggcucaaacgauccucccgucuuggccucccaaagugcuaagauuauaggugcaagccaccucuccuggcuugcuucuuucccguaaauugagguguguuauuccacugcuuaaaagccuacauggcuucauaucgcuguuaguauaaacccaaacaguggucugcaagacucugaaccuuagaucaggaugaucagaccccucccuccccuccacccuccgaccucauccuggcuacccacucccuguucacagacuacagucaccuggcucuaguacaacagacacuugaaccuaccccgccccucucccucagggccugguacuauccuccucgcuccuucuuaucacucaggccccucuaucccaucauccuccuucauuuccucccauccuuaucaccuacucauuucugucugucuccccaccucuuggauuaugaguucaggggagugggacccccuaugucugauuuccuuauguguaggacagagcgugccucaaaagcaugcuugcuuggugaaugaauugaaagaaccacccugacauggagcugguauuauccacagguuacaauggacuggaccuccucuuccagucccauauaauuuuuuuuuuuuuuuuuuuuuuuuaaauuuugagacagagucucacucugucgcccaggcucgaguacaguggugaucuugguuuacugcaaccucugccucccagguucaagcaauucucgguccucagccuccccaguaguugggacuacaggcaugugccauuacaccuagcuaguuuuuguguuuucguagaaacaagguuucaccauguuugccaggcuggucuugaacuccuggacuuaagugaucugccugccuuggcaucccaaaguggugagauuacaggcaugagccauuguaccuggccccauaucacuucuuauuaucucauaauauucuuaccuuuugcagugacagccccaaaguguguguguguguguguguguguguguguguguguguguguguuugggguggggaucauaauaauccugcaggugggguuuagcucuggugaaaagagcacagauccuuugauuuggguuugaaucccagcacuuccucuuacuaagcugugugaucuugggacauuacuaaccucugugagguucaguuuuucuuggcugcaaaauguaagcacaauacuaauaaguaacugacagaugcugugcuucugccagacacuguacccagugcuuuguguguauuggcugagugaauccucaugacacccuaaugagguaggucucuucucuucuugcuuucauuuuacaggagaggaaaaugagaugcagagaagcuaagcaaccagccugaggccacacagccaaucaguugagagucagaguucaagccuaggcugcuugcugccagagucagaguguuagguaggacuuuaugaaaucaugcccacaggccccggaacagguaguggugcagacacuugguaaaccguaguuaccccucccacuuugacauuuacucuccuggugacauuuaaguuuucugacuguuuuguuguucaaguuggugacaaaaguaccaauuuccugccugcucacuuccaaacacagcuucuguugaugagaacuaagggaguacaacuuuucaggccgggggugugcaugguguuuugggccuuggugcucaggaagugugggcacucccuuaaauuuuuuaaaugggcaaaugagugcauuuuccuauuuaaauuuuuuuuuuuuuuuuuuugagacagagucucgcucugucacccaggcuggagugcgguggcgccaucucagcucacugcaaccucugcuucccggguucaagugauucuugugccucagccucccgaguagcugggauuacaggaggcugccgccacaccuggcuaguuuuuguguuuuuaguagagaugggguuucaccauguuggccaggauggucuggaacuccugaccucaacugaucugcccaccucggccucccaaaaugcugggauuacaggcaugagccaccaugccuagccucacucccuuaaauuuuuaaaauggguaaaugagugcauuuucccauuugaaacauuuucugcuucaaauccuuauugagcacuuugugcuaggcauugugacuaugaucaguauaaaaaccccaagaaaacaaaaaaacaaaaacaguaauucacuguccugucacccccaacucaucaauccuuugcuuuuccauaacugguuaccugggugcuuuucuucguugugauuauuuuuuauuggaaaugcagauuugugacugugaugggccugaggucaggucaccuugcugaggcgaguuuccugggcggcuuugcccuguuuugauaaacagaagaaugagcagcuggagcugcauuucaaguggcugcuuuaguugaggcaggcaggccucaguguuuaugugacaccgagcagcuucaaaaugagcuuggucauuuaaaaaaauuuauuuuuuccuaguuagguaacagugguauaacaacauuaaaagaaauguagaaacuagagaaaggaaaaaaaaaagcccuuuaucccccccaucacaaaacuauuauaauuucaaaauaguuacaaguacaauguauuccaaguggcuucuuauuuaagauaauuauauucacagagcagggaccguuucagguccuuuaaugcugaaaggcuaaauaaagagaacuuuuuauuuuuuccauguuaauacauggaugauauuaaccaugauguuuaauagcuacagaauacugcaugaaauggauguacuauaauucauuuagccuuuuucguauuuagagauuuaagcaguagccaauuuuucaccauuacaaguggugcaaggaccaauaucuucaugaauacagcauuuucuguaaagcagaaauucuuucuucaggauuaauuuccagauaucuuucugguauuagacacauaccacuugccuaauaacguuccaaaaggaauucauuguuuacauugcuauuagaacauaugagauugccuguuucauuauguccgucccagcacuggguauuaucauuaaaaaaaaaagauuuuaaauuuauuuauugaguuauuuacuugagacagaguuuugcuugucucccaggcuggagugcuguggcacgaucuugguucacugcaacguccgccucccagguucaagcgauucuccugccucagccuuccaaauagcugggauuauaggcacccaccaccaugcccagcuaauuuuuguauuuguaguaaagaugggguuucaucaugauggccaggcuggucucgaacuccugaccacagaugauccacccaccuuggcuccucaaaguguugggauuacaggcgugagccaccgugcccagccaauauuuuaaauuuaauguuuacauuugcacacaugccaauugggcuucaugguggcugccucacaccacuuuuuguccgugugugagacucacauagaggcuguuuucugugauccuuuuuuaaaaaauaauuacauuuuuuuaaugcucagggaaaaugucaaauaauuguuuauguuuuguacugaaaucugcacuggucugaugguacccagaaaaacucuuaacuguagccagaaaccagcugagccuaguuguaugcaaccugacugcaaaggucaucaggugcucucauuuuauuuuuagagcuauauuuuagcucuaacgugauuguugggugaacacuugcagaaugaaauaugacugacaccuaccagcugucuacacauuccugguuauaucuuaggaaggcagugugugcuagcaccuugggaagagaauguugaguucaaauccuaguuuugccccuugcaccaauaccuugaucagauuccuccccugcguccucccuacccuuucuucaacuucacaccuuaguuucuuuacuuguaaauuggguugauagugggcugcugucagaauuaaggacaucguuuugucaaggauuuugcauacaggaagucauggugacagcuguuguuacuguuguccugaggaguggggacaggagaggaggaaaacaggcugguccaggugucuuuccuuaaaggaggcuccagcuuaguuggggagauagaugggcuggucagaguuucaagucauaggcagugcaggccucaaaggaacagccaggacuugagacaagaaucaggccaagugaguaacuguugcugcuguggcagugaauguuagcagcccaggccugcaggggggaagacucauuugggguacagugagaggucuugcugggcaaaugcaggguguuugcggcaagguaggcuggggcuggacuuggaggaugccugcgugauuuagauucuaucuuguagagaaugagguaucauggaaggauuuucuuuucauguuguaaauauuaaucauuuuauuguuuuguauuuuugauggcaauauaaaaauaccagcuuuguugagauauaauuuacauacaguaaaauucauccauuuagaaaguauacaguucaaagcugggcgcaguggcucaugccuguaaucucagcacuuugggaggcugagguggguggaucacuugaggucaggaguucaagaucagcauggccaacaugaugaaaccccgucucuacuaaaaauacaaaaauuagccaggcaugguggugggugccucuaaucccaccugcuugcgaggcugaggcuggagaaucacuugaaccugggagguggagguugcagugagcagagaucaugccacugcacuccagccuggacgacagagugagacucuaucuuaaaaaaaaaaaaagcauacaguucaguuguuuuuaguauauucagaauugugcaaccaucacugcugucuaguuccagaauauuuucguuacucacaaaagaaaccccaugcccacgagugcucacuccugauuucucccucccccaccuccuggcaaccaccaauuugcuuucuguuucugugaauuuaccuguucuauguauuucaugugaguagaaucauacacuguguguccuuuugauucuggcuauuucgccuagcauaguguuuucaagguccauccauguuggagcagguaucacugcuuuguucuuuuuuuauggcugaaugauauuucaucacagagagauaccauguuuuguuuauccuuuuaugagcugauggucguuugggucauuucuacuuuuuggcuauugugagugacacugcuaugaacguuugucuaccaguguuuguguggccacggguuuucaaugugggaggauuuugaacuggggagugguguuuggagccuuuggguggggugggcugugaggagccugugugugugucugcccuuacugggcuggguuuagggcaagcuucaugugcuuccuuucuuuuaagggacucucugagacaggguuauuauccccuuuuugcagaugagggcacucaggcucagugagguuaaauaagcugcauggcuagacaauggcagauagcagcccuguccggcucuuagccagcuugcagccaccugccccugcugggccaggcgauugcaguggucuuggcugggaggggcccagaggcuguguggugcuggagagaggcagcaggcuggaccugguugggcaaggcugagugguugugggauaagaggagauguuucagagcagcacccacagaaccgcugugaugggagaaacaagacuucgaguuaggagaguggguuggacucuuggugcagccuaugugaccuugggcugaucuugucucuuuugagcaucacuuuccucaucuggaaccuggggcucuuguggcuuccugccucucucaagggugauucgggaggaagagugggagagagagagagagagggagaggauggaggcgagagagguggagugggaaaggagggcagaaucugcuagaaccugcagagcucauaaucuaggggcggggagggacaugcagcaggugcaggcaggugugggaggaaguagccuggucaucuggauggacaucccugcccauucagagaagcucugaacccugcaaaagcucccacguggaggccagugagcugguuauaauccagagacugucaguuuuuccuaguacauauuuggaccugagccuuuguuucugcaaagagucugguacugacucacacagugucagcagcccccuuccauccccuggcacaccccucccucauuccuacugagcauuaccuuaaaaccagugaggucuuucugggucuuaaaggucacccaguguccuugccuaucugggccugucucuguucaaguggcaaggcggaccauccccuuuaucacugacuugcagcuugccuggguuuuguaaaaagcuugucauugccaguuagaaaauaaagacagaaaccuccccuuuggcauugguaucgugaugacuugcucuuguucugacucuauuuugcuggcuuguuaugagucagucauuuuuuuuuaaugaaaugaauaccuuugucuuaauaugaagcuaggcauauaugauaaagguuagaugauuuuucaaauaugaaaucagaauucuacccauacucccaaauuagagagcagucugauguguuccccuuuacugugaccaguggcuucauaggggaccuaguuaugaguccuguuucuuuuuuuuuucuuuuuuuauuuugagacugagucucgcuuugucucccaggcuggagugcaguggcgcaaucucugcucacugcaagcuccgccucccggguucacgccauucuccugccucagccucccgaguagcugggacuacaggugccugccaccacgcccggcuaauuuuuuguauuuuuuuuuuuuuuaguagagauggguuuucaccauguuagccagguuggucucgaucuccugacgucgugauccgcccaccucggccucccaaagugcugggauuacaggcaugagccaccacacggggccaggccuuuuucuuuucuuuuuuuuuuccucacugugucacccagacuguagugcaguggcacaaucuuggugcaaccuccgucucccagguucaagcgauucuugugccucagccuccugaguagcugggauuacaagcaugugccaccacaccuggcuaauuuuucuauuuuuagcagagaugggguuuugccaugcuggccagggugaucuugaacuccagaccucaagugaucugcccgccucccagaaugcugggauuacaggugugagccacugcacccggcugaggccuuuuucuucugugcguuccugcugucuucccuccaggcagcagcaagcugguaggagcuguacuugugaguugacaucaugauguacagucacuggucacuuauaaaacugggcaggcccagagcaggaagggucauugagggucaucuaaugcaaaccguuuacuuuagagauguugaaaccaaggcgcagagaggggaagugacuugcccaagaccacacagcuaauaucacugugagcccagguuccuggcuccaguuccugguucuuucugcccccuucuucccgacacuaaagauacaguggugagcacacaggguauucaguaacguaucuauuuuugaccuguuuuuaauggaggcugaauugggcuuuuaggguugaguucugacacgugccaggugaucugcuggagggaaaucuguuacuucuggggaagaguugaaggugucuucugaacucuggaaucuguuuugaggggaggcugagcccaugcguggacccuuaggcugagcccaugccugcuucagauguuccacaccuuucaccacaauuuauuuauuuauuuauuuuuugagacggagucucgcucuguggcccaggcuggagugcaguggcgugaucuuggcucacugcaaccuccgccuccuggguuuaagcaauucucugccucauccucccgaguagcagggauuacaggcaugugccaccacgcccagcuaauuuuuguauuuuuaguagagacgggguuucaccaucuuggccaggcuggucuugaacuucugaccucgugauccaacugccucggccucccaaagugcugggauuacaggcgugagccaccaugccuggccuauuuauuuauuuuuuauuuuuuugaguugaaguuuugcucuuguugcccaggcuggagugcaaugguguggucuuggcucacugcaaccuccgccucccagguucaagcgauucuccugccucagucucccaaguagcugagauuacaggcaugcgccaccacgcccggcuaauuuuuguauuuuucauagaggugggguuucaccauguuggccaggcugaucuagaacuccugaucucaggugauccacccaccucagcuucccaaagugcuaggauuacagucgugagccaccaugccuggccacaccccgguuuauugcauuugcuucuaauagagaaaucaacccaguaaacaaaugaauuauuguuagcaaaacugggggguggguugggaaaggaaaguaguuccuucuauaauaaaacuugcugauauuucguugaaagucauugucuuacucauccuuguauaagauaagucacacaaugagugguaucaggguugcaggguuucccccugugaggacacaaugggaugaaccgugugugggauggucuguuaaagaaaaacaagaagccauguguuggaaacaaccuaaguauugagcgguggaggauugcugaaauuguggacuacuaugcagucauuaccaacgcacugaaaaaauguuccaugauauggcaggauguuuaugcuauaagaaauuuaaagacgcgagcuucaaaguaaaguauaaaccuaauuuggucaaacaggcugggcgcaguggcucacgacuguaauccuagcacuuugggaggccgaggcaggugggucguuggaggucaggaguucgagaccauccuggccaguauggcgagaccccaucucuacuaaaaauacaaaaacuagcuggguaugguggcucaugccuguaaucccagcuacucaggggucugaggcagaaggaucacuugaaccugggaggcggaggguguagcgagccgagauugugccacugcacuccagccugggcaauagagcgagacucugucucaaaaaaaaaauauugguuaaagaaacaaacguuagacuugaagccgugcuuuauauggauauguggugcacuauaauguggugcuuaaaaagcaacuuaggcagaccugggccaagucugggcucugccacguaacugcuaugugccccugggcaagucacuggaucuuucccaguucaggcuucucagcuguuaagugggacuaguaccuuaucucuuuggguuguugugagaauuaaaugagcuaucugggcuuucagagaaagggcuucaugugccguggcucugaucagaccaaacaaguuaucuacugcucuaagccaucaaggccccccaugccuguuggauacuguugaguuauuuggguuggcauguagugcagcguuucuggacauacauacucuggggacuccccaucccaaauuucuuacagucucuccagugugccacacgcuuucuugccacuagguccuugcaugugauggaguaacucuuguaccucugucucccuaaauagacgggguucuccaaggacaucgugccacagggccugguaacccaguaggugcucaguaauuuauuuauuuauuuauuuuuuuugagacagagucuagcucugucgcccaggcuggaguagaguggcguuaucacggcucacugcaaccucccacucccagcuucaagcaguccuccugccucagccuccugaguagcugggauuacaggcgggugccaccacgcccggcuuauuuuuuauauuuuuaguagagauaggguuucgccauguuggccaggcuggucucaaacuccugaccucaagugauccgcccgucucagccucccaaagugcugggauuacagggugaaccacugcgcggcccauuaggugcucaguaauuuguugaaugaauugaagacaugggacuugaguuaggcuuuuauuauuauuauuauuuuuugagacggagucucacucugucacccagucugggagugcaguggcgugaucuuggcgcacugcaaccuccgccuccuggguucaagugauucuccugucuuagcuucuugaguagcugggauuacaggcaugccaccacgcccagguaauuuuuguauuuuuaguagagaugagguuucaucauguuggccaggcuggucucgaacuccugaccucaggugauccaccugccuuggccuccuaaagugcuggaaauauaggugugagccaccaugccuggccuauuauuauuauuauuauuauuauuuuggagauaggguuuuucuguguggcucaggcuggacuugaauuccugagcccaagucauccuuccgcuucagccaauugaguagcugggauuacaggugcacugucccucccagcaaguugggucuuuaaauaaagagugggguuuggugagcagggugggugcacuguucuaggaggugggcaggacagaggucagugguggucccuacugccuauucagggaccagggccccugggcaaaggcagagauaacauuggcacaaucugccuuucagcuuucauugucaugcgggagucaccaugcuuuguaagacauuuaaucuauaagacuugauuaguuuugcuaccuuucauagcuuggggcuguguaugccuguuuguaagagagauccauccagaucaagccugugcagcaauaauguaugugcacaaggccucuuguguugugcugaugguaagauaggagcuggacuuggaggcaggagguggccuggguucuguuucuggacuuaccacuuacuagacggguacucuugaguggagucacuuaagaaaguaaugccgaucaggggcucagagugucccaaguguuuucucuugccuuauucucauuaaacagaaguacagcucagaauaugaugggccagucuuaugugauugguguuaauaaggcaguagagaguuggggguacucuggcagaccaugagaaccugcccuguuugaaggagaaugcugccuccucuuccuccuuuuaaaauucacacauaugaugcucacuaagugucuggcacccuuuuuucuuuuucuuuuuggggcagagucuugcucuguugcccaggcuggagugcaguagcacaaacacaccucacuuacugcagccucaaacucccuggcuuuaagugauccucccaccucagccuuccaaguaucugggaccacaggcacaugucaccacaccuggcuaauuaaaaacauuuuuuuguagaaaugaggucuuaccaggucgcccaggcugaucgugaacuccugggcucaggugauccuccugucuuggccucccaaagugcugacauuauaggugugagccacugugccccgccucaguuuuuaaaaauacuugcuuaaggagagagcacugaaggaagauuuagaucugcucuguugaagugacagaguacggugguuuccauuuaugcguauuuuguaguucggauggcuucuuguggggaguccugugaguucacacuugggggcauggugugggggaccugugaaguggguguucuggggugagugcgaugcuagucacugucccaguuuucuucucauuucuuuuuuugugagugcuuggcuaguggcagccuugcagaucagcuaguuuugacccacauccucccucuaaguggugcucauugaauugagccacagccccaaggucauguuuucaagguuggcauuugggaggccuugucagaaggucuuauaccauauuccagucacccaaagugcugcccgccaugccuguucguucagcaggauuucccugagcaccugcucugugccaagcccuaugcuaagcaccaagggaguaaauauggagggcaguguccccagaguccaggaacucgugaucuagucggggaggagagggguaccuacucugucuuuuacacagcaaguguaaccucugaagaaugauguuccaggaggcaagagcaacccuggcggacugguggagcugggaagggaaagaugcuucuggaggggccuugggagaagaguccuccagggugagccccuugagagagguuucagagcucucauccaucuucauauccuggcacuuagcccaggcacuaaaauuugcauauuuuugauggcaauuaaaaaaauacuagcuuuacugagauauaauucacauacaguaaaauucacccauuuaaaaaguauacaguucaagguuaggcacgguagcucaugccuguaaucccagcacuuugggaggcugaggcagguggaucaccugaggucaggagcuugagaccaaccuggccaacaucgugaaaccccaucucuacuaaaaauacaaaaauuaaccgggugugguggugugugccuguaaucguagcuacuugggagguggagacaggagaauuucuugaaccgggugggggaaguugcagugggcugagauugugccacugcacuccagccugggcaacagagugagacucugugucaaaaaaaaaaaaaaaaaaaagguuccauucaagaugucaagccccacgggacugaggguaacaugaggguaacagacaggugauguuaaauuccauuugggcucauguucacccccaggccccuuauuuucuuucaaacacauggaaugggcauuuagaacuaggaagaucaugaaucugguggcuguguagaugccauaccagguauggaccacaggcuuggagcgcagcagcauacaggggucagaggucaaggccaguggucuaucagaacccaguuccugcaggagccagugccgguacuagguagacucagaugacugaaugguccucgggaucugaaggccagugggggagaugaggccuggccucccggaagugcucaguaaacauuuguuaaucauuuccugccuagggaagcucugugguaugcucaggagaaucuugcuucucaugggggaaugggugguugucauuuggguggccugacugccagccugcuugcuggcucucugggaguuggggugguggcaucaaccugcagaggcggggcaguggggcagcucacggcuguguggguaaguaagcagugagcacagugagggagcuguugccaggagccucuuggcuuagugagccaagcagaaccaugugaugcacccugugggcggccaccuggggacucaggacaugcacccagaucccuccuccccuacccacuucaaagaaagugcugcccucccaguggugaugaagaccuuccgcuggccccagccucugggaucuggccuuuacuuggguauucauguggcccuggggguuggcuuugcugaaguugggcagagcagguggguucuggaaugugcaggggcaaccagaguguccaucuguuugggugaagccagcuguuuaggucugaaggaucuguuugauuuuuagaaacaugauguguuccagaguuaguaggugguggugauggaggguauuggcgugaagaguguggaugcucuucguuccuuugcuguuuugggacuaucucucuaugggguaguggccccuuuccuuguuaggaucauuuagaacccccugggaucaugagaaugaaugugggucuauccuuccuucugugugaggaaaaggggagguauugugguuaagcaaguuuggagaacucuggccugaacaaaaucaaacagaugucuuucuugcaggacuuagaagaaacuuaaaucuguugguaacucuuuaagagggaaggggauauaaaacccuuguuuucccuagauuuuuguuuuacucuauagcugucucuuuuuagaagcaucucaugagacuaauguuuuuaggaaccugcuguaggaaauucauuuauucaaaaaauauuuguugagcaucuguuaugugcuagugacugcuccaggugcuugggauacagcagugaccaccuccaaccaagaucccgcuuucaagaacuuccauucuagcagaagugaugaacucauuuuuauggagcaccuacuguguauuaggcaugugaguuaucacacauuaucugcuuuaccccucacaacagccuggugagguagauggacuauuuuauuuuauuuuauuuuaugacaguguuucacucuuguuacccaggcuggaguacaguggcgcaaucucggcucacugcaaccuccagccuccaccagguucaagcgauucuccugccucagccucucgaguagcugggauuacaggcaugcgccaccaugcccggcuaauuuuuuuguaguuuuuaguacaaaugggguuucaccauguuggcuaggcuggucucgagcuccugaccucaggugaucugccugccuuggccucccaaaguggugggauuacaggugugagccacugucccaggccagauggaccauuuuaaagauuagguaacugagcucuaggggucaagagacuuggccacuuuggcagcugcauugucguuuuuggauuaugucaucaaauugcaaggggagguggugaaauaaggaauuucugcaacagaaauuggagucugcgguggggaugcugcaggccuuagcugcuguaucacuguguccguuuaugaaggcccgauggagaagaggcucugaaucaggccgggaaagagguauuucucuggaacaacugguuuguuucuguguuaugggcaccgagaagcguguggcucaucauguuuuccuuuggcuuugguuacuaagcaccugagagcuagauuuguggcccaucuugacacuucugcaggaugggaccauauggcaugcauuucuaugugcugaucuuaccccaaccucccgcccuccaucccgcuuuauuauuuucucuauacucauuuuugccuugccugguucucuuguuuguuuuauucuuuuguguuauuuguauuauucuaaaccaccacauauacuuggugggauggagcuggguauaguuaaauuuuaaaaauaauggugagggccagguguggugguuuaugccuguaaucccagcacuuugggaggcugaggcagguggaucacuugaggucaggaguucaagaccaguguggccagcauggugaaauuagccgaguaugguagcgugcaccuguaaucccagcuacucgggaggcugaggcaggagaaucccuugaaccugguggaggucggagguugcagugagccaagaucaugccacugcacuccagccugggcaacagagugagacucugucucaaaaaaaaaaaaaaaaaaaaaagaaauaauacuaaugaugagaugacuugcauaagaucccccagcuacucuguggggaagucgggcuccaagccagcucuccuggccccacccucuuuccaacauacucagugccuuucuggauuaggauccacugcaagguuccuuugcagugggagccaggucuguuuggcuuuugcagccauuguguuauggguuccaguggaagcugggcuggcuggauuggagguguugaggggcuuggauugaccuaagugucaccuguggcucaagcaaggcucuggacuguggauuccuucuuggugagggcuguucagccucacccaggagagaacccauaccucugcuucuugcuugugaggcaucagguuucaagcaggggucagaccagaugagcacuguuauguucuucacagcugcuucccacucguuauccucauaguagcccaggguagaaaaggagaggaugagugggugguauugaugaagaaacggagaccuacagaggugaaaugacuucacccaccaggugauggcugagucugcaacccaacaaaaaacucuggcuugcuggcauuucucaggccagacaguuccaaugugaacccacgguaccuucugcgggagaaaagguggcaugggaagcaggaagagccuaggauuugggaguuggaugccauggacuugaguccuggccacuacuaugugcauauggggaagucacuuuucugagccucagccgccucaucuuuaaaaugugggcccuaauuucugcccugccagccucacaggauggucaugagaaacugaaugagaagaugaacauggaagccuuuugucuggcauuaaccacaugugccugugugcuggguucugucugcauugugcuaaugaugguggugaugguauuaauaguaauaauagugaacauuuaaggaacacugccuccuauaauagucaccaugguaaacuuuacauacauuaucuuaaugaaugcagaaaacaagcagaugagcagggaccgucuauuauuuucccauuuauuuuuguuuauuuuuaauuuuuuuuuuguagagacagggucucauguuguggcccaggucuugagcuccugggcucaagcaauccucccaccucgguuccccaaagugccaggaucacaggugugaguuaccucaccuggcuguauuuucccauuuuuacaaguggaaacaggggguucaaaaaaguuuauguaauuugcuuaagguuguagagauguuacauaguggaguccagauuugaucccaaguaggugacccuacugugguaucacugcuaucagauuggaaacagcagaagucuaggaccuuuuugguuugguugaugacaucugugcacaucauucugguagguaggggccaucugggggcaggaaguuggguguggguagggguuggcccuggagaggcaauagaagcuggggcuuggcuggauaacaagccuggcacacugaguuugucucugagguuuaguuucucaccuguaagaugaugauauaauaaugugccucaugggauuaaagaaaauaagagaugccuagauacuuauacauugcuauaaaaaugucuguguuauaagagugacauggcauuccacaaaaugcaguguagauguaaauuaguuggaauggugaccucaccccugcuagguagcacuggcuuaugucccaccugagaguaguagcaucugagggcuagccacacugaacaagccacacaccugaccucagcauccucuucugugaggggaaugcucucugcucuucuaccugcaugcaccguguuuguggaagugcucuguguaggacagggaaagcaccuugcagagagcaagggcccacuggcugcagagagccuggugggugauggaccagagauaagggugagggacaguuuagagugucacaguuucucauagagcuuugggcagugacaccaguauuagucucaggaccaucauugacuccugguuaguuuuucuguuuucaaaacacuuuaucagcuguaaagcacuuaaaaauguaaauuaguuccugcaaaaacaaaaugcacaaaaaaugauggcucugccaggcuggguugggagaugaauguguaugcaugugugaauggauucauuucugaugauaaaaauacuuuaugcuuauuuaugugaaacuuggaaaauagaggaaaaguauaaaauugaaacuaaaagucauccauaauccuucuaaguagcuuuaucauuuaauguuuuaguauauuuccuuccuguuuuuuuuuuuuuccuuaauucuggguguaugcaaaggauuuuguaacccuuuacauucuggaaacuguucaacaugacuucuuuuuuuuuucuuucaaccaauuuguggagaguccauuuugcaaagccuuagcacagugccaagcacaagcuacacacccgggaugcugcugaaugcagaugagagcaugccagcucugcugaaguugggggcugggggcaguggauggcugugaguggugugaagccccgggccacagugaagacccuggaauggcugagagacugggauuccaggagaccgagguuugaggggaggcuuuucauuguuugauuagcucuuuuuuucuuaccacauguaagucaucauaauacuuaaaaaauugcuguaaaaagcagcuaauuaaaaauauaaauacagucuuuuuggagacuagaaacagucacaagagaagcaguuucagugagaaccagauccuuugucagugucagcgagggggaggggcgucggggcccagccagcaaauccuucccuccgaacugggggugcggaauguggcacucccuuuaguuagacuugaugagcuuuggauuugaguaagugacagccccuuuuauuuccugcuuuguucucucccagguaccaguugaccacaguuuucauucaugcaaauggaagcugacagcugcccagggaggguuagauaccugggaggauagagcagaggcccuccuucuccccgaccccucgccucugcaggcugguggggaggggggcaggggagucgaguuacccucucuccacgcuuucuucuuguguaugugugcguguacgugcguguguguguugugugugugugucuugggggauggagaaccccucucaggagggccuguggaaaggcugggguaaguggagugagcccguggguccugcccuuccaggcugccaagaguuuaaguugcugccucccggucucugugcccuuuuccugccuguggaaggcccucucucuguuuaggaacguggauguggcaggggcugggcgggcacuuggccuuuauaacaacagaagaggauuuucagugacgaggaagcaucccgcccuucugguucccugucuuccaccuggccccacugcgacagccucuccaggccucugacuucacuagaaucugccccuccaccccaccuucccccgaaccccaccuccuuucucugagccugagaggaguuaauuguguuagagugcacugagaaaccuccaggaaggggcccuagucccuguguugccuguucagcaaucacauuugcucacgucuagaaaguacaauauaaugacucagguuaaggggugaaaaaaugugguggacauuuugccaggguacuguguuaacuguuccaagguaucacccugugugagacucaggaacauucaguguuuugguuuccccccuauuguacugaaugccggcagcuuuccccuucuaauuauuuaucuuaauaauuugaggaaaguugauuugcuuuuuaaaaacuggcauccaagcguacccuaucgcacugcacacagcugagagauuaaggcaguucuuuagaauuccuaguccguguuguguacacagcgauaggcugggguagugguucugggugcaacuggggacaggcgaggaaccauaaauuuggcaggaaagauuuguguugguacccuguuauauuugcuuugcaucacauauuguuuaaaaagagcgauauuuucguuaaaggaaaaggaacuguguauuugagauaagaaguagaauaaaaugaaaugaauaguuggguuucguccuguggccuucaaaauggcguuauuucugagaucccuguuucuaugcuguuccaguauuuauacggaacuuauaaaauacaaaguauaggcaugucccgagauccuggcgaggcuguaauuuauaguguuguucuuuuucuuuuguuuuacagagcugaguuuggugaaacuucaggagguuuuagcuaguggcgauccaaagacauuaaauauugcuuuguggguacgucuccaccuugcgucuuacuuggugacuguucagugguaggcaaaugucagaacccaguaugcaaauguggaaguggacagauuugagucaguuaucucagcugguguuaugaaauacggaaauuuuuggcguuggugguggagggcguuggcauaggaggcgugaaugcucuuuguuucuugcuguuaugggaguaucucuugauugccccaucaucuuguuugguguggccccguuuccuucuagaaguugaguucccugggcuugugagaacccuuguacaucugccuccauuaaacucacauuuggagaucucguaaaugaacgcagugcaguccgggggcagagugaaggcucagacugcagccggacauggcucaguuacccuagguggguuagcagcugagcagguacuggucucaaaacccucugaagcgaagcugccugucgauuccacaguugccagcuuccagcauggagcuucuggaaguaucacggacugaguugggucccaaugcuggaugucccuacucuuccuccugccccucccacguuuggaugggcaaaugcacuaagaacagcccgugggcaagugaaugaaaccaaaaagcagcaagggauuuggacaguccaccucagaguaucugacuuuauuuugaggggcaugugucagaguugggugaagaaagagauucucagauggagauagagaaagauccccaaaagggcaggcuggcuaccagugauuuauuuuuauuuuucuuacuuuuuuaagagaaugcagggcauuuuacucuucugugguaggagaguagacuggccacagcccagcccagaacccuuaacaaaagguuaagcugcugggcaugguggcucacgccuguaaucucagcacuuugggaggcagagauggguggaucaccugaggucaggaguuugagaccagccuguccaacauggugaaacccugucucuacuaaaaauacaaaaauuagccgggcguguuggcaugugccuguaaucccagcuacuggggaggcugaggcaggagaaucgcuugaacccaggaggcggagguugcagugagccaagaucacgccauugcacuccagccugggcggcaagagcaagacuccgucccuaaaauaaauaaauaaauaaauaaauaaauaaauaaauaaauaaauaaaauaaaauaaaauaaauaaaaaaagagguuaagguuuauacgcaggccauuucuaauagauguuauggaagccccagguuuuggggcaucaggguuggaaaggaagccaaaaauggguguguccaaaggacagaugcauugagaauggguuguaaaauuucagccauuguguagauuaaccagcacggcacccugccccucagccauuguguagauuaaggagcacugcacccugccccuccucccccaagcaugcagcaccugagaaagaaaucugacaaagaugcuuuaauaugagucuagcgcuuugagccuuucauugucaucuccagugcaauugucuguggguuuuguuuuguuuuguuuuguuuuuucauuuuuauuggacuuugcuuugccuuuuaagggaaacucuggaugauauacuucauuauuucacuugucagaugguuaguaauaugguauugccauuccugaccuaaggcagcaagugauuccuucuggcaaacucuuuaagaaacaugggcauggagccuggcugccugaguucaaaccccugcucugcugcuuaccaguugggugaccuuggucaaguuacuuaaucuccgugccucaauuuccuacucuguaaaauggagauaauaauagaaccugugucauuacauuauugugggaauuaaauguguuagucuacgaagaggggugccucaggcccaugguaaauuuuauguaaguguugguuguauauaagaugaugaaguccgggcgcgguggcucaugccuguaaauccuagcacuuugggaggccgaggcaggcagaucaccugaggucaggaguucgagaccagccuggccaacauggagaaaccccgucucuacuaaaaauacaaaauuagccaggccugguggugcaugccuguaaucccaguuacucaggaggcugaggcaggagaaucgcuugaaccugggaggcagagguugcagcgagccgagaucgugccauugcauuccagccugaguaacacgagcaaaacuccaucucaagaaaaaaaaaaaaaauuaagaugaugaagaugcagcguggggccaugagaagaguccuggucuggugaguuuggaaaccuggcuucuggccuguuucuaacacuguauguccuugggccagacccuuuccccuggggugcugauuucacaccuguaaaaugaagaaguuugacuugcacagugcuuuucuuagacugugguaagggguggauguggggguagugccaagaccaagugaaagaggcuucuggaccuccauccuugcuucagccagagcagcguggguucauuucauuuuuggauuuugguuugugggaagaaaggguucucuugccgguguguguguuucugauaaacaaagaaguguggaaguggcugaaugagaugacccaaggacucuuucugggaagaugcaggaggaaguaggugagcugaggggaagcugguggggauaggccugguggggccuggggagaaggauuugaaggcucaagucacacggugcaggaugggacucaauauagggugggauagggcgguggguaaaagccguuacaauuuuguccaaaugguaugggcugauuuacuuauuagggagguacaaauggcuucguguuauaaagugucaagauccuuauuuggauaaggcaaccagaguguagacgagagaguaagaguaagaaaacaaggagaaaaaugagugucuuaaggauguagaaauuuaguuugcuggaagucucugcagccugaacaaaacagcuguuagguuugccagaacuuaaaccagagggugccugccagugguucauauucuugcuaccucuuccuccucuugucuuguuuuuccuuuccauucuaauaaucacgaugaguuucccugacaugcacgccccuucauucauuuguaugaucacuuagagaugaggagcugccuugccagguagaaaaaccauucucaggaugaaucuuuggcuuucugaaucagaguuuucuuuggguuuuagaacuucauucuuauuaaagugggaauuuaccggccgggugcgguggcucaugccuguaaucccagcacuuugggaggccaaggcaggccaaucgugaggucaggaguucgagaccacccuagccaauauggugaaaccccgucucuacuaaaaauacaaaaauuagcugggugugguggugcgcgccuguagucccagcuacuugugaggcugagguaggagaaucacuugaaccuggaaggcaaagauugcagugagccgagaucacaccauuguacuccagccuaggcgacagagugagacucggacucaaaaauaaauaaauaaauaaauaaauaaauaaauaaauaaauaaauuggaauuuaauaucucuuaucauuucuucaauuccaguuuuuauuagauccacaacuuuuuuggucaaaaccagaauuuugauuaugugugccauccuaggcuaccucaccauccaaaaauccucuuggaaaaccccacgcuuaucaggaaaaggagauggaagugaaaaaauaaaaauauauauaaaaaaaggaaaaccuaguguuagcaccccuuauccagcaggccccccaccuggacccccaccuguauucacauuccucccacacuuacagucaguggcuucauuaaucucuaagguuccauguucugcuccccaaauagacuguuugcucauugaagacaggcaccacacuuacauuuuuuuucuuucuuucuuuuuguuuugagauggagucucacucugacgaccaggcuggagugcaauggcgugaucuuugcuuauuucaaccuccgccuccuguguucaaggaauucuccugucucagccucccgaguagcugggacuacagacgcaugccaccacagccggcuaauuuuuguauuuuuacuacaggcaggguuucaccauauuggucgggcuggucucgaacuccugaccucaagugauccaccugccuugcccuuccaaagugcugggauuacaggcgugagccacugugccuggucuuauauuucuuuucuauuuuucuacccugaucaaccuuuucuuuucuaucucucucacuguuucuacgaucaaaguaguggagucaguuuccuugcaucugucccaagcagccguugcuaaugggaaugagugucaggcacuguacaucagcccuguuuugaaacucugugccugcugccucauugacuagcuggagaguguugaacauuugguuguagaauguauguggauugcugaguuucacgcaugagcuguguugucauuucauucauucugaguggcaucugcgccagggcuaccuggaguuuuuccagcuccccaggccuagcaaaggcagggauccugucucauucagcugcauuucuugagcugugcuuagaaggccugccacacaguagggaaucaggaacagucgcguuuacagagcucucgggugauagaagggaaaguaaagguauauuaaauuucuucuaggcuugcugccuaauccccuaaggggccuucucauuucuuucagcagugccaucuggcaggccugagaguauaugggaauaaguggggugcuggaucuugugggcaggcuaugggaucugggaaagggguuagcaccugggccuggagggaccuggaaucuagggggggcauacaucuaagcuaaauguggcuguggcuugcaaacucagaggccuuucgggcagccuggugaaaugauaaaugggcaguugcuguuuauucucaguccuagagauuaaaaagaggugcccccauuggaaacuggagguuacauguucuacccaaagggagcagcugccagucggcuucuugcgaugugaaaguacagccccagaaaacccagguuaagugauguccccuaauuuuuaaaaguuggcaaccaauucaacuauaaaaucaugccugcuggccucugagcaguaggcagggcugguguaugccggaggccaccaggggacauaacaccugccauagggucagaauagguggguguuagucaccauccagauggucagauaccggaauugccacagaaaugaacaugacaugcagagcaggcagagcaggugccaaaaguugguaucaaggaggcgaaggucaaguucuuugcccaccagaaagccuucuguuccuugucuccuucccuuccugcaccuccaaggacucuccacugcucccuacagcuuaaguccaaauuucccugucuggcauucaaggucuuccauaccuuccuuacaagugcccuuuaggcgcucuaaauggcgcgucagcuccuauguguggccucagcuuagcaguccaguguucccucccccugaaucccuccagacugcccaggcugcaucugccucagacagccggguguucccaagacaugcugcacuuucuucccucucugauuugcucaugcugcuccucuuccuggaaugcucauccccccaauuauggaaaucccacuccccacucauccuucaaaaggcucuggacaaaaggcacauucucccugaagucggcuacccucccgacucuguaaauuuggaauaaaucacaucuuucagcuucuauagcacucacccugcaucuccaccacagcccuuaugacauagcuguugagaaaggucugucuuccuugguagaugaugaggucauuguggaagguucgagucuuacuuacuguguccacagcauuuggcucagggcaacagucaacagaggcuuagugacuuagacacuugaugguagaguauggaaaacugauucucaugaggaaggugcuuaaggucuuugguaagccugggaaaggggcaguuggcuggaacagagggugugagaggagcagguaaagcuggauccagcucucuuucagcccaaggcaauaccuaaaacccuaucucugacuuggaaaggcaguauccugcugucuuccugcuguggccaugagccucacuggggcuugacuugaauguuaggacuuuuuuuuuuuuuuugagacggaguuucgcucuuauugcccaggcuggagugcaauggugcgaucuuggcucaccgcaaccucugccucccaaguagcugggauuacaggcgcccgccaccaugcccagcuaauuuuuguauuuuuaguagacauaggguuucacuguguuagccaggauggucuccaucuccugaccuugugauccgccugccuuagccucccaaagugcugggauuacaggugugagccaccgugccuggccaugaguagguucuuuaguggugauuugugagauuuuggugcacccaucaccugagcaguauacacugaacccaauuuguggccuuuuaucccucaccugcuucccacccuuucccucugaguccccgaaguccacugugucauucuuaaugccuuugcaugagagggaaggcuuuuuaaagggcccuuuucaagguuugaaauaaggcuccaugacaauggccugauuuggaugggucuuggaauacccuuuuuuuuuuuuuuuuuuuuuuuuuugagacggcgucucgcuuuguugcccaggcuggauugcaguggcgcgaucucagcucacugcaagcucugccucccagguucacgccauucuccugccucagccuccaggguagcugggacugcaagcaccugccaccgcgcccagcuaauuuuuuuuuguauuuuuaauagagaugggguuucaccguguuagccaggauggucuugaucuccugaccuugucauccgcaugccucggccucccaaagugcugggauuacaggcaugagccaccgcgcccggcccggaauacccuuaaaauauagccagaaagggcugaggauggguaagaacccaggauauagagucuucccauaaaagggagggccaucaugcaagaugaacaacuugguccugauauggauggggcuagaaucuccguauuguugcuaauaagguggaacugaauccccucccuguuccccaacacaauaaaacuucagugucgucugggugcagugacucacgccuguaaucccagcacuuugggaggcugaggcagguggaucaccugaggucaggaguucgagaccagcccggccagugugaugaaacccugucucuacuaaaaauacaaaaaauuagcugggcaugguggcacaugccuguaguuccagcugcucaggaggcugaggcgggagaauuguuugaaccuggcagguggaggugcagugagcagagaucaugccacugcacucuggccugggcaacagagugagacucugucuccaaaaaaaaaaaaaaaaaaaaaaaaaaaaaaaucuucagugcagggccugucugcucuccagggaaggcugcaguauugucagguuuguuucuuuuuccccacaaaacugcuucggagagcucuuaggucccaaguuugccugcauccaggguccagaugcuuccaggguccagaugcuuccaggguccaggcagugaguggaagugaaggaggcuccucuagugaaagaaaaaggcauccaguguuaauaguauuucuucccaguugcauggggcuugcauauuagagauaaaggaaacaucuuagcuacuacugagccauaaguggucucaccuuucuugaaacauaaggccgucuugguuuguuguucuguuuugugcuuuucacagaggcauggacacugaaagacguuucucugacaguggagauauaggacugaagagugacauggcuugcagagcacuaccugucccccuaauccacacuguccucucuccucaugggcagccugagaauguggacccaagguagcccaucaugcaguucuucaugaaaucuggaaaucuuggcauuucaugggaaaucucaucacugcuaaaguaggcuuagauuuguuuuaaaaccuugugugggcugggugcagggcauuuuacucuucugugguaggagaguagacuggccacagcccagcccagaauccuuaacaaaagguuaagcugcugggcgugguggcucacaccuguaaucccagcacuuugggaggcugagguggguggcucaccugaggucaggaguuugagaccagccuggccaacguggugaaaccccgucucuacuaaaaauacaaaaauuagccaggugugguggcgggcacccauaaucccagcuacuuaggaggcugaggcaggagaauugcuugaacccaggaggcagagguugcaguaagcagagauugugccacugcacuccagccugggcaacaagagugaaacuccgucucaaaagcaaacaaacaaacaaaaaaccuugugugggugaaucaaacacgucugcaagccugauucagccuguagcccaccaguuugcagccuuuguuuagauccguaguggagaaagagguuaaagcuacaaguuaggaccccugaaaaugaaagaugguuuggaagugaaucugaaguaaauugucacuguaugguuucagaccguuuucugguaguaugugcugugugacacagguugucccuguguugugcagugguuuugagcacaacauuggcccuaggccugcaguguggggugcaggcccucugcugagggcugcagaugcugccgggagugcaguggaugagguccugcccgcacagccucauucggcguugauacccaugccuggaggaugugggcucaucuucuugggucaggugagccucuuacaccuguguucauugcuuagcucuuuugaugucauugcauauugguucaauuacuuuucccuuuucagagccaugaauaauaacuaugauuuugcuagagggaaaaaaugaaaugaucaagguaaugcauuuacauguuacauaaaauucauaucauacagaaaggcagaaggaaaacagggagaauuacuuguucccuuuucucucuuccccucccaauuccuuuaacaggaagaaugucucacuagucaugugaucuacagcaaauccuuuaaccucuucaaacccgcaucucuuauauguuacaggacaguaauaaaacuuaacucauauuauuguuauuuuuuauuuaauguggauuaaguuaguugguaugaaauucuccaaauccuaugcauauauaaagggugcucauagagcuuuuuucuucuuuuuuguauauccaggauuucuuuagcggucuuuuguaauuauaguaaaagcacugagguuagauuuauggguuuuuuuugaggaggauagacugaaucccuuucccgccucaaggcuauagugggucggcacaguuuguguuugcuaaacauaucuuuagcugcguaagagaaagaaggaaaauaguaaagaugaacaguacuguuuucuacuugaaguucuaguuggcccccacucccuuccauguaggaaccuuagcuugcuuuccacacccucccaccacuggacucacaaaggccccugaugagugccuccgguaagacagggggaaauuuuuaucuuaauuagaaaaaggcuuaguaucuugauuguauguucucuggagccagugauagagauaguauaagaaauucuggacauucaaauguaaaacagauuaauuuguaggaauguuggauuuuuaucuggacagauguuuugucuuuuauggaguugguugggauuaagaagugggggcagggucauguugguauuuuauuuuugcuuugggcuuauguuacuuaggauuaacuuuagcuguguauaacaacagcaacaaaucagauuuauagucaguuaacggaggcuuaagugauguaaaguuuuauuucucucucacauagaaauuaguuagagguaguaguuuagggcucuuagaggccccaggcugucauauucuaccugcuuacacauggcuuucaggaucuaggucaccucacaguccaugauggcugcuggggcuccaucccccuugucugagucauauguuggcagaaggaggaaaggcacagaucaagaggaggccuuucagcugggcgcggugggucaccugaggucaggaguucgagaccagccuggccagcauggcgaaacaccaucucuacuagaaauacaaaauuuagccgggcaugguggugugugccuguaaucccagcuacuaggggagcugaggcaggaggaucgcuugaaccugggagguggagguugcagugagccgagauugugccacugcacugcagccugggcaacagagcgagacucugucucaaaaauaaauaaauaaauaaauaaaauaauaaagaggaggccuuuccugcugcaucagcucucucugagcagcguuccugggaaguuccauggaacacuucugcuuaucucauuggucauaacucagucagaugcacacacugagcugcaagggaggcugagaaguauagucucuuagucccagauacaauauguauaaaauucagaacaaggguccuuuuacuaaggaggaggaagagacuggauguuauggauaugggcagcaagcaguguuuucaaaguacugaaacagauuguagaacuuuguaaacuggcugccuuucuacuccucugcucaccucuaaccaaagagccaccuaauuguucugcauggugaccauugccuguuagauucuuggugaauagauuccuagccucaucuuuuguuauuuuuauuuuuuuaauaaaugguagaaugaggaugcaggaaacuuggaaaagcagagucaaaguucaacuagcacaggagcagaagguaaauucuguuggcuuauagaaugagcccagacccuggugucagaagaccugggucaguucuggucuguccucuccugggacucaguaaagucucuuggcucucugagcuuuccacaucaguaagauggggaaugacaacccuuaugggacugcagugaggcuuagccaaguuggugcuguggaaggcccuacuggauuccaaagcaugauacagaugaugaauacuuuauguggcugaggugcuuccagcaggcacgugggaagcauccauguaagauuggggucaugcaaaauggggugggaucacaucgcgggaugaagcacuuggaugcaaaggccugugugguccagccugagucuggcucaacacacagggucggauccuggcugcgcuccuuacugcuguauguacagauuuggcucagagggaaugcaggauuggcaacaugcaucuagucuuucuuguggucuccuggugccucucauggugugcuuauucuuauucugcuacggagagugugacuuaagcauguaauuugcauauagcguggcuccugaaugcaagccacuaacccauuauuuuacuuaguaaguuccaguguuggggcuugggggaugguguguccuuugccagugaaugcuuauguugguacauuucaaggguuauuuugcuuaugcacccuccccacccccgucaacguuagagcuuagcaucauaugaaaggcagugucccugugacuguaucauaggguugaugaggaugaaaugaaguaacugcaggcaguguccagcccagugcccagugcucuguccaggcucagugagugaccuuugcugcugcugcugcuacugcguccagcuggcuacauggggcugguggcagagggugacucaguucucagugugucuuuuccugcccccugccagguugcuuccccuagccuaguucccuuuuuuugugaaaugcucaucccucagcucuggacuucaauguacuguugguuucaaaaccuuaugaaacacaacaucaaugggggaagggagaagagagaagcugagaagccuaacccaacucugacagcugagcggcuacagaggacuucucaguugggcuucaauacuucuuaagaacuuucaaguuaggccucagaugugauuuuguuugcugacuuucucuuugcuaccuuggcuucuauuuaguuaacaaaucuaggccgggugcgguggcucacgccuauaaucccagcacuuugggagguggaggcagagguggguggaucgccugaggucaggaguucaagaccagccugaccaacaaggagaaaccccaucucuacuaaaaauacagaauuagucgggcgugguggcacaugccuguaaucccagcuacucgggaggcugaagcaggagaauugcuugaaucugggaggcggagguugcagugagccaagaucaugccauugcacuccauccugggcaacaagagcaaaacuccaucucaaaaaacaaaacaaaaacaacaaaaaaccccaaaucuaauucauucauucagcgugcacaauuuauucaacacaguuuguuccaaacacuggggauaugccccaaacagaccaaguucccuguuucauggagcuuacguuugguggaagagagacaaauauagaaacaaaaguguaggcugggugcaguggcucacgccuguaaucuuagcacuuugggaagccgagguggggagaucacuugagcccagaaguucaagaucggcuugggcaacauagugagacuccgucucuauuaaaaaaaaaaaaacaagucuaacaucagguagacuucagggcugugaaagaagugacauaggguaagggaauacagcguguugaggggaugggugcuauuuuccaaggaaagccccuccugguggggggccauaggaaacagcuggugcaaaggccuggaagacucacuggcaucuuucuggaauagcaaggaucagcuuggugggaaguggaaugagcuggggguggaguggggugggguggauuuuggagucugagcuugagauaccugcuuggagaugcugagcagucugcaggaaccaggagcccggagcugagggaggacaugaaggcuggaauuguaaguuugagagaaaucagcuuuuugaagcugugggacgggguaagaucaccgucaugugagaggaugggacuggccagguggugcauguguccaggcucagcggauguuccugggauacaaguaccuguucaucuuguugacaucuaaucuguaucugcgcauagugaccaaggauaagccacugagcugcuccaaacgugugcuaugggauggauuaacuguguggguguggaaaucccucagaaugaugagacagggagcaguggagaggaagacagucgaucauugaucggugagccuguacuugagaucuggccuggauaguugugaugguaggugguacccacaaugauggcccuucaggggauuugaagauugugaaggaggaccaagaggagcuguuuggaccaccugugauccaaggcgggaacuaggaagacaccuaccggaagucuuuguggaucuuuugggauuggauuggauuagcagauacagagcguuugaccuauaguaaccagcugacuguucagcaaacgcuucacuuccuaaaaggcuucuucuuuccaaggcaaacuggggcaugugaggaacaggaacuuacaagagcuucuagucugaacuccaggugcugacacuguuaacaguugcugaguggaguccuucucacuuggguggaaaguaaccuguaaacuuggcccaagucucccuuuuccuguccuuuggcccaugcuguucuggugcuagauguuggcucuggccuuugcacugaccaucuccucgagauggcacguggggaggaugugcuguguugagaagaacuuggcuggauaggcaaagacuugagcuagaaaaagaacaagugguuauucauuuggugcuucccuuuaaccagggccuuuuuuuuucuuuuauuuuaaaggaaaccuuuaagaaaggagggcucucaggccuuucuuagaauuuaggucucaguuuuacaucaugggauucuguuuuucuuggguuuccauuagaagauuaaauaacauaguggcuaugaaagcauacuauagauacuaggaacuguugcuuugauuguguuaaaggauaccucuauuccccagguccuuuauugauucaucuuauuuuuauuuguauaauaaaucauuagaauagugccuggugcucuauugcacucacuugcauauacuguauaaagcuuuguacauauuacuuguuuaguccucacagcagcccuaggagguagguacuauuauuuugcucauuuugcaggcaagaaaacaggcacagacaguuaaauaaggucacccaacuaacaagcaguagagcuaggauuugaacugggggagccuggcuccauguucuagguucuucaccauuauacuccaaggccugucgguuuucccaucaaucucuacugaagaacaauggcgauggccauacugguaauuguugugcuuuauaugcugugcacuguguuguguauuucagaugcacgaaugagaaucuucauccccgcaagauauuaagagcccguuuuacagaggaggaaaugaaggcucagagaauugaguaacuugcuugaaguccaaagcugaggaguggagccagaauucaaacucgaguuugucuggcuuccgaauccugcuauuuccucagcacaguggccguccuccaaggcugucacauguuccuucccuggugauucacggcaccuggcuaccuccuuuuagacucacuuuguggcccauggcacccaguugugucaugacaggacaguggcucccauuucuccgggccugacugugaggccacaugagccaccccagggaggccagcagagucagagcuuggcuuugaaagcuguuaaucgaccugagccccuccaugucccuugcuccauuuuaagccuagggcuuuccuaaagcaccgcagaucuccuuuucuugugagaagagauuaggcagauguauacauacacgguaaugugcaagugucuaguuucuugucagcaucgggaugagcuguuuguagugaagagccugggccuggugagcccccgggaugauggguggggaccaucugugcucuccuggaaaggaaauugugguuucuuucuuuucuuuuuucuuucuucuucuuuuuuuuuuuuuuuuuuuuuuuuuuuaguuuaugggaaagggagacuugugucucaauugagucuuuguggcguuguauuacagagagucacagaaaauguucuauguaaaugacuaugugcucugauuagagccucaaugggcaccauugugucauauugcuauuauuggcgauugcaggauacuaaaugauauucucaucaggcugaaaaacuucaguguuagcagugaaacucgggguuaauuauacugcucugaauuagagcauggaauuaaguuguagggagaguaagccuauugcuuucuucccccucugucuuccucuucaagauucuugcuggggguuugaucagaauaguuuuuaacccauguucuauaucuguacuacuggcauuuuguucuccaugaguuacuaccccauuugggguugggaaacacaggaccaauuuauaggacagugggagaaggggagacauggucuacuuaauagugcauucuucucagucaauagcuggguaaaaaauagcaugaagauugaagucuuaggggaaugcuggacucucuagaggggccucuuuaauuuagcucuugucucuucugccuuugaauucucaucucuucugauccugacucaccucuuugaagaaaugacacacugaccuacaucuuggcugaaacagauagaagagucuaucucuguucugccccuucuuggcauucccagcacagccuccaagggagucugucccagagcugaggcaggcccucucggguugcaugccauugacuucucagcuuuguuuuaacugcagaguuuccagugcucugcucuucuugaauugcuccugauugucaccuucuugcauuccuuucucucauuucuuuuucuguaaauuucaugucacugguaucagguuuaaagucguauuuuuuaaaucccuuucaauguuacguggguuguaaauguaauuguuaauauuauuuaaaaauuuuugaaaagugauuuuuagugguggccuuaucauaucuacauauuauuacuccaccauuuugggauguuuaggucgaauccugguuuuuucuucuuuugcuguuguaagucauguauauuggcaauuagccuaggagagauuccuagaaaugaguucacugagaauaugagcuuaagagaaagugaggauuuaaagccagaucugucugccuucaaauccagcgcucuuuauacugaugugaguucuccugucuuuuuuaccuaucagaauucuagaacucucccagagaaaccaggcagauacugcuccacaccggugagcugcuucucaccuggguagucuagggugguuugcuccagaauuguauuucugcuuuuucuuuuuuuaacuuggcagugguuaaccauucccuggagcagcaccagguaagucagcuuguaucagagucaucugcuuuaccugacaugagcacacguugucauauauuugcacaugcagauaucauauguuaaacaauaucacauuguugaagaaaauuacacuggaaagcguaaaauauaguuuggaugccauauugaguguaacuuaauccacccgauucagaacuuuuguagagugccucggaguuccuauuuggaaauaucaguuagcaguuuuagucaguagaguaacauauuuucuauauuuaugauauaucaaagagacuuucugaagcagaacccugauugacucaagagucuuuuccaaauucuguauucucucagaaccaggauuuaauaggagguggguggggggugguccuuggucaaacuggggaaaagccucauaaugagauugccaaagcgcuuacagcauuugaaggcucagagagaugccguggucaggaagcuuguuugagucugucuggaagccaguaagucccacagaauaccuacugauaauccuguggaauaagcagcauauggaauguugcugagcuagaauuaaaguccacacacggccaggcgcgguggcucacgcuuguaaucccagcauuuugggaggccgaggugggcggaucacuugaguccaggaguucgagaccagccuggccaacauggugaaaccucaucucuaauaaaaauacauaaaauuaggugggcguggugaugggcaucuguaaucccagcuacucaggaggcugaggcaggagaaucgcuugaacccaggaggcagagguugcagugagccaggauugugccauugcacuccagccugggcaacaagagcaaaacucugccucaaaaaaaaagaaaaaaauauauuccacacaccuaguuuuucagcccuauacaggcugaccccauaccugccaucuccuuuucacuuccuguucuuucuggccuccgugaguccacgugugcccuugucucugcuugcugugccuuucucuuuccuccacguugcuaaauuccguccauuuuucaaggcucaguucagaucauccuucuuugcuuuaucauuuuacauacuguguaugguuuggccucuuggucugcugcucucugugucuguuguauggagcgcuuuucuaucugguauuacgguuauuugugugcaugucuuuugauucaucuacuugaagacaagagcuggucuugggcugccauuccugcaguguaggcucucacauugccuugcacguaguaagugcucaguaaaugcuuggugaacaaguguucauggcguaacuuaauacuuccaguggugagaguuccugucaagaguguuggcagugaaguuguuccccuuggcaauuucuaugcugaucucggguuacugcaugagacacagaaucugcguuucccucccuucagcaucacuggggaggacagccuuacuuuggaguuuuuuuucugaucaguuacaugaugguuucaucuuuaagacuacugauaacaggcagcucugccuauggaguagccauucuuuuuuuuuugagauggagucucgcucugucacccaggcuggagugcaguggcaugaucucagcucacugcaaccuccgccucccggauucaagugaaucuucugccucagcuuccugaguagcugggucuacaggcgcacgccaccaugccuggcuaauuuuuguauuuuuaguagagacgggguuucaccauauuagccaggcuguucuugaacuccugaccucgugauccacccaccuuggccucccaaagugcugggauuacagacauaagccauggugcccgguggaguagccauucuuuaucccuuuacuuuccuaauaaacuugcuaucacuuuacucuaaaaaaaaaaaaaaaaagacugaccagguguggugacucaugccuguaaucccagcacuuugggaggcugaggcaaguggaucacuugaggucaggaguucgagaccagccuggccaacauggugaaacccccgucucuacuaaaaauacaaaaauuagcugggugugguggcgggugccuguagucccagcuacuugggaggcugaggcaggagaaucaccugaaccugggaggcagagguugcagugagcugagaucauaccacugcacuccagccugggugacagagcgagagucugucucaaaaaaaaaaaaaaaagaaaaagacuauugguaacaacccucauuuuuuugagcacuugcuaugcugcuaacugcuuuaugcacacuauuucuuuaauccuuaacacuauuucuuuaauccuuauaucuacccaugagauaggguuuuguuauucaggcaguggcaaaaccugcggcuuagagagguuaaaaaaaaaaaacaacaaacugccucaaacaaagucauauaguaaauggcagugcuggagauuaaauuuaggucugucuuguucugcaguccauauaccauauaacuuugccaaauacaacacuaugguguguguguguguguguguguguguguguguguguguaugcacauguguggccuuuauugaacacugugguguguguguaugcacguguguggccuuuauugacuuauugaauugauccugaaucuucccuacuccuuuccugucucuuuucucuuucugaauaacaucauuucuuuuucucuacuggacauggucucuguggguuucaccccucaccccucuuauuuuugaaguuuuauugaggcacugguugaggcuuuagggcucccacuguuaaguuugacaguaauagguaaguguccccccagucucccuuuugcccuuucuuuuuuuuuuuuugagacagaguuuugcuauugucauccaggcuggggugcaguagugugaucuuggcucacugcagccuccgcuucccggguucaagcgauucuucugccucagccuccccauuagcugggaauacaggcgcacaccaccaugcccagcuaauuuuugcauuuuuauuagagacgugguuucaccauguugggcaggcuggucuugaacuccugaccucaagugaucugcccgcugcagcuucccagagugcugggauaacaggcgugagccacaccgccuggccgcuuuugccuuuucuugacauugccaaugcauccuguccccgagcgucucugaguuuuaagucucagauuuguuuucuuuggagacaaacugcagguagguguuacuucucaccgaaguucccagauagcacaggcuuugcuaaacaacacagcaccaggaacuccaucauagagaccgcaggaugcugugugcgcgcacaugcgugugcaccuagugagauguaaacauuuaccuggaguaaaagaaauucuuuccccagagcccaaauuuggcuagucuccuuauguacacagcuuugacagggauuccauauguuuugcucaucuuugcuuuuuugcagccuccacaaauuuauuuuccguaccacugccacuaaacagaguuguuucuaaagugcagaucugguugugccauuccaccgucaaaaauuauuuuuuggcuccuuguugccuucagggugauaggacaggugacugcucaccucuccagcuucucuuacuuucuuucuucuucuucuucuucuuuuuuuuuuuuuuuugagacggagucuuuccaggcuggagugcgauggugcagucucggcuuacugcaaccuccgccuccuggguucaagcaauucugcugccucagccuccuaaguagcugggauuacaggcaccugucaccaugcccggcuaauuuuuguaauuuuaguagagauggaauuucaccauauuggccaggccggucucaaacucuugaccucaagugaucugcccgccucggccucccaaaauguugagauuacaggcgugagccaccaugccccucuuacauucuuuucuucuguucacuacagccguggagagcuccggguuguccugcacaugugcacugcccucucuuuuauggaccuuuuaggcuggcugcacccuccgucugugucacccuccugcuccuccuccaccuggcuaguuccuguuggccacuuuuggaaauucaugccaguccaguccacccugaguacauccucuuucugugucacugagcucacuaugcuggguuuuaucuaugucucccucgcaacuagaucauucacgucuugaaguuaggcaucaugcguucuucauuucuguaccucccaacucaaugcuuagcacccagcaggggcucaagacuguguguggaaugaaggauucgugugaaaaugcagggagauggaaggcugagcguuucuguuccuugaccauucccggguuugacuaauaacucucauacacacugcuacucauugaaggccuacugugugcaugcauuccaugugugcuauacaguuuauuuauuguuaacccacguagaauucccagacacauagcguuacuacaaacuucaucacaaaaauaaagaaaccagggcccuguuucucuuuguuucucagaugagaagucucaccagaguugacuguggcuucugagcauuaugaggcacauguaggauuuaaagcugaaaggcuuuaucccugagacucagggaaauaugacaaucuuuuauuuuguuuuaauuaauauuuuuugagucagcgucuugcuuugucacccaggcuggagugcaguggugcaaucauggcucgcugcagccucaaccuccuggguucuagcgauccucccaccuuagccuccugaguagaugggaccacaggcacgugccaccaugccuggcuaauuuuuguacuuuuuguagagaugggguuuugcuguggucucaaauuccugagcucaagcaauuggccugacucagccucccaaaguguugggauuacagguaugagcuaccgcacccagccugacaauuuuuuaaacagaauuuuaggugcuugggcccuggaagguucccaguuguccaacucuugagguggggggugggugggggguggagagagagagagagaggaaggcuuuuccuucucaaauaguuugcauuuacacgaaggccacgguguacuuguuuauugaaucaauaaagauacaaucucuuugaauaguucagaaucugauaucccuguuagacugaguucaccuuuugugaaggacacaggacugcuggauaggguguugcagcaaugaggaguuauguuauaaggggucucuucagugucuuuuuggucauaugaauuuuauuugcccaguagaacaugacugaugaggcucugaauagucaaagaaaacaucucucuuauguucugcucaugaauagaacacucuguguccugaauuguugcuccacuggggccagcacgugguguauuuuucuaauguuugaaccaaugggcuuuuucauuuuggggcaaucaagguaaagauuuucuggugcuccugugugacagggaaagcaugucuuguauuuucucucucuuucccuucugucuuuugaguuuggaaaauuauauuuugaguuacaugacuaauuacaugaguaauuuuagcaaauuuacuagaaauugauguucugccaaugauuggaaaucccuuccuccccuccacucuucuaaaccaaaacagugcuguguccugaagcuagaggggugaguauucaguauuggaguacagcgguuuagaacauuggagacauuuacaaggauaaaucuauggcccuggguucugacuuucuuuugccuguguguguguguaggggugugugugugugugugugugugugugagagagagagagagagaaagagaguaagagagagcgagcuggguuuggggcugggaaggaagaaugauugauuaggaagcuguugugcagaguagaacaggacuuccugaaauguaagacccaaagaaacauagauagccauauuuuccaguccuggaaucagacucaagucugauaaaagguuuucuuuugauuugugauucugauaauaugaaaagucuuacaaaaguauagaauuguagcugguaggcugcuuuaugagaaagaaaauaaacucccacagagugggcauugaccugggagaucuggagccuggugcaagugcagaccaugguuuucacaaucuuugaucacuuuccuuuuguguugaacuuucucuuuuagcuccauauuuauaaauggggucauauuuagccagauauuuuauuuuuauuuuuauuuuuaaagagaggcaggaucuugcuguguugcccaggcuggagugcagugccaugaucauagcucacugcagcuucgaacagggcacaagccauccucccauuucagcuuccugaguagcugggauuacaggcaggagccacauuuccuggcuucuaguuggguuuuuuuguuucuggaagaacagaaccauacuccucaggccaggaagaccuagguagagcaagaccagcaaccucuuggcuagagggcugugggagcugagcaucagugagugaggggaaagcagugguuuuuugucuugagaagaaguucagcgcucaguuaaccagaacaagugccaccuguauaagacagcagacggucaaagcagaagagggaaggaaaugguugaauaauucuuuuuuuccuuuuguuccuucucugcccugagucucccccacccccaaagagauaucucaaaaugucaagguccagugaaauggacggugggauccuugaggaggggucuguggggugggggucucugaaggggcuaagccauggugggcuaauggcucuguuuaccgagugcaugcccuaugccuggcauugugcuucuuucucgaaaccauccuacagguggaggaagcggggguuuaaagggagccagcagccagcgacucucuaucuuacagcuucuaauuggcuuugaaaccacacaggcugcugcuggaggaaccuuugacauccucagugugcagcccucuccccucccucugaagggaggcauacuccuucacuguugcuuugacacucuaggauguuccaaaacuagguggucagcuuacucagaaggcucugggcauuuuuccuccugcaggagggacugcgcacaugcgaaagacaugaggaagcucugaugcucagggcugugggggcuuuggccuuggcccgcacagccuucucugguauagugaggucuccuuuuggguuuuucacuuguguuuguuuugaggcguaugugcuucauaugguugaacucauuccucgcccagcuggacauagaguugacugccucagugggucccaccucgggggugggaaauguaaccucaugagggccacuguaugguugggcagauucacagcugcucugaggucaggccuggcagguggcgagggccuaagaggaauuggaucacccuggaaccuagcuggggcuaggaugguuguugcaugugauuuucagcaggacucuaagggaucuccaaagcugguuggcuggcuagcgagguugggcgagggaauaacucauuugcuuaacuuuucauauguaacaacuggguuuuggguuucacaagagacaagguaggcaggcaggcucaggugguucuguauaccccauuucauacaugagaaaauggagacuuguuucagaucguaagguaguuggaccgcagcuacucuuccaagacugguauucguuccucuacucuguuaaagccagagagaggaugcaggccaagucaagugaccaaagcuaaaggggaaggaagggcuggcuggacuuagcagugaccacagacagaguugaagccuucacgguuggcguuggccuuguucacugcugugugccaagcugcugacagcaucuggcuaucgcagguucguaauaaguguuugcugagugaaugaaagaauauugguguuggggaugaucucuuuuucacuugcucagcaccuuccagaauuuuguucuucucuuugccacucccuuuuuucuccucccuggguaacaccucuuauugcaggaguaggaucagguuuugaguagcaccuuugggguacccauucaguuccucuuuucccccguaauuaugggauuugggauugcccuuugggagaauuagguaacuuuagguucuguauguuaauuugaggccuggauuuugaacuuccuucugaugcagauagaccuuggaagggaguccuuacuuagaaccucuuuauuuuaucuccucacugggagaguagaucccagacagguuuugggaaccaccugguguccccaagcgagcagaggcagaguugggcuugaaucuccuccuucauugcagugcuuucucugcccugaucccauugggugacccuggacuaugaauauggauuaugagugggcccugagagugaucagagacauccuucaagauugaagcugcuuugguuccugccacauggaacugagugggagaaugucucaauucaggauggugggagugucucuuuguccaaguaauaaauggaaaccguuugcucccgacuuuugcagauaucaagggcuugucuuuccagaguuugguuuucuucccuucucuccgccucccuuuucucugcccgccugugguuuugagccccucauggcuaucugggcagugauggguggaagggagcuggugcaguauucgaguagagaaguucugcugcagugaguguggggcaaguuucccagacccuuguugggucagggcaggugguuguggcccaguuguuuggccuucugcaggcugcaccccugcccugcugccugccaguggggugagggccuggccaccugguacuuaacaaguuugguucuacauguguucccgugaguggaggacaaaaugaaaauaccuccugaucguguucaaccauuaguugaacaaccauuugaaaugguuauugcaaccauuucagaguuuucuucuguuugugaugucaucugugccuuauaaggggugacuugcuaccuuauggagcaccuagguugaggcccggguugagcacaguuccauacguuagcucauuuauuuauuuugagacaggaucucacuucuguggcccaggguggagugcaguggugcaaucacagaucacuguagccuugacuucccaggcucaggugauucucccaccugagccucccgaguagcugggacuacagcuguguaccacuaugucuggcuaauuuuuuguauuuuuaguagagaugggguuuugccauguugcccaugcuggucuugaacucccggccucaagagauccucuugucuccaaaucgcuucgcagaagugcugggauuacagguaugagccaccaugcccagccaaguuaguucauuuaaucuucacagugguacaaugggcuaauaucucugucuuauagguaaggaaauggagacuaagagcucuuugccaaggguugcugucauccauuuauucaucaacagguaguuauuagguaucuacucugugcugggcccuggccugaacuuggcuuugguggaugagacugacaaguucucuguucucacagagcugagagucuggggauaaagaucccuuauuaugguuucuuuugugguguuguggggagagggugaugauuaggguuuggguacuggagagagaauuaggauuuuagcucauuuuacucaaaugcuuuauauugcaccauguuacuacauuuuccccugugcuuccccccuacccuauguggauuauuacaguuuacuuguguguaaacuuaggcucagagaggcuggguaacuuaucccagcuugcacaaaagaggaccugaauuugagcagaccguagguugaauucuguccuucuaugcugccuuucuaugaauaauauguuuacauauauauauauauauauauauauuuuuuuuuuuuuuuuuuuuugagauagagucuuguucugucacccaggcuggagcgcaauggugugaucucagcucacugcaaccucugccuccuggguuuaagugauucucuugccucagccuccugaguagcugggauuacaggugcgcaccaccacgccuggcuaauuuuuguauuuuuacuagagaugggguuucaccauguuggccaggcuggucuugaacuccugaccucaggugauccaccugccucggccucccaaagcacugggauuacaggcaugagccacagugccaggccuuacauaaaaauuguuuaaaaagcaguuugcagaagaauuaucaauccuuuuguuaacauuuuggugaacucuugaacacauuuuuuaaaaaguugagaguugcuaacaaguaaagugaaguccugugccuguuguaauuuggacugaggagugugaguugucuuggucuaaaggucagagugagggucucugccugcugcaggggucucccgguuaggguuagggugaaaagcuuuuuaaaauaaaccucucaaauuuguugucaacauuaaccuaugguaauuuuuuuuuuuuuucuuuuuuuugagacagggucuuacucuguugcccaggcuggagugcaguggugggaucucagcucacugcaaccucugccucccgguucaagcgaucuuccugccucagccccccaaguagcugggacgacaggcgcgugccaccaugccuggcuaauuuuugcacuuuuuugguagagacaggguuuugccaugucacccaggcuaaucucugguaauuuuuaaacucugcucaaaguuuuagaaaacauaagucuggaaauuccaaguugagccacuggugacuugugagcaugaguauggcaugggauugggggugggguggggcugacguggccuggggcagaugccgggugguucuguuuggaaacagaaguuccacugcacaugcagccuucacgucuugugggggcuuuugugggggcuguguacuucccaguuugguuauuaguaacuuuauuugguucuggucauuaacggcuuuugggggcguuuugggggccuguuugaggccccugaacaugcauuuuucaguugucguuguccauguuauuaaaaggauauguuggaggggguugcaguuuagucugcugcuguuucgaauccuuuucuuugauaguguuugccuuccucccaccaaaugcugcacugagagucucugguaccugggucccuccuucccuugccuuugcuugggaggucagugccuucauccaggacaucuuugggcauacagguaaucccaagcagcucugcucaguuguugauaccccuucucacagaaccugaucugccucagcucuccuugccuccuaaguggcagugccccgcugcugggaagacuccucucucugcuggaugcuucuucaggccugcugcugcacagcuuacggccaugaugacugcugcagugcagaaggcauuucaguuggcuguuuguuuuucaugcauuuuguguuuguagugugcuggccacgggagcacucuaaacacauuaugggccgggcgcaguggcuccggccuguaaucucagcacuuugggaggcugaggcgggcagaucacuugagcccaggaguucgacaccagccuggccaacacggcgaaaccccgucucuacuaaaaauacaaaaauuaaccgggugugauggcgcgugccuguauucccagcuacuagggaggcugaggcaggagaaucuccugaaccugggaggcagggacugcagugagccaagauugugccacugcacuccagccugggugacagagcgagacuccaucucaagaauaaaaauaaaaacaaaaauaaacauaaaaauaaacacuuuauguacacaaucucacaucacuuucacagucuuggaaggcagauauuucuguuauccucauuuuacagcugacgccuaucuaaggcuuguauaaaagucagucacuguccaggcucacacagccaaugcuggagggcuguguggcacccagagagcacaguugcugcuuggaauaaaccuucacuuauaguccggagcagggugguucuaaagcucccuuagcuuucccacuaguaagcuuccagguucugguacaguuucucagccucggcacuacugacguuuggagucugaugagucuuuguugugagcgcuguccugugcauugcaggauguuaggagcauacuuggccucuauccacuagaugccaguagcaccccccucccaacucugcccaguugugacagccaaaaugucugcagacauugccagauguccccugggggacaaaaucuugccuaauugagaaccaccgagucauggcaaccauuucaaacccuaagccaggauguacguggagauggagaaagguacaacauuuagaauugguacuguuggcugggcacgguggcucacaccuguaaucccagcacuuugggaggccaagacgggcagaucaccugaggucaggaguucgagaccagccuggccaaugcggugaaaccccgucucuacuaaaacaaaacaaaacaaaacaaaacaaaacaaaacaaaacaaaacaaaacaagucgggugugguggcgcacuuuuguaauuccauguacucgggaggcugaggcaggagaaucgcuugaaccugggagguggagauugcagugagccgagaucgcgccauugcacuccagccugggcgacaauagugaaacucugucucaaaaaaaaaaaaaaaaaaaagaauugguacuaucuuagaaaaccuggagcacccugcugcuuuaacugcagcccucugugugggcagacagauugacagugggcuuaaugugggguaaccuuucaucaugaaaauuaaauuacacugcaggccuuuuguagcccuccuauaugaaacccucuuaaaauauuuucuuuuugcaauggaagcuugggggaaaaaucauagucuuagauuuauugaaguuuuguggauaaaagcacuuuuuauuaaaaagaaccaggugaaaacuagaagggccucuuuugagucugcugacagacacguggagaauauauagucagcggaacauuccugugcuuuccguaaagcuguggaugaaccugccuuucagguuucguagccucuucagucagaugguuugagaaugcguguuuugugguguaugcacacagacuguaugaguuuguuuuuuuacacaugacuaguaaaccugucacauuuugucaaaugugauuuucuuucuuuauuaaaauagauuuuauuuuuagaguaguucuagguucacagcaaaauugagcagaaggugcagagauaucccauauaccccuggcccccacauaugcacggccucccccguuagcaacacccccaccagaguggaacaaucaaugaacguacauugacauaucacuaucacacaaaguccauaguuucuguuagaauucaugcauagcauucuacauucuguggguuuggacaagguaugaugacauguaacugugauuuccucaauucaauauguauaguuccuguucacacauuucuucacacauuuguuccucagugcucaaaugccugcuguauuccaggcuguauuugaagccccugagccuuuauuuggagaguucauugaacauuagagcaugcaguuugcugagaugucuuguacuuagaaaauccaauuuauaaaaaaccucaaauagaacaguaaauuuagggaauuuuuuuuuucugaugauaaaauuagauaacucuguugcauggauucuguaaaacacagcucccuccuguuacgccaugaauuggguucaauuuacaacaccccuuuaggcauacuuuuucagcaacacaugucugagccgaggugcacugugccucuuucuguagcaggcagcuuuuaggggguguccuaguggucuuauguuuuauacaucucaugggaguggcugguuucuaggaaauagcucacuugccaguuuugguaacccuaacagagcuguuuugccaaggcgucuggugaauauuucugucuuccagucaggacuaauauaguacuuuucagaggugauagccaguuaacugaugacuuuuuuuuuuuuuuuuuuuuuuuuuuuuugagauggaaucucgcucugccacccaggcuggagugcaaugaugcgaucuuggcuuacugcaaccucugccucccggauucaagcgauucuccugccuugccuccugaguagcugggauuacaggugcgcaccaccacgccuggcuaauuuuuguauuuuugguaaagucaggguuuugccaugcugcucaggcuggugucgaacuccugggcccaagugaucugcucaccucggccugccgaagugcuggcauuacaggcgugagccauugcaccuggccguguuuucuguuuuuuauuuagaggaagucacuugaucaugcuuuuccccccacccauggcauaggaaaaugauucuuuugcugauugugcugauuaaaugugauguggaaaaaccuacuccugguguucagagagguuuuccaggucacaguggggugggucucaucuggacaucagaaucauuauguuaaugauaacuaagagcaguugacugcuuacuauaagccagccacugaccucagggcauugcauaacuggcuuccuuuacucuucacaucagcccugugggcuugggagugagaccucuaccuaguuuuuaaacaaauuacauaaacuuuuuggggcucagcucccucaucugaaaaucagaaaaugauacuucucuggcauuuugagcaugaguucaggagucagacuuccuggguuugaauucuagcuucuucuaugacuuugagcaaauuacuuuaacuuugcuaagccucagguuucucguguugcauaggcagaugauagucauaucugaauguaacgagaaucaaaugcaaccugggacacagugaacacuuggugaacguuagugccuugguaacagugaugauagugacaauaaagaucgaugaugaugaugauggcgauggugcuuaacccaguaugaaggugaagugucuaagcuucuugagggcagaguuuugucuucuucugcacuuucuuucuagugucuagaauugccuguagguuuaccccuggaucccgucaggauggggcuaaauuuagaauuuuuggaaagaugugagcuagcccgucuacagugacauccagcucaguguguauguuuggucugugaacauaguagaggcaugauucaacugugaguuugugcugggagcauagauggaugcuuuucaggcucuugaaaugugcaagugugguucccuugcagcaggcauugccucucccucguuaaucaagaucuuuuccuugccaggacuucaggagauccuggacauccucuggagcccagggguggccucacccgcuccuugcuuuagccuggaaugcaggcccucaacauuccagccuuggguuagugccagagcugugaaagcagggcaggcauuuccaccuugcuugacaaaggcuuuugcucucugggugguugggggugccucugaagccaggcgagaccagagaucucauggguuuguguuucuucauugauacuuuuaaggggagcaacuuaaucagugggaaaccagaucucaaaggaugggacagauaaacgcaggguacagagaagagcuugggggagugucaagcuuauuugcccaaaagggcugacccuaccuuaccgccauuaauacauguccuucaugcaucccuggguaacagggaaguaguaccaaaaaucuuacagugcaauaaacacuuggcagaaauggagaaacuaguaauggcugagcagcugugcccucuccaccaccucacuaugcaguacgugggccaccagccgcuaggggccuggcagccacagagaugagggaagcaugcugaggacccugguguggaguuggaggggucauguccucugaaagguggccaccacucaucgccagcccuuacugucaugugagaauguggcucuguguuuccagauauuguuuuuuuuuuuccccuccaacagaagcaggaaauauaaaaaauuuauauaauauauauaaaauauauuauauauaaauauauaaauauauaaaaauaaauauauauuauauauauaaaaauauauaaauauauauaaaaauauauaaauauauuauauauaauauauuaaauauauuauauauaauauauuuauauaauauauauaauauauuauauaaauauauaaauauauaaaaauauauaaaauauauaaauauauaauauauauuauauauuaauauauuauauauuauauauaaauauauaaaaauauaauauauauaaaauauauauaaaaauauaugauauauaauauauauaaauauauauguauaaaauauauauuauauauuauauacuauauauuauauauaauauauaaaaaauauauauaaaauauauauauaacuucacggaaacucugaaggagaggucaaauauaauauuauauauuuuauauauauaauuuauauauauauaaaacuauauauauauauuuuugagagacagucuugcuguguugcccaggcuggagugcaguggugugaucuuggcucauugcaaccucugccucccagguucaagcgcuucuccugccucagccucccaagcagcugggauuacaggugugugccaccaugccuggauaauuuuuguacuuuuaguagaggcaggguuucaccauguuggccaggcuggugucgaacuccugaccucaugauccgcccaccuugaccucccaaagggcugggauuacaggcaugagccaccgugccuggccaggaaauuauauuuuuaugagaaauauucuguuguuuaaauucuggcaccucguucuuuuuuuuuuuuuuuuuuugagacgaaguuucacucuugucgcccagucuggagugcaguggcaugaucucagcucacugcagccucugccuucuagguucaaguaguucuccuggcucagccucccgaguagcugggauuacaggugccugccaccacgccuggcuaauuuuuguauauuuaguugagauggggguuucaccauguuggccaggcuggucuugaacaccugaccucaggugauuugcccgccuuggccucccaaagugcugggauuacaggcgugagccauggcgcccggcccuaguucacaaaauauauauggccaaacaaaacaugucuggggcuagacuuggacagggggccccauugugcaaccucuuauauagcaaauuagaguuuaccaggaaguuucugcccuucaggcccucugcucucacagaaacucuaugaaggagaggucaucuugucuauguuuguaagaagucacauugagagaaaugacaucuuagcuccucuuaugugccaaguaguuugucugcguuaucuucuuagauuggcuccaucucucaggugaggaaacagacuuggaaaggugaagugacuugcccaccuaguuagaagcacaucaucuucugauuccugucucauuucauuucaccgcuuguuugcccucucuguggucuugcccacggacuuguagucccugauguacgccaggccucucacaguguggcccccgggauucccuuuuaugaaaaaaaguugagcaugagcuguaaguuagaguagguuuuaauucuguccuaccacggagucuguuuuauaugagaacaaguuauuuaacuccucugaguguuaauuuccucauuuuuuuccuuucuuucuuuuuuuuuuuuuuaaagggccaguccccauucucacaggguguuuggaaggaguaacugaagggggguauauaaagccgcuggcagccaggcaugguggcucacgccuguaaucccagcacuuugggagccugaggcaggcagauugcuugagucuaggaguucaagaccagccugggcaaacauggugaaacccugucucuauaaaacaugcaaaaauuagccaggcauaguggugcaugcuuguaaucccagcuacuuggguggcuaaggugagaggauuacuugagccagggagguugagacugcaaugagcugugauugcgccacugcacuccaguuugggugaugcagugagaucccaucucuaaauaaaaaaaaaauaaauaaagccccuagcauggugccuggcacaugguaggcccucaaaagaugacccuccaaaguggccaggacucaccaugcauucagggaauauggauucuuuugguggcagcaggcugcauuuuugccuggcugaaugccugcaagcaugggaacuuuugaugcaacaguaauccuuggggucugaaaggccccaaaucucccgccagaucucugagguuaacauccagucaaccuuuugcuuuucauucuuggccucuuuccuccucaccuccaccagugugacagucauauccucucuauguuucugguaaguucuggccuugagggcuggucuuaugacugacaagugaagagcagugccacccucuacuccacauucucagaagcgucucuagguuccauacuuuaaggcaggcuagcuuccaaggcauacugacagacaucccugugcaguccugggggcacgagggucccauuccacccuggggcuucagggucaggugaggaagguagaucccugaaguuggguccagaaaaggccacugggcuagccugucucucguucuggucacugaccucaggauccagcaggacgcugcuagcuugcuuggcucagcucugcgagugcugggagcaauaagcagugcugaaaacgcgaugcauuucaacccaaagcacucugaucccuuuccaggcuuugggagaauguuuuuuccagcucgguuacuugcuggcaugcauaggucaauauacaagguguucucagagaagccggagcugaauguugacuuuugugcucccugggguguguucuggggaggaaguggguuuucagguuguggugcguguaggauguggucugggaugauuaguaucacacacuguggauaaaguuaacacgcauuguggagcuuuuuuccucuuuuguacuuuugggcgaaggugccucaaaagcagcuuuguuuaucaaggaggugcccuugauucuguaugcauuuuuaacaucugaauagaaguuagacgcacacauaauugcuuuacuugaugcaguaaauacguuucagccagauaauccauaagacccuaguucagauccugacuuugaucccucuuaguugugugagcucucaccaguuuacuugaccucacucucugagcgucagauuccugaguguaaaauagguacaaaaacucagauuguuguaagguuucagugaguuguugcguguaaagcauuuaguauacaguucuugucacaauguuuaguaauggcagcuauuaucuuaacuauuagagcggcaguuuggcguggcacuaauaaugaugauggugacaguuucacugagugcuuacuaccucagcuauucuuccaaguacuuugcaucacuuagcucauuuaacccucacaauaaagcgauaagguaggugcuguucuaaucucuguuuuacagaugcuaaaacucggcagccaggugugguggcucaugcccguaaucccagcacuuugggaggccgagguaggcggaucaucugaggucaggaguucgagacuagccuggccaaaauggugaaaccccgucucuacuaaaauacaaaagaauuagcuggguguaguggugcaugccuauaaucccagcuacucaggagacagaggcaggagaaucgcuugacuccgggaggaggagguugcagugagccgagauugugcuauagcacuccauucugggcgacaagagcgaaacucugucucaaaacaaaacaaaacaaaacucaggcacagagagguuaaguaacuugcccaagguaacccagcucauaaauaugaaaagagcagggacuuuagagucagaagaccuggguggcacgcuugcaugccguguccuggugguguggccuaccgcagagugacugacucugauugccuucccaacuguaaaauggugcuaaugauacagaccgccccccauugccugguguggugcgcggcugugagugcuuaauaauaggugcuuaggcaucauuugcuaauuaacugacuguguuagguuauuaggaaguuccagugggcuaauaaaagcucuggguaaacguuaguuguucuuuuaaauguccugaggugcuuaugauuggaguuuaaacagcacaccuguuuuucagauuucggaaccacuuaagagaggcacaguguaaagaagguggagaugagaauaucaccuuuacuccugauacagucuuggagaaugcagcuuaguuguggggcagcauuagcuuucugauaugaagcugagauuagguggauguaccaggccagucacgggcagccuuggguacccagaggccuucucacgugggucgaggcaggugguggaggugguggcagcgguagcccccauaauacuucuagguggaagaacagaccaccugagugagagaaaucacuccugagcccugggggagaacuguguggaggggcagaugggagccuggaguuuugagggaaaaaaaacuuuccuuuuggaagccagacguagggaagaagcauauugaucacaaugacuauuaaagaaagcuccccaacaccccagcaaaacacccacaaaacaagaaacuacuucugccaaugguucuagccaguuuucuucaccacaguucaugacugcuucauccuuuuaggugaucacacccaaaacuuuugggucuuccugccuuuuuuuuuuuuucuuuugagaccaagucuugcucugucacccaggcuggagugcaauggcacgaucucggcucgcugcagccuccgccucccggguucaagugauucuccugccucagccucccgaguagcugggauuacaggcaugugccaccaugccuggcuaauuuuuguauuuuuaguagagauaggcuuucaccauguugaccaggcuggucuucaacuacuggccucaagugacccaccugccucugacucccaaagugcuaggauuacaggcaugagcuaccacacccagccuuuuuuuaaaacaaaaccaaaaccaaaagagacagggucucuggugugcaguggugugaucauagcucacugcaccuugaccucuugggcucaagcaauccuccugccuccaccuccugaauagcugggacuacagauguguaccaucacacucaucuaauuaaaacaauuuuuuuuuugguagagaugggaucucgcuauguugcccagguuggucuugagaacuccuggccucaagcgauccuccugccuuggccugcuaaagugcuaggauuacgggugugagccacuuuacccagccuugggucuuccuugacuccugacucucaaaccucauauucaguccaucugccagucuguggguucaaucuucaaagcaaacccagaaccuuacuacuucucaccucuccccagccaccgcucugguccaagccaccaucgucucucaccuggauuagugcggggcucucuuccuggucuccccacuucugcccuugucccucuucagucuauuucuaugaggccaccagaauuaucuuuuuuaaaaacugaagucagaucauguugcuccucugcucaaagccccgcagugauucccuggcacgccgaggggaaaaggcaagauccucccaaaggccuguacgaucugcccccggcagcucccuggccucuucauuuugugccuccucugcccccucugcagagccacacuggcccugguaguuucuagaacacgucacguucaugccugccucugggcuuugcaugggccuucuucccaggcacaacguggggcucuccccacuucuuccacccuacagagaggccggcccugaucagcuguuuuauaauagcuccucccgaucaguacuccugaucgcucccuacugugcugugccuuuuuuuuuuuuuuuuuuuuuuuuuugaggcagagucucacucuguccauugcccaggcuguagagcaauggcgugaucucagcucacugcaaccucugccucccggguucaagcaauucuccugccucagccucccgaguagcuagaacacaggugcccgccaccacauccggcuaauuuuuuguauuuuuaguagaggugggguuucaucauguuggccaggcuggucuggaacuccugaccucaggugauccaccugccuuggccucccaaagugcugggauuacaggcgugagccacugcgccuggcugcucugcuuuuuacccauagcucuggcucuaauauaugacacugccccucccugaauuagaauggaggcuacagggggaugcuggucuguuaguugacugaugcaucuucagcacuuaagacagugucuggcacagaguaggaacagaauaugguccuguaacaaauacugaagguugugcucugugcaccugggauagagcaggagcaagacacaucauuccugcccucacaggguuauggucuccuaggugacaagguagugcacacuuccauaggucuuacucugggacaaguacugugccaaaugcuuccucccagccgccugaugagguagcuacuguuaguuaucaagucugauuuacaggugaggcaaagaaaggauaaguaauugacccaaggucacaccuagcagguggugaagcugagccaugggucuuggcuucaagaaucugugcucuuacccaccauaccugcugcugccggauucaaacccgaauugcauuaaggaaucaucauaaccuguuugauugaagcuauaagggaacuuugagcauggugaauggggcgcucuauggaaaagggguucugggaagccucuguggaagggagguuuuguuaagugaacuccccugguaaacggagugauuggcccccaauuagcuugcuguucggauuaacuguaauacaucacacuuucgaaagugaagauaugccuauuuuuuccccucuaggucuauaaaguagauuuuugccauuaguaaaauuuaaagugauugggggcuaugguuacugagaauucaagagguagauugacgaaauaauauuugaaugcaauuuuauuuuuugaaaaauguuuucgagauguccuguuuuuagccaggaagcaaacuccaggaaaacucucuuuuccauuaaaguguggaugguguacuguaaacaaagacuagcucucuugagcugccacguuucuauaacuuauagaaacagaagcuguuuuuuuuuucuaaagauccaaacucauguugccacacaaacaacaaaauaaaccaguguguuccaaaaacaagcauuugcucuacccacacgcacaguuggaaagaugcagguuugauugaagaagucggaagccagugagguaauggcagauucuuuuaggggcuccuguuaauuuuaguaagcuuggaagaagcuucuagguuguuuaguguuucuauuagaaccaucaccucaacgaauuuguuauuguagagauugauuaggggaucugcuuccuuugagcagccaggaucccccagcuccagcuucuagccugcuuuucuuccucaucucuacucuuucagaauaaugcauggcuuucaaguccugugugauagguggcuucuuagcgggccucugaaggggcugagauuuguuccuggggcugagacuuuguuccuuugagggugcagaggcugcuaccugcucaggcugcccccaaauugcucuugugugcagugugcugcuuggggaccaguccuggcucugccaccauggcggacacuacuggcuuccucuuaaucucaaucucuucuucuccuuucuuucuuuuuuuuggagacggaguuuugcucuuguugcccaggcuggagugcaauggcgcuaucaaucguucaagcgauucuucugccucagccucccaaguagcugggauuacaggcauguaccaccacaccuggcuaauuuuguauuuuuaguagagacaggauuucacuauguuggccagucugaucucgaacuccugaccucaggugauccgccuaccucggccucccaaaaugcugggauuacaggcaugagccacugugccuggcccucuucuccuuucuaacacaagccugcuucucaguuucacgcacacauaggaguggccaccugacccuguguuggcaaaugauugcaggcuguugucaccgguggggcuccuggaaaagcccucuaugggggauugacucuggcaugacugggguguggaugcugugcucagaggugcugcaguaaugguucugcugcugcugauaguaacacaggcagugcugugucaugcacaguaauccuguaagggagauacuaucaugaucucuguucgguggaugaggaaacagucugaggaaaggcaccugaccuguucaggccacacacuaaguacagagcugggauccuggcaccagcauuugcucucaccaccucucuguuauguaccucucacacaggugcgagucccaccccagaggggccuugagaggcugcaaguguccugggugggcugccugcuucaggaggacuuauuauuggggaaaaauacccccccuacuuauuacuaagggccgaaugcuuuauguucacacaacaacuccauguugugugacuuuggacauguuccuuaacuuucuuuaucuuggucuucucaucucuguaaaauugggaucauaauggcaccaacuuauaguuuuuuuuuuuuuuuuuuuucuuuugagucaggaucucacccuguugcccagacuggagugcaguggugugaucuuggcucagcccuugggcucaaacgauccccccaccucagccuccugaguagcuaggacuacagacauacaccaccaugccuggcuaauuuuuuuuuuuuuugguggguuuugcuauguuucccaggcugguuucuaacuccuggacucaagugaucugccugccucggccucacaaagugcugggacuacaggcaugaacuaccaugcccggccaaacuucuagguuucuuaaaaaagugccuggcaggccaggcgcgguggcucaugccuguaaucccagcacuuugggaggccgaggcgggcggaucaugaggucaggagaucgagaccauccuggcuaaaacggugaaaccccgucucuacuaaaaauacaaauaauuagcugggcguaguggcgggcgccuguaguaccagcuacuugggaggcugaggcaggagaauggcgugaacccaggaggcggagcuugcagugagcugagaucaugccacugcacuccagccugggcgacagagcgagacuccaucucaaaaaaaaaaccaaaaaaaacagugcuuguuguucuuuuguuguuauuguuaaaggaucauuaucucauuaucaacaacauuggcagguaauugagcaacuguuugucuccuugucaauguggagauagaaaauugccuacgagguuggacaaggugcuggagcagcgucaaggaagagagaucgaacaagaagacugcuuugcccuuggacagcuuuguuucugaagcacuuucucauauucucccauuuaaucauccccucccugccaacuuuuccaacaggugcauacuuagguagagcuauucuuuaucagccuggggcuaagauuuguuccugggcagguuaucuuugucucugccuggauagaggcaggggcaguagaguugucaugcauuccagacuacuagcuaugcagaagcaggagcaagguaagagcagauuuguaugaaugagggugucagggaauaucuuagauguccauuuaguuguuaaaaaagagaacugaugccuauauuucaaaacccaacuuugaucuggaugcaguggcucaugccuguaaucccagcacuuugggaggccgagguggguggaucaccugaggucgggaguuugagaccagccuggccaauguggugaaaccuugucucuauuaaaaauauaaaaauuagcugggcgugguggcacacgucuguaaucccagcuacuugggaggcugaggcaggagaaucgcuugaauuugggagguggagguugcagugagcugagauugcaccaaugcacuccaggcugggcaacagagcaagacuccaucucaaaaacaacaacaacaagaacaacaagaacaaaagaaaaaaccccuaacuuuggagagguuaucuccugaaaaggaggguuuuggucucuuucucgcacugcucuaaaauagugacuggcacauaguagguagucaguaaauauuuguugaaugaaugaaugaaugaaagguaauuggccuucccugcucaguucucauuaaaaauucugguuuucacauauaugggcagugucccaacaggcugcugggggguggccguuugugauggccucaccagucuuucccagagagggaagugcacauuuuuaggcuacuuuugcucugacugauacacuuggcugccuaacaaaaagccagagaagaacuaagauuuuuagcaucauucaaaaugcuugccauuccuuuugcuuugugaaaucaugagcuaguuauuuugaguucacauaaaggucagaacuugaucuggggaaggagguuccccuugguuuaugugaggggaacuuuuucgcccuucuguuuauuuuauccaaaggcuucuguuuuucucccaagcuaaaaucuggcauuuguuguagaaaguucucagcuuauguguguguguguguguguguguguguuuuuaaaaagagcucauauuuuggcuuuaguuuugauucucagugauuuuuuuuuucugccugagaguugauuuucugcuucuucaaaguccagcucucaagugggugccuaaaguuguuucguuuuagaggugacuuaaucauuuuuuaggccuuuaagugcugcucccagcuuguguuuccuucuguuuuuaguuuuuauguggggcagggucuccaaaguacacgggcucuuuuccccaccccucuacccucauuuuaacugugcaucaaauggguccuguuucuucuucauguauaauuuugugagucagggaagguggugaaggcccuugaacccuggcuuugucauggcccuuccuuaaggaccugaaggucucuucuccuaagggcuagguugguucagaaagugagaagggcuggaccuuuuguggggagaggauacagcaggguccgaacagcugggcugacaccgggcagcagcccagcagcagucggagcugcagggucagcucaccaugggcugaacuugggcauugccuguuuaggcagagucugcccgagccuuuccugcucccugagaauccucagcauguuuuccugcugagcaaggagugaggaaugaagcccacuacgaagcccgagcugcaaauguauuuauuuauuuauuuauuuagagacagagucuuacucugucgcccaggcuagagugcaguggugagaucucaguucacugcaaccaccgccuccuggguucaagcaauucuccugccucagccuccugaguagcugggauuacaggcgcccaccacgggcccgagaacugagucucgcccaucuaauuuuuguauuuuuaguagagacaggguuuugccauguuggucaggauggucucgaacuccugaccucaggugauucacccaccuugaccuuccaaagugcuaggauuacaggcgugagccacugcgcccggcucugagcugcaaauuuaauagggaaacugaaggaagagguucuccacagcaccaguggggcugagaccuguuuuccucaacuaccuuuuuuuuuuuuuuuuuuuuuuuuuuugagacagagcuucacucuuguugcccaggcuggagugcaauggugcgaucucaucuuacugcaaccucuucuucccagguucaaacgauucuccugccucagccucccgaguagcugggacuacaggcaugcaccaccaugccuggcuaauuuuguauuuuuaguggaaaagcgguuucuccauguuggucaggcuggucucgaacucccgaccucaggugaucugccugccucugccucccaaagugaugggauuacagaugugagucacugcgccuggccaacugcuuugguuucugaguccucccuccucuaagcccgcucagugugugucauuccugggaggcgguggcucucccaggaccccaugccgaaaucugccuucuucuugucuucauucccccaccugggguaccccucaguguuuucccauuacacagauucacguuuacauguucuagaaacaucuguaagucuuuuuccuguuuguaaauuguauauccucuguuagauuaaaaaacuuuuaaaaguaagugucuuucucuguggugaccuauuuguguggcauaguauagguuacaaagcccuuuucaugcauuguuuuacuuauaaguaauguuuauagaugauaccgagguagacccuauggggugcuuacuaugccaggucuguucuaagaauguuauacacauuaccuuacuaacccaccccaaccauccauuguguuauugucaccccuguuacaggguggagagaagaaggcagagagaaguggaaugacacuccugaggcuaggcauuugccaagugaggucugggauuugaacccaggcagcugaacuucagaauccugguguuuaaccacuauaccaugcuggccuucauguuauugagcaggauaaggaauugucacucuugacuuguuuuugaaacaugaaaacccuucucuuaaauucaaaaguaauacauagcugggcacgguggugugcaccuguagucccagcuacuuaggaggcuggggaagaggauaguuugaguccagaaauuugagacugcagugagcucuauagucaugccacugcacucuagccuggguggcagagugagacccugucaaaacaaagcaauaacaaaaaaaaccaaaguaaugcguauugcagcaaguacuuaaauaauguagaugcauaaaagcaaaaagugagaauccccacuccuccuccagugcucugagauagacugaaguaacucuucagggaugaguguaaacacaagggauguccucgaagacuuuccacuuggaaagcuuguguauuuuauacauuaaguaucauaaauauguaguuacccuaauggguccccgccauugcucugcaggcagugggcugagguucaggaguuaagucagccccagggcacaggguggugcaacagaagagccugagucgaauccagaucuccccucuccacugugacuguuuccugggaaacuagucaggggcugguuuuauaggaauuauccagucguauuauuauuauuauuauuauuauuauuauuauuauuauuauuauuauugagacugagucucgcugugucgcccaggcuggagugcgguggugccaucuuggcucacugcaaccuccgccucccagguucaagcaauucuccugccucagccucccaaguagcuaggauuacaggcuugagccacuauguccaacuaauuuuuuuauuuguaguagagaugguguuucaccauguuggccaggcucaucuggaacuccugaccucaggugauccgccugccucggccucccaaagugcugggauuacaggcgugagccaccgcccccagccuuccagucguauucuugacaaaugguuuuccaugaaguuguggacaccuuccagggucacaauuaaaugguuaaaugagucacgauuaaauaaugauuguggguaccucccagaguuucaaugaaaaagggaauuaacuuuggacacagacagaauaaugcaaaucuucaguuuugguuuagaaaaucugaaaccugcaguggggaauacagaaaagaaggaaguagaaggagucuguccccaaccccgccccuuccuuuuuucucuccucuggagagagaagggauuaggaggccuccuggaaaggagucccuuuccugugaucaaacucaccccuucccuccaccagagcaauuacagagccuccggccuggaaccuuccucaccggccuggaggagacaccauucugcggacaauggggggaaggaaaggaaagcaaugccgcugccaauggugcggaugacuuccucaaugccagacuugcuugcacuuucaaagucccuccucggagguccccugguaggaccuggagauaggaugugcuuucacucuuuacagacuauuguccaggaaagaaaguuucagacuuucuuaggcagggaagggcccucugacugugaauuuauuuggaaauuugaaagagaagagagucuuauccuaggaaguguucuuuuucuuucccccuggauuugacaggccaggcaacagcaauuauccaaaccacugcucugcaccaagaggcaaaccacaggaaaaagaaacccgaacaagcaaggagaauagaaguuccccaaagcaugccuucuuguuuuucucagaggacagucuuuucauucauguuuuacagauugguccaacaagugcaguucuucuagucuccuaucuagauaagcaggauauuagaaggaauaggagaggccugcaaaaagcuaugauaggguggaaauaggauaggagaaacugaaaaaaggggaggcgugcgcuccaacaccuccauagcccuuggggacgggcuuaguuucuaaugagaauacagaaggcccaugucucaauaggccccgaaaaauauuaauccagcccaauaugaacagucugcuaauuauaugacugggccugcuuaggagaucagggcaauauuacauucagaguacucaguuuaggaagaugacacaguguaauacauacagauuuccaucauuucuuuuauuccucauuuggagaggcaacagggcugagauagacauguuagcgauggcuagauugauugauuuauugacugaaugaauggccugcuuuaggcagcgggaacacugaaugaacauuuuaaaaucagcugguauaggucaggaacugugcagguugcugggaauggguagaugaaaagacauugcuaugguuuggcuguguccccaccuaaauuucaccuugaauuguaauccccauguuucaagggugggaccagguggagauaauugaaugggggggugguuucucccauacuauucuggugguagugaauaagucucacgagagcugaugguuuuauaaaugggaguuccccugcacaagcccucuugccugccaccauguaagaugugacuuugcgccuccuuccccuuccaccgugauugugaggccucgccagccauguggaacugugagucaauuaagccucuuuccuuuauaaauuacccagucucagguaugucuucauuugcagcaugagaacagacuaauacagacauggaccuuggcuguagggaguuugcacuguagugacggcaagagcucacgugauccauuuuaagauagaagagcgagcucaggcagaggaacacagagccaggaugguccaugcacggaaucuggcccugcccuuacuuucuccaggagcaugggcugggucccucuccucccuaauccucacuuugcucaugugugaaauguagaucaaguaaguucuacacucagaggucucuugugaagauuaaaugagaaaaggcauggaaacugccuuugcacacagccugguauauccugaugucugcugauacucuuauuuuuauguuccuugacauuccaaaucugccccagggagaauuccaggacagcucuggagaggaagugaucuuugaauccaaccuugaaaucacccuaggagaugcaaagaaggugacaccaguuaagaauaagauguguacccauuuucaaauguucuuuuuuuuuuuuuucagauggagucucgcucugaugccuaggcuggagugcaguggggugaucucggcuaauugcaaccuccgccucccgggauaaagcgauucuccugccucagccucccgaguagcugggauuacaggcgccugccaccaugcccagcuaauuuuuguguuuuuaguagagaugggauuucaccauguuggccagacuggucuugaacuccugaccucaagaauccaccugccuuggccucccaaagugcugagauuacaggcaugaggcacugcaccuggcccaaaucuucucaguucuaaauggcugugauaaaaacuacauugauaauuuuuuuuuuuuuuuuuuuuuggagauggagucucgcucuggugcccaggcugaagugcaauggcgcaaucuuggcucacugcaagcuccgccuccuggguucacgccauucuccugccucagccucccgaguagauggggcuacaggcgccugccaccacccccggcuaauuuuuuuuguauuuuuaguagagacgggguuucaccauguuagccaggauggucuugaucuccugaccucgugauccgcccaccucagccucccaaagugcugggauuacaggccucugcgccuggccuugcauugacaauuaauuuguuuauggaaagccaguuauccaaugauggugaacaaaugcaacuugacuguauaauacuuauuuugguuuuggaccaaagucaccauuaaauaugccaaguucuuguucaaggaaacagcuaaugucguggacuugcaucucauuuguaguugguucucccugaaaagucaguggugugggagaaaugauacuuagucaaaaucaucagugaaaaucauugcuuggaucaucccaaaauauaaugaacaaaagugauauuuaucugccacauugagaaacauucaccauaucucaauaagcucuccucagccaguugguccuuuugugguugaaaaaagugccauaucuuugguugggcauccaauaaaauaugguauuuaggggcuaccuguauggaaaauccauauccuuaaagguuagcucaccaggaggauguugagaaauggcacaaggggcugggcgcgguggcucaugccuguaaucccagcauuuuggggaggcugagguggguggaucacuugaggucacgaguucgagaccagccuggccaacauggugaaagcccaugucuacuaaaaauauaaaaauuagccaggugugguggugggcgccuguaaucccagcuacuagggaggcugggcaggagaacugcuggaacgcaggaggcggagguugcagugagcugagauugcaccacugcauuccagccugggugacaggcaagacucugucuccaaaaaaaaaaaaaaaaaaaggcacacaggaauuggguugggacucaguagaucaguagauuuagaucucccagcuuagucucaucuccauaguguggguggaguaguacucacacuauuuaaauuauuuuuauuucacuaccugaauccccucagcaaguauaguuuaauucaccugaguaauacgcuuaugcgaggggauuucuccaugggccuuuuguuuuugcuccugcuggugaucugauuuuaaaugugaacgugccauugcuaagaguuuuuguucuauguauuauucuguguggaaaauuucuuaaaugggauuauugaaguauacuucauuauuuaucuucuggcaauuuaucaacaacagcaaauaucauucauuauuguuuggaggacagaacuauuuuuauauucuuuaauuaaaaauggcuuugacauuuucaaauucagagggaaguugauaauuuagugcuguaugauaggaccuuuaguuggucugaaugucacauaauuguacaaauugcuguuaaaguauauuauuacuuauuuucugagagguagagggacuugguuauccugggauugcauaauuauugguucacuagaacuacagaugagugaaaagaaggguuagauacucucuaguucacuuuucuuccagugcagggaacauucuaugggguuccgaacagauauaauaagcucauaauaacaguggccauugauugaacucuuucuaucaaacaaugugaaaaacauuaguagaggugauaucuuagucugcuuuugcugcuguaacagaauaccugagacugaguaauuuuuuuuuuuugagauggagucucacucuucugcccaggcuggagugcaguggcgcuaucuuggcucacugcacccuccgccucccggguucacgccauucuccugugucagccucccgaguagcugggacuacaggcuccugccaccacgcccggcuaauuuuuuguauuuuuaguagagacgggguuucaccguguuagccaggauggucucgaccucgugauccucccgccucggccucccaaagugcugggauuacaggugugagccaccgcacccagccuuuuuuuuuuuuuuuuuuugagauggagucucgcucuguugugcaggcuggagugcaguggcgccaucuuggcucacugcaaccuccaccucccggguucaagcaauucuccugccucagccucuccaguagcugggacuacagaugcaucacgcccagcuaauuuuuguauuuucaguagagacgggguuucaccauguuguccaggauggucucgaucucuugaccucaugaucuaccugccucagccucccaaagugcugggauuacaggugugagcuaccacgccuggccauuuuuuuuuuuuuuuuuuuuugagacagagucucacucugucacccaggcuggagugcaguggcaugaucuuggcucacugcaaccuccgucucccggguucaagcgguucuucugcuucagccuuuugaguacuugggauuacaggcaccugccaucaugccuggcuaauuuuuguauuuuuguacagacgggguuucaccauguuggccaggcuggucuugagcuccugaccucaggugauccacucaccucauccucccaaacugcugggauuacagguguaagccacugugcccagccccaagacugaguaaggggugagcagaaauucacugguucacaguucuggaggcugggaagucucguaucaaggugccagcaucuggccagggccuucuugcugugcuaucccauggcagaaguacagaagggcaaagaaagagggcugaacuugcccuuuuauaauggcaccaaccccacccaugaggguggaguccuaauggccuaaucagcucucugagaucccaucuguuaauacuguuacaauggcaauuaaauuucaacaugaguuuuggaggggacagacauucaaaccauggcagguggcaagaaguaucaaacuacuagauccuugggauugugcuuuguacugggguguauuuuuuccaacaauccuaaaaaucauuugaauagagauagcaauauauaucuuacccauuuggaaaugcacagagauucaggaguguucacauagaaacagaagaucauuggcuuuuguccauucccaacgccagugaucuguuuuucuugacucuuuuugaucuguguuucugaauguguugauauacugcgcuacuggugugcaggaugauuuuaaauguugcacagaugaacauuaauagucaucuauuuuaauauguauuaggaaaaagcccauaaaacaaugaagcccauuaaaaccccaugguuucuuggauaguauuacauagggugaagcuaauuuuauuucaguaaaaaauaugcaggucaauuuaaauaaaaaaauagauaauaguauaaauggcuuguggcuacaguaaaaaugaugaugguacuugaauguccaaauuaauuuaagugauauauguguucauagauaccauuucauuuuaacgugguucugcuggucagaacagucuuacgauggggguggucuccaggcuucaccuugugcccacuggcucuguuugguuccucugggcucacacacagggagcuacguaugucucucucauuuccuuugguauguucucuggguuaaauguccccagcuaucugaucuguucccugcgggccuuggccauuccuguccuggccuuuacuggcagucucuauucuaaaaugugggcaucccacaugagguccagcuucuccugagauccccggaggugcagcugcugugauggugaccuuguuuagcagaugcucccugcaguccaaacucccacccaucguccugcccuuugauccauuucccaugaacugcuuaccucaguuuucucaucuguaagauggagagauaacuguaagugcuuagcacaguguuuacuagcacagacuacugcuauuacugucaagucacuuuuccuuugcugccaauaggucauuuucuguuuauggcuucuucaguaugaacugaucaacuguaacuugaaaauuuccagacuuaggacuuuuggacucauagugaaaggauccuuucccaauucccuugaucgguuuuuccuuuaaaaaaaaaaaagauauuugacaucuuuucacuuucaaguucaguuucucuucuccuuuuuuucugggugaugguuuauuauuuaaaaaauuucuauguauaugugauuuaaaaguaaacccacguagcugaaaaugucucauagguuuuucuugcauuuucaguugacccauucacuuugcaaaucuuuagaguauuauauuuaagacagcuugcagcuguuuucuuauauauauuuuacaugacaaaauuauauuuaaaacauauuaaacuuuaaaaaaccauaguuuauaauuuauaagccauguagcauauuucuauuuuugagacaggaucuuacucugucacccaggcuggagugcaguggcucgaucauggcucacugcagccuugaccuccugggcucaaguaauccuccugccucagccucccaaguaguugggacuacaggcacaugccaccaugcccagcuaauuuuuauauuuuuuguagagaugggguuucaccacguugcucaggcuguaauuuuuaaaaacuaaaaaaagaaaaaaaaguguuuacaggacuuuaaauugagaaacuuaaauaucuuuacauauucuguguuccuaauuuauuuuugcagcaguaauuauuucagcugucuuuaguauugacauguuggaaccucggauuaauuugugcauggauauauuuagagccuuuuacuugacaagaaucauguauaucaugacugaauuuguaauuucccagcaugagacccaaauuaauagacaguauuuagauucuaggcaacgaugcauuauauaaaccagcaucauuuagggaguggcaaagacucucuccccaccaguucugugaacuugggcaagguguguaaucuuucugagccuuaaucuaauuagacccuuucuccuguaacccagaggggguguuaguaaaguuggugugaaaaaagucaauuauuguacugaugcaauuugggugaaacugugaaguucaguguucacaugaugguuguggagacacugaaccuuaauccuuaggccagggauucaaaguuuuuuuugacucucauguugaacguugucuaaagugcagugugcccuaguuuuuagguaauucugagaauucuaaggcccuugcuggaauaauuaaugagaauaugagauuucagcaaauuagggccaggagucagugcucucagcauggaagaaucucaccuccaaaaauuuuauguggguuuuacacauuaagcaagcauaggugaggugcagugaaggggaagugauggcugucagucguuuggccagguuccuuugcauacaggggagcuaguggguguauaccagcugagacagcugaaggaggagaacaugaagaauaguuggaaacuauugaaccuccaagauuuuucugucuuuguuaacaacuagcaguuacaugcuagcauuauuuauuuauuuaguuaguuaguuaguuaguucuugagauggagucucacucugucacccacgcuggagugcaguggcaugaucucagcucacuacaaccucugccuccuggguucaggugauuuuccugcuucagccuccugaguagcugggauuacaggggcccgcuaccacgcccagcuaauuuuuguauuuugagcauguuggccaggcuggucuugaacuccugaccuugugaucccccugccucggccucccaaagugcugggauuacaggugugagccacugugccuggccuuauuuauuuauuuuugagacagggucucacucuaucacccaggcuggagugcaguggugcagucauagcucacugcagcuuggaacucuugggcugaagugauucuucuuccuuagccuccccaguagcuaggacuauagugccaccaugccuggcuaauuuaaauuuuuuuugugugugugugugugguggagauggguucucacuguguugcucaggcuggucuugaacucuugggcuuaagcgaucuucccaucuuggccucccagagugcugcgauuacaggcgugggccaccacaccuguccugugcuaggcucuuaacguccuucccagauguuaugucccuucccuugguggcugcugcuuucugccacauuuuaccuugccuuuccgcaccuucuaccaugucuccuuuuccagccucauucccugagauguagccggaguuccaguucagccaaccugcccguuguuuucucuccuggaacuggguguuugagccuccugcauggaguguucuuccuucccagcuaaaguccuggucaucccauuuccaucugaaaggcccccuuguucaugaagccucucaugguccuucccccuaccccagccagguauacuuucucuccucuuggaauuacccuauaggaagaacaugguggcuugaccuggguuccagucucacccaucuguuuaccuggggagugaucuugagugggucaauuuauguucucagugccuuacaaaauggggcagaggauaccuaacccccaggagcugguguggcugggguaccuuacacagggccugacuguaguagcuucucuccaagcauuggugucuuaccucuucuguuucucuaaugguguuuugcacauucauuguuguauuagaguuuguuuuuuugucuuaccuuguuuuaauaaauuauaaucuuaugggagaugacacugucuuuucuuuguuucauauauaaaaaguguuuugcugauauacguagaaucaaguuggucuggaguuacucuggauaagggaugaaaucagggagcucuuguguucaaaggggccuucuucccuuuuuugguucuuucuccucauuuuuuagcuuccauuuuuacuuccuuuaguauugagaaaguaccaggcucacuucaaagaguugacuucaaagcucccaccagcucagacauacuugccacugaagccuguaggaauuggcaucaauggaagacccuguggcgguugcauuuaagauuuuuuuugggacuucuauuuuuauaauucuuuuaaaugguaaagggggaggguuacaaaauaucugcgccuuuaagauaucaaacauaagccagugaaguuccaaaaaaaaaaaaaaagaugucuuagagaaaugaaaaggauuuuacaauugguagaaaagaacaacucuuuuuucuuuuucuuuuucuuuuuuuguuuuugagauggaguuucgcucuuguuguacaggcuggagugcaauggcgccaucucagcucacugcaaccuccaccuccccaguucaagugauucuccugccucagccucccgaguagcugggauuacaggcacgggccacuaugcccggcuaauuuuguauuuuaguagagacgggguuucuccauguuggucaggcuggucuugaacucccgaccucaggugauccaccuggcuuggccucccaaagugguaggauuauaggcaugaaccacugugccuggccaagucuuuuuucuuuaaaaaaaaaaagguuacuuuuacuguuuuguccuaguuacaagaucuuaggacagaaauaaagccuuaacuuguauguaacauuuuccaagauggcuaaguggaguugcagguuacauagcagaaaacagaggcuugggccuguugagaccucacacccaguucuucuuggagcugugggugugggcugaaagagaagacagggagauuaaagaccagugauuucccuccauggacccuuugaugcucuuguuuguugacuuuuugaggcuuggagugaccgacucuuccaggaaugagaaauggaaucccucccaguuuugauggucgucccaggacauauuuccugaaggccuacucugugucucagcaccauuccaggacuccccccgacagccuuacggagcgugcuacagucuuccugauccaauauccugccaccugcccacucauucacccucggcccuaccccaugccuuugcacgaaucuuuccagccugagcagccugagaugggucuuuuucccugcuccgaaauccugaccucauaauggcucaugaaucccuauucaaccuucaagaccugguucaaggguuaaauccuuuaaggagacuucuccugauuuuuccccagcugguugcuuuguucuccagcgauuuguaaccuugugaacaaauauucuacucauuuuauucuacuggaaugaucuauuuacacuuaucucccugcaaauuguauccugcccuucaauggcuaagugaauggcauaaacagaugcuauaggaauugagacuaaguuggagcugggugaucagggaagguuuuaaggaagagaucugggacaaauagcuaaagauggauucaguguuuuuuuuuucuuuuucuuuuuuuuuuuuugaggcggagucuugcucuguuucccaggcuggagugcaauggugcgaucuuggcucacugcaaccucugccgcccagauucaagcaauuuuccugccucagccucccagguagcugggaugacaggagcccaccaccacgcuuggcuaauuuuguguuuuuaguagagacagguuuucaccauguuggccaggcuggucuugaacuccugaccucaggugauccacccaccauggccucccaaagggcugagauuacaggcaugagccaccgugcccggccugauggauucaguuuaugugcaaaauuuaagaggauggguuucggcaguucagguuguuaggagacaaggguggaaagguguccuggagcccuacagagaugggcuucaagugccagccaagguguuugaccauuuuuagaagaggaaugagaugauuaaaguggaacuuuuaggaagaguaggagugagcgggauggauuuaaaaggcggagugagaggcaucaggaaggcuggguaggagagcauugcuacagucuaggagggagguggcagggguguagaccagggaucacaaagcaauggcuugccaucugcuucuguauacccagagagcuaagaaugguuuguaccuuauuaaaugguugaaaaaaucaaaagaauauaugcugugauauguggaaauucugugaaauucaaaugucagugucuguaaauaguuuuuuuuuuuuuuuuuuuuuuuuguggaacacagccauacuuuucauuuaugcauuguuugugguugcuuucacacaaucaugccagcccugaguaguugcugcagagaccauauggccugcaaagacuaaaauauguacuuauguacuaucuggcucuuuccagaaaaaaucagcagaccccagguguagaccaaccagggugaaugaguguaugacuggaaaugcaaagacgggcaggaucaagggacaguuuagagcagggguguccaaucuuuugguuucccugggccacacuggaagaagaauugucuugggccccacauaaaauacaccaacacuaacaauagcugaugagcuaaaaaaaaaaaaaucacaaaaaaucucaaaauguuuuaagaaaguuuaugaauuuguguuggucugcauucaaagccauggugggcugcaugcgggccauggguuggccaagcuugguuuagaggcggaugcaguacgggagaguuuucccuucucuucugauguaacuccaugucuugguggcgguguucuagauguaggcaucuuuaggcaggggagugugcguggaagggugaaaggguugugccuucaugacgcucguguguguguguguguuugugugugugagugaugcugagcuagucuuagaguaaaugcagacacuggaugguagcgaguucagugcaguuuuuauggagggacagcuugcugccugcugaugaagcuggacaagacuggguagugaagucaaaggcccacaccuaacucugaggcucuugggggcaacuguguugugcagagaagguaggagggcagaggaagaggaggagcggccccugggagaaugccuucuacccagcugcagcuucucaaggguguguuugcgucugaccuaagguguuggagcucuuuguuucuggcuguguucaggcuuucccccgcuugccuuuaggggaagcugaugacugcuuuagcguaaagagagggccaggaggucaacuucccuacagucccgugccugcuucuggguuggggcuggggagagugcugcccacugaacucucuaaauguuaaaagauacaaagaggaagcacagagugaaaagggagaccccagaggacagcagaacaucccgaagcauaucccccaucagagaagaggcaugauuuucaccuggcuugcaggugcaggaugggcaucucagaugcugugagucugagggcagaugcccaucaguccaggacaguuccuggggacaaaagccucuucucaccuuuagagaaauuaagucuuauugguagaaaauauuuuagagagguucuggucuaagccucucauuuugcagaugagaaaccacccaaggcccaagauggauggauuuaucaaagccgguugguacuggaacuuggauuuaauuucaggucuuuuauuauuacuauggaacaaaucuuaacuuuuucaagugcauaccaugugcccggcuaugugcuggauguagaugcuuuaucugcagguuuaaucuucacuacaacuaugggaaguagcuauugucucucuuuugcaagugugaagagugaggcuuagaaaggccaacuugccugugaucggguaacucaagagggaaauuggaucagaguccaucugagacugacuccagagccaauguucuuagccaauaggggcacauaaaacuguucugaguggcuuccuagcuccuguuuccaguguccaauccauucucgguuucuguucauucaucagaugugcacugaguaccugcaagaagucagaaggguguuggguuggugaggacagauuguauaccaucuuggcuuuggccgagccaaacagaaugccaaagaucggcaaagauagggaaugauuguucuuggccucagcuccacgcuccccuccucuguaaaacugccccugacaccccggcaggauugaauuccuccaccuuuaagcucccagaguaccuuagcucugucuuuagcacuucacacugugucaugccuccccuugggcccuaaggccaagagcaugugccauuuauuuuuguauuccuacuucuauagcccagugcauauugggggcacucaggaauugcugagcgaauaaaagaaugaaugaauacagacccagauugucaaugauucucaaaccuuauuuuacaaaagaaucacuugaaaagcugguuaaagaucaaaacuccugagcccuacuccuggugauugacuccuagguuuggggugggaccccagaaucugaauuucccggaagcgcccagguguuucugaugcggguggucugcaaaccacacuugcagcaacccuggcacaggugcccagccuucuggaauaaagacaggaacuaagcauuaaaaauagcacgccauucauuugcuugugccgagccgccaagugcccccuccugccggcgacagguccggaugugggccaguucucagcccagggaaaaugaacagugucuucuccguggugcccagaacagucugagucaguggaaugugcuggccagucaggcagaagggaacuuccacuucuuuuuuaaaaccuugguggaaacugugcuggcaaggcaaacagggaggagaggaagcuccauguggggcuugggcuuggcggacgacuuggggcuggccggacuuuggguggccgccgaggaccauugcuaaauaugccccuuucguccugaaauagucacuuccccggcuggcuuuuguguuggucggucgccacaaauguguggcuguuguucaaggaggccuccugggauauaaaaagagagaauggggccaggcugcggccagggcuguguaggaagacaggagagcugccuuuucuccugucccaccacggacucauuguaagauucagagggaguggcuucugggcccuggguuuacuuuuccaucuguaaaauggguggggggaaggggcagcaucauaaagcuucuuucuucuccugaaagggauguuuuaaggcccaugucaagauugaacacagggcucuguuguugggcugaugcuacugaugaagucucaggaagcucgaaguuuguaguuaacucuuucaggguagauguggugaauagucucuugguauuguguugaugguggcccacuagaacagaaggucccagagggcaagggcuuggucuuucuucuuccucucuguauccccacuguuuagaacugggcugggugcagaguagucuccauaaauguuuauggggccaauaucuccaaauauuggcaccuacuaagcgucagucccaucucucuuuugucuucuucacagguuuaacuugcuguuugagaagaggcgauaugaggagcagggcauuuuuggaggaagaaacuuuaccucuguuuucaacguuucauccaguuucucuucuuuuuacuuauuuggagacauggucuuacuuuguuguccaggcuggaggcugaagugcaguggcacaauuauagcucacugcagccucaaaacaccuggccucaagugauccuccugcuuuagccuccugaguagcugggaccacaggcuuacaccaccauaccuggcaaauuuuuuuuuuuuuuuuuuuuggagaggcagagucuugcuccguuguccaggcuggagugcagugguguagucauggcucgcugcagccucugucuccugggcuuaagccauucuccugccucacccuuugagccuccuuaauuuuuuauuuauuuauuuuuuuuuuguagagacagggucucauuauguuguccagccugauauugcuauuuuuuuuuuuuuaauggcgauguaguaaucuugcuuuguugcccaggcuguucuggaacuccuggcuucaggugugugccacugugccuggcccaguugcucuuuacaugguggaauaucagagguuaaagacuugguaaaaauucaugcggugcaauaaaccauguauuacauaauaggggugacacuuguuaacuucucccaggcucaguuuccucauguguaaaauaggugaauaguaucuacccuccaggaguuguacaaggcucauguauacauaguguaugugaaugugcuguaugggugcaagggguugcagaagugauaauguguguaaacagauggugugguuggcucauuggagggguggaggcccuaagugagaugaccucugagguuuacucuuccuagaguaguuggaaagcaauucagccucagugguaagcucucagcucuucuagggcaggucccucuuccaccacccugugucugcaagcauuuugguauuaaguuguuuuucuaaggcugggugcgguggcucacgccuguaaucccagcacuuuuggaggccgagguggguggaucaccugagaucaggaguucgagaccagccugaccaacauggugaaaccauaucucuacuaaaaauaaaaaauuagcugagcgugguggugugcgccuguaaucccagccagcuacuugggaggcugaggcuggagaaucgcuugaacccgggaggcgaagguugcagugagcugacaucaugucauugcacuccagccugggcaacaagagugaaacucugucucaaauaaaaaauauuauuuuucuaaaaagcucuuauuuuauugugaaacacuuaaauuagcaaaucucaggcuugcugaauaaggcuucccaggcaaaccacaucccacaugugcaaaugucuggugacacagugcuucauuuuuuuccacuaguacuuacuacuaccugacauuauaguguaaguuuacuugucuauuuguguauggucugccucuccuaugagaaugugagcugcaugaggucaggacauuguuuuguucacucaugaauucccagcacccaggacagugucuggcauguagugaguacccaguaaauauuuguggaaugaaugaaugaauacuuaagugggugggaaguucuuggaccuuagucuagacccaugguucucaaagagugguccugggacucuuggggauuccugagauccuuuuagggaucugugaggucugugaggucaaaguauuuuuauaauaauaguaaacuauuuguccuuucacucucauucccucauguaugcaaaucucagugaacugauauuuuccaaauaaccaaugcauaaggccacaaagccaugcaggguaaaaagagcuaugaacaaaaguuuucuagagaagaauuuggaggaaagagaguuuauucuagugaacagaucgcaaacugggagaugcugcguugguguaaaaugaaggugcauuccagagagcaaagagagaaucuaguuuuuuguuguuguuguuguuuuguuuuuuaaauuuugagauggagucuugcucuguuucccaggcuggagugcaguggaguggcgugaucuuggcuuauugcaaccucugccuccggguucaagcgauucuccugcuucagcaucccgaguagcugggacuacaggcacuugccaccacgcccacacacccuacuaauuuuuguauuuuuagcagagacgggguuuuaccaugcuggccaggcuugucucgaacuccugaccucaagugaucuacccgccucagccucccaaagugcugggauuacaggcauggcagaaucuagguuuuuauagcaaaauuucuggcccauguccccaaucagguuugauuaugcaaaugaagggggcgggucaaacuugcuuaguucugauuggcugacacagcugaguucugauuggugauacagcugagcccugauugguugauacagcugagcucugauuggcugaagcagacgagcucugacugcuugguucaugugagcucugaaagucccaagucaaaagggugugggguuuugugaaacuuggaguacguagugugaccucuagucagcaaauggccacuuggcuguauuuuaaauuuagguacacuuugcugcuugggguccaucuugaggggauugccuuuuucagguucauguuuguucacagagccauucaaagugcaguggauacauuauaaauuguacaauuauuuguaauuaaaaaaagaacaacagcaaaaaacccaaagugcaguggaugcaaagaccaauggauuuucauguaacagaauaugaaaaguucaccgacacaguuucacauuccacgaugcagagaaguuuuuaauaacugccauccacauguugaguuuugguguaacagcaaagaaaaauauccacaacuacugaaaaggcugagaaaauacucccuuucucaacugcauguuuuugugugaguccagaauuucuuuacauuauuguaacagagugaacgcagaagcaaauaugagaauccagcuguuucuuacuaagcagacauuaaagagauuugcaaauaucuaaaauaaugcuaucucucucacuuuuuuuuuuuuuuguauuggaaacaucauuuuccauacaaugucauuuauguuaacaggugacagauuuauuuauuuuuauuuuuuauuuuuuugaaacggaguuucacugugucacccagccacccaggcuggagugcaaugguacaaucuuggcucacugcaaccuccgccucccggguucaaaggauucuccugccucagccuccugaguagcugggauuacaggcacccgccaccacacuuggcuaauuuuuguauuuuuaguagagacgggguuucaccauguuggccaggcuggucucgaacuccugaccucaggugauccacccgucucagccucccaaagugcugggauugcgggcugggauugcgggcaugagccaccaugcccaacaacagauuuauuauaagcaaaagcucuuugggguccucaauaauuuuaagagcauaaaggagaccaaaaaguuuaagaugugcuggucaagacagagcccuguggacuauggaagggauugaagccauucuguggauccuauaggcuucuuuucuaagcgaaugauuaguguuuauucaguagcccuaugucaggugguuucuguaugaaugagagguuugccuuuccagcugcggcggggcuuugggcaaguugcugucucugugcuccuucguuugcucauguguuaaaaacuggcccaggggucuggggguggggugguaagaaaauggguugagucuccuucaucucuaacauuuucauguuuaauucuuggaaccuccacuuguuagcucuguucacuccucugaaagagauuggugagaauugaaacagugaaagaagauuuuagagaaaaggugacauguaaagcugaacaaggguugccugugaggcaggcaaaaaggacauuuauuauauuuaaaaaaaauuuuuuuuuugagacggagucucugucgcccaggcuggagugcaguggcaugaucucggcucauugcaaccucugccucccgguucagcgauucuccugccucagcuucccgaguagcugggauuauaggcacacaccaccaugccugguugauuuuuguaguuuuaguagagacgggguuucaccauguugaccaggcuggucuggaacuccuggccucaggugauccacucgcuucggccucccaaaguguugggauuacaggcgugagccaccgugcccagcccagaaaggacauuuauauguggggaccacugcaucuugcagauggguaaacugagguagcgacaggugaaggcucaguuacauucauccugggucccagacugucuccaaccuguagccugaagcuuuguuuccuuccucccuagcccaggaugacagcagugaccuuccaugggaucuuuuccugggauuuauugagccacugaggucauuggccucaggccaccugcgucucucgacugaccaguuauucuucaaggaagacacuguguguguguguguuuuaguugcucuucuauaacuuccgggugcucuucucagagcagcagugcuuuaaaaaaugucuguguguguauuuccccacuuugagccaugaaauauguucagucuguuuuuuuucuaguccaaaguauuuccauaucauugugcaccugaggaaaugcauacuuugauagaaaauggacaaaaaaguuguauugguagaauuaaaugaacuaaugcaugucaagcacugagcacuuugacucaauaguaauaauaauaauaauaacacaauguaucauuaugauaguguuauaucucuuuagcaaucuugauaguugacuuguauaauucacaguacagaagcuuauucuaaaacuaaaaugcuuugguucuccugugugccaggaacagcaguaaacuuuauguccuaagauuaguaugguuggaaaugcauguggcagugguucccaaacacuggugugcagauggaacacagcccgugaaguuuucagcgguccuuguuaaaaagagauaaaggaaagagauaaaggauaaagugcugagauucucgugaagcuaaaugaagcuaaauaaacauccuucaaugagaauauguccuuccuauaguuuuuggaggaaaauauuuccuuuugugagacaaaaguguuaguaggugguaaguacuuuuuauuuagcauaguacaaaguuguggcccucugucaacccuucacauuuugguguguguaauguuugaaacugcauuggucuguaaaaucccaaacccagguagauaaaaccaagaagugacagggcuggaagggaucuuaggaauuaguucauaaagaacuucaggcucagagaagacaugugaguugccuaaggucacacagcaaaucugaagcaaaucagggcuagaaacccauagacgauggucaugagcacugguuuugagucauccauuugaacacaccuguguucagauucuaccucuguuacuuaugagcugauuucuuaccugugaaagugggauaccuacccaagggguucacgggaggauuuaauaagaugauuuggauuaggaaaaacugacaaauuuccccuuccuucuucucccugccuuccccucaccuguuaauaaauagauccuugugaaaggucagugagcagcaucagccagaagggcuuuguuuucagcaaggucccugcauguaugauuacaauccuaaguaauaucagcuguugcuugcguugguuucucagcucucucuuggugaucucucucuuuagcuguugaaugaguucaaagaucuaggaagagcuuugaaaccccucuagcagcauuucugucuccagucccagcacaggucuuuggaggaugagauaaaaaggguuuugcccagggucaaaugcuguguacacgcuuggucacucuucccuuucuugagaugacauguccccuucuuggagacccaagaugauugacaacaauaacauuccuuuacaacguuuucuucucaucuagagcacugggaggcugccuuuuaacagagauaucacagaguagcaagcaugcagacauucucaugacauccuggcagauaucaagaccaaagaacaucccauguucccucuugaaggcuuguaauaacugccauaaauuaucuugugggaauggaguggcccuggccuaagcugugcuguaccggacucuccuggugacaguuuuaguggcugcauauguuugcagaagaaggaagcgugguaacuuggcaaacagcuccaaacgcuccuggcuugcugccacaggauuguccuugagacuugggcacagugaugugugaaaaaugcccaccuuugcucuugguguccagugggccuucuaugggcccucuauagaggucaucaccuggggauuccugacucuggccagguccugaggucuuuccauguuacucuccauguuacuugaguaacauaagagcuucuuauggcucuuauguucugcaggacggaugaacuagguacccaggacaggucuguuugugcacaaggcugucuccuucucccccuccuugguuuuucuacugaggcuuuguugugcuuggcucagggugauguuagcaaaugcacucuccacccugcugugccacauuaaggaaacgcauguuguauuggcuucugccaagucagcucacaugcuuuguuuuagugacucugugaagagcucaucaucuauuauuuauucagguaacacacuucuaucuccuaauuucggugcuacucccauuuuucauccccgguuagcgugcugugcgccaggagggcugccuguugucuuuaagaaccacuuugaacauuuuugcuuugguuauuuauucauaccaacauguuguuguuaaaugacgugaaauaaaaccccauuuuaaaaagaaauuguaaaaggaagcuauguccuguguggaaaucaugacaagcccagaaacauguuacaaaaacauuaaccaggagcgguggcucacgccuauaaucccagaacuuugggaggccaaggugggcagaucacuugagaccaagaguuugagacuagcccggggaacauggugaagcccaucucaacuaaaaauacgaaaacuauccaggcauaauggugcaggccugugauuccagcuacucaggaggcugaggcaggaaaauugcuugaacccgggaggcagagguuacagugagccgauauugugccacuguacucuagccugggcaacggagcgagacuccaucucaaaaaaaaaaaaaaaaacaaaaaaaacccacacacaacaaaaaauaaauauugccuguaccuaucaccugaggagcccauuguuaaugguugugugucuuuuuagucuuuuaaaaaauguguuaaaaaauguaguugucauaauguccguauauaaauuuuuaaguggaguugauagauuucauuugaagggcugcugugucauaaauguaaaaugcuuagcaaggugcuuggcaccuggagcuguucacaguaaauggaaggaauuuuuauggaggguguaagguagagugggcuccugagccagacugcccuguuccaggccuggcucugcuauaucuggcugcuagagccucgagccagccauugaagugcagugccuucauuuccccaccuguaaaauggggguaauuaucauauaccccaaagugcugucauaaggauuuaaugaaauaucccauguaagauccuuagagcacugcugccggauggucaucucauaguagguauugguuguuauuauucaggaaaauguuggaaaacacauuuuuaaacaaagcugguguucaguccccucccuccccccaaccaaggaaacucucuuuaauucccagucugcugugauucagugcuggccugggagcagcccucgagggcagacacagcacuuguccccuacccagcacagcaccugccugugcauccuuagcugaugaaugaggcucacagccccaggcgcccugcauccuucccuucuuucugguacccucuuuugucuccuccaaacacuugcuacucaggcuucagggaggaaguaggaaguaggaggugguuucucccucccagacccccagcucacacuggucuugaagggcguggcaucugacagagcccgguggcugguuuucacgugucuccugaagccaccccuaaggagaaggcuucgaugucaucuucuggucagagccgagcacagugguccucuucagagacagauccgugcagcaggauggcaccucuguuguccucccagacuagcaguagguacacgugggcuucgcaggcuguuuucugcccuggaaugcugcuguuuuuuagacccagcauaccucagugucagagaaggcugguuuguuugaaacggucagaaugucauaaauaccuuaugau[450 bp omitted]cgaggaggaaggcggggcaauguuaggagccucugugccuuggagcugcaggcgaguugucuggucuugggugauucccuuccuauguuugcaucucaauuuucccucuuguaaaauggagcugagagcaucccuuauaucacaggaaugucauuaggauuacuuaagguguuggaauguuuccuggccuaggggaagagcucaguagaagcuugcuauugcccuaauaucauuacuaucccagauaugcauuuucuuguuauuucccuguuaggcguuaagugugugaaaguguguguguauauuuaaaaggucaaaguaaaauucuuuagaaccuuagggcaggauagcucuuguuuaguuagggguguuuggugacugcuggagaagucaccuacccagcugaucuuacaauuacugucugcuuaaaggcagcucuugacuuggccuucucuaggggaaaaacauguaguuuaugcaacuuuucuuuucccuuucugcucuggauuugaccuuuuguuccuucaggugauugaaaaaauucgaaaagucaccuguuuccucagaauugcuuuaagacaagacuaagugaaccaacaagaaugaagucagcuuuuuggaaauaccucccaagaggccuugcucuuuaugcaggacuguuauuucaaaggaugguguccccuccccaaccauaagaacgauccaaaccuguuuucuggggcccagaguuugcugaggauaggacugggcugaagcuuucauugcuggucugugggguagagguaagccuccccugugaagcugguagguuacaugcuuuggcaacaugaauuguuauuucuggaguccccugggugcuguuuagaaaugcagguagguggcugggugcgguggcucaugccuguaaucccagcauuuugggaggccaaggcaggcagauuacuugagcucaggaguucgagaccagccugggcaauauagugaaaccccaacucuacaaaaauacaaaaauuagccagggaugguggugcaugccuguaaucccagcuacucaguaggcugaggcaaaagaauugcuugaaccugggaggcggggguugcagugagccgacaucgcgccacugcacuccagccugggccacagagcaagauuucaucucaaaaaaaaaaaaaaaaaaaaaaagaaaaagaaaaaaagaaaugcagguaggugcuucuagcuacugcugugggauagcaagguaguuaccaaacugauaaggguagcaucuuacuuacugcugaaaaauucagugucuuuuuucuuuuuuuuugagacagagucuugcucuguugcccaggcuggagugcaguggcgagaucuuggcucacugcaacuucugccucuugggcucaagauauucucuugcuucagccucccaaggagcugggauuauaggcacucgcuaccacaccuggcuaauuuuuguauuuuuaguagagacaggguuucaccauguuggcuaggcuggucucaaacuccugaccucaggugauccacccaccucagccucccaaagugcugggauuacaggcgugaacuacugcgccgggcuugaguuugacuuuuugaaaauauuccaccuauaagugaaguugugcaguguuugucuuuauguguuuagcauauuucacucagcauaauguccuccaggcucugaugggcacuuggcuuguuuccaugucuuggcuauugugaauagugccgcaaugaacaugggcaaauugccguguugaguuaaggaagcucuuuuccagucugaguuugcaaauagcuuuucauauaugagcguugaauauuaucaaaugcuuuucugcauucacugagaugacuuuauguauuuaaaaaaaucugauggccuauauuuucuauuucuaaacuacucguguauuccugguauaaaucaacucaguguguuacucucguuuuuauacauagcuggauucguuuucacuaauauuuuguuugagauuuuugccucagugaucauguaugugauugcucuguaacuuuucauucacauuuuguccuugucuguccugguaucaaaguuauauuggcuucauagaaugagggaaauguuuauccuucuaaaaauauuuaguagaguggucuaagaugagaguguaagugaguaaacuuucucaaucaaauauuuugugauauguuucaggaauuucauuacauguuugguucaauuuuuaaagcauuucuuuuuauuauuuaaaacuuuuagcauuggugaccauccaugugcugcuuuuauugccagcuuaacuuguuuuuaugacaucuucaggaagaaaaccucugcugucuauuuaauggagaugaauuguuaaacuuuuaccauuugcaacuacacgucucuaugagucagacuuuuauugaucguguacaacuaaaugaaacccggaaaugaaggaaauguaacaagcgauuuuauguauuuuuuguuugcucaaauugccuuuauaaaauagauugauacucuauaauaagcaaauguugugaauuuggaauuuucaaauugaggcuuacuaauaauguuaacuauuuuauccgaguuuauuuggguuucuuauaaaauguaauuucucaagaagauuuugcugcccuaaaaaaaaaaaaaagaaaaagaaaaagacaaaaagggaagccacugguugcuaauggcuccugcggcucugacgauccucgaugaaguguucuuugauuaagugucaagaugaguggugcagaccuuugacagacacaugauugugguuggagaaagcccagcauuaacugcugaccuugccaucugugagcagguguugaaugagcucaguucccucccagcccuucuuuuucccuggugggucauuggcuccugaguaagauagaugcaugcaauagaagagcuguuaauagcauuuacucuuucuuaauccuuauuaaucccauucauauuucagugucugaaacuuggcaggaugucaagaagccacagugcaaguagggaaauugaacagcaaggaccaaguacaauguuccccugauauuuaauuugcuaaaacauguaagaagaagaaaguucuuacauuguuaggucccaaagagagugccacuaagcaaccuugccaaaaccaccuugcuggagcuucuuauuaucuuuuuuuagcgaauggcaauaaagucauuuugucaagcuaaccaaguaccauaaugagaucuuuguggcauaaauuaaccgaguggggaaauaacuuugacagggguugauguccgaaaugaaguguuguuugucugaugucaagccuguggggaauuugaaccuugcacucuuuccugauaagacauuaaccucugcaugggcuugcuggcccaaccuuuugauuaacuggaccuauuuucuuguagaucuaauacaaggauuuggagaaccccaguaaaaugcuggagggacuuagacucugaucucuauugggaugugucaaauuggagauuuggugggcuuuucugcuguguuuacugcgauggguguguguauuugaagucuguauguggccuuuaaggauguguuuggggcgcagaaguucuggguaacagagaggcucucaaacguuagauuuuggauuagacuuugggucaacuucaggguagcaagaggauggauacccgagaacauguuuucuccgacuuccuggccccugucuucuaaguucuggguagugaugggucuuuggaggggcagcccuuucugccaugugaaucuuugcccagcccugagggggugagggcuggccaagggagccgggccauggucggagagaaggcugaggcuccuugagaagcauuuggaguuugagucaguugugucuuuuaaaaaaauuacccauuuuggacuugccuguggaagcaauuagagagaucacaggaccguuucugauucccaauucuguccagugucuauucagaaaaauagaaaacagucaacuggaacaggggauuauuugagcacacacagaguccuguugucucagcagcgugcccucagacaauuugccuuuuagugaaguuuaagcccaugaaaggaaauaaaaaguguuuuauuagauggcaaagaaagauggacuggacuuaugagacuuugagaauuuuugcuuuuucuuuguuaaugcaaacuuuggaagagagcaacucuuucuguaaugcaauuuauuuguacaaugugguaguuauuguuaauagcuaauaaugaucuucaacuggguaaaauaccauuguguguuugagagggagagagagagagaaggguaggaggagagggagaauaucuuuuguucaaagccaaauguugcuacuucugaagacgagugcaccuuauggguauagccagcuauaauguuuaucaaacauauacuuuuuuuuuuuuuuuuugagauggaguuuuugcucugucacccaggcuggagugcaguggcaugaucucagcucacugcaaccuccaccucccagguucaagugauuucuccugccucagccucccucguagcugggauugcaggugcacgccaccacacccagcuaauuuuuguauuuuuaguagagacaggguuuugccauguuggccaggcuggucuugaacuccugaccucaggugauccacccaccucggccucugaaagugcugggauuauaggcaugagccaccaugcccugccucaagcaucuauuuugugcaagagcuugcagaaguucuuuccugccacagccgugguuggccacauugcucccccaugaauauguggaaacugacacuucaggagaauugguggcucacccauggcauucagcuaguggguuauggggcagagacucaaacucagcccugacucccacagcauuguucuuuuucuguaaauugcugacuuacucaguugaucacaguucauugccguuuacagaauuugucugcacccauugugccuuuuaagugucgauuuucuuuccugaaagcacacaaagcaaagcacggcucugcagugugacccaccgugugcuguguggacagaugaugcuggucagcaggcaggaaaacgaucugccaggcgcuggggguggggcagaggauuguucuuccugaccuugguaugaaaaccguauggaguucuuagugaggaaaaucacucuuagcccaaauuccugcgaaggccgaugggauuguuuuuaagauuuguuggauugcuggauuuguugaagggagaacuggaagaagcuaucagaaguuuacagggcaucggagggagacacucccuuuggccacuuucuccgccaaaacuauccugguuuuagcccaacaguuucccacgcccgcccccacccccacaaccuuguuuguuuaaagaccauuaaagaacgucuucaauuuauucuggauugaguuuuccucaaaccaaaccaccccucaguucaccccccagagcuguugaggcccuuccugggggcuuguggcuguggcugccucagaucagagcagacccugggcugcaucauccuuccacauugucucucuaaaguaccugaagccaguaguucucaaacuuuggagaggguuuugagucaccucgagagcugauaagaacagaggcccagauugaaguugaauagugcugggccuuuguuuuuaccaaguucccuggaugguucugcuaccuccuagccugugagaacuacuccuuugugauuucuugccauugaaauuuuuucucaccuucuucuuggcuugagugcucuucuggguuccuuccggcuguccaaaucaaauuuaauuuucacacccagaccuugucccugcucucauccuucagcccacccuccuguuccccauucagccagacccccugccagucaguucaagugcuaggcaugggguaucgagucucaggccgguccacagacauuccagcaccuggugguaagaggugagugcugcguggacccacugaggaaggcucuggcugugcugggggaggggaguuuaugcucguccucauagaaggauaagcaggaauuaagugggcaaaggagggagugaggaagcucucacuuucuagguaguaggaccagcaugaaccaagguaggggaugacaacauggcucauucagggaauuugagguauguugauacauggaaaaauguaccugaaaugugaguccugcuuuugugacucacccuuuccuuuacauaagcauugauuuacaucuguuguuuuuuaagauaguguguauguugaaaaguucagaacaagaucaaguggagacauaaaaugguaagaugugaaaaguuguucuugccagauuaaaugguuccaccugaagaaaauuuuuuuuuuuuuugagauggagucucacuuuguugcaugggcuggaguguaguggcgugaucucagcucacugcaaccuccgccucccggguucaagcaauucuccugccucagccucccgaguagcugggacuacagguauacacugccaagcccggcuaaguuuuuguauuuuaguagagacgggguuucaccguguugccccaggcuagucucaaacuccugagcucaggcaauccccagccucagccccccaaagugcuaggauuacaggcaugagccaccgcacccggccugaauuuuuuuuuguuuuguuuauuuauuucuugguuuugcuggccuuuaagcaacccaagacuagggggcuuucacuccgucccuagagagcucaaagggccugacuuaggggacacagucagugaaggggaugaaugaaugaguuucagauccagguguucuggauaagucacuuuaccuuucugggccuuuuuccucaacuccaaacagaggaugucgguauagacaaucccuaggaucuuguccccuuuaugacugaucacacaguuccacugcuugcccuugaggcuuugguguccgcgcaugccuauucagucugacccacaagaggccaggccagcucuguuccaggcccugaaaaucccauuaaaacuccacucacuagccuguucccugggggugcugaaucagcauuuaauggggaaggccacgagcuaggcucugguggguaggaagugugugacuucucuuaccucaacaguuucuacuguaacuagcgggauaagguaaaucuauggaaaugcaaggcuuaugccgaggcucacagagugggccaggcugcauaaguccuggacaccacagggccugcuuugagaaggcagcuguggucccacagccuugaccaccaggcaccauccucuguugccaguggacccacauuucaaaucauuuuaucucuuuuuuuuuuuuuuuuuuuuugagacggaguuucgcucugucgcccaggcuggagugcaguggcgcgaucucgacucacugcaagcuccgccucccggguucacgccauucuccugccucagccuccuguguagcugggacuacaggcacgcgccaccaugcccggcuaauuuuuguauuuuuaguagagacgggguuucaccguguuagccaggauggucccgaucuccugaccucgugauccgcccgucucggccucccaaagugcugggauuacaggcgugagccaccgcgcccggccuuuaucucuuaaauaaccuguauucauuuguuccuucccaugucuuauccaccaaaaaucuccaauuggaaauucagacaaggauugagacccuguguucuuaaauuggguugauugaaaucuagaaacaaugauaguaauaacagaguuaucuucucucgaacaucugccuccugccugauguuauuucgcuuaauucucucaagggcuugaggagaguccugccauaauccuuccuuucagaggggaagaucgaaauuuagcucagaucucaagcuaguaaucaucagaaccaggauauagaaucaggacuagaccacauggucccugcucugagcugcugcggguccaucccuguggcucuguccaggguaaauggaugauucaggggaagggucagcaaacuauagcccaugggccaaaugcagccacugcuuguuuuuggguggcccaagagccaagaauaguuuccacauuuuuaaauggguggagaaaacaaaaucuacaaagaauaauguuucaugacacaugaaaauuauguaaaauauacauuuaacgcuuguaaguaaaguucuguuggaacucagcuacagucguuaguuuacauaucaucgauggcugguuucgcaguacaagggcacaguuuaaagccugccaggccuaaaauguuuacugucuggccuauuacagaagacguuugcugaccccugauuuagggcauucaugaggcuugaugagauguugaaaaucagcugucuccucccgucacucucuucugauuguggguaggcucuggugcaccagcucuccagugaucuccuaucugaugcucagaguucuuuuuccauugcauggaugucaaauaaaagugucugcuuuguggcauuucuggcuugagaguaccugcccaaugugauuugccaaggugccauuuuaucaaaagucuuaggaugacuggauggguuugccuugaauuuguuuugccuuugcugaugguuguauuuagguuaucauugaaagaggauugcagaacagcggcaguuuccugugcugucuggauugaaguugaauaaugcccuaacuuuuaauugaaagggacuguuguaggcgggagacugucuaagagcugaccugucaccaccaccugagaugucugagcccacccuuggacuuucuuggcacguggggaagagggggccuggguccugggcucccaccuaaacucagcagaccccacuggcagguguguguugugggggugauggaggcuuuuuggagggcauugagcuccuuggguggaggugggguggcugccuugggggcucagugcagcucuggccaugauggacagaaggagacaagaauguagcuucuuguucugagaacuucagcccaaguuccuccuuucaugcagcagaauccaagacacugacuugccccucucugcuguugaggcuucuguguugcagagauaccuucuggcccugcuuuauccuagugaggcagcucaccucucccguguuucacugcucgaacucuccuucccaaggcugugcuagugguagugaugacaauaauagcuacuauuuauugugugccccucguaugcuaagugcuucacguagauuauauaauuuaauacuugucacaacagucuuaugagguaaauacuguauauauauuuaaaaagacuauuuuuagagcaguuuuagguucacagcaaaauguagaggaaguuucacagagauaucccaagcaccccuugccauuuucucuuaguuaugaaaaugaucaaaugggcuggguguggucccagcacuuugggaggccaaggcggguggaucaccggaggucaggaguuugagaccagccuagccaacauggugaaacccugucucuacuaaauacaaaaaauuagcuggguguaguggcacaugccuauaaucccagcuauuugggaggcugaggcaggagaauuguuugaaccugggagguggagguugcagugagccgagauugcgccauugcacuacagccuaggcaacaagagcaaaacucugucucaaaaagaaaaaaaaaaaaaaaaagaucaaauagacuuccaagugcccaugucucagguucaguacugaucagcauuuuacccuccuuugcuucagcucccuccugucauugcucauugcugagaguggguaaggggcuuucucagguuccuguagcugguaggaucccgcuguccucaaaguuccugcacucaguggcugacggugccaggugacucccccuuuugggguccaugacauuugcugcuguuucuaaagccccuacugugugcugcuaauccccucaccaagcuugcagagcggaugguaacugacaggugaaaaaaugcaagaaguuaggucacggguccggggacauccugcuaauaggugguggugccaggcuucaaacucaggccugacuucaagucccgcagcuucucugccccacccugucucuguccuccucaccucuguaguguggugggacucggugggguggucguuugacugugggaacuucuguuugcaaagccuuggaaggacccaggugacugcagauaguuccgugagaagcaucugggacuguugaccucacugcugaucuuccuugugagccugugauagggcuaacccuuggcuuucuggccagaguguagacagagacccgauuagcauuuuguggucagucagaggcaguuugugaaccuggaacuuggaagcugguuuccuccucugggagggauguggagccuggggagccaggaaggcauggacugaauauacacccagcugggcaguggggaagggaggauuccguggggagcuagcccugaacacagcaagcauuugguaaauggugccuguuagcuguuuuuauccguauucuaagguggacgagcggcgcaggagagaacugguaggauuaauggagugguuucauuauucagauuuaagugcaugcagccagaagucuucaacugaagaauugaaacucucugcucuuuuuugggggucaugguggcagugugaggggcugguucaugagugaggagaaaagguaguggcaggcagaaugguacauuuuauauucauauugugcacauuauucacaccugacaugggccagaaauccucuccuaagagagacacuuggaaaguaaacaguuuguuaaucauuucaacccguggacuuugguugcagggugcauuuugaucaaggguuacaaacaccaaugucuucagggacauuuggggacauaaauaaagggaauggacaaaaagauggaaaagcauacugccucucagucuuucgcaugcucauguuugauagagaaaaucaacaucgugggggcaguguugcuuggcaacugccauuuguccucagcguuggggugacauuacuagggaauggcugugaacuccaagcacuuccccccgggaagcgaggcugacacucagauccaauucaugucuuuaauguggccaaaugagaaagccagauguauuucugagaagccaaaaaacaagauuuaaaaaaugcuaucucccuaauuuuuuuuuuugagacagaguuuugcucuuguugcccaggcuggaggacaguggugcgaucuuggcucacugcaaccucugccucccagguucaagcgauucuccugcgucagccucccgaguagcuaggauuacaggccaccaugcccagcuaauuuuuguauauauauuuuuuucaguagagacgggguuucaccauguuacaggccaggcuggucuugaacucccuugaacucaggugauccaccugccucagccucuaaaagugcugggauuacaagugugagccacugcaccuggcuucuaucucccuaauuuuuaaauacuuaagauuuuaagaaacaucacaggucaagcaaugcauggcagugggcuagauucagacaggggagccucaauuuaggacccccagauuuaucauacaagguggaggaaggguucagauagggacuuggggauugccaacucugacccucucuucagaugaagagauuagcccuguggaggaguccaggauuuguauuuuagucuugguacuggguguucuggguugaguugcuagaccauucugggacaaguugcuagaccauucugggacuuacuuucuuccuccauaaagucaaaggguagguagaucacacauuuuuaaagugugcuccuugaggugugucagggguuccauaagcauuugcuuucaguuuuauuaaaagcagccuguacucucaaauuugaguauauuugaaauuguaaugagagcaguugcucaggauggagugugguggcucaugccugccccacacuuuggaaaccugagguggaggaaaccuucaggccaggaguuugagaccagccagggaaguauagggagaccccauuucuacaaaaaacaaaaauauuagcuggguauagugggacacauguguaguuugaacuacucggaaggcugaggcugggggaucgcuugagcccaggaguuuaaggcugcagugagcuaugauugugccauuguacucuggccugggccacagagugagauccugucucaaaaaaacaaaaaacaaaacaaaaacaaauuaaaaaacaaaacaaaccaaaaaaaccaaccaacacauuugcccaaauagugaaucacaucaaauuuuaaaauucgcuggaaacuaucugcuucuuaauuugauuauacaucaauuauguucaaaguaaaaaacaagguaauuugaaacagcugcuuuuauccagguguauacacgguguauacauacacagauauguaugaaauguggaacucuauacccguauguauggaguuccuccuaagagucuuuuugagaaaauaguuccauugcuaaaaauacccaauggaaacuucuggccugggauuuccaaguucacccucggcugugcgucucaaaguccacacagccucaccaaaauagcccuucuggguacuuuuuucuguguguucuuggaggaggccaucgugccuccagcucccuaaggcggaagaugagccagcggggaucuuugcagggugguugguucucguuccuuccaccgaagccuuccauggcauuuuugggaccuggaauugugaauuauucugccucuuccccacagucccugaugacagcaugaaguucagagaguuuauuugcagaugaggcagggaagccggccuguucucaucuugcugugccugaugccuugugcuuggggcacuguucacugugcugccugcuggccugcuugucucugccuuuuggaugggagauaggccaccccacagugccacaccugccuucagggaagcuuuuggguguuccuugucuggcuucuggguucagugggagggcccacccagccugucauuuuaaugauuuaccuuagaggagccaguuuuauagggaguuguuggauaaucuucacaaggcagauaaaugggagagcaggaagaaugauggccuuucagaguugaaaucugugcugcuccaaaucccauaaacugcuauuugauuuuaaacauugcuugaagcgguucacauuuugguuaauuacgucaguggguaaaaauaacuauugucauauggugugugggcuuggcuuuagaaggauaaagagucuauuguuacccauugugcuauucagucacuuauuacccauccuuaaaagcccaacguggauaacagaaaaccuggagagcuuugucacuugcugaaauccaagcugcccugugaauuuauccccaaacacugcuccuuuugagaaacuuguacaagcugccuuaauuuagucaauucaaauggguugaugggggcuguucccaaggcccaggacaggcagggguuugugaccugcagcccuggaacugccuuuggguuucauggucucaguugagaccugcccaggguugaaccagcuuagugcucccugggggugguuaaguucaaggacuucaggguccgauugaccuugggcugaaucuugaccuggggcuguaagaugcucggucaggaccuuaacuuuuccaaggcucggugucuacaucuggaaaauggggauaaacacaguuccucccugcugggauuauuguaaggcuugaaugagaugauaaauacaacaucugacuugcgacuggacgguagcaaaggguuuaguuaauauuauaauaaguagaauggaacagcauuagauucucacacagggucacuauguuguuuucucccauucuaccccugcauauuacccugaagcacccccaagccucucccuccccaucccucaagccccucccuccccaucccccaagcucaccagguccuggcgcacccagaucuuucacugcuuuucuugccugugagcucuuggggagucaggaccaccuuaagcacccucugcaucuuuggcaccuaaccuggggccuggggcccugcagggccacaauuagcagcauggacaacagcauggacggagagggucucagagccuggagagcuccuaggggcuggagcagucacaggaagucaccaagugaauugaagggugguggcuuuggagguucagugaggcaagaagaaggcuguuaggcugggaauuaaggaaccuuguguuguucgagucucaggacaacucagauauggggucuguauugcaaaugccccugcgucauuuuacaacugaugaaaacaauggcuccacgagacccucaagugccagagcucaugagugacaguggaaguugaacuaaccuuuuaaccacccuaguccacaccugucaggcugacgggcuuucaguggugauguguugggagcucugugccgcagaucucugugugcuccugagacucugcccgccugucucuacccugcugugcccacuaggaggaggcugaccuuuauguucuacaccagugggugcccuuggucuccagcuuccagugggccagucuggcgagagacccuagcuggagaugaggggagguagccuuggccucucuccuugcccuuccucgcugcugcuaccccaggauucuugcccaucccuuacugguuuuccuuaaccccacccucacccuugaaaacagacucuuuaaaacucuccucacucacccucauugagugugucaucugcuccagcuaggauauuggcuaauaccgcauguuucagaaagaaaaauucgcaguucuauuuauuuuuuuacuguggauugaagggagaggcaaccagguauauggaugaaggaguagggccuggcugucaccacugguguucacaaaaggcucccguuuaaguccucuuauauuccaaaugagggguuauaggucgagucagggcguugcucuaacagaagcaaaaccaaaaauacacggccguagauacaacccuguucugguacuuccuaauuuuguguguacaugugugcaccuggagcuucaagaaaugaaaauggaaauggccugaguguuucucagcccuaggaugaggcuguuucugugauuuagggcuggagguuaugaagacuugguuuacaauaugcacaguacagaagcggggaagucaaggugugcugggcaaggaaacaucuuuaugugacccacaaagagugaagcagagggaagaaccagaaguuauucugguuugcagacugggagacagguuuaaugacacagucaugucagagagaggggaagaggagaauacguagggggucuguuuugauguguauguacauguaggauuuucauguagaggaguuggggaaaauuuuagaaguuuuagguguaaaugcagcugguaagauccuuaugacuuaguuucuuuuuuuucuucuuuucuuuucuuucuuucuuucuuuuuuuuuuuuuuuuuuuuuuuaagacagagucucacucuguugcccaggcuggagugcaguggcgcgaucucagcucacugcaaccuccgucuccccaguucaagcaauucuccugccucagccucccagagugcugggauuacaggugcaugcaaccacaccuggcuaauuuuuguauuuuuaguagaguugggguuucaccauguuggccaggcuggucuggaacuccugaccucaggugauccaccugccuuggccucacaaagugcugggauuacaagugugagccacugcucccggccuuaguuuuugagugggaagaaucuaguguucagaguggaccacugaugucauagcugcagguuuggcugaauugggauggugcagaaagccguguuaaccauuucuuuuucucugaggccuggaggaggauccuugugacuggaaccacaguugggacuggcagugguuuuuccugcuggcaaggaaaaaaaaaaagagaaaagaaagaguucgacuuaucagcacaaagaaaggaggaugugaaacuagaaccaucucuagggcaguucuagcaaugaacaaggcuggaaggcucaccggcgagggguuuccccucaggaaaggggacagagaagcuuccaccuccuggguagcauuggguguuccugggcacaucugggugacuaacggguuuucugccacacaacugggguauauagggaagucuuuggccagaacugugggccguacugcauucuucccgugucugucacugcugagucgugagcuugaucucuuuucuuaguguuugcuccuuuuguccagcuaugggggccagcagaagcuuugggucaucuguaccagugacuuugcugugaagauguaagggagagugguugaggucaagaucuggguucugguucuugugccuccucucuggcuguguguccuucaacaagcugcuuacugucucugggccuccgugcccucugcaacuggguuguuggucuauuuaaauacuuggagaaaaaagcugggcaugguggcucaugccuguaaucccagcacuuugggaagccaaggugggaggauugcuugagcccaggagcuucugaccaaucugggcaacaaagugagaugcuguccccauacagaaauaaaaaaauuagcugggcaugguggugcaugccuguagucccagcuacuugggaggcuuaggugagaggaucgcuugagcaugugggaucaaggaugcagugagcugugauugcaccacugcacuccagccugugacagagugagaccuugucucuuaagaaaaaaguuauucaaaaaauacuuuggaaaacaaugcuggggagaguaugagcuucagauugcacauugguuucuaucaggaggaucugagccucggugguguuaccuguaaaauggggauaaaaauaccucacaggguugcagugaagauguaaggaugaugaugaugacaacagcagcucaaauagaucauuuaacuuaauucucgccaaagcaaggcagguacaaagaucauccuguuggcagauacagacagggagggacagagagguuaauuaagcaagcuaccugcccgcaguuacauggccagaagcaguggcacugaacgacuuccuucaggcggucugaguccaggucucagcucuuagccaucacuccaugguucugugcugagacaagggauguagaaagcccagcacagugucuguuacauaguaggugcuuaguaaguuagaguuccuuuuuauccucagaaugcguuugcaaguauagccucccacagugcuuuuacuuuaaucuuuccccuuacugggcaaaaaaauguuugcugcccugugcgacuugccuagcuauugacuucucuuuuuucugccucucuccuaugauccauccuagacuguggauugaggcucagccuagauuaaagggcaggggcuggaggaggaagaugagcugaaaaaggguaggccugaggcgcgaaggaguugaugguaggguggaaggugggaaugggaaguuugagaauuggaggaccugggggcaagacuuucccccucugggcucguucuuuccuuccugugccguuuauugagugccuacuggguccaccauucuaggcauggggcacagacaagaucucuguucucauggagcacacagugugguuggaggagucagugauggacagagagugagggguguugguuuccauggcugcucggagaaggacuugcugaggagguggcguuuugggcaggccaugaaaaggucugggcagaguguguuugugggagggaauaaauauguaaaggcucuaggggagaaucaguuucgagaaugugagggggcagugagaccagaggggcuagugggcuguggcugaguuugaauuuuauucuaagugucauggaaaguaggaggacgguuuuuuccaccaggguccuuuuugauuauuuuauucuucgugacgauccuacuuaaaaaaaaaaaucuuauucaccaaaaagguguguuugugaaacaauagaguguacaaccuugaaucacuuuagauuuuuaaaguauagggaaacaauuauggaucacaaugaauauccuugagggcugcuccccuccccagcugacacugucagcuaaaccuuuaaggccucuugugugucaagcauuaauucuucccaaagcugcuugacaugugauuaaaaauuuuuacugccaccuacugauggaaagaagaagaugaauuuuuguacaaugaaaaucccaaacacaguggauuucugguuuccacugugcugucaggacugggaaaugggucuggggaaggggugugcugggcuugguaucccccccacccaacccccuuuuuuuggcccugacaaucuggucucugcuucuguguccuucugcuucagcucaucgcacaguggguggagggaggugcugaccuggggaguugcuccggggagagggcuggagguggggggaugugucuggggagaaacacugggcacugggagucagcagccgccagcccccacauaacccaguuaauccuuuguaauugaccccgagguugcaaugauucccuguguuuaaugucccaagacggccuaacccugaccagcagaccuuugcuuaaugugcuucuuaccaccccacccccauuauuaaauccucaacugcuuuauuucugauuugcauuuuccauggcugaaugaaucugcugacuuccguuuucuuuuucuguuucagauccugugcgcagguggcagugaguacccuuuuccucucuauucuuguguuguucgcuacugcccccuaauggacacacagcaacauuaacagcaaugugaaaugcuaauuuauuaaaaccugcucgguuuccaauuuuucuuuuucuuuuucuuuucuuuuuuuuugaguuggagccucgcucuguagcccaggcuggagugcaguggugccaucucggcucacugcaaccuccgccucccggguucaagugauucuccugccucagccuagcaaguagcugggauuacaggcacgugccaccauguccggcuaauuuuuuguauuuuuaguagagacggggcuuccccauguuggucuugaacuccugaccucaggugauccgcccgccuuggccucccaaagcgcugggauuacaggcgcgagccaccacgcccggccccaauuuuucuuuagaaguaggagugaggguggaaacaacaaaugaaagaaaaaauuuuaauuaauugugcaaucaugaugaaaauuuauauuuucuguaauuuuuuucuagccucaucugugggcgauuuaacuuaguugaaauuguaauacauuauuuguauauuguuuaugugcuguuauccuuuaaguauuuucuuguguugcuacauugcccuuuuguugcuacauugcuacauuuaaagaaugggguggaagaucgucauaaccuuuggaaaaugagaccuggacucccgcauguuuugcuuucaugcacagggcugagucccaacugcugacagugcugguucauucccugguaauaaaaugagaaaaauaaggauaugacuagaaguuuuuuaaggaagcuuaaauauauucaguugaaagcaccauccaucccuggauuauguccuuacuaauuuuuuggucauaaaacauuucuauaagaauugaaggccgggccugguggcucaugccuguaaucccagcacuuugggaggcugaggcagguggaucaccugaauucaggaguucgagaacagcuuggccaacauggugaaacaccaucuguacuaaaaauaccaaaaaaauuagccaggugugguggcaugcaccuguaaucccagcuacuugggaggcugaggcaggagaaucgcuugagccugagagguggaggcugcagugagccgagaucacuccauugcacuccagccugggcaacaagagugaaacuccaucucaaaaaaaaaaaaaaaaaaaaaaaauuaaaaauaauaguaguugguaguuuuuuaaaaaauguaccuuuuaggaaaaaaaaaaaaaaccaugguuuuuguuucuccccaaaauuugggaacuuuuuuuuuccugauugguaaaaucucaguuugugagauaaaauaauuagauuguacucauggaagcauauaugggcagaucuugcugaaaucuucuaauaaagcaaaucucaauuaauaaugguaauuagagccugugcaaacaaugggaagaguacugccguugguuuuucuuccuguuaauuaguuuaauaaauaaacugguggguaccuuguacaggcuugaaucacugcugcagaagaacacuucuauucaaacaucuaccguagguaguagaauugcgggaaacagaaaucaugagcuauuuuaacugaaaggauuuacccugggaagugagaguuuacagagucauuggaagggccgcuguauuaguuugccagggcugcuguaauaagaucaaggucuuggggguuaggacuucaacauaugaauuuggggguggcggagcacaagucagcucauaacagcuggggaggaggcuuuaggccuggcccugagaaauuacucccagacuaaggcugcagaacugacccccuagagagucaccaccuuggucauagacagcaagcagagagggaggaaucaggaagucccugcuguaguugcuggauccagcggugaauguucugagcugugauccugggaucaggaagcugcagccacugccacaguguugguucuagagccaggcagcaugagauccagucaucgcauccacacuacagcuauaagaaggaggaagggcagaagguugugcuccacccuuuaaggacacuugcuagaagucagacagaacgucuggucacacucuguuugacagaaguuagucacaugcaacaucuagcugcaugggaggcugggaaauguggucuuuguucccaacagcuaugcauauacagggccaaaaaucuccaggaguaugaugaagggaaaaugggggaauggaguuugggggucaagaguggucucugcugcaccucccugaacagagacucuaggagacuaguaaugaauucaagauaaagcagccaguguggccaagguucuccuucagugccugagcucuuggccauaggagcucacgccuccucuccuuuccugugaaugacugugugcaguguaagcauggagcuucugcacucucguggccagguacucuccauguggccagaaauggcaguuucugaggggcucauguuguaggugaugauacaaagaagagaaagagagggaucaguuuuuccaagugugcauuucauuucaguguaaauauuuugugagguggggcaucccugucuccuggagaaauauauuuuuaaucuaauuguuuacuuucuuugcauagccccuaguccaauuccugacccuucaguagcaacuguugccacaggggaaaauggcauaacgcagaucagcaguacagcagaauccuuucauaaacagaauggaacuggaacaccucagguggaaacaaacaccagugaggauggugaaagcucuggagccaacgauaguuuaagaacaccugaacaaggaucuaaugggacugauggggcaucucaaaaaacucccaguagcacugguaagcauaggcuuuucugccagucauguuucuuaaaggaaaucgguagaauuuauaaaugucauguuuuccaaauacuguucuucuuuuaauuaccuaagaaaaucuuuuuaaaaauuuuuauaaagauaguaaugcauauucauuauauaaaacauagacaagaaaagaauaacaaguaaaucauuaacuggagauaaccauugaucacuugauauacgaguuuuauaauuuuaagauauaugcaugccugugugcauauguauauacauauauauguuuuauuuuguuuuacaaauaucaaggucauccuuuacauguagcuucucaccaauauauuacaaauauucuucccuguuaguauauacauuucuacaggacaguuuuaauaccugccuggcauucuauuuucuaaaucaggguuggcagauaauaaugguccuugggccaaauauagaucacuuucuguuuuuguaaguaaaguuuuauugagucugccuauggcugcuuucaugcuagaauugaguaguggcaauggagaauuuguggcuuguaaagccugaaauauuuauucuguggcccuuacagaaaaacauugcugauaccuggguuagauaauugauucuaaaacugugguucagagaucucuaggggucuccuagauucuuucaagguauuucuggguauuguuuucauaauacuacuaacauguuauuuggcuucuuuacucucauuuuaucaugaguguacaguggagucuugcagauucuauaugauuugggaugacacugucacucuuacagcuaauggaauguaugcuuucauauuguuuaaaaaacuuuaucuuuuuuauuucuaauacaguaugguaaauauuaaucaauauaacccauauaaacaaaaauucuccgggagccuuaauaauuuuuaagaaguuaaaagggcccugagaccacaguguuuaagaauuacuugucuaaaagcauuguaaauuauuuaacugcuccccuguuguugggaagguagauuauuuauuuauaauuuuucauaaaaaacauugugauacaauaguuuuguuaguucuagaaguauugauaaaaucacauacacaguuaaaauaagucauugaauuauuucuaggguaauaugagaaacuuuuagaaauuccuaaggggcugggcacaguggcucaugccuguaaucacagcacuuugggaggcuaaggugggugaucaccugaggucaggaguucaaggccagccuggccaacauggcaaaaccccgucucuguuaaaaauacaaaaauuagccggguguggucaugcaugccuguaaucccagcuacucgggaggcugaggcaggagaauugcuugaacccaggaggcagagguugcagugaguggagauggugccacugcacucccgacagagugagacucugucucaaaaaaaaaaaaaaaaaaaaaaaaaaaaagaaaaauuccuagcaagcuuauguuaauuauuguuacaaaaauuugggcuuagagguugggaccauaccagauggucuucccagaaaucacuggacaggcuuacuguugaagggcauuuccagaggaagccaaucuacaaugauuggaauaagaaccuacuucuucaaauauacagacaucaacacagagucacaaggaucaagaauaaucagggaaacgugauauuaccagagaaacaaaauaaagugcaagugguugaccauaaagagaugggagauguaugaacugucugacagagaauucaaaauacauguuuuaaggaagccuagcaaacuuuaagaaaauacagauaaagaauucaaagaaaugaggaaaacaauaagugacuagauugagauauuuaacagagaagcaaacagaaauucugaagcuaaaaaauacuuugaacaaaaugaaaaauguaauagagagcaccaagaguagaacugaucaaguagaagaaauaauccuugaacuugaagacagauuauuugaaaauauacagaggaggaaaaauaaaaaaguggauaaaaaggaaugaagaaugccuauaggauuuaugcaacagcaucaaaagacgugguauuugaauuggaguucaucuaggggaagagaaagauaaagagguagaaagcuuauuuaaagaaauaguagcagaaaacucuccaaaccuggagaaagauauaaauauccagguacaggaaggacaaaugacuccaaucagagucaauucaaacaagacuacuccagaacauaaucacacugucaaacaucacagacaauggggauuuggaaagcaaaaagagaaaagaagcaaauaacauguaagggagcuccacuucagcuagcagcagacuucucagcagaaacuuacaggccaggagagagugggaugauauauucaccaugcugagggaaaacaaccugccaaccaagauugcuauacccagcagaacuggccaucaaaaaugaaggcaagauaaaagacuuuaccagagaaacaaaagcugagggaguucaucaccacuagacaugucuuauaagaaaugcuaaagagaguuuuuaagcugaaagaaaaggacacuagugauuaauugaaaacauaugaaaggauaagacuaguaaaauaaauacacagucaaauucagaauacaugaauacuguaauggucauacauaucuuuaauaugaaaguuaaaagauaauacuuaaaaaauaauaacuacaauaacuugcaggggggauaugcaauauaaaaagauguaaauggugacauaaacaauucauaauaugaguggggaauggacuagaaguguagaggucaauuugugugugugaucaaaguugucaucagcauaaaauaaccuguuauaacuauaagauucuuuuuauaagccucaugguaaccacaaagaagaaccuuuaguagauacacaaaaaauaaaaagcaaggaaucaaaacauacuacuagagaauaucacuuaaccucaaaggaagauaguaagagaggacggaaggaacaaagagucuauaaaacaaccaaauggcaguaguaaguucuuaccuaucaauaauaaccuugaaaguaaaggguuuaaauucuccaaucaaaagacauagagugcgugaauggguuaaaaaaaaaaaccgaucucaauaguaugcugucuacaagagacucaccucaccugcaaggacaugccuagacugaaagugaagggauggaaaaagauacuccaugcuaauggaaaucuaaagaguggcaggaguagcuauacuuaugucagauaaaauagacuuuaaguucaaaacuuuuaauggagacaacaaacaucauuuuauaaugauaaagggaucaauucaucaagaggucuuaacaauuauaaauauauaugcacccagcauuggaaugccuaaauauauaaagcaaauauuaauggaucugaauggacagauugacugcaaugcauucauaguagaggacuuccaccaccuuacuuccagcaauggacaaugauccagacaggaaaucaauaaggaagcaucagacuuaaacuacaguuuagaccaaauggauguaucagacauauacagaacauuccauccaacagcuguagaauacacacuuuucaacugcaccuggaacauucuccagguagaucauauguuagaccacaaaacaaguguuaacagauuuaagaagugugaaaucauaucaaguaucuuuucugaugauggcaucaaacuagaaauaaauaacaggaggaacuuaagaaaauucacagauauauggaaauuaaacaacaugcuccugaauaacuaauggguugaugaugaaauuaaaagggaaacuaaaaaauaucuugagacaaacaucacuucuuaagcaauuuuguuaacauauuucuuuuucuucuuuaaaauggugccauaaccuccuucaugaaauugcugugagacauaaauuagaaaaugcuuguacagccccugguauaggaucuguccccaggucacuuacagcagguccccagcaggggucaugcugaucuugccaucucccacaguaacuauuguuaauuguuuugucacaaaugccccugaacaaucaaugggucagugaagaaauuaaaagggacauuuaaaaauuucuugaagcaaaugaaaauggaaacacaauauacuaaagccuaugggauacaccaaaagcagcccuuccaagaaaguugacagcaauaaacuccuacaucaaaaaagaaagcucccugggcacaguggcucgugccuguaaucccagaacuuugggaggccgagaugggcggaucacuugaggucaggaguucgagaccagccuggccaacauggugaaaccccgucucuacuaaaaauacaaaaauuagcuggguguagugacacacaccuguaaucccagcuacuaggaaggcugaggcaggagaauugcuugaacccagagggcagagauugcagugagccgagaucgcaccacugcacuccagccugggcaacagagcaagauucugucucaaaaaaaaaaaaaaaaaaaaaaaaaaaaaaaaaaagcaagcucauaccuccagccuggguuuugagagccugucugaaaaaaacaaaacaaaacccucaaguaaauaaccuaauguagcacguuaaggaacuagaaaaauaagaacaaacuaaucuucaaauuaguaaaaggaacaaaauaauaaaggucaaagcugaaauaaaugaaauaggcacuagaaaaacaauagaaaagaucaauaaacuaaguuguuuuuuugaaaacaaagaacauugacaaagcuuuagcuagacuaagaaaaaagagacgcuacucaaauaagaaaaucagaaaugagacauuauaaacugauaccacagaaauacaaaggaacaauuaugaacaauuauaugccaacaaauuggauaaccuagaagaaauggauaaauuccuugccauauaccauuuacuaugauugaauuaugaagaaauagaaaaucugaauaauccaauaaugaguuaggagauugaaucaguaauagaccaucucccauuucuauuuauuacuguuguuauucuaagagacagugacucccucugucacccaggcuggaguacaguggugugaucauagaucacuguaaguugaacuccugggcugaaaugauccuucugccuuagccucucaaguagcuguggcuauuggugugcaccacuacauccagcuaacuuuuaaaauuuuuuuguagagauggggucucacuguguugcccaggcugcucuugaacucccagccucaagugacccccaccaccuuggccucccgaagugcugagauuacaggugugagccacccaguccucugccaaaccuuuaaagaagaucuaaugacaguucuucucaauugcuuccaaaaauugaggaggagagaauacuuccaaacucauuuaacaagagcaguauuaccuugauacgaaaaccagacaaggauacaacccaaaacacuauaggccaagaugcaaaaaucuuuaaccaaauacuagcaaaccuaauuuaacagcauauuaaagagaucauucaccaugaucaacugggauucuuccuagaaauacaaaaaggguucaaccugugcaaaacaauaaaugugcuacaccauauuaacagaauggaggacagaaaccauacaaucauuucaguagaugcagaaaaaacauuugaccaaaaaauauuguuaacugugcuuucuuuucugaacuuaagaacuugcuuuuccaaaaccuucccagaaucccuguaugaaucaacaaaauuuaguucuuaacacauuucuccuucuuuaaaauggugacauuagcugggcaugauggugugugccuuuaaucccagcuacuugggaggcugaggcaggagaaucgccugaacccgggaggcagagguugcagugagccaagaucacgccacuacacuccagucugggugacgagcaagacuucgucucaaaaaaaaaaaaaaaaaaaaaagaaauaauggugccauaccuuucucaugaaguuguugugaggcauaaaugagaacauacuuguacagcaucugggacauggacggccucucaaaaggagugcugcuguucuugcuaccugcaccacuguaacugauguuguuucaucauccucgucaccaucauuguuauugauuguaaauggaagcacaguggucaucuuccaaauaugccacucugacucugugaacuugucacuuuauaaagaggaaauucaagcuuggaggggccuucuggcaugacguuuauugaauuguggggcacaagaugcuucccugcuuguuccauuuuccuuucucuuguuuauucuccugccuuauuuauuuauuuuuucuuuugagacagagucuugcucuguugcccaggcuggagugcaguggugugaucuugguucacugcaaacucugccuccuggguucaagugauucuccugccucagcuucccgaguagcugggaucacagguggcugccaccaugcccaauuaauuuuuguauuuuugguagagacgggguuucaccauguuggccaggcuggugucgaacuccugaccucaagugaucugaucugccugccucagccucccaaagugcugggauuacaggcaugagccagugugccuggcuuccugcaguuuuuuuauugauuggaugaauguuuguauaucccaugagccagaugaggcacacuguccaugcacauagcaagaugguaacacuuacaccaucuuuacucuuuugggauuagucccaagcuccuugagaaugacugccguaucaccuggguuuuacucuucgguuucugguuguuacuccucagucuucagcucaauuaggaugcauccauuugguaguuuuacaguuaguaacccugauggcuuccacugguuuacgaucuuguacaucuaagaugaugaaacuaagguucagagaggugagaugacuuugaguaaaauugcauggugagcaacuagcagaauuggacccugaaaccagauuucuaauguccaaaucuugucccuuguuuaucauaucauggugguucaauaauaauucuucguguuuagugugguguacuagagcuaucaacagagaaacuugagacugagagguuugaagggacuaauucuaggucacacagcuaauggauggagcaggucuuuaaucccagaucuggguuccaagaccaguccuuuucucuuuacgcugcucugucccugcuaucuuuaugucagaaaaccacugagcuuccuucuagaugucaggguuuggcaaaaaaguuaucaugugcuucugcgucaugcagcguuuucugagaauggggagagggacucauuuugcaucuuugaucucucuuuuuuauuuugagauggagucucggucuugucgcccaggcuggagugcaguggcgcgaucuuggcucacugcaaccuccaccucccggguucaagugauucuacugccucagccucccgaguagcuaggauuacaggugacugccaccacacccagcuaauuuuuuuuuguuuuuuuuguuuuuuuaguagaggugggguuucaccauguuggccaggguggucuugaacuccugaccucaggugauccacccgccuugaccuccuaaaguuuggucucuuuuuguaucagcuucuauacagacuuaaccccauuuuuaagucacagccagcauggucaacuucugucaguuuugcuucuguuccaaaggcuucuguuuuacuaacauacacacauacauguaugcauauggauuuaaauaaauucuggugcagggaagucuaggaggcaaagagagauaaaacucugugauuggaaagucacuucuggaaacuagacauauagagcagaccucacucuuacauuucuuuuugaagugcaauaauuuuuuuuuuuuuuuuaacaauauagggcccaguccuguguuugacauuaaagcuguuuccaucaguccaaccaaugugaucuuaacuuggaaaaguaaugacacagcugcuucugaguacaaguauguaguaaagcauaagauggaaaaugagaagacaauuacuguugugcaucaaccaugguguaacaucacaggcuuacguccagcgacuucauauguauucuccaucacuccaggaauaggcaaugagacuuggggagaucccagagucauaaaagucaucacagguaagaugacuggcucccagggaugaugacaaaccauuucuuauuaugguguauucuagggccuuguccguucaaguugccuguuggaaagagaaugguuuucauaaacuagaagaggagaaaaggugcuauguuguuucaagccugggauuucugguggccacaucauucaguauuaaggcccuauguguuuugggaaguucuaacuacuucuguuugguuuuuaaaaucuuuuguuauuguugguuaacaccuaccuuucuguuaagacucaggaguagagacuuccuuaaaaacgcgugucuucaugguaauuaccagccuuuuaagcucccaggaaauugaugcuguguuuauauucccaggaguuucuguugggcaggaaaguuugguguauuuuauaggggaguguguguuucaaaugaaauaagaguuugaugauauuuaaauuuuaauucagauuugacaguuuagauuuugauuuaucuuagaugucaauaccgaagccaucuauuauagcugcaaacuuagcuuuuuuuuuaagcugaaaagaaccaaacauuuuaaaaaacagguggagaaacuuuuuuaaggugaggagaaccaaaaauugaagaaagagguccucuguuaguuuucugaucuagggggcuggggagugugaucucaggggcuggagucggccaugggcgccugagcucuuggagcccacggcuggaggugaacgagguccagcguggagcagcaaauaugaaaccaguggcuuccgacauuuuaagucaggaaacuauuucuuuaaacaaaaccuugcccaggagcccaaaaaguaaaaauaaaaaacuggagagaaaagagccaaagaaaugggagucacgggcacccugacaaaacuccuggagcuccucagagcacuauuuuaggggggaaaaccugccauaaagguuugcucuguuacauugugaaagagagggaaaggagagcacagagagaugacagaagagaagagaaugagagaaaagagcauagaacuuggaaauggucaugaggacaaggugaccccgaggggguggcugugggaaaggggaugcggaggugcaggaagcaccgguagaggggcugaguguccuuaucuagcuuaaagcccugagcacagggcugcaugggagcagguccaucagcugcugcguauugagcacggcacaugugccucucuguccuuaauguuauuuuguccucacaguaacccugggggcugcagcagaagacacuguaauguggagaaguuaaguuucuuccggugucucagaguuacugaguaucaagugguggggcuggaacccggagucuaacucuagaccacuguggugcagugauguucauaacagcuauccacagucaccgagcugggaauuuauugguucugcauuacuuaauaaaacaaaaagacgcaugacugaccugauuuagaacucuuugcaugagagacaugugcugugaagaaucaucuuaccguuucggagcuggacggugccuuagaaucaucuaggccgaugucuuuaccuucaggccccugcagcccucaggagggguuuugcucuaucugcagcacuaccugugcuuuucuguacaugaagcugcagcccuggguucuccuguccccacugcuaccaggaguguguguucuugagcaagccccccugccucucugggucuucguguucuuauuggaaaagugaggggagugcaugucauuuugggugaagugguuugacuuaugucaccaucaaccaaauaacgcgaugggaggaagguccaggauauaguggagauggaacgucuucugaaaaauccccuuggugcugggauauugaaugugcugcuuacuugaaaugucuugguaauuuaaaaugauauuauuugcauuaucuugaauugagaccuuuagauuaguaaacagucacuuuauuugaggcuuuguuccugauaucuaaaacacauacaauuaaaugcuaccauuuaaaagggacaguuuagaagaguguccagucacuauugggguuaaucuuggagaacaguguggauccuaaacaauuucaguuuuaagguuuuuuucuucucuuccguguuauuauuuucucccccagcccugcugugaaaugauggaaaugcauugggcucugauagaaaggaaguauuuuuagugagucacauugggacaucagugaccucagucauucuuucuuuuuuucuuuuaaaacccgcucccagcacugaaccccagucauucuuaaugaaggugacugcauauaucuuguuccauuaaugcauguuguauuuuuaaaauagagccgaucccaguuucugaucuccguguugcccucacgggugugaggaaggcugcucucuccuggagcaauggcaauggcacugccuccugccggguucuucuugaaagcauuggaagccaugaggaguugacucaagacucaagacuucaggucaauaucucgggccugaagccagggguucaauacaacaucaacccguaucuucuacaaucaaauaagacaaagggagaccccuugggcacagaagguggcuugggugaguuacaaaggguaccuuccgucucccuuacugguucuuacuuucaguaacuaaauguucuaaaaaauaaauugcucuuccauguguauggagauuuagaauuuauaaagggcuuuuccuccacauuuuaguuugaucccccaccugcaugaggaaggaaggaaacguguucugauuuuacaggggaacacauuggggcugagaacagcaauaggaauugaaacuuuuuagagucuggcacccaggaaaguuagaggccccuuuagcuuucuaucuaacagcugugucaacccaaguugggccuucagaggaacuuaucacgucugcugguugauguuggcguugucauuugcagguuucauagcauuugcagaggauccccaggauaacuccaugaggaggacaggcacuuaaucugcauuuuauacuuaagaaaacagagcuacagagugggugucaggauccuugcuugcgagugacagaaaccagacuuuggauagcucagacagaaggaacaauuuauuggcucauguggauuuuccugcuagcgggaggccuuagagaaagagaugaggcaauucucaucccucccucuugcuucuuucuguucaucagcuucauucucagagcagcucccucugcacacuuaaggagcccagcugcuccuguuucacacccugcagcugccccaccagccagcugccccaccaaccagggucugguccagggaaacgugucuugaguggggucugauuagcaaagucugcuucacagagcugucccuggaaauccaugcugggacaggagaagauaacaacccaaagaagggagaaugaccugaaauaagcagaguuugaaagagaagcaccagauaucuguggugcuacuggaauaacaguacaaauggagauggagcuaucaggccuuuuuauggggcugccucucucucuggaggaggaagggagcagauauugauggagcaccaacuguggccacugucugauggccaucugaugggguuggggcuccgaaggaaaaugggggaugugucccucuugugguugaugucuuuuugucuccugugcuugaaacagaugccagcaauacagagagaagccgggcagggagccccaccgccccugugcaugaugagucccucgugggaccuguggacccauccuccggccagcagucccgagacacggaaguccugcuugucggguuagagccuggcacccgauacaaugccaccguuuauucccaagcagcgaauggcacagaaggacagccccaggccauagaguucaggacaaguagguugaacuuuguaaaaugguggcagccagaguuuccuagcacaauguucugucuccugugauucugauucugagugauuucuugcauaacagcuaguuuugaugucagagggagcuuccuggaggagauuuuggacagagcagaucugcucaguuucuucuuaacuccaugggcagugcacaucucucauuaagugaaaucaaauacauggagcagccccugugugcgggcaccaggcacugccucacgccaucuuucacagcuuugcgugguggcugaugagacaaacuggcaucauacuuuccucuuaaaaacaaauaaucauugcuuguuuuuccuuugcuuugaguuaagaaaguuaugaaagugaguuucauuuuuucacccgccuuguaauucauaccgaucuuucuguugaaaugcuuguugacaugcacauugcugcuuccucgcuauaauuuaucagcacuuucacucuguaaguucaccaauauuuggaggcuuuggugaaaagagcgggaggugaacacauuugggaauacuuagagguaguuacuggccaggcuguguuacuuguacagggcuagaaguuuuggcaagacauuggugagaagccauucuguaaggaaugacaguuuuuccugguauccauguugaaggaggguccauuuguguccuuccuucccuuuguacuuguuuugcuaaugugggaguggguggggaggaugcggccguaggacaggcugccugaccucauggggccugcagugaccuggcaggaguggcaggugggaggcucucgggugaggagggcuuggauuccagaggguggguuaguuggaggaggaggaaggggcuccuaugugggugcgguuggcaguggugggguguccugcacaugguaagcuugcgugagagagugaaaggggcugaaaucuggucugugugcccugcgucaagccaugcacccagggcuggguccagccaggggaaggucccuuugacugauuugcuaaaaggacuuguagauuugugugggccuggggucccugcuuuuuaaagcaguuugagcaaaagcaaaguaguagugauuacaucucaggcucuugguggugugaauucacacacauccugcuuuggguugaacugucuucaugcuugguaaauaaucauuauaguagccuuucccucucuauaaggggcgaguguguguguauagauaagucuuagucaguuugggcugcuguaacaaauggccaugcacuagauggcguaaacaaugaacauuuauuucucaggguucuggaggcuggaagucugagacuggggugcagcaugccugggcuccgggugaaacacccucuuccucuuccagguugcagacucccugggucuucacgugguugaaggggugagggcgugguuucucuccagccuuuuugauaagggcacuaauaccauucaggagggagguaauucaugaucuaauuaccucccaaaagccccgccuccuaaaagcaucacaucagggguuacaauuucaacauaggaauuuuauggggacagaaacauucagucuguugcaacacacacacacacacacacacacacacacacacacacacacacagauaaacacacauuuccacccaccccagagcacccugcacuuuucaagugacuaguuagguggggcaggguuaaggaaaccaucagaggacauuguugaggcacccaagacacgacagaaagccaccucuagggcugaagggcuagaggaggacaggguguuucuggagcccagugagagcuggggcagugguggacacagcugugucaggacaggaggcccagagcaggaggugauggaggaaggcacugacuccuuucuccuguggcccuucaggggccugcccauuggcucauaguggaacccggucacagcccauguggcaagaccccccaugaugccuugcacaaggucagccuccugggcccagagcaggugagggaagggcaguggauaugucgggaggguggagugggcagguggugaauaacuggcacucggguuaucuuuucuugagguuaggauugcucuccaguuuuauaggugaggaagcugagcucaagugguuuuccuguggcccaccugggugucauagcagagugagcccuggaacccaggccugccucguccugacuucugugaucucgggcgaucacauagaucgcaguguucgcucuugcaucauguguguuugacaacuuuucugggugccccuggcccuaggguaagacaugcauagaguccaagucaucauuuaggucaaaucucuaaagucaacuuacaaaaaggaacaaagaauaacccugcaggugccauuggccagguuguuucuucaccgcccaaugaugccugacuuuggcugggaccgucaugcuuuccuagccacgguugauggugcagaggaggaaggaacacucccccaggagaguuugcugggcuugacagcaugcccugaugaccucucccucccucugccuuggccguucugguuauuuugaacuccucuuguguucucacagaugcuauucagguuuuugacgucaccgcugugaacaucagugccacaagccugacccugaucuggaaagucagcgauaacgagucgucaucuaacuauaccuacaagauacauguggcgggggagacagauucuuccaaucucaacgucagugagccucgcgcugucauccccggacuccgcuccagcaccuucuacaacaucacaguguguccuguccuaggugacaucgagggcacgccgggcuuccuccaagugcacacccgugaguucaugccuggcucucaccacccuuuccugcuguccugcuccgugccaggcccagacacaggaugcaugauguaguaauggugacuguuggcugaccacacgccaagcuucgugugacaugcuuuccuugcacuggcacauuguaugcucacaacagcccugugaugugguuggaaguagccuuauuuuauagauaggaagccaaggcugagagaggugcuagacagguaucacagcuggaaaguggcagaggugagauuaagccucugguauuucucaccuggagccugcgcuuguaacucucuuuccaguguggaggagaccuagagugaauugauacagggagacaaaaaugaccugguauucauauccccuugugucuugggugcugacauuauaacgaaucacuggcacagcuguaucucaucuuuguuuguuuaaaugucccuuaaaaauaagauuuuaugcagcaaauaaaaagcuuuagguuucaaagaagguccgauaauguaaaauaaaacaguaauggugcacuaguaguacagugguauaauauugauuauauacuauuaaacaauaguagugacaccagcacugcauuuugcacugugccaugagauuuauagacacuguaguggccuccgagguagguauugggguccccuuuuacagaugaggaaaugacacccugauggcugaacaguuugcccaaagccacagagcuagugaguagcagagcaggacuugaacucagggguguguggcucuggacccaggcuuaucccacaagaauguccauuccuucgcaggaagcacaccuuagcauucuuauagauguauuuuggacuggaucuuugggaaaaugaaauaugcuugcauuucuuuaccuuuuacucuuuuacuauuuauuaguuaggauuagguucagccacgaauaacaccaccaaaaacaacaacaacaaaacccaaguauccguggcuuaaacaagacagggguuuauuucucucuccuguaacagaagcccagugcuaggcaggauggggaugauagagguuauccaaggcucaguuguaugaaacagaaacugugagcuauuuuaaccaaaagggauuuauccugggaauugagguuuugcagaaucauuggaagagcugguguauuaguuugcuagggcuaccagaacaaguaccaaaggcuguguggcuugaacagaaauagacuuucucauaguucuggaggcugaaggucaaagauuaaggcaacggcaggugugguuucuucugaggccucccucuuggcuuauagaugacugucuucucccucacaugguuguccuuagucugcgugugccuaugcccucaucucccuuuauaaggacaccagucuugcuggauuagggccuaccuucaugaccucacauuaacuuaauuaccucuuugaagacccugucuccaaagacagccacauucugaggucuuggggguuaggacauaaacauacacauuugggggugagggagcacaagucagcucauaacaguugaggagcaggcuuuaggccucgccccaagaaaugacuccuggacuaagucugcagaacugacccccuggagagucaccaccuuggucacagacagcagagggaggaaucaggaagucucugcuguaguugcgggauccaggggucuauguucugagcugugauccugggaucaggaagcugcagccaccgcugagguuuugguucuagagccaggcagcgugagcuccagucauugcauccacacuacagguauaagaaggaggaagggcagaagguugugccccacccuuaaaggacacuuccuagaagucacccaguaccucugcucaugcuucguugagcaaaacuuagucacauugcaacaucuagcuccaugggagcugggaaauguggucuuuguuuccaacagguaugcacacacagggcuaaaaaucuggguggguaugaugaagggaaaaugggggaauggauuuugggggucaagacuggucucucucugcugucccucccugaacagaggcucugggaggcuaguaaugcauucgagauaaagcagccaguguggccaagguucuccuccagagccugagcccuugaccacaggagcucacgccuccucucauuuccugugaaugauugugugcaauguaagcacagagcuucugcacucucaugaucaagugcucucuccauggccagaaacagcaguuucugaggggcucauguuguaggugaugauacaaagaagacagagagagggaucagguguccuaaguguacauuucaucucaguauuuucugagguggggcaucccugucuccuggagaaguauauuuuuaaucuaguuguuuacuuucuuugcauagccccuguuccaguuucugacuuccgagugacaguggucagcacgacggagaucggcuuagcauggagcagccaugaugcagaaucauuucagaugcauaucacacaggagggagcuggcaauucucggguagaaauaaccaccaaccaaaguauuaucauugguggcuuguucccuggaaccaaguauugcuuugaaauaguuccaaaaggaccaaaugggacugaaggggcaucucggacaguuugcaauagaacugguaagcaaauaggcuuuucuguuaaaccaucauguuucuuaaaggaaaucaguauaauuaauaaacauaauguuuccaaauauuguuuuucuuuuaauuaucuaagaaaaaacuuuaaaaauuuucauaacacuaaugcuuauuuauuauaugaaauacagacaaguaaguagaaaaaacuuacauggaaaccaucaagcagagauaaucacuuuugauguaugacauuuuacaauuuuuaaacauauacauauagauacacaaauauaugugugaguauacauauauuuaauacauauauauuuaauauuuaauacacacacacacacacacacauauauauauauauauauauuuuuuuuuuuuuuuuuuuuuuuuuuugagacagucuuacccugucacccaggcuggagugcaguggcaugaucuuggcucacugcaaccuccaucuccuggguucaagugaagcgauucuugugccucagccuccugaguaauuggaauuacaggugugcaccaccaugccuggcuaauuuuuauaguuuuaguagagacaggguuucgccauauuggccaggcuggucuugaucuccugaucucaaaugaucugcccaccucagccucccaaagugcuuggauuacaggugugcgccacugcacccagcccacaaauauauauuuauuucuuucacaaacauugaggccaucuguacaugugguuuuguaaucugccuuuuccccaacuugccaauuaauuaugaauauucuuuccucuuaauaaaauauuucuacaggaugauuugaacaccugccuggaauuccaucaucugaaacagaguuggcagauaagaauggccccuaugccaaauuuggcucauugucuguuuuuguaaauaaaguuuuauuggaucacagccauguucauuugcuuauguacugucuauggcuacuuuggugcuagaauugaguaguggcagcagagaacguguggcuugugaagccugagauauuuauuuucuggccauuacagagaauguuugcugaccucugggcuagaucagugguuuucaaauugugguccagggcucucuagggaucccuagguucuuucaaggggucuccaagguaguauuaucauaacaauacuaaaauguuauuuggcuuuuucauucucauucucuuuuggaguuuuccaacuuugauccgauaugggaugacauugucucucaggucuaauggaauauaugcuguggauucuuacauuuuaaaaauuucuucauuuuaaaucccugauauaguaaauauuaauaaauauaaccuauguaaauacaaauucucugagagccuuaauaacuuuuaagaugguaaagaaguccugagagcaaaaaguuuaagaaccucuggucaagauguguuagaaauuaacuacugugcuguguugggcagguggacuguucacagucuuuccuaaacaacacugugaugagauacuuuguuaguucuagaaggcuaauugaaauugauaaaaucauuuuauagucagcuacgguggccugcacccaucgucccagcuacuugagaggcugcggcaggaggauugcuuggcccaacaguugcagacuagcaccagccugggagacccugucucaaaaaaaaauuuuuuuuuauagaaacaguuuaaauuauuaaauuauuucuaggccuacaggagaaacuucugggaaauccuagagaguaauguucauuauuguuguuuuaaaauuuugaaauaauuguuuuuuggaaagguugaaaaacauacagucuuccuugaucuaagauucaagauaguugaaaucuuuuauacagaggguagaauaaagauauaccuaauguaaaugaugaguuaaugggugcagcacaccaacauggcacauguauacauauguaacaaaccugcacguugugcacauguacccuagaacuuaaaguauaauaaaaacauauauauauauauaaaagaaaugggacagauuccuugaaacacacaugaaaugaguuacgcuuuugagauucuccuugaagaagcuucuucaacugugcugguuggguuaagcaccgauagucacucagaggaucugcuucugaaauaagggaucuacuaaaaugcaucccucagaugaaaugcaguauucccuuugcaaaucugcauuucagacuguugacaugacgucuuaacgucaacauguuucuucugucuuuuaaggauguggauaaugguaagaggaucaccacugagggagaugcaugauguugugcuacuugcuauugcccagaacuuacuguaacaauaauauaauaugcugggggucugcgaagugcugagugcucucauacugcauuuuacauuuuuaacacaacuucauggagcagguauuauuaucauuucugucuuacagaguaagaaaugggggcucugcaaacuuaaguaacuggcccagagugacaagguggcaaacugaccugugucugcugucuaagaccaagugcuuaaccaccauguagauugacacuuugaugugguacagcaguaaaguuuaguauuagugaggagagggcaucucuuuuacuauaguuuauugugaauauucuuuccucuuaauaucaguauuucuacaggguaauuuuaacaccugccuggaauugcauugucucaaaggacccguuucauucaauggucccauugaaugaaagucaagaaggcuugcuauaagaucuaaacucuuagggggguuaccuuucuauuaucaaauaaccuuuauuguuauuggaaaaagucagcuuaacagcauuaaaagcaauuucaaaaaaaggaaacgaauaccauaugauccaguaauuccaguccuauguauaucuccaaaagaauugaaaacaggccccuggacaguuauuuguacaucaguguucauaguaguagcauuguucacaguagccaaagguggacccaagaucccaucaacaaaugaauggauagauaaaaugugguucauccauacaacaaaauacuauucagccauaagaaagaaagaaauucugauuuaugguacaacauggauggaucuugaggacauuaugcuaagugaagccagacacagaaggacaaauacuggaugauuccacuuacaugaguaccuagauuaggcaacuuaauauucuacagaaauuagaauagagguuaccaggggcuguucagaggagggagugggcauuauuguuuaauggcuacaguuuaugcuggggauaaugacaguguuuuggguacagguaguggugauaguuacacaacauugugaauauugaugauaccgaauuguacacugacaaaugguuaagaugauaaauauuaugguauguauguuuuaccacaauaaaaaugaaaaggaacaaauaucucuauuuuucuaacccaacugaauuccuuuucucucuguguccacagucauacauuuugcuuguauacuguaauuauuauacaaauacuuuuauuuuguauuugaauuucuuuuuacucagucuauaccacaacuuuccccuauaguuagcauggccuucauauuuuuaguggcuaaagaguauuucaucaugcagccagaucacagugcccacagcccuccccauguuauugaauauuuagguuguuucuagguuuuuauguuuauagacaaaggcugccuuucaugggcuuuugucuguggaaucccuuugacaucaggaaucugcugguaggaaacaaaggcuccucccaguggcuucucuguaaggagaauccacuuaaaauuaaaaaaaaaauuaauuuuggaguagauaguacguaaacauggcacaauuuuuuuuguuuuuuggacaagguguuugcagugaaagcauuucccuuuuuuguccccuaccugcccauuuccucucccuggaggugacguuuguugccagguaaagagagacaggguugaaagccgcgguagaaaauaggcccagccuccgcgguuacuuccgggccucuauguaggcaucccuggugcagguggcugagugggcagcgggagaugaucggaggaugggcuccugugggagauuccauuucugacucugcucugaaggugcagggugugccuguuuucuucccuuccucauccguccucaaaugcugcaacuuaguaaaggucagcucuccauuucaguuuuccucuuugguauguaaggcugugucacgggaagauguuuccuucugagugacugauuuaaaaaacacaacaaaacaaaaaaaccucuuuauugagauauaauauacauaccgaaaagggauguauccucagcacauagcuucaugaacuuuuacaaacugaacacaucuuguuaccagcacccauauaaaaaaacugaaugugauuuccacuucagaugaccccuugaagggcuuuuuuuuuuuuuuuuuuuuugagauggaguuucgcucuuguugcccaggcuggagugcgauggcgcgaucuuggcucacugcaaccucugccuuccggguucaagugauucuccugccucagccucccaaguagcugggacuacaggcaugcaccaccacgcccggcuaauuuuguacuuuuuuugauagagacgggguuucuccaugcuggucaggcuggucucaaacucccgacuucaggugauccgccugccuuggcugcccaaagugcugggauuacaggcgugauccaccgcgccuggccuuuuuuuuuuuuuuuuuuuuuuugagacagagccucauucugucgcccaggcuggagugcaguggugugauaucggcucacugcaaccucugccuucuggguucaagcgacucuugugccccagccucccgaguagcugggauuacaggcguguaccaccacacccaacuaauuuuuguauuuuuaguagagauggguuuucaccauguuggccaggcuagucucgaaccucugaccucaagugauccaucucggcuucccaaaauguugggauuacaggcaugagccauugcacccagccuaagggcucauuuuuaagacaacaacaaaaaacuggagaacugguaagauaaacugggaaguucaugugcgucacagaagagcugaaauucuugagagcacugagugugugcauuucucagcucgauuuuggagugugccuuuugugaacucauuagaaagcguaauggcaaaagagcagguccucucgacagcacuuggagaggaagcugggcgucaugauaguaacaguuuucccuucuccuuccuuucuucugagcaguucccagugcaguguuugacauccacguggucuacgucaccaccacggagauguggcuggacuggaagagcccugacggugcuuccgaguaugucuaccauuuagucauagaguccaagcauggcucuaaccacacaagcacguaugacaaagcgauuacucuccagggccugauuccgggcaccuuauauaacaucaccaucucuccagaaguggaccacgucuggggggaccccaacuccacugcacaguacacacguaagucucuuaggaugcccuucuaaggaacagccucucuaacugucucuuggaggaggcacugguuaaaugauggccagugugcuucugggauccagguugacucugaaacugcugaaguugaaaacauuggucucagcaaugguucugcugucaccauggggcacuguucuucaagcuaugugaacuuagaauugucauuagaaggaagaaaugauuccuugggaauggugacugaaaugguucuagucauuccuugagaauacagaguagagaagggucaccuugucauguugguauuggaagauacugcccagaugaggagcuucgccugcaacaguuagggagguguuuugcgaauauuugaauuaaauacaugguaaagauguuaguuuguaauauguuuuuaguauauuuuucuccaucuauuagauuuaaaaaacagauuagaaauuaaauguuaaaaauauauuugaaauaaacuugaaguauuaaaagaagccuaaauuaaacuucuuuugagacuuaaucuguauaauuauuuucuugauguguuuuugggaaguuuuccaucuuuugagccagcaaauacuaguuuuauucauucuuucuaaaacgagccaggcuauuuuuggauauaguaaauaguccuggaauucuacuuaaucugugcuuuuacaugaauugccuuuuuuuuaaaaucaagggcccagcaauguguccaacauugauguaaguaccaacaccacagcagcaacuuuaaguuggcagaacuuugaugacgccucucccacguacuccuacugccuucuuauugagaaggcuggaaauuccagcaacgcaacacaaguagucacggacauuggaauuacugacgcuacagucacugaauuaauaccuggcucaucauacacaguggagaucuuugcacaaguaggggaugggaucaagucacuggaaccuggccggaagucauucuguacaggugaguguagccccaacugccucuuggacuccucccugaguggugcugaccuugcaggucaguccucccaagucuguaguuugucugguuuugugugaugugcagugauggacauugagcuuuccgaggcauccuguuagcuuaucggugcugucucgaugcccucaucauuucugcauucaauaaauauuuauugagcauauaccauaugccagucaaguccuugccuucuuggaacuuuucgaaggaggaagugggauguuuaccuagagugcucaggaaaggccucaaugacaaggugacuuuugagcaaagaucugaaugaagggaaggagccagccauguggauaucagggcaugagaacauuacaggcagaggccugugcagaggggccugugcagcaucaccacuguaucuggaggcuggaggaagagcaggaggcaagggugggaggaguggacccgcaggaacaggaggauauaggugggaggugaggccugaguggggcugagccaggauguggaugauaucuggcauugguuugucuuuugugcuggagaagaugaaaaguuuauugaaaugaugcccagccuuugcauccuucuugauccucaccuaucucacaacugaaaaugugugauaaagagaagagcccucuguguaauugaggaugcuuucagggcagcccaggaaaggcuuugcagacaguggugggcacuucugcucacagugcugacuguggcaccuuuaucacucagcacccgugcacuacucauuuucugcccuucucgcuccuaccucuucccuuuuuagcccaggccauucagauauguucaggcugauuuggaagugauggucucaugggaucagccucccugguaguauaggagcuccagccuugauggccucuggcuuuucaguggugagugggguggccacagaaaucccugcagcuuugggucacuucugcuccaucccaccuggucuagacacccaucuuugauauuugggugccuuucauugcugauauuuaucuuagcuauaguuauuuguagccuauagcaagagaaaaacuguaucugagcauuuaugacuggguguggguggaacaggagcuguaaaagugggugcaguguucagguuaccuuuccaggcccuggguggcaaauguggguguugcacuaggugccuugguagagcuucuccugcucuaaaauucugugacauucaauuaaugauaauacuguccuccaguuguaauauggaguuuucuauuuacaucaguuugauguuaguccucaguaaaaaucuaauggcccucagauagagacaaauaacacucuauuuugaagaugaggaaacugaugcaucaucaauggaugaugcaguauguuaugugaguagagagugucuugaacuuagacuuagaaaaccugggaucuaguuuuggcuucaccaccugccaugucaucaucagccaauuacuuaaccucucugagccucuguggauuuaucugcagaugggacaguauaggccucaccugucucagaaguaucaucaagagggccuuggcugggcugguggcucacaccuauaaucccagcacuuugggaggccaagguggguggaucaggaggucaaaagaucgagaccauccuggcuaacauggugaaaccccaugucuacuaaaaauacaaaaaucaacuggguaugguggugcaugccuguagucccagcgacuugggaggcugacacaggagaauuguuugaacccgggagguggacguugcggugagcugagauugcgccauugcacuccagccuggucgacagagcgagacuccgucucaaaaaaaaaaggggguccucaugaugagauggugcaagugaggagguugcuacuucucacaggaugauacagcugacucucauggagcccuggucucuuccaggcgucuuucuuggugccugacaucauuguucaauuuacucuucaaagaguccugcagcugaggcucagagcaguugggugacugacccaagcucacacaguuugguguugcccaauuuagggucagccccugccucuuccaccacaucacccacccaccuucucauccccaggauucugcuacucccuauuuccauguuugcaaaggcaaaagucccggaaucucaugcugugcuguacuugcuuugcagauccugcguccauggccuccuucgacugcgaagugguccccaaagagccagcccugguucucaaauggaccugcccuccuggcgccaaugcaggcuuugagcuggaggucagcaguggagccuggaacaaugcgacccaccuggagagcugcuccucugagaauggcacugaguauagaacggaagucacguauuugaauuuuucuaccucguacaacaucagcaucaccacuguguccuguggaaagauggcagcccccacccggaacaccugcacuacuggcaucacaggugggcuacaaggcaggggcuggucaguuggcacugugaucacuccuggagcggcugacccacagugggucugcacguguggacuagaaaucuguuuuuguuuuuuuauuuccccuaaaauauuugcuuuuacugacauagacugguuucucauucuauagaaaucaaucuaaaaaagcagaguaagaggggcucauuuuuuacauucuaaaagauuccuuuucuuuacagcauaacucauugccucauugccauguuuucuuuuauauuuuuuugagauggagucuugcucuugucacccaggcuggaaugcagugacgcaaucucagcucacugcaaccucugcuuccuggguucaagugauuuuggugccucagccuccugaguagcugggacuacagacacaugucaccacgccuggcuaauuuuuguauuuagagaugggguuucaccauguuggccaggcuggucuugaacuccugaccucaagugauccacccgccuuggccuccuaaaguguugggauuacccacgugagccacugcgccuggucgucuuuuagcccacaucuguugguggcuuacugugugcuauggugagggauacuauggugaguaggggcgacagggccccuggagcauaggacugagaagagcauugagagggagaggauuuccaggucugguggugggugagcuagcaugcugcugccaauuuugcagcaaggaccuggggauggaccuucucuggccagcuacaggguauagagcuggugggaaaugcaggagccugugcuagcaguugaccauuaacaugggaacgccaccucccagcgggcacugcugccgcauacuugcgagguugcugaagcuuguaguuuagagcaggaccaucccacuagaugugcaaugugagccucagguauaauuuaaaguuuucuagaagccacacugaaaaaaaagugaaaaggaauagccgaaauugguauuaauagcauuuuacuuaacuuaguauauuaaaaguauuauuucaacauguaauuucugugaaguauuaaugaguuauuuuaugucuucuuuuguacuaagucuuugauaucuagucuguauugugugcuuguagcacaucugaaugcaaacuggucaccucucaggggcuuggcagccgcauguggcuagagggcugcuguaucagcacagguuuagacaauuauguugugguuguuuuggaguucagauuucugucuccuugaaucuugaauauauauaauaaugagaacaggcugggcgugguggcuuaugccuguaaucccagcacuuugggaggcugaggugggaggauugcuugagccaggaguuugaaaccagccugggcaacauagcgagaucccaucucauuuauuuuuuaaaaauauauaaaaaaaaugggaauaacccaaacuguaugugugagaugaauuuagguagagagagagaguguguggaguggaucaucuuuaauucaguguguucuuucuuuuguguuaguucagagaguggcuccauacccuggcuuggaaagggggggugugcacaaucauggaggccauccauggaggguccugugggggcuuuucugguuucugggaagaggaucuguuggguuucucuaggugguauuugagaccaacucugggaaaaauguggggacuguuuaugaagaacacagagaagugcugugcccaggucucagcagaaaguguguucucucccaccucaucugugauucuucuccuuggacauuugcuccgucuuugcucucagcugaccagcugauccuggggccaagccaaguccauguggugucauugugcagcucccaaggccacaccuuagaguuccaccacagucucuuucucacucuccuucuuccaccccagaucucaggauaaugaacccggcucaucuugagucauaugggacugggggagaggacaagggcagguuagcuuccucaugcaaggauacuagcuucuuacucuaaugaugguuucuuuuacugugcaaaaccuuuucaguuugauuuaaucuugcuugucaauuuuugcuuuuguugcugugcuuuuugugugguauccaagcaaccauuguaaauacuaugucaagaagcucuuccccaauguguuuuuuuuuuuuuuuaaacaaauuuuacaguguacagcuuuaggucuaauguuuaaggcuugaaucuauucagaguuuauuuuugugucugguguaagauagagguccaguuuuauuaugcucacggauacacaguuuucccagcaccauuuguugaagaggcugucuuuuccccauugugucuucuugacauccuuguugaagauaaguugacuguauaugugagaguuuaauucugggcucaguauucuguucuauggguugaugucugucuuuaugccuuuaauauacuguuuuaauuacuguagcuuugaauaaauauaucuugaaaucaggaagugugaggccuccagcuuuauucuuucucaacgcuacuuuggcuauuccuggucuuugauuguuccaugugaacuuuaggauuuuuuuuuuauauucuguaaaaauugccauugggauuuugauggagcauugaauuuauagaucgcuuugaguagugucaagucuuccaacaaugugaagucuuccaauccaugagcaugggaugucuuugcauguauuuguguauuuguaucuucuuuauuuuaucgauguuuugugguuuucacucuacaagucuuucaucuccuugauuguauucuaauuauauuucaaucaaucuguuaaaaaauaaaauaaaagcauguacuguucaaaacaacaauagcaaaaccaaacaaggcugcugggugccugcccuggggauuuggcuggaugcccugaaggggucauugugagcuagguggguuucccaggaucugcugucucugcuccucaccaguuuccuucccugccuuuugcuucuggauuugcuguuuugcacgagcccagcauguagcuuccagaguaagaucuugaggagguugcugaagcauguucucuaccuaauguguugcuuugguuuucaauauugggugaucauguuuuguuuuguuuuguuuuagaucccccuccuccagauggauccccuaauauuacaucugucagucacaauucaguaaaggucaaguucaguggauuugaagccagccacggacccaucaaagccuaugcugucauucucaccaccggggaagguaaggagaggccuccguggguuaaacagcccaugagugaugcagugaccagagcuuucucugugcccacugaggcaugugaguaaugcagacacacgccugucuucucacugcagccuaugcuguguacucagacagagaaggagggugagguauuugccugaugguugacaaacuuucuggaaagggccagauugccaauauuuuaagcuuugcaggugguauagagucuguugcaagcauucgacucugccauuguagugugcaagcagucacagaagauacagaaggaaugagugggaccauucccacuagauguuauuuaccauggcagguggauuugguuuguggcccauaacuugcugaucugugaucuagguuuuucuucucuuuuaccucacugggccuuuuaggugguagaauauuaguuuuaaccaacucugucucucucucucacucuacacacguacacacaugccauccucagaggaugacuuuccuuugaaagaaaauagaaaaagauuugcauuugcuagugggaauuugcagaguaucuccuuagcugagagaagagguggauuaaaagcugcuuuuccuuaaagggcucuguuacauucuuuugugguaggaaaggaaucauucgagagucucuucgguagcuguguuugagugcuugcauaaggccuagauuuaaaagcccaaguuuuguuguggggguucccuccucccccuccccuccucccccuccccucuccuccuccuccccuucuccucccccuccccucuccuccuccuccccuucuccccuucuccccuucuccuucccuuccccuucccucuuucuuucuuuuagagacaagaucucaccauguugcccaggcuggucuugaacuccuggacucaaguaauccucccaccuuggccuuccaaagugcugggacuagacuacaggcaugagccucugugccuggucugggagauucuuuaugcaugaauaaugcaguguuuccucugcccacucucuccuacuguggugcuguccucauguccuugaggaggauagagaccaaacacacugucgggguuagggaucugggaggauagaaauuugcuggugccauaaccuguggcaaaauuucaaaaagugagguugaaaucucuaucuuuuaauuuugggucuguuuccagcucuuagucauuuugcugugaugcuugucagcaagucccauugaggaaggccauguugcauagcagccagacugaccagugcuggccugugauuagaugaaaccuugggcucugagcccgaugcccuggauugggaacccaacucuaccucauaggcagugugaccuugugccugguccuguuagccuuuuguaccuucguuuucuugucuguaaaauggagacaauaagcuuaugugaugggauucauggggaugaagugaguuacuguaggugaaacccuuagaauucaauguaagucaaaccuggcacagagagauacuugagagaugguugcugaucacuaucacccaacaucaccaccauguagauaugcaggagaagaaaucucucugccaucacuuucuuaugauucuccuucuguguaccuuucuuagcuggucacccuucugcagauguccugaaauacacguaugaggauuucaaaaagggagccucagauacuuaugugacauaccucauaagaacagaagaaaagggacguucucagagcuugucugaaguuuugaaauaugaaauugacguugggaaugagucaaccacacuugguuauuacaaugggaagcuggaaccucugggcuccuaccgguaaugucuucugguucuuacucuuugggggcugagccucaugagcauaaagcucuacaugccugcggucagacacgucucagggaccucuuuuugcucuuuguuaucccacagggcuuguguggcuggcuucaccaacauuaccuuccacccucaaaacaaggggcucauugauggggcugagagcuauguguccuucagucgcuacucagaugcuguuuccuugccccaggauccagguagggagaagacaacaguccuggcacugguucaguggcauuuugcuccacguguccauagaaggccagcuguguacaugccucccucagaccuucaggaggguuggugugcccagcucuccccucccagagguugagaugucacugggucaccgggcuuacugggcuuccuccuccgaggucccacagccuggaccccacacucucccuucucuaagugccaguuguucuuccaaucugcaaagauuauugacuccccuuaucuauguguggucacuugugggcccauaugccaggugcacaguuugacacauugcauugaauccuuaaauaguagaaucagaggaagccacauaaauugucuuguucaauccucuguuuauuuuucuucauaauuuuaauuauguuuauugauuuguuuauuuuauuuuauguuuuuuuuuuuuuuuuuucagacagagucuugcucugucacccaggcuggagugcaguggcacgauaucugcucacugcaaccucugccuucuggguucaagcaauucuucugccucagccuccugaguagcugggauuacaggugccugcuaccaugcccagcuaauuuuuguauuuuuaguggcgacgggguuuugcucuguuggccaggcuggucucgaacuccugaccucaggugaucugcccaccucggcuucccaaagugcugggauuauaggcgugagccaccauguccagccuauuuauuuuauuuuugagacggaguguugcucuguugcccaggaguacaguggcaugaucauagcucacuguaacuuugaauuccugggcucaagggauccuccugccucagccucccaggugggaccacaguugcuuaccaccaugccuggcuaauuuuuuguagagauggggucuugcuauguugcccaggcugguccugaacuccuggccucaagccuccuuccaccuucuuccaaagcucugggguuacaggugugagccacugugcucugccugcuuuuuggaagugagacuuuuaaggccuagagaggggaaguaacuugcccaggguuacacgauggcuuuagaggcaggccugaaauucuggucuuggacccuuguuaagugcuucuacccuuuaucacauagaccuaggugauacaggagcuucagggauccaagaggggugcauccccuaccuucaagccagaggcuaauggacuggcugguuuguuaguuugucugcuuuucuuuccuaguuggugguuguugggcgcaggaaagaaugccugccccagaagcaaaguuuagggaguccccacauccuuccccgguaaacaaauggguuuccugucaccugagcauggaugcugcuguagguaccucugcucauaugugggugcuagucucaaaaugucagagguggcaggaaaaauaucugaaaauccagcccaguucccuaaauuugcaguugaggagacagaccuggagaggaacaguaacuuucucaagaccauccagguaguaguggauugggaacaggaaccuggcuucugcaugcauagacuaguuuuagguccaaagcuauuuaacucccuugugugugugugcgccugugugugugugugcaugcauguguguguaugguauacacacuuuaacucucugguguuagggucccaggccaguuuuuagcacauuguguggucugcaugaacaccucuugaagugucucccauuuggacuuuucucaggugucaucuguggagcgguuuuuggcuguaucuuuggugcccugguuauugugacugugggaggcuucaucuucuggagaaagaagaggugauauugcuuaugcuaauaauaauacucugguauuuaaggaagcuuucuauuaaggaacauuucaaacuuugacagauucagaaggaaugauaugaugagcgccauguucccuucacccauaguguucugcauuuggccaguccuauuuccucugcgcccccagcugggcgauguuaaugugcucccagcugucacaucaggccacugauagacgccacagugugggaugcuacuuucaaaugauauguucuuguuuacaagucaguuucauaguauuaugauguuaagagauuucauuucagagguagcuaaguuugaacaccagcucugucuuugaccagcuguuuaggaagcuuagccuuaauguccucaucuaugauaggaggauaaucauugugccuaacuugugaagcugaggaggauugaauaaauaaggcacuucucagugucuugugccuuguaugcuauuacuauuauuuuaucuguacaacuacccugugaggucauuaaaugguaaaaguagcagcccuguuuugagugcucaccgugugccugcaucugugcuuucugugaauuaucgcaugcaugaggcucugcgaggcagguccaguaagucccuuccaaggaugcagaagcugagucaggaaguguggaaauagaacuugaaccugguccuugcacuucauggcacgcccucuugucuguguagugugugaagccuguguguguuaguugggauuucuuugcuguaaggugcugccaaccagggaaucuccauccugccuuagggguccucaugcggcccaggccgguuccuugugcugccacccugcccuguuggagugacaggcagagcucaugcuccagcuuuuagguuagguucuguuuuuuuuuuuuugagauggagucuggcucugucccccaggcuggaguacaguggcaugaucucagcucacugcaaccucugccuccugguucaagugauucugcugccucagccucuugaguagcugggauuacaggcaccgccaccacacccagcuaauuuuuguauuuuuaguagagacggaguuucaccauguuggccaggcuggucucgaacuccugaccucaagggaucugcccgccucagccuccugaaguguugggaucacaggcgugagccccugugccuggccagauuagguucugauuuuggggggggaaauggaucagucaguggcuggauaaaacaguuuuauuguuucuuguuaaaaauaagaguaauacaugcuuauggcaaaaaauauagaaaagaagagcaaaaauaaauaggaaaucugcaaucgcagaacccacacaaaacuacucuuaacauuuugaugugaccaaacucacacacaaaugugugcacacacauggaaucauguuacauguuagaaucaagccugcuuuauucagcuuagacauuguuggcagcuucauuucaucacaauuuuuuuuuuuuuugagacagaguuucguucuuguuguccaggcuggagugcaauggcguggucuuggcucacugcaaccucugccuccuggguucaagcgauucuccugucucagccucccaaguagcugggauuacaggugcccgccaccaugccuggcuauuuuuuuuguauuuuuaguagagauggaguuuugccauguuggcuggucuuaaacuccugaccucaggugauccacccgccucggccucuuaaagugcugggauuacaggcaucagccaccgugccuggcucauuucaucaucauuuuaaguggcuacagaguauucaacuguaugacaguaccaugaucuaguuaaccaauuuccuagguguuuccaaguuuuuuuucuuggccacaguuacuuauccuugugccuaaaucuuugggcacauucacgauuauuuccuuaggcuaaauuccaagcuaggcaagugcugggucaguggguaugcgugcuuucaguuuugauacauacugccaaauuaccuuccagaaaguuuuucuuaaauaccaaugcagaguugagucaacagugcaggagugugcagaugccucaccaacuugccaguuccggaucugauauguuuuuugguuuauugcauucauuuaucagaaaagcuuucucaaaaacaaaguaugaaauaacaagucuugcuuuacauuaaaguaaugccacugcuauauauuugcaaggaaguucuuaaaagugacuuggauaugauuuuuuucauucuuuuagauaguacaaaagaaaauaacuucacaaauuuguaauuagcauuugcagcuugggucauuaaguuuaguauuagggggcaggauuuggugucagcugugaacuaaugccugaggaaaagguguaacaccuuuauuucauagaugacaucaacuccagauacacaagggaaaagcacaggaaggaauccuuuuuugucuaaugggucucuuuucucuuaaaacaggaaagaugcaaagaauaaugaaguguccuuuucucaaauuaaguaagucucucaaauuaugagcuuuauuuuaaauccuccaaucuguucggugacuaucuauaaauaauuuuugauggaacuugcugucauuuuuccugauuggcacauuuugaccaugaccaucuggaaguuuuugcuagcucuguuuucugcaaggaaucuauguuuuauuagucuccugaagcuggcuuccuugucauguucuacucuucuaccaauaaauacggauuucuugauuaaaaaaacgucaaauagguuaucaagauccaggggagagaagaacuuacuuaaagucacaaaaccaauuaguuacaaaguagggucuagaaaucagauuuccugaaucauauuuuaguguuuugugaauaauaguacucugacccccucuugccaaauuauacccuggguuuuguuguuuugggaagauuguuuacugucauuucuagaguaugaaugagucuuucuaauugcauauuuuuucuuucccuuucuaucaugaagaccuaaaaagugaguaaucucuuuauuuuuuuuaauaacuuguacuuuucuauugaauauggacuucacugaauguaaaaaauccugauaaguuuuguuuucuuagaucuaaguuaaucagaguggagaauuuugaggccuacuucaagaagcagcaagcugacuccaacuguggguucgcagaggaauacgaaguauguugcuguaaauacuguuuuuaauugugucagguuccaacccaagcugggaucugaggggaguugguggauggguggcagguagcugaaagaacacucgagggacuguaggcaguugggacauggcuuuauucucucuccuacagagucagcagugcaguuauauuacucacagacaauaguggcucaaagccagguaugaacucacacaaacagguuacauuaaauggcuauauaacgcaagggguuguugcgcuccaaacccuuugcgucauacuguccuggaugucuaccuuggacuacuccugacugaagcacagccacuuuccuuagaaauuggcuuguuuuuccugaaaguuagaaaacuguuaacagaaacuaggaauucaagucagggaacuguuagccacaauacuuaggaagcuauaugagcuggaaagaaaccaaaugggcauguagaggucuggggcuugauggcaguguggccuaggauggcuugugaggcucacuucugaagcccugcacaaggaauuucuuggccagugucugccuuucaguuccccaugcugugcuccaaccagcccaggaaccagcccugcucagagugaccaugcacacucguccuccugugcugcccuguccagcaucucugccuuugcucucuugaaauccugcucagcacucagcacagugcacaugcugcuuccuccaugggcauucugggaucccauuaggaggacuugaguucugugugcucagacugccuuguuuccccuguugcuuguuaccaauauucagcauuucuuuaauucugccuuuuuguaauguuaguuuuuucuguguacaguacaccucuccuccagguugcaacugcuugaaggcaaggguuauccuuuuuccuauauucuaaccuuuguauuaguucucuaggcugccauaaaaaagcaccacaaacugggaggcugaaaacaacagaaauuuacugucuagaggccacaagucccaaauuaaggugugggcagggucacacucccuucuaaaccucugggcagcgcccuuccuugccuccgcagcuucugggagccccaggcgucccuugguuuuguggcagcaacacucugaugucugccucuguguucacauggccaucuccccucaugugucuaugucucuuugucucuuuuccuccuauaaggacacuagucauaugggauucagggcccacucuaaucuaguaugaucucauuuuaauuuguuuacauuuguaaagagccuuuuuuuuuuauacuuuaaguucuaggauacaugagcacaacaugcagguuuguuacauauguguacaugugccauguuggugugcugcacccauuaacucaucauuuacauuagguauaucuccuaaugcuaucccuccccccaccccaugacaggccccggugugugauguuccccucccuguguccaaguguucucauuguucaauucccaccuaugaguaagaacaugcgguguuugguuuucuguccuugcgaucguuugcugagaaugaugguuuccagcuucauccaugucccuacaaaggaccugaacucauccuuuuauggcugcauaguauuccauggugaaugugugccacauuuuucuuaguccagucuaucauugaugggcauuucgguugguuccaagucuuugcuauugugaauagugcugcaauaaacauacaugugcaugugucuuuauagcagcaugauuuauaauccuuuggguauauacccaguaaugggauggcugggucaaaugguauuucuaguuucauauccuugaggaaucaccacauugucuuccacaaugguugaacuaguuuacagucccaacaacaguguaaaaguguugcuauuucuccacauccucuccagcaccuguuguuuccugacuuuuuaaugauugccauucuaacuggugugagaugcuaucucauugugguuuugauuugcauuucucugauggccagcgaugaugagcauuuuuucaugugucuuuuggcugcauaaaugucuucuuuugagaagugucuguucauauccuucgcccacuuuuugaugggguuguuugauuuuuucuuguaaauuuguuuaaguucuuuguaguuucuggauauuagcccuuugucagauggguagauugcaaaaauuuucucccauucuguagguugccuguucacucugaugguaguuucuuuugcugugcagaagcucuuuaguuuaauuagauccaauuugucaauuuugucuuuuguugccauugcuuuugguguuuuagacguaaaguccuugcccaugccuauguccugaauaguauugccuagguuuucuucuaggguuuuuaugguuuuaggucugacauuuaagucuuuaauccaucuugaauuaauuuuugucaguuucagcuuucuacauauggcuagccaguuuucccagcaccauuuauuaaauugggaauccuuuccccauugcuuguuuuugucagguuugucaaagaucagaugguuguagaugugugguauuauuucugagggcucuguucuguuccauuggucuauaucucuguuuugguaccagugccaugcucuuuugguuacuguagccuuguaguauaguuugacgucagcuagcaugaugcuuccagcuuuguucuuuuggcuuaggauugucuuggcagugcaggcuuguaaagagccuauuucuaaauaagaucccacucauagguauugggggcgagaaauccaacauaucuuuuuggggcacaguuuaacccauaucaccucuacauuuccacuuuguucuuuugcuaccaaaacaccacggguuuggucuagguccugcuccucaccuuuacagaaagccaaucacugagaugacaaauauugccggggaagaaagcuuuaaucgggugcugcagccaaggagaugggagcugaaucucaaauccaucucgcugacugacuaaaaccagggguuuauacagcaggaaagaaauguaacaauguguaagaaaacaggaacuaggggcugggcaugguggcucacgccuguaaucccagcacuuugggaggccaagguggguggaucacgaggucaggagaucgagaccauccuggcuaacauggugaaaccccgucucuacuaaaaauacaaaaaauuagccaggcgugguggugggcgucuguagucccagcuacucgggaggcugaggcaggagaccgcgccacugcacuccagccugggcgacagagcgagacucugucucaaaaaaaaaaaaaaaaaaaaaaaaaagaaaacaggaaguagggaggggcaaggaggcaucuggugcagugaucugacuaguuucaguucuuuguuacucccugaagguccuuuccugagaaaggaacucagauaaaacaaauacaaguuucaggcuuuaauagcagaaggguaaauuucuauguuuauucaaaaacaacuugucuaugggacuguugggcugguuucacugucauaugcuaugcuaaauaugaauaauauuugaagacuaaauaaaugaacaccucauuuguuuuguuuucaggaucugaagcuuguuggaauuagucaaccuaaauaugcagcagaacuggcugagaauagaggaaagaaucgcuauaauaauguucugcccuguaaguuauuuuaucuacagcaucuucucuguguuccaucaguggccaucacaucucuaaguguagaggggagggaaucagugauccuaaguaaccacuuccacaaccauucauuagucaccuacuuccacaaccauccauuauucaccuacuaugugcuaagcacuauauuuaggugcauucucuuaaauccucacaacagccuuaugaaguagguaguagaauauuuguuuugcagaugaggaaaaugcacagagugguuaggugaucuuuccaagguuacacagguagugacgggaaaacucggcuuuguacuaggucugucugucucaguaagggaaaaggccagagucuguguucuuaaccccucugucucacaacuauuuauuucaguucuauaauucuggaaugaaagugagcagagggagacggggagucacacucucuguguccagacacaugggcugagugaauuccacagcuaaguaugacuuauauuuagcucauuuccuguuuuugagaauuaacaaugucugcaucuuagucaacaggauuacagcaaauugaguuuaaaauaagaauuauuuauuacaucaaaccauuagaugaaauguaaauaauucuccauugaaaguuccuuguaaucucucuuuuggguggggauuagggcacagagaggagcauaagcagauuguagccauguucugauggagcugaaauugauagacuuugcagauaauuuuuacaucaggacgucaucaucuuuauucgaagccguguuuuucauuccuggacuaaaacauuaaguucuuuuuaaauucagcauuuucuaguucuuggguucuuucucuccauuuauuuccuuguacuugacaaggaguauuggcccauguucugagggaaaugcuuuuaaaacuaggcuggggguauugcccuuguaaggguaauuugggauuauuggccccuuuuugugaaugucuguggagauucucagaucuggagugggagcugggaaguggguguuuggguauuguucuuauugggaagccuuuaggcugagacucaggucaguacuagacuuagcauuguuauguuauuuuguccagaggagggugagguaguacaaucagagacggggaaacugagguggugcugcuucuggcucagccugacacuugcaguucuaagguuauuauuucaucucuuaaguugggcaaguuuguguguaugcuuuugagaugacaauaauauuuauaaaacauaauucuguguuuuagacccuccuacucauaguagucuuauacauucaauuuauacuugaacuugguacucuguuuuuauaacaacuuguuuauaugagaauagaggcagaguagaaugguuaaccuagggaccuaccccguccuaguggaaggggcacuagauuugaauuuugacugccccucaccagauauaugaacuuggagaagucacuuaaucucuguaacccucaguuuccucaucugugaaacagggcaguggcuuguagggugguuuugaggaguaaauaaaauuguuuagcauauucccucaugguagacaccugaggaugcuaauaguaacagguucauuuuaugugagaaggcaucuggugugguuaagaucuuggguccuggugucaggcugcagguucaaauccuggcccugccacucauuagcucugcucuggugaucaugugacuucucugugccacggucauauagagugaccaugaggauuaaaugagguggucuauaugaaaugccacacugugcaucuucaaagacacaagucccaguuuugccauuuugaauuucauuuuuuuuucuguuuuguguccaacuuuacuaaaacauuugcuuauaauggggaccuuuuuucuuuuaaugucacagaugauauuucccgugucaaacuuucgguccagacccauucaacggaugacuacaucaaugccaacuacaugccuguaaguugggggacggucucacagcacuggacuguuucgaugaaaucuucagugugcuuugcuucuuucuguuucuuugagguugacuaugugcuguuucccauuuuuagggcuaccacuccaagaaagauuuuauugccacacaaggaccuuuaccgaacacuuugaaagauuuuuggcguaugguuugggagaaaaauguauaugccaucauuauguugacuaaauguguugaacagggaagaguaaguaucuuuuuuaguuuuuaaaauuuaaaauuacauuaauugcuuuuuauuguggcagaaggguaucuuaaaaaccauuuguuucuuuaaaaaaacucaaacauuagcacuuuauucuuauaaacuuguuuucugucuuuuuuuccccauaagagaaauguuuaaaaacauucuuuaaacaauucuauuuugucauuaucuuuuuuuuggacaaauaucagugucuucuguuuauuacguugcugcuggaguuaguaaauagcaaaaucucccaggccuagugcaagaugcuguucacgguguggcucuguucuucauuggccccaugaacacggacaagcccaucaugucucuaagcaaccggugucuucaucugugagaugaggguuuucaucagcuccaugauuuucaaauuuagguugagcacugaaccccuccugccuccaccccaggguuuuuuuuuuuuuuuuuuuuuuuuuuuuuuuuuuuugagacagggucuccucugucagccagccuggagugcaguggugcgaucauggcucacuacagcuuugaauuccugggcucccucccacuucagccuccuguguagcugggacuacaggcgugcaccacaugccuggauaauuuuuuuuauuuuuaguggaggcaaggucucacuguguugcccaggcuggugucaaacuccugaccucaagugauccugcuuccuuggccucccaaaguguugggauuucaggcgugagccaucacaccuggccuggaaccauuucuuuaagcaaaaucucagacuuaucccuggauaagccucagcagccuccucucuccugcaacguccugaaaucccucuucugcuuccaucaaagauaagauuuuuuuuuuuuagauggagucucacucugucgccaggcuggagugccguggugugaucuuggcuuuugcaaccuccgacucccugguucaagcgauucuccugccucagccucccaaguagcugggauuacaggcaggcgccaccaugcccagcuacuuuuuguauuuuuaguagagacaggguuucacuauguuggccaggauggucucaaucuccugaccuugugguccaccugccuuggccucccaaagugcuggauugcagaugugagccaccgccccuggccaauauuuuuuauaguaauaaaauucugcauuuccaugaauugaugugaagagaacugaaaaacacaugcuaaucuaaaaaaaugcugugccuuaggaaugggacuuaauguugcuuuaugaguuguuuuuaaguguagguucauugcuugaggaauaggauucgauuccuuaagccaguggaucucaaacuuuagcauccaucagcaucaccaggagggugguucuacccucagaguuucuaauucggaauugcguuucugccaguuucugggugauucuacugcuguggcaccagggugcacacuuggagugguacuguccccaggauagugggagcccuucaggcaucauuucuuuuauuguucuuuaauucaugguaagcuagcagauguuuauccagccccugguauauguaagauccugugcuaggggcugaggauggaggagggaaagauaacagagcaguaagagaugacgcccauccucauguugcuugugauagagggugggcuccuuacccucuuguugaaucaggagaauaggcuguaauagaaauaaaagcguuuuuaaaaugaaugcugauaggcugggugcaguggcuuacagcuguaaucccagcacuuuggaaggccauggugggcagaccaccugaggucaggaguuugagaccagccuggccaacauggcgaaacccaucucuacuaaaaacacaaaaauuagccaggcgugguggugcaugccuguaaucccagcuacuugggaggcugaggcaggagaauggccugaacccaggaggcggagguugcagugagccaagauugcaccacugcacuccagccuaggcaacagagcaagacucugucucaaaacaaaacaaaacaaaaaaagaagaaugcaaauaagcuuuuuaauacuguugagcccagggccuuauacaugaaacauucuuauaaaucuaucuguuagacaaacaaaaaugacauaauuacauuaauggagaacaugaagaugaauuuaaauggucuuuuguucaucuaaaaucaagauugaaguuagucuuagugacccugggugaauggggaagggaguguauuuucugcacuagauucuccauauauguuauuuuuuuucuguaacaacccugugagguauuaugauuucauagaugagguaacugaggcuuggggaguuuaagaacuugcccacaagguaggaacaaaaauauaccugguaagaggcugagcugggaaucaacuccaugucaguguguauccagauccuggguuguuucuuuggaaccugggucuuuaaagaaauacagaucccgcagccagagucagaaucucuggagguagaacccaggcaucucuuuuuaaacaaaacaaggccaggcacagaggcucaggcauguaaucucagcacuuugggaggccaaggugagaggaucacuugaggccaggaguucaagaacagccugggcaacauagugagacccccaucucuacaaaaauacaaaauagcugggugugguggcacgucucuguaguccaaacuccucuggaagcugaggugggaggaucacuugagccugagagguugaggcugcagugagccgugaucgugccauuguaccccagcuuguaugacagagugagacugucucaaacaaacacacaaacaaaaaacagaaaacaaaacccaaaacaacucaaacuucucaggugagucagauaaucaauuagcuuugaaaacuaccagcaguagagcacaccuuagaauacugagugugugugcguguguguguaugugggguguguguguguguguguaugugggguguguguguguguguguguguguguguguguguguguggucauuugccaaauggguauucagauauucuuggagagcagguguuuccugguuauuucuguucacaucugcccaccaacuuuauagaaaucaaagaccccagaaugauuuaauuugauuuucuuuauugguguguguauuuguauugcaaccgauguauaucugaaagccuugggaaaaaguccucauuucuuccagcugucugggguuaugggagaagaugaggucagugaacaguugugguggcuacucuaggggcaaagggagcuggauggggacuguguccuaggucaagggacagcugcugcucugcucuaaaucaauuuucaugcugaaagcagggccuguuguaggcagaucugauuuuuaaagagaaaauaagucuggauuuuuaugagaaauuuuaagaguuggcaagaauuguaaauuaaaaaaagaaaaaacaauuccaacaggugcuguggugugcccauagacccagcuacuugggaggcugaggcaugaggauugcuugagugcaggaauuggaggugguagugugcuaugaucucauuugugaauagccaccacacuccagccugggcagcauagugagacccugucucuauaaaauaaaauaaaaaaauucgaagggucaaacaaaacccaacuagaaggucugauuccaucucugaugccaguuuucaauagccagucucccuugugagguuuuagugauggcagauggcaugaucugagucuucuuauaaaaaugcaauuuuguucuagaccaaaugugaggaguauuggcccuccaagcaggcucaggacuauggagacauaacuguggcaaugacaucagaaauuguucuuccggaauggaccaucagagauuucacagugaaaaauguaaguaagaagucaggaucaguugagcucauguaauuaccauauguuaauuugggggugauauguuuuagguugauauuaacuaauauguuuuccuaugcagugagaaauguuuugcugcuuuccuuucagaacagaacaauccauaugcauguauacuccaaggcaaccccuugacuuuucugggaaauuuacuuucuugggaauaaccuaaguuauuucugaauaaaaugaaucuuaagagcauggcucuacaucaggaacucuuuccuuucuuuccacuuccaggugacuugcucauagauuuuacagaacaaacuguagccuuuuggauuauuugguuagaaauauggcaucaggagcggccacuugcuguuaggaguaauugauaacaguuacauuaauaggauuccagggcauaugcacauggccuuccuuccccucaaaauuuacaaaagcaaauccaauuaaauugugcaggcauucuaggaagucaaguuuaugugcuuuuuuucuuuuucaaggaugcuuugaaaauagaggcagugccaugaagcagcauugguaucuguugaugggugugugcauuggcauaacucucugcuguuuauaucacaggccuaaacauuaggcaugugcuggcuugaagucugagacuauccuaaggaaauaaucugaaaugcaaccaaaggcuuauucagaaagacgagucucagcauuauuuauaauagaggaaaacuuuggaaaccaugcagacaugguuuuguagcuuuuguagcuuuugcagaauggauaacuuaacuaugacucgucugcuuauaauaucauuauucagcuauuagaaaugauggcccaggugcggugauucuaaccugugaggcuaaggugggaggaucgcuugagcucagguuugagaccagcuugggcaacaugcugaaacuccaccucuacaaaaacaaaaccaaaccaaacccaaaaauuagccaggcaugcugguauacaccuguagucccagcuacuuggaaggcugagguaggaggauggcuugagcccaggaggucgaggcugcagugaaccgagauugugccacugcugcacucuagccugggugacaaagcaagacccggucucaaaaaaaaaaaaaaaaaagauaaauaagggauggguagacuauauaauuaccauggggacaugguaggauguaauguaagagaaacauucuaggagaugaaaauguaugcauauuaugaauagugcauaaaaggaaagccgggaaguauagauucacuggaguugaaucuugaaucuuuuggguggguuuuggggguugauggguuagggucuaguuuaugagauuauccuugaagauuccacaagucauggauaaaguauaguauauuaaguaguaauucuuuacuaauugcugugucucaaagggucuggccucaauauuucaguuccuccucuggagaugccaucaaagcuguuaccaugaucuggccaccuaaauaaugcagcucacaguaguagaaaaaugucaugcuuauuucuuuucuuuucuuuucuuuuuuuucuuuuuuugagauggagucucucucugucauccaggcuggagugcaguagcacaaucucagcucacugcaaccucugccucucggguccaagugauucuccugccucagccuccugaguagcugggacuacaggcaccugccaccaugcccagcuaauuuuuuuuguauuuuuaauagagauggggugucaccauauuggccaggcuggucuugaacaccugaccuugugauccaccugcucggccuccaaaaguguuaggauuacaggugggagucacugugcccggccugucaugcuuauuucuauagauuuugcucauuugaacugacuggcuucuccuugguugccuccacugcuuggggcuuaccuuguggaggggaauuuaggauggaguuguccacaucauuuuuaaaaauugcuguuacuaugauuauuauuuuuuauuaacuaaacuccagacuuuauucagauuucauguuuuuccacuaaagccuuguuuuguuccuggcucugauccaggacaccacauggcauuuaguaccauguuauuuuuuaauuauacaaaaugccugaauacauuuuccuuuagaaaaucgagaaauuacaaacagagcuaaagauuuccuuugacuaccaccccuaaccugagccccuuugccccuccacgaagauaauacuaaguauaacccuccucacuucucccucuuccucucccccuccuucuccccuugcccgcucccacucccuuuccucucccuccucccucucccuccucccucucccucccuuuuucuuccucuucccccaccuccaucucucacagcugguuucugucuuuggaucaguacuucugguuaaaugugugaauguuaacuuuaucugugaugaggucuucuagcaccucucccuucacucugucuguuuuuccuguuuuccaaauuuugaauacugcacauucuuaucaugaauauacauuucaaaaaaugagugucaaagggcagcugucauaauggagauggaaaugccugcagugcagauguaggucacauggguacggauguaggucacauggguauggucauucccugguaugggcauaacgaguacagcugagucagggacaggacucgccccagcuggggugggcuucuggugcuucaagguauaugcuuugguaugagguagggaaccagucuguguaauaaugagcucuauugucuuucagauguugaaauggaugguuuuuugggggaguccuuucucagcucucuccaauucuaaauauuugcauggugcuugcuaguggccugucacuuuauucacuucucuaggggacauagugaauuaugaggccauucuugccuagaaggcacugauuaucaugguguauuugaguaaauuauuuuugguuuuauugucagugacauucccaggggggcucggggauggggcucaugcagcucuaaggaggugcagguguaagaaugugaguucauuauugauaggcagcuguggcaggaagggaaggaucugaaugcagaauuggaggaugagggacuucuguugcaucugaaaucaguguuggggaaaugacuucacuucugugaaucucugcugccucaucuuuaaagggggauaauaaacucuccuucuugagcauauugugaggguuugaugagcaagcacuuuaucagcugcugugcaaauguaaaguuuaauuuuuagucauuacaacuccugguuaguacucaggcucugcuugauuuccccugccuuuuugauguuguuaggcagccuuucugucuggaucuaaaucauuuucugggcuuuuagauccagacaagugagagucacccucugagacaguuccauuucaccuccuggccagaccacgguguucccgacaccacugaccugcucaucaacuuccgguaccucguucgugacuacaugaagcagaguccucccgaaucgccgauucuggugcauugcagguacgcagauggcacgucacgugugacagauuucaaaugucauuauauauuuaugagcacuuuacaaaagcaaagccuaagagggaauguaauaggcauuuaugaauucaggaaagguuuggauaaggaaccauggacuuacucccuaagcccugagcuuccaaaacagggguuggcaaacuguaacccauggaucaaaucuggucagcugcuguuuuuguaaauaacauuuucuaggaacacagcaugcccauuuauuuauauauuguuuaugguugcuuuucugcuacagugacagaaagagaccauaugguuugcaaagcuuaagauguuaacuaucuggcccuuuacugaaaaaguuugccaaccccuaacaauaagaaguuagcuuugaagcuaaaggaauuaauuuaggacagaagacaggaggggcucuguugcccaguggggaaaaaauggcuaaaaugugccgccauccuggguuaugggcaacuugaauggaacugagauugaagaagcuugagcaaaggguuauauguguggcaucugacucaaaugugaguuugggacuuaggccccagucccaagcuagugcugucugacuugcugaggcuucaacugagcaaauguguacugauccugugcauugcccucaaagugugacagugaaggaaagcaagauauauguacaaaugaggaacucuaagaggguugcagucgagggaacccacuguaauaggcuuauuucucuuuucucucagugcuggggucggaaggacgggcacuuucauugccauugaucgucucaucuaccagauagagaaugagaacaccguggauguguaugggauuguguaugaccuucgaaugcauaggccuuuaauggugcagacagaggugaggccaagaucuguauuugacauuccacccuuccccuccauuuuuuuuuuuuuuuuuuuuuuuuuugagacggagucuugcucugucgcccaggcuggagugcaguggcaugaucuuggcucacugcaaccucugccuccuggguucaagugauucuccugccucugccucccaaguagcugggauuacaggcacgcacaccaugcccagcuaauuuuuguaauuuuaguagagacgguguuucuccauguuggccaggcuggucucgaacuccugaccucaagugaucugccugccucagugucccgaagugcugggauuacaggcaugagccacuuugccuggcccuuccccuccauuuuuaaaagguugcauugugucaugcacuuguguuaaaauaugucacccuuccagaucuuuccagcucuuggcugugaacuaacacuggauuucuuugcagacuuuaagcugacuuggaauuaaauuacccaauacaagugacauaguaguacugaugucaguaauggaacuacuacugagauagugucaggauucuuuaccuugcugccucugacucauuaaauaaucuuaggacaucuuugaacuuuggcuuccagguuuuaaacucauaaaacugguauuuuccagucuuuguuucuaagaaggucugaccaucuuuaaaauaagcuaaugaaacaaacucaucaaacauuaaugaugugacauaucauaaugcugcuuaaauguuaauacagcaauuuauccucacccagacuuguacauuuuaaagacuaucaauuaucauagcuacagaaggguggcugaccagcggagaaaaggaacacuuaauaucuaugguauaguuucuguacuacugcuggauuugguuuuacccaaacuguuacugagaaguguuuuugaggcauguuuucaacagaacauauugcaaaguugcuuuccucaaaggggugaauguuccuugaccaggaugagagcagaauauuaauuuuguaucaggcuaucguccuguaccgauuuagaacucuaugaauaugugcuguguuuuugagucuagcagggaauguucuagaugccuggguacauugcgugcucuggggugagcuuggugguuguuguggaaagagugaaauucaacuccuguguuggucaaaagagagauuuucuuuuuucugcuauaauuauauaaaguaguauuucucaaucuuuuauccuuuuuugagaaacauagaacucuuaucccugcuacuagagucuaaucucuuuuuuauauuuugaaaacaauacuuauucauaugaaagcauuugacaauauauuuuucucuccucuuuuuuuuuuuuuugagacggagacuugcucugucaccgggcuggauugcaguggugcgaucucggcucacugcaaccucugccuccuggguucaagcgauuccccugccucagccucccaaguagcugggacuacaggcgugugccaccaugcccagcuaauuuuuuuuuuguauuuuaguagagaugggguuucaccauguuggccaggauggucucgaucuccugaccucaugauccgcccgccucggccucccaaauugcugggauuacaggugugagccaccgugccuggccucaauauauuuuucucuuacucuuccuuccccaauccugcuuccuggagguagccaauguuuauaguuugguguacaucuuuauaagacucuuuauguacaucuguaaacacacacacacacacacgcacacacaguacuuugaaaaaauuggaugcuguuuuuuuuuugagauggagucuugcucuguugcccaggcuggagugcaguggugccaucucagcucacugaaaccucaaccuccuggguuccagcgauucuccugccucagccuccugaguagcugggauuacaggugugugccaccacgcccagcaaauuuuuguauuuuuaguagagacgggguuucaccauguuggccaggcugaucucgcacuccuaaccugagccgaucuaccugucuuggccuccccaaagugcugggauuacagacaggagccaccgcgccuggccagauccuguuuuauguauguugcuucucugugauuuuuuuucuccucuuauaauaucauggauauuuuucugugucagcuuauacccuuguuuccucuuuucuucaucacuauccacagauucugauauaccuaccugaaggauaguccucauccagcuccaccugaucaucuccuuuuaaccucgcuccucgguugagcauuacaguugauucuuacucuguacagucucacuagccaaggcaaucuuguuggacauuugauuguucgaaugugugugugcauuuuuuccucuacauuuccuccuuccuuugcccuucccugagacuguggcauuuuuccuuggggaggggagguguggagugugcucuucugguugagaaucauugaggaaggacaucuugcuucugugauuucagauuucacugcaauguuguuaccucuugaaacauguucgcuugaaccguuugcuguuggguggaugggguuugggaguugggcgggggaaugaccuguuugaaaauaauuuugggugcuaauuucugggacccauguucauuuucugucucucucuuucguuuuucuaucaggaccaguauguuuuccucaaucaguguguuuuggauauugucagaucccagaaagacucaaaaguagaucuuaucuaccagaacacaacugcaaugacaaucuaugaaaaccuugcgcccgugaccacauuuggaaagaccaaugguuacaucgccuaauuccaaaggaauaaccuuucuggagugaaccagaccgucgcacccacagcgaaggcacaugccccgaugucgacauguuuuuauaugucuaauaucuuaauucuuuguucuguuuugugagaacuaauuuugagggcaugaagcugcauaugauagaugacaaauuggggcugucgggggcuguggauggguggggagcaaaucaucugcauuccugaugaccaaugggaugaggucacuuuuuuuuuuuuucccccuugaggauuguggaaaaccaggaaaagggagcuaugauuuuuuuuuccaaaacaauuucuuuuuuaaaaaagacuauuuuauaugauucacaugcuaaagccaggauuguguuggguugaauauauuuuaaguaucagaggucuauuuuuaccuacugugucuuggaaucuagccgauggaaaauaccuaauuguggaugaugauugcgcagggagggguacguggcaccucuuccgaauggguuuucuauuugaacaugugccuuuucugaauuaugcuuccacaggcaaaacucaguagagaucuauauuuuuguacugaaucucauaauuggaauauacggaauauuuaaacaguagcuuagcaucagagguuugcuuccucaguaacauuucuguucucauuugaucaggggaggccucuuugccccgacuccgcuuccccugcccccuguacauuugugcuccauuuuuucuucccuuuucccucccaguuuucuccaaagacucuucuguuggcaacauuuucaacccauugguugggugagaauggcgacucaaauaucaccuugagaauuucugugggugggaaugggagaagcagaggaauccuacaguggcagaaauccuuuucuugucccuguauuauccuuuuucucaugucuguauuugguaugaaggauuauuuaaaggugcaauaugugaauuagugauucaugauguucuagguuuuuaguaacguuuuacucagguuggcauuuuaugugucugugucuguauguguguguguauguucagaagcguggcaaucugugaacacuucagcgugaauucagugucagauuaaucccuccuuccccaaaguccacuggcuuucgucucucucugccgugacacauaucggaaucuacuguguauauauauauauauauauauauauauauauauauauauauauauauacacuaagcucucaaaaacagucauuccuaugaauugagguguacaaaguuugaauuuguaucaaagauguaauuauuauuuuuaaaaccuuuucacuauacugcugcuguaauuacuuugauuuuuaaaauguagauuaauuuuuuuuuuuuugcuucagguguguauccaccaagaauuucaaauuuauguggauuuauuuuauugguacauaaucuguaaacuucuuaaggcauuaacaugaaaagauuuuuucuuuuuauuuuauauuguggcucagguuauauuuugaagauguuuugaguuuauccuccaauaggcaaugaaguugacaagguuuuaugaaggaauaaccaagucccuggaguccuguggcuguugccacaguaauguguccugcuguaaacaggacagguguguccuguugagaaugugagcgggcucuuccagccuccuggucccuccugacucugccacgccccucaccucacuggcacuucgauaacugacuggacguguuaaugggucuuuuaggguucuaaagggugaaccacacuuuuaaagccccggcugugguucggaggguuagugcuguaugccuuuuauuucccuuucccuuugagguacugaaaggaugaaaagguggugucauguuuuggggagaaucuuacuucucaaauggaaauugcacuuuuugcugaauccuuugcauuuuuuugguaguaagcaguucauugaguaucagguccucaaaggaaugaguuggcccggcuagggugggcccucuugaccuaacuucagagggggccuuggcucaguaggugugaaucagggaagccacauuguccucagggugcuguaugaagcugggugugggcggauuccucccacaccuucacacuggccugccuccaacucauacagaucucggagcggucgguacuucauucauaggucccuguucaggcagcaguucugugggcuguggcccucuccccuccaauauguccgaaaccauugugauggguggcaaaucccagggagcuccuaagcccugcucugcccacaucacugccacagagaagucagaggaagggacuuguugcuaaaaaauccuuuaaaagguuaaauacuuuaaaagauuaaagcaacauaacuguaaacauauuguauaaaaaugaaaaacacaggaacccucuucccuuccgccuggugugggcuugggaaaugggcaagcggccccagcaaucaugggaggaacucuugcgggggagcggucugggauuccaaaugggcaggucacacgaaggucacgaugcuucucugcauccugaaaagggcuggggacagggccagugggggugguaaggguauuuauagcacagugcuugaaaagggaagauuaauguguaaauauaaaggacacacaggcuggggguuggucagaggcaagaggagggugccucugagcuucaaccccucccaggaacaaugagcucaaauuggaagaguccaguggaaucggggggauggugugagcaccccuguucagucuuugacaauugcauacagaaaagcagcugguauggguuugggugucaaugaaagggccaaagacugguggccagcugguuugggggauuugggccauugauagcaucucccaggaacaacgacuuuuugccuccaaaguuggaucuagugaugaucagcaccagcaggaaaugacauuuggugucugcccacugcagccauacugugaccuccagccagacuuccgccuaauugacuccacuggauuugugcucuguugagucagaggcucccggggguuggggaucgaggggcgggggucagcuaugcagcccaucacguguguuuuucaucugggaugaaaaagccugguucucuuuugaaaugcuugauuguacuuauugagcuaaacaagucuuggugacuguuguugauuugccucaaaaguuuuaaguccuggguuuucagacuacuguguagcagcuguguguuuaacauacuguagcuuuuucucccuugggggcacauacaaauaggauguguugauguggacucuaaacuguaauuuuccuguaacuauuuuggaaugaugcauauuucuaauguuuguuauacuuguacagaguauugcuguugguugcuuuuuuuuuuuuuaaggaaaaaauggccugaaaacauuuuuuuaaagacuuacaaauaccaaauauaaaaaaaugucaaugcauuaugccuuugcuucuuucuuucuucuuuuuuccuucuuacaaugugccaagcaguuuacuggccugcauuuuacuugggcauccuuaacaaaaacacauuucucuuugggauuuccggauuguuuuaguuuucuagggcuguuguaacaaguaccaccaacuggugguuuaaacagcagagauuuacuuccuacaauuuugguggcugaaauccagaugugggcaggguugguuuccugugaggccuuuuuuuuuuuucuuuuuuugagacagagucucacucuguugcucagaguggagugcagaggcgugaucucagcucacugcaaccucugccuccuggguucaagcaguucuccugccccagccuucaggcgccucucuucguagcuugcagauggcugucuucuccccaugccuccacauggucuucccucugcuugucuguguccuaaucuccuucuuuuuuuuuuuuuuuugagauggagccuuguucugucgcccaggcuggagugcaguggcaugaucuuggcucacugcaaccucugcuucucgggcucaagcgauucuccugccucaaccucccgaguaguugggacuacaggugccugccaccacacccagcuaauuuuuuuguauuuuuaauagagacaggguuucaccauguuggucaggcuggugucgaacuccugaccucgugauccacccgccuuguccucccaaagugcugggauuacaggcgugagccaccgcucccggcuaaucuuauaaggacacgagucauacuggaucagggcccacccuauugaccuaauuuuaccuuaauuaccucuucaaagacacuccaaauguagucaaauucuguuuuaguggggguuaggacuugaccauaugaguuuuggaagggacccaguucagccuguaacacauauucagggcaauuuagugaagaggaggcuuggaggaaguggcugugugucuuaagauuguguguguucccagaagguuggagguaugagccugcagguggauggauacccaguugguuggggguguguuaugauauaguuagcucuccugggcuuucugcuuagggacagcgcuugggcugcggauaaaguauccaucaucuuccuguuuugauucaggccaaaguugucccagaacuuuucugcccacaguguugguuuagaggaggcagggagacacuguauugcugaccuguuaucugcauacuuaaaaaaaaaacaaaccaaacuaggcuacccugcaaaauagcacagcauucucugcuccuagcacuuaguuugauaaaaacuaccuuacccagguauagccuaggaauugagauauugugggaaagaaaaaccgaaugaucaccugugguuuuauaaaauguaaagcuuaagugagaaaacaaauucauagaacuauaaacagagaacaaucccaauaagaauuaaauaagugcauagaagaaaagaaacacaacucuagaauaauauaauagugggauuaggaguggauuuuauuuuuauauucaccuguuuauaguuucuaacuucucccaaugaauauggaguacuuaagaguaacuaguuuaaaacuuagcacuuuucccuccuugccucaaaaaagugaagcuacaguauaguuuuaaauuuacuagucaaguuacaaaauucuuuuuuuuuuuuuuuuuuuuuuuuuggagacagagucucgcucugucacccaggcuggagugcaguggcacgaucuuggcucacugcaagcuccgccucccagguucacgccauucuccugccucagccucccuaguagcugggauuacaggcgcccgccaccaugcccggcuaauuuuuuuguauuuuuaguagagaugggguuucaccguguuagccaggauggucuccaucuccugaccuugugauccgcccgccucggccucccaaagugcugggauuacaggcgugagccacgacgcccggccaagcuuccaaguucugauagccaucccaucccuucugggguuucacagcucuauuuggggcugaacguggcagaucucuggggccuccaacaugagagccugggcuuuacauuccugcaggcaggugaagccuccugacccaaaaggugaguagugggccccuguuggggccagcaguuuuggaugaugccacuagauggcggcagagaacugggcuguggaagcaauccuuggcuaggcuguggcagggcaguggagcacauaggauuggaaaagaaaccaggagguccguaaggcaaggcuaaaaaccagcaacagggcgaaggaagcgcccuugccagcagcuggcagcuuuccguauaauuuguuagauaauauguucaugguaaaaaaauuuaggaaaagaaggaaaauaaaaaaauccuaug

SEQ ID NO: 21357 - RNA, 7686 nt, Homo sapiens
acccuaaaccaucuuuuauugcgcacuucagccgugagacuggggcuggccugugugcccuaggcguaguauuguagguuggcuuucuucuuggccugcaccuccaggaugccuuccauguaguccucgugggugagcuccguggcaccccugcgcagugcgaucaugcccuacagccgggacaaacagagucuaggucugaacgccugaaugccuucccuggcucccugaggcucaggccucuucccucagccgucuccaccagccaaaugcccccauccuguccagggagggggcaagaaggcacaaagcaacgcacccaccccagcugaccacucaccgccuccacacacacagccuugcacugggccccauugaagucaucugugcagcgggccagcuccucguaguucacgucaggacuggggacaggacagauaccacaggcucaguggcuuaugcggaaugggcagaggggccaaauauccuccccuggccccgucaagcaacaaagucaaguugcccugugaucagaggcaagucccuuacucaaugcgccuuguuuucuucucaguacaagaugugggggaugaagggaggaaguuaaugcagguuauaacagguuauuucuagggucucuugagcucuggccuucuagaaaucugcaucugggacuccagggacugacuguccucauccugugcccagcacugcgcuugacacugucacaucuaauccuuaccacgacccugugaaaucagugcuaucauccccaagucccaaauaagaaaagugaggcugaggccgggcgugguggcucauaccuauaaucccagcacuuugggaggccaaggugggcggaucacaaggucaggaaaucaagaccauucuggcuaacaaggugaaaccucgucucuacuaaaaauacaaaaaauuagccgggcgugguggcgggcgccuguagucccagcuacucgggaggcugaggcaggagaauggcgugaacccaggaggcggagcuugcagugagccgagaucgcgccacuguacuccagccugggcgacagagcgagacacugucuccaaaaauuaaaaaaaaaaaaaaaaguaaggcugagagagggcaugccaccugcugagagucauacauaucugaacucaaguccaucuggucccggccauuccuggcguguguuaaugggcugaggugugaggccaggaaacuaagugccuccagccucugugccuucagaugagggguggagucuaaggagcagagcacccagaauuacgacaugggcccuggcaagacgcuacaucacacaacugaggagaaacggaggcuggcguguggaacggugcugugugugccuggggccugggaggugguggucguggaggcuggggaagaucaguacagagaagcauggcagagacauccuccugcgccuguucaggucucugugcccugcccgugcuccugcucaccugacauucaucuuucgggaguggaucugcaugauucuggcccgggccuccucauugggcaucgggaacucuaucuugcggucaaggcggcccgagcggaggagggcgggguccaggauguccacccuguuuguggcugcaauuaccugaggaagagaagccacaacuugaaaggagcaagguguucacagaugggcagacacggucaaaaaaggcagagaggcagcccccagagugcaggugagacacaugggauguuaaagacagaucccaauucucauuccagcuccaccacuggcuagcugggggccugacagcuccugaccucugagccucaucaucuuugccugggagugcuaauacucaccuuaacuuggguguugggcuggaagccauccagcugguucagaagcuccagcauuguccucugcaccucccgguccccagccuucucacugucaaagcuagggcacaggaagcccgagaugcuggugagggcacagcuuaggcagagcccuccccuccucuacccccuggaagccuaaccuaacccguccagggcagggaaauggcucacucaacuuggggcccccagcccagggacuggcacauaaaaagugucauuaauuguugaccacauucagagacugaagagacuccuagaaucaggugcugggcugaggauaaaacagugagcaaggcugggugugguggcucaugccuguaaucccagcacuuugggaggccaaggugggccuaucaccugaggucaggaguucgagaccagccuggccaaccaggugagauggugaaaccccaucucuacuaaaaauacaaaaauuagccaggcgugguggcagccaccuguaaucucagcuacucgggacacugaggcagaauuacuugaacccgggagguggagguugcagugagccgagaucacgccacugcacuccagccuggacgacagagcgagacuccaucucaaaaaaaaaaaaaaaaaaaaaaaaaagcaaaaccaaccacugcuugggcuguuaacugugaugaauguacacuugcaaacugagcuaacgcuuaaaaacacagguaucuggcccagccuuggacggugcuguacaggagagcccaggcaggcaucccccgggaaguaucccugaggcugagaucugaagguugaaagcacaccagcuaggcaaccaaccaguggagaacaggguaagagccacggcgggccugaaacgcaggaagcaccguggcaggaguccagagcaggggaggcuggggacaggcaugagaugagggugaaggcgcaaaaaggcagcacacguugagccuuguaauuccagcauuuaucccagggagcaacagggaggcccaggaaaguuugauuuuuuuuuuuuuuuugaaacagaggcucacucugucauccaggccggagcacaguggcacaaucucagcccacugcaaccuccgccucccaaguucaagugauucuccugccucagccucccaaguagcuggaauuacaggcgcacaccaccacacccggcuaauuuuucuauuuuuaguagagauguguuucaccauguuggccaggcuggucucgaauuccugaccucaagugaucugcccaccucagccuuccaaaguguagggaauacaggagugagccacugcacccagccaggguuuuuaacaggauugguuuaugucagggaccacuguggguucaugugagcgagguggccagauuccugcuuuggcuuuuuuuguuuuguuuucuuuuuuuuuuuuugagacagagucucacucuuucaccaggcuggagugcaguggcgcaaucuuggcucacuccaaucucugccucccagguucaagugauucuugugccucagccucccaggcaucugggacuacaggcgccugcuaccacgcccagcuaauuuuuuguauuuuuaguagagacaggguuucaccauguuagccaggauggucucgaucuccugaccucgugauccgccugccucggccucccaaagugcugggauuacaggcgugagccaccgugcccggcccagauuccuguuuugaaaggaacaugcuggcagcugugggaaugaauggcuggggaaacagggaggcuauugaucaggaguuaggaauuggaaucucaagaguugaggagccaccauccaggggcaggaggggauacagggugggaaggaaccacaauuuagcacaacugagagucaacccgcuuccccuuaccgccacagagaucgcuagggacccuuggcccucccuuaccgcuuggugccgauggcauccaacucaucaaugaagaugauagagggcgcuuucuccuuggccagggcaaaggcaucccggacuagcuuggcaccaucuccaaugaacaucugcaccagcugggggccagccagcuuuaggaagguggccuggcaggaaaaggugguagagucaggucaaaggcagacccuuugagcccaucugguagaguuucugcuccugcccacuucccccgcaucccucccaaaguacucaccuuagucugugcggcacaggcccgggccaggagggucuuccccgucccugggggcccauacaucagcaccccuuuuggagguuggauccccaaguucucaaacuucuccuugugguucauuggcaagacaauggccuccaccagcugccaggaggaaguccugggugaggagaugaagcccugagggcuucuacagcccaacccuucauggcuccaaccccaaucugcaucccuccuacucuaacucagggacacgcccauuucuuuccccauaucaagaggacacaaggcugggcgcgguggcucacgccuguaauccuagcacuuugggaggcugaggcgggcggaucacaaggucaggagaucgagaccauccuggcuaacacggugaaacuccgucucuacuaaaaauacaaaaacauuagccgggcgggguggucgggugccuguagucccagcuacucaggaggcugaggcaggagaauggcaugaacccgggacgcggagcucguagugagccaagaucacgccacugcacaccagccagccugagcggcagagcaagacuccgucacaaaaaaaaaaaaaagaggacacagaacacucauccccacccaggcuggcuauggacucuccaggaacgggaguauauggcagaaaagacaccgggccaggggcugggagcaguggcucaugccuguaaucccagcacuuugggaggccaaggcacgcggaucaccugagguugggaguucgagaccagccugaccaacauggagaaaccccgucucuacuaaaaauacuccgcuaaaauuagccaggcuuggugucgcaugccuguaaucccagcuacucgagaggcugaggcagaauugcuugaacccgggaggcagagguugcggugagccgagaucgugccauugcacuccagcaugggcaguaaaagcaaaacuccaucucggaaaaaaaaaaaaaaaggacacugggccaagaaccaggagccugggcuccaguccuggcucuggucucucugugauccugggcaaggcauuuaaacucucugggcuucagucuccucaccugucacauggcaccccucccuuccucccuagguugcuaugaggaugaaagacacauuagggagaugagcugcaucaauggcguggagaaacuaaaaggcugacaaggcugcuggcagcugccgugccucccucaccuccuggaucugcuuguccaaacccccaaugucacuguauugcuccgugggccucucgucuaccuccauggccuucacccgcgagucauacucugugggcagcgucuccaggaucagauaggagucuuuguucacacccuaaggacacagcacagggccuucagauuuggcccagcucaagggcuacccaacugacugggugacaggugucugcagagggaaagacacaggacugggcaauacaagaaucaaacagcaaguagacagaaucccagacucucggagcuguucugccaagauucagagccaacagugaccuggggcggguacaggggcucagcuagucaccagaaaagcacugccugggcucaggccccacucaccaccaggucuccuggcuuuagcuuuucagcauccaccaacccaaucacaggaaggaaguacgucuguggacaaguuacaggggcagucucaguuaguguccucagggaaggcucccuaguccugucccacauccgcuccucacccuccuccagucucucauugcugagccacgcucaccugucguguagagguuuugaucacagcacacuugcccuuccucugggaguccaggucaauauuggcaccauccuccucuuggucauuaggaucaacauccaggagcugggaaggaaaaaauacucagcuccuugaacuccccaaggcccagugcuuccuaagacaguuccuaauaccugcagggcuggccauccuuaccucccuccuccaauagcccugagcccaccaaacgugggugccccugcuaagcccagggauugaucucuguguaggugcugcuccucugcacagggcucaucuaccccggaggagacauaaccaacagaaaaggagacacgugagaccucccaggacuuugcaggccccgucuuccccaugaaagugccccaggagguguagcucugacaugcaguuuggccucaauaccuccacccacucuuucccuaguggccccaccccaggcuguccccauucccugcugacucccucucuuccccuccacauacacacacaccucgaugacguuggagacaagguacggcagggucuuguucacuuugauuuucucacuguucucuuuuaucuuguccuucauggcuuggagcucaugggugacucucaacacuucacucuucaugaucugagaucaggaggggaggagaagcaaauauaaacccuggcacagcuuaugcuagagcccuguaacuagugagguccagggugcccaggggacccucccgcauccauucauccagcucugaggcucucugaaggcagagucugacuguguccacauccugcagaagucaaaagaggaggccaguuuggaaaccuccuggugaaauagugguaguauuggaauaaaagcaggccuccgagagaggcaaacauagguuuuagguucugccucauaguaagaacugggugcuuuaucgcaguacaaaccucucugggccugucuccucaucuguaaaauaggcauuuuacuaaaagaaggauucuugagaggauuauucccaguucucacugggaaaggcaaucugauaacuucucaucucagcccaggccucccaccacccccuaccugucuucuugucccuuuuaaggcuuaguuuucuuuccucucuuccugauaugagggggaagcccgagccccaugucucccccagggugcccgauuaggaaguacgagaggcgacucggaucgccggggccuguccugugggggcuccaucgcccgcacaggagcugugcgcccaccuugaucucacuguccagcagccgugugcgcuggaugaucuccuccguggacaucuugagcaccuccuccccaauuccaucuugcuguaaaaaauuauuuguuuauuuauauauuuacuuuuacucaggacaagcaucccucguucuccgaacccacucacagccucaguuuccacgcccauaaaaccaggauggagucaggaccccugcccacaucccaaacaaccccguccccgggaucgggccagaccuugacccccagccaccuccuucccucuugucaauggcgucucccugcgggccccgguucccggaccgccagcucgcccggugcccaccucggccucaucccacacggucgccaucuucuccugccgagucacuggacucucaauauucggcagcagauucauuuccuggaggagcgggcagaagaugggaccaggcgggagccgcaacgggagauuaauaccgucuuucuuaaagccuucucuugaccaguggaaaaccucuccccacaaaucccgacucuugacccgaccagcuccggccgugcugcggagcagcgaaucugccucuccgauuccaaagacca

SEQ ID NO: 21358 - RNA, 7003 nt, Homo sapiens
uucuucagugaaguuuauuucagaaccauugaacaguaugauauuugcucauuuauaaauauucccauuuaaauaaucugagcuuauauauuuucagucuuaauuaaaggacuugauuuaaagagagcacaccaguccaaauugaauugauuccauagcuauuaaaaacuaggcucuuuuacagacacugcuacuucuugcccccuuugaauaaauuagaccaaugaauaaaacaaacaaacaaauaaauaaauaaauagggaagcgguugcucaucagaaugugggagcgaaugacagaggguuucuuagaaccaaauguggccgugguuucugucaggcgggcuuuaagugaguaggagaggugagagaggccuggcucaacaaaagggcuggggauuggcccugaaaggagagagcugacuguccuggcugauggacaggagauccucuuagcacuacccuaaggcaggcaguugggcauugguguagacaacaggaaaguccaggcuauagccguacucaaaaaccuuucuguucccuuucugccagcccuagggauugaguccacauucagcacaggacucucuggguacagcucucuuuaggaagacacaaauugcauggugaagucaguuauauccuggccgccuuuggucccucccaggaagacgggcauguuuucugcuugagaggugcugauguaccaguuggggaacugggcagacucaaauuccagcuuguuauugauuucuaucuuguugaagacaaaucgcuuuuccaucuucuucuuuggguaauuuuugggaucuacacucugcagcgaaagagaaagaagaauuuuuguggggcaagggacaaagaugcuaugggaaagauguucuuuggguuggccagaaaggaaacugacgagcaggucacaugaucaggagccagacuccugaguuguaacugggcccccaacuuuccgugugauuauuaaaagagcccuucuucuuuucuaaaacuuagugccaaaugcugaggagcauaauguaggugagaauuuuuuuuuuuugggggggugaaaauuaagcuagagcuucuugaaguaccuaguuuccaggggcuuuuuauuguauuuuuccuuaugguccuagaaugacaucaacuuggaaaugaagcuuuugcugagaaagcuggaggugauaguggugguaauuuugggaguggaguggacaugauaaugggacccuuuaagucaucuauuucccaaggugucuaucaaaugagagcagcccuaacaauauauaaucuguugggguuguaacuaugguaggacauaauaacaucggcaaaaugauuuaauuuucugcagcaggauugaagguugcacgcaguuaaaaauuauguuaaauuuauuuacauuaaugcaaaauugucaaauagaccuguucccagcuuuuccuagggaugggggcggggagaaggugguugucugggaauaagugguagcaggaggcugagaagggcuucauuccauagcauucacuuaccuccagcuguagagugggcuuaucaucuuucaacacgcaggacagguacagauucuuuuccuugaggcccaaggccacagguauuuugucauuacuuucuucuccuuguacaaaggacauggagaacaccacugaagaaagaagggggucuugugguuagggacacagcagugcagggucaccccaaccccuaggccccaugaguaggauacauguaauuugguagccucugugggaacccacagugagguuccuuggccuaagacacaggauaacuugacuucucacagacaauagcagggucauuuuguugauuuaggguuuccccucaaaggccugaggguuucucagagccucauagcaguaggaacggagaaugaaagagggucuacauuuuaaaugcugaaggaaggaaggaaggaagccauugugucacuggcuggcaaugugcccauccacaggagcggaacaacuugaucaauguggaaggaaaggaaagaggugaagcuguacuucugccagaaaucaggcaccagaacuguuucaggaacagagaguagcccaugggaagaaacugggagaggagaggcugagcugggaaaguggcuccaaagagagacacucauuuugaucuuccucagucacagcagugucaauuggaggcccugggaucacucuuacuacccgauuccaaagaaacaggauuuucuuggccuggcugagagcaaauagcuucccccugagugaggcuguccuucaaagucagcagccuuaguugcccacacuccugugcagaggcuuuggcuacuguggcacgaugccaggcagaucaccacagcuaaugauggguucaccgcacuugaaacuuuugcccguuacagcggagagauauaaguuccugcugggcgguaaaauuucccuacaaggaaccaccuggcauugggugggacggauguuggggcaaggggggaagacuggggagggggauggacacauuaucgcuccagcacucuuguuucagccucaacaacaggaagagagaacccacaggcaguuaggccauguccaucaaaugaccccauauuguggaagaauugacauugcacuaugcccaagagacuuggguggacaugguccugggagugcuugagccgucuaauuucucagggucacacuccuguuaacaaaugcacuggccagugcaaucaaaugugccauuucuaggaccaaaguuuguauauuccuuuuuaauauuuuuuuucacuuguguugaucauuugccuuaaauuaacuuucuacuuuguuuaaaacauggagaauuagcaagcugccaggaggccaggcagggaaaccaggauguuuccauuuaccuuguugcuccauauccugucccuggagguggagagcuuucaguucauauggaccagacaucaccaagcuuuuuugcugugagucccggagcgugcaguucagugaucguacaggugcaucgugcacauaagccucguuaucccaugugucgaagaagauagguucugaaauguggagcacauguuguuuagguauaaaaucagaagggcaggccucgugaggcgaggcggcaaaauuugauuucuuggaggacaccugagcauauacggucaaagucugaugacaacaccaguagggaugaagcugggagugggguggcuaagaacacuggaccugacacuauuagacauggguuccagcuucaggucuauuacugcucacuguggccgagcaacagagcuacuuagguaaaauggugauggucauaacacuagcccacagggagguuacgaaccucuggugacaauguaagugaaaggccccugagaaagagugagggaguugcaaaugucaguagccaucaagaucuucuuuaagaauaguuuccacuaaagagaugauugcuuugguuuccagccuucuuuguuuugucuccccgcugggccuucuaccuuuaaagggcuuuggcucugggggaauugaguuggcuggggcuugaugacuuccaagaggacacaaguggagaucuacugccugcucuuggcuaacuaccuucuucaaagaugaagggaaagaaggugcucaggucauucuccuggaaggucugugggcagggaaccagcaucuuccucagcuuguccauggccacaacaacugacgcggccugccugaagcccuugcuguagugguggucggagauucguagcuggaugccgccauccagagggcagagguccagguccuggaaggagcacugcggagagagcgagggagggagccuggugaggugguccugccaggaaccaugcuuugacaucagagaguagaaagcucagagaggaggaaagggcuugaaagaaucccgagcuucuaaagaucaucccucucugggccaggcgugguggcucaugccuguaaucccagcacuuugggaagccgagguggaugaaucauuuaggucaggacuucaaaaccagccuggccaacauggcgaaaccccuucucuacuaaaaauacaaaaauuagcugggugugguggggugcaccuguaauccuagcuauucaggagacugaggaaggagaaucgcuugaacucaggagguggaggaugcaguaagccaagauuguaccacugcacuccagccugggcaacagagugagacucugucucauaaaacaaaacaaaacaaaacaaaacaaaauaaaauaaaauaaaauaaaaagauuaucccucucugaagcucaaggagguuaaguguguacucaagggcacacagcagguuagaggcagacucaagacuagaaugugggcuuucugacaccuuacaggcuauucuuuuagaauaaaucccauuucuacuuuguucaucuuuuuuguacaugccccaccuacaccauacauguauaccuucucuauaucuuuuuguaucccuaaugcugucacacuaugauuugcuuuuucaugcagaugaccauaacauuuuccauucaccuaugcucacucagcaaguauucaauuuuucuacacuguucuuuuuuuuccuuuuucauaacacugucucauaggcauucugcaaauccugugagaguacuuuuugugaaauguuaccacuuuccucuuauucagagaagcuccguauuaaggcuucacugagguugccuuaaggcaugauaaugguucaaaggcuugaaagacaguuaaagagaccuguaagugcacaaaagaaaguugagcaggagagaauuuccugccuggagcagagccaagcugcuggaagaggcaaugggggcaaaggccaggcagacaagccaaugggcuccucccacagcugcagccaacaaguuaugccagucuuaaaacuucuaaagaaauauguuuuuaacaagauugaggacuggauuaugaggcuaggggaggcuaucacaaacuggaauaaaauaaagccagagaaaaguggcugccucccaaccugcacaacugaccuagcuaggcugauggcugggccaccuaggaaggcuacugagcaucauauaaaacagaagggacagcaggaauauaacauggcucuuuguaaggaugagucugaaaaaugaccauuugcugcccaaaugcccuuagcuacaacugaaaauauuucagaacuggagguugcaggaugcuggaaucucagagaucauccagcucagcccuuuauuuuucagaugagguccaaagcggguaaaaugacuugucaaggucaaacagcaagugaaugguuuucuuucaagucucaauucaucuuuuuguuuauaucaucuaugucuuguuguuauaagcuucaccccagguagcaaaaaacuauucuacucaaaagggguagacauauguuaguucucaagaucaucucuugguuucagaguuuaacucaagugauuggcauaggcugaauccaucucuuaaaaggauaaucaaauuuauguugaagacuugguugucuuccuacuaugaaaugggaaacauuaucacuacuccuccccugucaccaccaaguguggccaccaccaccaacguuagugagugacuguggugauaugaugaccaaguggccaggucagcaaguggugcagccugugucucacuggaagagguuaaagucuuucuaaaacaaaauaccauggcaucaaaguggcccagaacucccuucuuugagcuuucccuguguuagagcccuuccuuggguugggaguuaaacccauagucuuaccuucaucuguuuagggccaucagcuucaaagaacaagucauccucauugccacuguaauaaaaacagggacaugucucaauuaugucuucuaaacagguuuauuuuuccuucccuguguacaagacuugacuguucauaagaaacugcaaacagccugccucucaaagcugccugaaacaccuggcaaguuucacagugauaugcgcagaacaguccagaaggcagauucuaggccuggcaggugggcacccugggugcucccuguuggaucuugaggccuaaccucuagcccagcagagucagcuaaaaucugagcucucccucucccuccaagccacacuuugcaaagggauuccuuguauugugggcuuggagucuuuucuccccauuugccucugcaggaagcccuugcaacaacacaucuggauagccuccaggucccaaggcuggagggacuuguaaugggaaaguagucuuuaaaucagauuuacuuggcacccuguuugccacugaaagaggcaauuuaggggaaaaaucuggucuccaagcacagauaacacucuacucuugaaagaggagaccugcucauguuacuggucucagcgucuccacugaccuguaauaagccaucauuucacuggcgagcucagguacuucugccauggcugcuucagacaccuguguaaaaaggagaaaaugagugacuuccccaugacggcuacguucaugugugauuucucucagcauccagugcauggcagucaugcaaagaaaugaucucugaguaaaugaaugaaugugugaaagagaaguccuuugggucuagagaaaagcauuugcuaaaccaaaccccaacuagcaauguauuggcuaggagagcuggagcagaggcuuugacacuaaccuuuagggugucagcuguuagauaagcaguauccauucccagaauauuucccgagucauaagcauuauauuacaccuggcauuuuugcaaaaagcugagagagggaggcagagagggaaggagagggagagacagagaaagaaagagagagagagagagaauaugcauacacacaaagaggcagagagacagagagacucccuuagcaccuaguuguaaggaagauuaaagucauacuugagcaaugaagauuggcugaagagaaucccagagcagccuguugugccuug

SEQ ID NO: 21359 - RNA, 11553 nt, Homo sapiens
uuggacuuuauagaaugaaaugccagagauuugauauuuauuaucugaaauagguuuaacauuuggagaaauguguucaaacacacaaccuuggaaagaaaagcaagcugauaggucagagaacagagggugggcagaaaacacgaugugcauaauuuugcugcguguugggcaaaaaguuagaaaacuggguucuuuggagaauaaagagcucucagaugagguaaagguaaaacacaaauaaauuuccaacccuugaugagggccacgagauaucaauuuuaaauauauaugaccacaauaucaauaaugaagaaaucuuacguuuuauugaauacuuuggccagaucagccccuuugaagggaucacuaauuuaggaaagaagaacaacaaaccaucauucacuuuccugcagguucaucguuuuccuaauuauuucuauggauccugcuuuauucuuucuguaaauuaaggggcaggaggagaguuucuauaauagaucagcaaugucugguucuuauccaaauauuccaccuaauaaggauguaaauucucauggauuggacaaucacucugcaacauuccugagaauugaauaauauaauaaucuugaaagucagcagaguggauuauccacuuuuuuuuucuggacuugaacuugugaacucaacaguagcacugcaaaaaagcaaacgugcuaagcacuuugccagaguaaccuuccauguagacuuuucaucuuaaauacacacaacugaaaacaacuacaauuuuuggaaaauuauguacaaacccgauacuucuuuugauuacauauaaauacaaauuagcuauuuuuuuccuaaaaagugguuauaauaguaaauaaauacaaaauaaaucugaccauuauacuucaugugcugggguugaacccauauaaaauguacaacuaaauacauuuuaaaucuuuaaggaauaauucucugauuaaaauauuuguuuucccaacuucuuuucguagauauaaauauauuuucaaaauagcuguuuuuuuuuccauuccauuccauaaauaaagucuucauugggaaauauuaaagugucaacuggggugggguuuuuuuguuuguuuguuuuuuucuuuuuucuaaaauauauauauauauauauauuuauguauuuaauuuugcuguacuagcgacacccacaacccuccacaaccauguccugauaguucuuuaauacaaccuuuucauucucgucaagguacagcaucgagauagcacugaguucugucgggacacagcaugccuuaggaaucuuagaguuaacagaguugaccaacgucugaacaauggcaugauuaguggaguucagaugaucagccagaggaaaagggcauucuccguggcaguaaaaggcgugauaccccgggggagccacaauccagucauuccaccccacgucacugaaguccacguacaaagggugucucuuacagcuggacuuaaggcguuuccgcuguuuguguuuggcuugacguuuuucucuuuuguggagaggaugcccuuuuccaucauggccaaaaguuacuagcaauggccuuaucugugaccagcuguguucaucuuggugcaaagaccugcuuauccuaacaugucucuuggagacaccuuguuucuccuccaagugggccacuuccaccacgaauccaugguuggcgugucccugugcaguccaccgcaucacagcgggggugacaucaaaacuuucccaccugcuugcauucugauucaccaaccugguguccaaaagucuggucacggggaauuucgaguuggcuguugcagguuuuaugauuucauaaauauuaauucggugauggaaacugcuauuguuuccuaaagcaucuugcaucuguucucggaaaaccugaagcucugcugaggugauaaacuccuccguggggauagaacuuaaauuaaagaagaaucuccggguuguuuucccacucguuucugguaguucuuccaaagauucuaauuugauagagaaaaacagggaagaaaaaagaaaagucugaauuucaguaagccaaguaaugacguuugauuaucuaugagaauuuuuaaaccucaucgugggauuugauguaacccauguaaaaguagguaaccagaaaauaaaaauuuccucuuuaaauaaacauggagccucccuucucucuguucuguaaguucaugucaucaugcauugcauaccaggaaacaaccuuucauaauucuuuguuguguuuuugaucuaauacaugaauacugcuuccagguggcuauaauaaugggggaaauggugaagcauuucuuuggaauuccagacuuuaggguaaaaaaaaaaaaaagucagcacuauaguuaguagaggucuaaugagugaggauuugaggaaauuauugcauuucuuuuuuaaaaaaggcuuuaaugccaaucccuuaagcaguauucuaaaacauuacucugcaauuuagaugauuuacaaaucucgauauacagauuucagcuuccuaauuaaagacucugaaacucaacaucaacgaugacauuuugcaaagcacacccuacuauuuuacucaaaaguccagagacaaaggcauuuacagggaucuacuucuuuggaaacguaugggugguacuaggacacuguaguaauuaaggccaaacaauuucaagagaaauagcuuucccaacuguugucuguucucucaccucuuuaugaccucaaauaucaaaaucucauuuuagaugcuuuuggaagaaaaauaaaugaccugucuucuguuugcaaugccuuuauaguuuugaaagauaaaccauguuaaaaaaccauguaccuacccaguaauagugugcaggauggacacaaaaccaaaaaaauaauaaaaauuuacaaaaauaugauuaugaucuccaugacaaaaggaacagucucauccuauuacagaauaauccuucuauauccacuaucauuauuucaaaauagccauuuaagugggccaugcacaaaagcuuugucugauuuaaaauuucugaauuucaauuuuuaagaaguauuauucuccaagcaaguaauauauaacacagcaccuugaaugcuuguagucugcaaaucaucaaagguacaacauuauuauuaaacugguaguauauaccaugagaguuugagacauuuaaguuuauuuuauucuaacuuuaccacauccuaucauuucacugccaacagaauuugccugcuucauucagaauuccuacccaagugcuaacaaaaucuauuuugccaucguuccauguuaucauaagaagagacuauguuuuuauuaauuuuacaguuguauuuccccuaaagacaaacagcuguaaguugugcacugaaucuagaugccuuagcaaaggagaaucaugucagaucacucacucaaaggaucuacccguguaagccuucaucaucaaagcaacagucaucaugcaagcuaaguggacacaccaaguucagucagggcaguuuauaccaaacuaacgcuuuaaugcagugcuuuucaaacuucagccuucacauaaaacagcuuguacaccguaaagcuucagaugcaggcucugauucaguaggucuggggagaugcuugagauucagcauuucuagcagcuccucaaggaggggauucugggaacuguaagaccacacuuggagugucaagguuuugcagcauguuuuucauauuccaguauagauugccaggagugcauuuuuaaagugccuuuuuguuaaauaauauaaaaacuaguagaagaaccauuagugguggcaaaggaguaagaguugaaugggccagcucugggugggcccagccagggucucagaacagaagguucuucuaaagcucuucuacguggauauggggaguaucaggccaauagaguccuuuaggguucccuugugccuauuaauccaaaccucuggggaauaccuuucaggauccauccacauucuaaacuccacuggaagcuaaugguacuuuaggccagacacaaucauuaaaauaaccuucugaccauuugaaccuggacucuucucaguggcucccaaggaguaccaaggacuguguuuggccuguuuuuuucuccuucuccuugcaauucagacguuucugcugaagguaauuuuucagcagagaagguaaaagucagcaaccucagaccccaaugacaccaaagccagaccagcaccugagcuacuggcuuaucugauaagaauacaucuaagaacacccucuuuucuuucaaagagggggaggcaaggaaaauuaucuagagcacucgcugacuagcuauauuaacaaaagugcccagagaaaucacaauugcaagaaaaacccuaaaucccaaugcauaaagaaacauacauucucacacauucucucucucgcacacacguacacacccacauggccagacgaugacagugaagggacaagcuacaagucaaguaugagggacagguaaaugaaguaaagaagauggguauaaaaaagguaugaaauagaauaauaaccucccaaaaaauuaaaugacaagauugaaucauacaaaauugccacuauuugaccagaaacacagacaacaacaauuucaugugguucaaggucucaguggaaguaggcagccuuagcaaaggagaaucaguuaguggccuuaagaaaggagaaaaaauagacgagcaaauaauaauaggcgauacgaagaucuuucucugaccuucccacugcaccucagugaaucuguuucuugaaaggucccauccucaagacaaaagcauccauugcaacaccccugguugcagaaacaggucacagagguaaguuagacguucacagaaacccucaaacccaggaaaguaacuggccaagguuagggaauauacgcucauuuucuuuaaucugccagggaagaguacgaaucuuuucuuaaggguacaaaaauuaaaaccuauuugaaauaaaguaaauuaaauaaacaaaccuucuauaaaucaucacagcaacccugaggaugccaaaaauauauggauccucaaguaauguaugcuuuuuuggagacuuauacaauugcuaguuuucuguaaauaucccuuccugaauaagcugaaguucuuaagggauuugaggauuucgaccugucuuugacccgaguuugugagcuucuaaguucuuaaccaaauggauggagcuauggcugcaaaaaugugggaaagugaagaaaaauaagacaacaaugauaucugaacuuuucuccaaaagugaaguccuaauuuaauaaucuauacuauaucaaucauuccucuaccucaaaauaauucaaaagacugagcugaauucucucagucagccuagguccacucuggccuccuuuucccuagagaaggaaaggcuauaacauuaacaaaagaagucauaaugauaaugacagcugaaugcuuuuuuugaguguaaucuggcaccaucagcuuuauaugaauuaucucacaacaaaccaauuagagaaaaacuaucauuaucuccauuuuguaaaugaaacaguugcaguucagagagguuauguaacuuuccuaaggucacagagcuagcaaauuaaaaguagauauauauaauugaaucuacugcgcuucucagguuucuugucuuuuguuuuguuuuguuucuuguuuuugugacacagggucucacucuguugcccaggcuggagugcaguggcacaaucuuggcucacagcagccuccaccucccagguucaagcaguccucccaucucagccucccaauuagcucggauuacaggcaugggccaucauaccuggcuauuuuuuuauauuuuaguagagaugugguuucaccauguuggccaggcuggucuggaacuccugaccucaagugauccacccaccuaagccucccaaagugcugggauuacagguauuagccaucaugcccagccaguucccaaauuucuggcuacuagauggcacuaccuaacauacaugaggacucaaaaacuuaagcaaaagucaaaaccauuaggggcacauuuauauuuaguacaaugauaacauugggugaguucugucccaacuaaaugaacagaaauauaugacuuagguaugauggacagaacagacagaaaugagcagaaaagugacggggcccacuggaaugugucuauuuuauaaggagccacugcuauuuuguggcugcccuuuuguucuaaauaaaguaugguaaguuuuaucaaaaaaguaaguuaccguuaugcuucgaggauuuuaaaacacacuuugggcuaaaaaaucuccaguaaaacaacaacaacaacaacaaaaccuggggauaugcuggcaaucaguaaggcuggaagucacugcccuaacacaaaaugaaagaggcugaguauaauauaagauuuuccagauaauaaaauaacagacaacugaucaaggagaaaaaaaauaucaaauacaaaagguuaaaaacauuccauuuuaaaaaaaauacaacaagggaauggcaaauaaaggaauagagagcaugguugucaucaacaacccugauuuggccucugcccacccuuaacaccaacaccuucggaaugaugaaauauucucuuauugucucagugaaaauacacaaagagcaagucuaagaacgcaaaauaguucacugcaaagggauuaagagaaauuuaggggaaccacuaaaaaacagguggaacggaaaaugucagugccaaggaaguaucacuggacaccaaagccucaaucucaacaaccauuuccaaauagaguaauuuuccuacuuaauguggccucuguaaugacaaugaaauaccuggggccacuagggaaccauaccagguaaguauugguuuugguggaucuauguguccaaaucuguuguuugcacgggggaauuugugccacaaagucucuaaugcagggcaauaguuauuucuugaacuuuucuauuauauggauauuuucauaauaauuauauuuguggaaagaggguuaaucucuauuugaaagcuucagucacagaggcaaauaauccaguuauuucauguagaaagaagacuguguccuucagagugaggagaacaagaagcaccuggucuuucucucucccaucugacaaaaaagcauaaagacuuuuuggagggccagugaagucaaccaguuucaauguguuuccaacuacagcaauacacaaaacacucuuuccacuugcagaacugacuuuucuauguucaauggcaguuuccaaaggucuauguagcugaagcacuuuuuaaugaucuugaaaacaauaacauuuuagcaaagcugauauucucccaaauaaaagccacuggagaaaggacuagacaaaauucaauaggaaaaauacaacugauaauucugucucagauccccuaugauauggucgcauuauacucauauugguugaaagaaugcuaucaugauaucucgucgaguaauuccaccaaaccauucgaucacaccuacaaagaaaacccaacagguaauucuuaugauugggucuuuauggucuuuuuucaaauaaaugcucauuaaugcuguagaaacuaaauucuguucuugagccagcaaccuucaucacaugguuuaccaaaaacuuuuuucguggcaugcauggcacaaggauguuuaucaaaagcaaauccuggguguauacaacaaugauuagucuugaaaaaagugcuauauccauccagauuaaggaugauauauuagucauaaugagacaagaaauggauuaguugaaauuuggggcaaaauuacauagcuuuucuccauuaucuaacugcauuaagaccugaaguuauuacaaguugauuuuaaucaaguuggucacuucuguacuguuucucagguaacauuuacacucacaaagauauaaauucugauuuuauaaacucaagcaugcuuuuuaaguuaaaauaacacaguugaauaacguguagccuguuuaguucugaucaaaccacuucuagaugaaugaugagaauaugcagacaucacugauaaaauccucacacaauggaauguuuuagguguuaacuaacuuaaaugaucuuccuuuuaaguuguaacagagacacagcaucuuccaggccuuaaaaauaaaguugagagcuuccaugcuaaauuuccagaagaggugucuaaaacaguuguucuuauuacauuccuauacaaaaaaaaaaguauucuaaucagcauuaccugggaaugauuagcuggaucuauaaucauuucaggguuaagauggcagaauguacacauacacacaaauuuuacauaugacaacaggugauuucugcuuucauuggaugaauucugaaagaguggagugagaucuuacugccuuucaaaucugauuucugcuagcagagagcaccucacuuagaaaugugcuuguaaaugaacugaugaucaauucaguguccccgucguaauguguagcugccucaaugagaacguaucuucugcuauguggcuugccuuugggacuuauucccauuaccaacaaauacucucacaaguauaagucacccuucacacugggagaaaacaucuggaagugccauuucccauuagucuauuaucaguguaaauuucccacuugaaauuuaccaccuaagcagggaaaggcaagaaagagaacuucacucccaacuccccaaauaucugccaagugguugcucugugauauacacuuuuguacucuuuucuaggaauugaagaaacccaugcucuauuuuaaauguauuaagccaaagaagcauuuaaaaguguagaaaaagaauugaaguggaacauauuuuugacuaauugcucuaagaacuuagguacagcagaccucaauagcugcuguaagacauuuccaguccacuaaaugcccuucugaugaaacaagcagaaauaucccaccuuagaaaaaccacauguaguaucauaaaagaaaaaaaaauccacauuucggugcacaugaaaaaaaaacaggcagcugcuacaaacgcuuuuaucugaaggcuugccuugucucuacucagagccuaucucagauuuaagcacaggacaagaaagucauuguggaaacaauaagauugauuguaguauugaucucccacggggauuagauugggauucaaaaucuuccaaaccaggcccagaucaacuauaaauuagaaagacuuuggggcccugggcuuugauuuuucaauacuaucucugaaaacucugcccuuggcucugucuacccuaaaacccuggcuuaagcggcagauuuauagagcaaaagcuuccaaacagacuuaaagaaaucucaaucugccucccuuuuucuccuuuucccucuguggaauucuugcacguuuagcugacuagaggcaugccuuuugcccucaucuuccccaucacuugauuucucuccaauucuuccaggaggaguagcucuucuggcugcaagccaggaagagggugcggaguuacuaaaggggaaucccuggcucccccaccacacaagcagugaguuaaaaucagauucagaaacgauaguacagaagcaagaguggaaacguccgcuggugccccggccaagcugccucuacagggacggcugcagucugcccacgguggagggcuuugcagggugacuccccgcccccacgcccugcuccaugccucaccuucaugguggaagcugcgcacaguguuggcucggcuggcugcccucuccaaccgguggucuggggcgggugagcccggcugaccugagugccugcgauacaggucuagcauguaggggggcaccacggcgucccugcugggggugggucucuguuucaggccgaacaugcugagcagccgcaacucgaacucgcucaggaccucgucagagggcugggaugaggggcggcccgacgacgccgccgcgaacuuccugcggcccagcuccggaacgaggccagccgcgccgcccaggaggaccuggggaagcagcaacgcuagaagacagcgggucccggccaccauggucgaccugcggacaggaccgacgugagucacccgaguuccccgcccaguccuccccccucgcgcccccgcggcccggucucccauuuggcuggcgugccuccuccaggaugcccuccuggcuuggcacacucacgagucuagguaagaccgaccgaagcucaaacguuugggauaaugaagggucccaaguuccugaaccagaugauuuaucgcucccauccaacgcuuagcucgucugacaucagauuugggauuugcccucccccccaaccaaaccagcgccaaugacugucacuuuuuugugugugacacagcgcugacagccaaugccgggaaccugggaaaaccaccgcuugaucugacacccugcguccccuauacaaacccaaaugcggagugcugagcgcugucuggcauauaaacacacauaaauggugcaugugacuuccuuagaggcacuguauagaacuuccugacacacacacacacacacacacacacacacacacacccuuauagcuuccagacccuguaagcucaaggccacaacuucugaagccacuuaugacuugugucccaggccccuacccucaggggugucucgaaaggcagcuccaucccgcauccccacagugcagucaagauacacauguaucuucccgggauuacguaaauggugaauaucuauuaaugcacgugucagcuguuaaaaacacaguaccaagugauccuucaguacugaccccucgcauuucuggaaacaaguagggagaaccccaaacuccuaguacuuuccuaaaugggacacggcucugagcaaagaaaccaagucucccggaaacacuugaagaauggagaucaccauggcagagcggacagguucucagcuaacgggugaaacccaggggcuacccucucaaagggauuucuuugacccaaaaaaguuuuuaaaaaaauuaaaaauaaauaaauaaauaaauaaaacaccucaucuaaguguuaacagcuccaaaaguauuccagggagaggggaagaaagagggguggaagagugcgggccgggagggugaggcuuacggucgcccggggcagcuggaagugggagccccugcagggcuccguugcacguggacuggagaggggucuguuuacuucuggccuggacguaaggaagggcucuaccgcaguggcugcccaaaucccccucccacccaccacccaccccgggcccuggcccgcguccucuaccuuuaggagaccgcaguccgucuaagaagcacgcggggacacguccauugaaagagcguccacauggaaaaacucuggucaaaggaccuggcgcaaggaccgaauguccguuccuuuucuuugccuccuccuucucccgggugccggccgcgcagucucucu

SEQ ID NO: 21360 - RNA, 4201 nt, Homo sapiens
uaaaaccggguauaacacuuuaauauagauuuguggaacucuggcccuugcagccagaauacacauuuauaagccauaaauaaagcacgcagaaaccauaaauuaaucggacccgagaccuggauuucaccgugucaagauugggaaugcuuuuuuuuucuuuuucuuggucauuuacaacagacccuuacauuauuuuuuuuccuguuuuuaaacaauaguacaacccucugguucuguuaaaacuacaugguuuuacaccgagucacucacaaaauuuuuuuuuuuuuuuaaguaagacuucccugcaacaacagcaauggaggagaacaacaacaacaaaaaaaucagaaucugcaggugcuugaagaagcaggagucuacacaguaguggaaaccggaggcuuuuuuuuaacuuuauauucuuucccguuuuccuccuuauauagaacgugggguaucuguguggcccucuguuugggacggaacggcugcagcgggugaagaagacugcugucuuggggguguugggguggggguguuauggauuucuucucccuugcgucucugcaacaccgucuccccaaagucucgacccccacuugcucucucacuuguccucgauccggggugccagaguuagccgggccugaagccgucgucuucuuaagaggaguucauaaugggccgggaguacacccccugguaguaggagguaucugcggccaggggcgaggcguccaggcccguuuuguucgugaccgggcccauggccaagcugccaggcaugggggaaccguagccgggguagugcaucaccuguucguaggccuugagguccauuuugugggguuggugguggugguggcugugguggugcugcugcuccgaggacaugagguuguugauggagaacgggugguugaaggcguagugguguuccggcuucaggugggccucaggcggcaggcccgggugguggggcgggcccagcaggugggccgcggccugcugcugcugcccgggagagggcgccggcucuggggggcucagcgccgcagccggcguccccuucagcucucccaggcccccucgcuugugcuccuggcacggggaggcgcucgagugaggcgacucggugcccgccggagucucggaggccggcccggcggccuccccgaguugagccugugaggccugggcuccggcggccgccuucuugccgcugccggcggcgccugcggccuccuucagcgccagcugcuucucgcacuugaagcgcuucuggcggcgcagguagcagccguucucgaacauguugcccgagucagggugcaggguccagaaggagcccuugccgggcuugucgggcgagcggggcaccuucaggaaacagucguugaaggagagcgaguggcggauggaguucugccagcgcugcugguucugccgguagaaggggaagagguccaugauccacugguagaucucgcucagcgucagcaucuuguuggggcucugcuggauggccauggugaugagcgagauguacgaguagggcggcuuugcgugcguguagcugcgccuguaggucuuggggucgcgggcgcggcucaggcccgccugcccguacauggggcucauggaguucauguuggcguagggggccaggccgcccauggccccggccgccugccccccgagcgggcucaggcugggacucaagugcggccccaugcccgccacgccggccgccccggccgagccgcccaugcccgccauggcgcccgcgccgggggacauccccgccagggacgggcucaugccagcgcccacguacgacgacauguucauggagcccgcgcucauguugcccgagccgcugcccauggcggccgccgacaugcucauguacguguucaugccguucauccccaggccggcguucauguugcucacggaggaguagcccugcggacagagccccgggagggaggcgacagcguuagcaccgcggcuggagggugcccagaccucccacccaccgcccaggccuccgcguccggggaggccuccggggagcccuuucguccccgauggcccagucuccggacuccgagucuguuucauucagggagagucaugaucgaucgcccuugggaagguggcgagcggauugcugcuugggcauguggcccguuccuagcccuucuccaccucgcccagauucuagaacaggggucccauggaguacucccaagccagcaccccaaauacauuccccuaccccagagucuccccaaacucucccaccagcauacugagcuggcgccgaggcccgaaguccccggacgccaccuccggucgcagcaagcaaccugcgggacaacgcgcggggcgccucgggcugccuccagcgaagacugucccgggcccccucuguccggucucccuccagggacccccucccuugucccagggaaacugcaaggcagugccugugcggagugcgggggcggcuggaggcacugaacggggcaauagggaaagaaccgagaccugaaccacacgcggcugagcuuugcaggcaaaaacuuucuuucucuuuguccacuagucuuugacucugccuccacuucagcccccaacuccuacccaucuucuccuccucagcuccccacccccucgccggccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugauuccaaggagggcggaaaaggcggcugcccagaaaggcugggguuguggggcggggugggggggugccagcgagggaagcgguccugagguuggggaaggagcgagcgccgccgcuccacuucccccuggaaaagacgagcgcuuaccucgggcucugcauaguagcugcuccagucggacggcucgugcccuuccaucuucaccgcucccagcauacuggaagccgagugcauggcaguuuaaaauuuaacagccacaacaaacgaccagcaaucaccccccacccccacccucuuuuaaaaaaaagucagccaaagcaccguccccuccucccucccucucucgcgcucccucucccugggcuccacucccucucucucccugggcaggccggaggcgguaguuggaagugggcgggaggugggggggggcgaggagcggaggaggcccaggccagcgccccgcgguagggagcacccgccgccgccgcgcucacgggcugccggguggcggcugagguuggcagugccgagcugccccgaggcggcgggaagcgcgcggcgcgggggcuaguggggggguggggaggaggaggaggaaggaggaggaggaggcggugguggugguggaggaggaggaggaggaggaggaggaggaggaggaggaggagguguggaccgcggagcggacaagugccgcagugacgugggaggcuggugauauagcgcggcgcgcuggcgcgggccuccaauccccagacccggggcagcccauuugaauaaucagcucacaccuaggugagagguagccgcagccggcgcuccgcaccugccccucagcgccugccguccgccccaccgccgcggcgccccgcacuccugggcgggccaggggagcgggcugggcgggcgaucgggcacgcgggaucccuggucgagcccccuuuccucccggguccacagcgaguccccugaggaaggagggaccugggaggaaaccacccucuggggcggcuccggccuccagcccccgccccgucucaucgcgccgggcgcccggugcgccugucggagggcgcguccagccucagugcccggcagaucccuaugaaagccggauuuauuuaugccggguuucuucgcucucagugcucauucucugucaaaacagcaaguccaugacagccaauuugcaaagcgcuguccuauuuagaaaaacuacguacacaccuuuaacucgcccgcugcugcuccugcgaggccccucccuguuacaguucagacccggaacggccucgggagaagcgcggggcgcacggucuggccgccucggcucuccg

SEQ ID NO: 21361 - RNA, 4201 nt, Homo sapiens
cggagagccgaggcggccagaccgugcgccccgcgcuucucccgaggccguuccgggucugaacuguaacagggaggggccucgcaggagcagcagcgggcgaguuaaagguguguacguaguuuuucuaaauaggacagcgcuuugcaaauuggcugucauggacuugcuguuuugacagagaaugagcacugagagcgaagaaacccggcauaaauaaauccggcuuucauagggaucugccgggcacugaggcuggacgcgcccuccgacaggcgcaccgggcgcccggcgcgaugagacggggcgggggcuggaggccggagccgccccagagggugguuuccucccaggucccuccuuccucaggggacucgcuguggacccgggaggaaagggggcucgaccagggaucccgcgugcccgaucgcccgcccagcccgcuccccuggcccgcccaggagugcggggcgccgcggcgguggggcggacggcaggcgcugaggggcaggugcggagcgccggcugcggcuaccucucaccuaggugugagcugauuauucaaaugggcugccccgggucuggggauuggaggcccgcgccagcgcgccgcgcuauaucaccagccucccacgucacugcggcacuuguccgcuccgcgguccacaccuccuccuccuccuccuccuccuccuccuccuccuccuccuccaccaccaccaccgccuccuccuccuccuuccuccuccuccuccccacccccccacuagcccccgcgccgcgcgcuucccgccgccucggggcagcucggcacugccaaccucagccgccacccggcagcccgugagcgcggcggcggcgggugcucccuaccgcggggcgcuggccugggccuccuccgcuccucgcccccccccaccucccgcccacuuccaacuaccgccuccggccugcccagggagagagagggaguggagcccagggagagggagcgcgagagagggagggaggaggggacggugcuuuggcugacuuuuuuuuaaaagaggguggggguggggggugauugcuggucguuuguuguggcuguuaaauuuuaaacugccaugcacucggcuuccaguaugcugggagcggugaagauggaagggcacgagccguccgacuggagcagcuacuaugcagagcccgagguaagcgcucgucuuuuccagggggaaguggagcggcggcgcucgcuccuuccccaaccucaggaccgcuucccucgcuggcacccccccaccccgccccacaaccccagccuuucugggcagccgccuuuuccgcccuccuuggaaucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggccggcgaggggguggggagcugaggaggagaagauggguaggaguugggggcugaaguggaggcagagucaaagacuaguggacaaagagaaagaaaguuuuugccugcaaagcucagccgcgugugguucaggucucgguucuuucccuauugccccguucagugccuccagccgcccccgcacuccgcacaggcacugccuugcaguuucccugggacaagggagggggucccuggagggagaccggacagagggggcccgggacagucuucgcuggaggcagcccgaggcgccccgcgcguugucccgcagguugcuugcugcgaccggagguggcguccggggacuucgggccucggcgccagcucaguaugcuggugggagaguuuggggagacucugggguaggggaauguauuuggggugcuggcuugggaguacuccaugggaccccuguucuagaaucugggcgagguggagaagggcuaggaacgggccacaugcccaagcagcaauccgcucgccaccuucccaagggcgaucgaucaugacucucccugaaugaaacagacucggaguccggagacugggccaucggggacgaaagggcuccccggaggccuccccggacgcggaggccugggcggugggugggaggucugggcacccuccagccgcggugcuaacgcugucgccucccucccggggcucuguccgcagggcuacuccuccgugagcaacaugaacgccggccuggggaugaacggcaugaacacguacaugagcaugucggcggccgccaugggcagcggcucgggcaacaugagcgcgggcuccaugaacaugucgucguacgugggcgcuggcaugagcccgucccuggcggggaugucccccggcgcgggcgccauggcgggcaugggcggcucggccggggcggccggcguggcgggcauggggccgcacuugagucccagccugagcccgcucggggggcaggcggccggggccaugggcggccuggcccccuacgccaacaugaacuccaugagccccauguacgggcaggcgggccugagccgcgcccgcgaccccaagaccuacaggcgcagcuacacgcacgcaaagccgcccuacucguacaucucgcucaucaccauggccauccagcagagccccaacaagaugcugacgcugagcgagaucuaccaguggaucauggaccucuuccccuucuaccggcagaaccagcagcgcuggcagaacuccauccgccacucgcucuccuucaacgacuguuuccugaaggugccccgcucgcccgacaagcccggcaagggcuccuucuggacccugcacccugacucgggcaacauguucgagaacggcugcuaccugcgccgccagaagcgcuucaagugcgagaagcagcuggcgcugaaggaggccgcaggcgccgccggcagcggcaagaaggcggccgccggagcccaggccucacaggcucaacucggggaggccgccgggccggccuccgagacuccggcgggcaccgagucgccucacucgagcgccuccccgugccaggagcacaagcgagggggccugggagagcugaaggggacgccggcugcggcgcugagccccccagagccggcgcccucucccgggcagcagcagcaggccgcggcccaccugcugggcccgccccaccacccgggccugccgccugaggcccaccugaagccggaacaccacuacgccuucaaccacccguucuccaucaacaaccucauguccucggagcagcagcaccaccacagccaccaccaccaccaaccccacaaaauggaccucaaggccuacgaacaggugaugcacuaccccggcuacgguucccccaugccuggcagcuuggccaugggcccggucacgaacaaaacgggccuggacgccucgccccuggccgcagauaccuccuacuaccaggggguguacucccggcccauuaugaacuccucuuaagaagacgacggcuucaggcccggcuaacucuggcaccccggaucgaggacaagugagagagcaagugggggucgagacuuuggggagacgguguugcagagacgcaagggagaagaaauccauaacacccccaccccaacacccccaagacagcagucuucuucacccgcugcagccguuccgucccaaacagagggccacacagauaccccacguucuauauaaggaggaaaacgggaaagaauauaaaguuaaaaaaaagccuccgguuuccacuacuguguagacuccugcuucuucaagcaccugcagauucugauuuuuuuguuguuguuguucuccuccauugcuguuguugcagggaagucuuacuuaaaaaaaaaaaaaaauuuugugagugacucgguguaaaaccauguaguuuuaacagaaccagaggguuguacuauuguuuaaaaacaggaaaaaaaauaauguaagggucuguuguaaaugaccaagaaaaagaaaaaaaaagcauucccaaucuugacacggugaaauccaggucucggguccgauuaauuuaugguuucugcgugcuuuauuuauggcuuauaaauguguauucuggcugcaagggccagaguuccacaaaucuauauuaaaguguuauacccgguuuua

SEQ ID NO: 21362 - RNA, 7740 nt, Homo sapiens
auccaucccagcuguuuauugaaagggaaggugggauggaaggggugcaggaugaggagggggcgugaggcacaaggacaguagggugugcccuggugggggccgccugaggauccccuaggaggcccuucaggcugguggagacugaagguaaggguuagggaggggaggggcgagagccuugagcgcugcucuccagcugcaucagagcucccucuagugguacagaagagagaugacgccuccggcuggggagggaggggcuggcgccucugagagagcccauuuauuaucagggucacggccaagaccgugggcuugguuucuagguagguggacuuugaggggcaaagacaacccacuuuuccugcccccuacccccggcucuuagagaccauuuaaauccauauccaaaguauauccagagccaccugggaccaucaggccucuggcuagucuuucugggccaaaccuguccuccacccugaggacccucagggaaccaggaaggugaggggcuggcuccgccccaccuguagcacaagagcuggcccaggaggaggcugaagauguguuucuaguuccugcaugcugcuuuguugugugaccucggacaugucaccuccagccuucuucacccaccucaccuaucaacuagggcuaguaauugccuguggugggugggcuggggggcucugaugccaaaaugcagguagaagacacacugugagaggcaaacgucuucacucauccugcagggaaaggccaagugagcaucugggacccauucgagcugaaugacccccaccccuucaucugugucuauggagggcagugcguguccucauccuggcgagaagaggaaucugauccaaagcccucauggcagagaggcaggagcugauggcuugaaagggcaaggguuugcccaaggucaugcagaggaaggaguggggacggguugaaggagauguuuucugccccugagggccuugggaagaggguguggguaggaaguuuugggaggacuugaggaaugcugguaucuuggaagaguuggggccccacuccuggggagggagcacugggauuugagcuccagauuugaccuggaguugggcucuaaagggacccugcuaaaagggagaaguuggggaaacacugagaggggguuauggugagaaggggggaaggauccaggacccacaucuuaggccaugugggcagcucaggagucccucuugggcuggauagucugcacagaagauugcccaaaggggcuggcggguggcgagaaccaugacuggccacuggcauugcggaaaaugggugacaacugcugcucuggcucauccccgaagaccuccacguggcugucggcuucgggguccaagggcucugccuugguguccuggcucagccagccuaucauggcccagaagaggcagauggcgagcagaacuccagcugccacacagagcgcugugccugccaggcgacaggugcccagggccugguuguagucggcugcccgcugauccaacaccaggaacucacccucaccgaugcccuccagcuuggggggcacugcauagccaguggucagagccgccacacccagcagcagaagcaggguccccgaggacaggcugaucuagggagaagcagacagaccaggaagcagucagggucagccaggggccccuggccaagggaucaccuuggauccucaccagacuuaaggguaaccccuugauccauccucaggagaugggaaucacagaacacacuugcuggggucuaacugacaggaggcauaaacugucauguuuuauuuggaauccugaggccucuuaauuuccuucccagcucccaccuagcaguggguuucuccggccaacccuguguuucccuccaucccaacucaucucuuuauccuuucuaccuuccugucucuguuggguuaacuccuaugcaccaucagaucucaucucaaaccucaccuccucagggagaagaccccuggacugagucaggucucuugcuuuacucugggcaaacugugcccauucauucuucaauacacuuaccauugugcacacuuggacauguauuuugguugcuauguaagugacgucugccucucccgcaguacugagagcuccaugagagcagacugugccuguuuuggcucacuaggagucuucugugccuagcacgugccggcacagagcaaaggcugaauaaauguuugcugaaugauuaaauaaaccacagcuaaaagaguuccucgaagacagggaccucaugucuuaaauucuguguucccaagagccuagcacagugccucgcaauaagaagaugcuuaaaaauuuuaaauacacacuaaccuuuccuuggaagucuuccuugaucauuuccucuccugguguucccuacagaccugaccugaaguuauguaaguuggccucucugcagagguuggcaccuuaccuccucacuagagugaaguccuuugaaagcaaaagaagggacccucugccucagucucccgagaauauuuagcaaagagcuaugcccauagcaggcacucagcucauugccaccucuacaccuugacccauuggugcacccuggccgacuagucuccuuggcuguuaaagacaucaauucuucacauuuuuucucugcccuggcaagguacuccagucuaccauugagaaaccacaguaagauuuaagugagaugaaccucacuuccugccagucagcauaguccaucucuuaaccauaguaauuaguucaaggcuggcaagugacccaaugagagccaacacaaugcuugucaggacuucugggaauuaaaagcauuguuucuuauaaaugauuuuuaaauuucugaaucuuuuaccucuccauauaaacuacaagugugcaaagugguaaguguauugaagaaugaaugggcacagaguuugcccagaguaaagcaagggacccgacucaguccagggaucuccucccugaggaggugacauuuugacguccacaaaauaacgugcugggguuuugauuggcauugcauugaaucaaagaucagguugggaagaacuaacaucuugacuauuccaauccacgaauaugaacuauuucuccauuuauuuaguuauuugauaucuuuugaguuuuguaguucuucucauauuacagauauuuuguuagauuuacaccuaaguauuucucucuucuuuggugcuaagguaaaugguaacauguuuuuaauaucuuacuauuuugcuuucucucuuccuuucuucucucuuuucuuuucuugacagagucucacucuguugcccaggcuggagugcaguggcacaaucauggcucacugcagcuucaaccuccugggcucaaacgauccuccuggcucagccucuugaguaguaggcaucacaggcccgcgccacuacauccagcuaauuuuuuauuuuuaguagagaugaagucucacuauguugcccaggcugaucuugaauuccugggcucaagcaauccuccugcuucagccucucaaagugcugggauuacagguguaagccaguaccuguggccauuuuuuguuuguuuguuuuuuuaagacagaguuucacucuuguugugcaggcuggagugcaacggcacgaucucugcucacugcaacugcugucucccggguucuagugauuauccugccucagccuccagaguagcugggauuauaggcgcccaucaccacacccagcuaauuuuuguauuucuaguagagaugagguuucaccacguuggcuaagcuggucucgaacuccugaccucaggugauccacccaccuuggccucccaaaaugaugggauuacaggcuauuuucuuuucugaaggaaauaccacaggaaaugcugacuucccuuagaugguguggagugaagaccugagaguccacacaguaguggccauuuggggaacauguggggagagucugaagcuaacaggcuaccaggguaggggcaccaugaggaggcugaagacuaagaaaacuugcaaaguccuugguauaaaggguugaacugcuggaucaaacuuugccugaaaguaugcaaccuuggaccuugggucucuucuaaaaaaugagcaacauuuucccuucuuuuuucuuuuuuuuuuuuuuuuuuuuuuuuuuuuuugagacagagucuuguucugucgcccagcuggagugcaauggugcaaacuuggcucacugcaaccucugccuccuggguucaagcaauucuccugccucagccuccuaaguaacugggauuacaggcgccugccaccacgcccggcucauuuuuuuuuuuuuuuuuuuuuagagggaguuucgcucuuucacccaggcuggagugcaauggauugaucucagcucacugcaaccuccaccuuuugguuucaagugauucuccugccucagccucccgaguagccgggauuacaggcgcccgccaccacacccagcuaauuuuuguauuuuuaguacagacaggguuucacuauguuggccaggcuggucuccaacuccugaccucgagauccaccagccucagccuccgccuaccaaagugcugggauuacaggcgugaacuaccgcacccgguccauuuuuguauuuuuaguagagaaaggguuucgccaugcugacagagcagguguugaacuccagaccucaggugaucugcccaccucagccucccaaagugcugggauuacaggcaugagccaccauuauuuacauacaauaaauauguaaauaauuauguaaauaauuuguauguaaauacaaauacaaugaaggcucccuucauuauuuaaacccauuugaauuggguuuucuguugcuugacugugcaagacuccuaacuacuacgcuaucucuucuuuuuuccucugagccucaaauucagacucauuuccuccaucaaggcagaggaaucaugggaggugcucaucuggccuuaccuuccaacacagugagggccagggccggcgggggcacaggaccggaggucccucagggucgucgcugagagcagugccugcacaguccucauagaagaggugcagguaggagcggaccccauaccacuugccauccuccacgcuggggccgcggcugcagcugcaggaacgauugcagcucggcaucauggaccccuggggagcagguaaggugcagcugacggagggagggauuagugggagcugcucauggugaccuucauaagcccccuaaaucuuugugccccacccgcuucuccucccacucgagacacccuacacgcauagcacagucuggccuuuuggaaucccagccuguccuucccaaagcacacugcgaaugagccaaugcacugaaggccuuagcccagugccuggcaauuggaggugucaauaaaugugcauguuuacucuggaggccacccaguaccugggacugugggcucuggagccugaccacuuggacuggagucguggacacacugcuuccuggaggcgugaccuuagacaagugcuuccaccuuucugggucucaguuuccucaucuguaaaacagaccuaauaaucauacuucuuucauacaguuacugugucuaaugcugagaaaugguagcuguugugauuaguacuguaauuuuuuugcuauuacuuccaucuugaacuuuuuagucuccauaucuggaaugagagagccucacccuccgcuccccuucagacccccuccuggggguaauugucauggcugacacuugggcuggaguucccaagcugcaaggcuauaaaaagguccuccccaggacugccccugaaagccuccagauuccaaugaauuuugacuccauuggaagugaaagucagggucccucaggauuaaagacucuuaggcuuaagggcuguuagauuuccagagaaaccuaucaaauaaccuuuuuuuuuuuuuccacaaaaguggacacggaucuugggaauggaagguacuuguauauccauauacagguuuggcccgaaccaaagccaggagguguugggggaggacugggcuucuaccccagucuccaugauggcccucagccuuaauuagcagccuccugcaaaaugaaacaaugugcuuguuccaaaggguaagauaaagguccugacagcugccccucacuuccaaucagaugugguccucaaaucccugcauagagaaacucaccgaaacagcacagagaaacacacagacauacucacaaagcauacagagacauacccagauagguacgacacacacacacacacacacacacacacacacacacacacacacgguuggagguucugcuuggagucacacggcacacaagauugcugucaagaaagccuguccauaaauaguggcuguacacccuccucacuuacaauucagggaaaagaagagcggggaaggaaaggaggaaaaacaacaacaacaaaagccacgacagagaacgggaaaaggcagagacugaaagcgaaggaccgucggaggaggagggcgagaggucuggagaggagggcucgccggaggaggcgggcggggcgggcugugcggagggugcggccagcgcgguacccgccccggcgaggcgcuggggaggcccggguggggagaagaaauggggccugggggacgguaggagccuccgugcggagaccacuguucaaggccacaggugaggagguguggagggggcuucggggcuguugaccugggucagcuccuccccuccaauucaccgcuuccgcgacuccaaauagauggaaucacucaguccugcugcuacuggagagggaaggugaccuugacgcugccucccgcucggccuggccccuccgccuggcguuucagggcugcacggaguaggucuggcgggcggggggcggggcgcaggcacccgggacgaggguugccaugggaaccgcuagggaggcguccccagcccgggagccgggaggagcucggugggaggggagcgggaggcggagggggcugcgcuguccgacguggggagacugcggcggagggaggaggcgaggggcggcaggcacgggcggaagugacggaagccagggcccgaagauggacggaaucugucgccucugcacagccucauucaguuguguccuucccagacccucagacucgcccacuacagcguccagcgcugcccgggcgggggagaaggggcgcccucccgggggggauggguagggggugucggccggggaaaucaggccauuucccgccucccuuccccaccggcacccgcgccacucuuccugacaggaccaccgaugcccugcuccacaccaacugcguccuuuucccuagagagaaacugaggcagagagggguaggaauggguuuuugaaguguuggcggggguggggguguccuuugaagccucuacccagccuaucaacccugaggcgucgaggggcgauggggcuguuucugucucccgccccugcugcuucccugggacccccaccucccaaagccgaggcucaggcgcaaaggucccggcccuggcgggacacggcccgggcugaggaugcgggcagagcgcggggguucuccaggggcuggggcuggggccuggccgcgcguggggcagggcuaagcucaccucucugccugcugucucc

SEQ ID NO: 21363 - RNA, 10490 nt, Homo sapiens
guaaaguuuauaaagcuuuauuaaacauuucaaacagcugugcaacgaacacaccaaauaaaagcucuagaauagcaguccagacguuucacaaguauggccucacagucccauucccuagauggacugccuccaguucuguucucugccuggcccaucucucuuuccccucaggcaagagagagauggauggaucagacugaaaggacaggcaugcugaucuccagcaggcaggggccaggagaaagucucguuugccaacacuuguuacugaagcgcagaaaaagcagcaagugacagucacaaagucuuccuggguauucuucauaauguacagucuauaugcgcaggaacgaagaagcuccuggcgggaggaugauggccacugcuccccucugucuugucugaaccaccucggaguccagugugcuggucacucugcaauccccaugcuaaauaaaaacuguagcggcaccuaccauauauagcuagcuauugcuaaaccucaaaaucagaccacguucgauaaagcuucuuuaaaaggaauauacacauguauuuguacacacacacacacagggcacaccaaaaaauauccaaacaucuaucaaggggaucaaggccguuacgaaacacacagguacucucccacucacucagcuggggacugcuagaacuacgugaacacaccauacuucaaugcugcagagcaugcacgggagacacaaugaggcccccuccuugggacaguugagaaaggcaggaggaagggcaaaggaagugaggcugggcgggaaagcuugagcccagacacccaggugaaagagcaacaucuaucuguugcuuccuuucuuaaaaaugaaguggagaaaauacugaagauuuguggacaacuaacagucaagacauguuucugucuagccugcugaacaaggaaagaaggaugaaaaagcgaggcucucgggcgucagcaaucucuucaaauucgagauaagugcaaaaaugagcccugucuuggacagguacuccccaaaaaaggaaaaggguagaagagaaauaaagggaaaccagaagagggacugaggagucaguaacauucugggaaggaaggagacccugacaaggaggggucacagaggugacaaugagacuggcauuuuaucugccccaggucacauuggggcagcugaccaggauggacccagacuccucacaguaaugaggcgagagggguggucaugcggccagccaggaccuagauggggacagaacacacacaaccacaagaccacccacgacuauaggacuuuacaauaaaagcaccggucagugccauuauucacauuguaaggauaaaacaucacaggccaaaaaggcgccgucaggaaugugacacccgcgaggcugcgggauuugaaacuccaaugcuuuaugaccuaugucaaugccuccccucccgucuucugcuuccuuggaaagcuaacagggcaggccguuaggugcccacaacgccgggaucaugcgccgauucuggaagcggggaaucggagcagugguacaggaaacaguuuccccagcagcuauagcagauaaggaacagggcugccaggaaaaccaaggcacaaauugugcaaggcuuccguuccaggaggaagcugagcagguagaagcccaugaacauggaguggcugaaccacagggcgggguugaggggcuuggggaugaggaggacgggcagcagccacuggaggcaauacaugaucucugccgggcagggccuucaccaaggcugccgggcaccgcugcaggaaccgaccuaaugggagccagcgggcgcaggcggcugcccuccgcuuucuucaacccucacucuccaggagcugagccgcugugcucucuggcugucagcccgggaucaccaaggcagcagggauccugaagagaaaagucaacacaacagacaaacagacaaagaacagacagacagacaaaaaaaaaaaaaaaaaaagaaaaaaaaaaaaaaaacaggaacagaauguauacuuauuugggaaaauggaucaugguuaacaacagcaaaugugaaaugcccuuuccucccugcccacccgugaaaguucuacuccucuccaagucacuaauucgggaagcuuccugggaugucuccccggggcuucuccugggggaucggggagagggcucuuuggcacgguuucacacagugggcuggcuuugccugggcccugcccagcagagaucauguaucgccuccuggggcugcagcccguccucaaggggcccagaccucacaauaccgcccagugguugccaaaggacgaccaagggcucccugcugugcccccacgugguaaggacaggguucuguaucuagcaucucucacagccauaggugcucaggcacuaagugcagaguuaaagcuguuagcggggcacugccggccaccagaccacaggcaaaggauccugaggcagcuacagccucgaaauauuuuaagauggcagccuaggcuaagcuugccuuuuucaaacagcccagcgucacuuugccagaaucugccaacuucuccgaaagucaauguagaaaaaaagucacuaugcuacuuuguccaaacugaacucguuuggaucauuacaccuccaucugcugcuggcacuguauagaaccugaccucugggagcuuuuaaugaaaauuaauuuucuauccacauaggggcaaaugccaguuggucccugggccaggcagcuugcuggaaagaggugcuuucggcuggcuaccggugcgcggggaccacacucacaaaccgcauuccggucuucccgcccgaaaauccgcgcugugcgagggacccacaagacuggcggucuaaaagggacccgccucacuuggaaacggggcugcgguagccacaacccuccgguagcgguagcguaaccccguucggugauccagccgcacagcgcaacggguacaaagaaccccacuggcuaaggccgaccuaccagggcuugggggaggggagcggaagacugaggucgaaacgaccuguccagcagaaaacuauccccaagcauauuccaaccacuucuccguagagcucauuccuuccgugcauacgaagggcgccaauccuuccuguaucccuccuacagauaccgggugacuacugcuuuugcgcccaaagcgcagugcucuggcucagcucccuacaguagcgaccuccaccgcagauucucaucuccucgcuaccguaagagagauguaaagaaucagacggguuacgcgcucaggcacccucaugaagcagaggaccugggcuuaaaacucauucaguaucaggaaaagagcgccgagcacgggccuauuaugccaaagcuucugaaaggggcaccacguuuuuugcucuauggggcagaugaccccucccuaauuucgguuuuccauccauccccaagguaggcuuuggaguggcaccggagacugagcucaaauuugcaggccagggacuggggagaagggcgccacacuaagagaccugcacccccauucucgcccuguacucuacccagagucgugguaccccuccauuuuaaagcaaaauccaaaagcaagcacggcggaaucuucuggaagggggcuaagauggaacucaggaggcgggggucgguauggaaagagcagauggauuauuuuuuuccucuccuggcgaaugaggagcgcccccagccaccccuccucauaaacaccccccaaggcgcgcaugcgcacuuagguggcgggcggguacuuaaggcgcggccaccgcggcugcggcagugcgcccaacagcggacuccgagaccagcggaucucggcaaacccucuuucucgaccacccaccuaccauucuuggaaccauggcggcaguggcggcggccucggcugaacugcucaucaucggcugguacaucuuccgcgugcugcugcagguaagucugacgggguuucgggugggagaggguucccaacucgcgccccuagaacccgcaagacugcgucgcgauugccgcuucccggacccguccuauuccgauugccgcgauccuugccugcccaagugccgcugccggcaccgcgcgcccccugcccauucccugcgccguccuccucgcgcugacccucccuagugcgcccgcgccugccagggaacaaagacucggggcgcggcgggcgaccgcugcggacgaucacccaggcauuuagcgaccuacgcgguaagaaaaacccgcuacacccggacucgaccccaggagggaggcggggcacuacuguguugaaagacuuuacagcucgcagagugaaaauuuuccaccuuaaaaaauugcgcauugcggagaaauuuuauuuaaaaaaacauauagcgcuugcggggguggaacaaaaaauaaguuagaaaaaggcacuucucagaaaaaauaaaaauuacuucgcaaaaaaaaaaaacccuacaacgaauuagagaaaaaguaguucacaggaaaacagaaaaacgcgcauugcaggaaaaauaaaucggagaaaagcacuuggcagaaaaaaaugcauuagauuaaaaacgcacugcagaaaaaaauuagacaagggagcuaacggaaaaaaauggaucgggcaaaaacgcuuuaaagaaaaaaauuagaggaaaaagccccucgagagaaaaauagaaggggaaaaaaagcacuuccaaaaaaggacaauugcuuuacaaaaaaaaaaauaauaauaaaaaaaauaaaaaagaggcaaaagcgcuugguguaaaaagagauaaaucagaagaaagcgcuuugcccauaaaaucauuuacccuaaaagcucccuuugcaggaagaauucccugcuaaaggaauccuuugccaaaggaaucgcauauuuccuucaagguguuccuggaaugcugcauuuacuggguaggauucgcuuuucgaaauccuccagggacacagcccauugcgagaagugagguauaccuaaguuguggguccaaucagcuugccgccaugcagcucucagcacaguuggaaaagcuccagcugcccugacucguggacaagcugcgcccgcgcccgccucuccagccuacgcuggaugggcgggcggggcaggggguggggcgggggugggcacggcagcaccacagacaugcugugggugcucuccacuaaggguggguccuggguuucucgucgcagguguucagguacucccugcagaagcuggcauacacggugucgcggaccgggcggcagguguugggggagcgcaggcagcgagcccccaacugaggccccagcucccagcccugggcggccguaucaucaggugcuccugugcaucucggccagcacgggagccagugccgcgcaggaaugugggguccccuguguucccucgccagaggagcacuuggcaaggucagugaggggccaguagacccccggagaagcaguaccgacaaugacgaagauaccagaucccuucccaaccccuuugcaccggucccacuaaggggcagggucgagagaggaggggggauagggggagcagaccccugagaucugggcauaggcaccgcauucugaucuggacaaagucgggacagcaccaucccagccccgaagccagggccaugccagcaggccccaccauggaaaucaaaacaccgcaccagccagcagaauggacauucugacaucgccagccgacgcccugaaucuuggugcagcaccaaccgcgugccuguguggcgggacuggagggcacaguugaggaaggagggugguuaagaaauacaguggggcccucucgcugucccuugcccagggcacuugcauuccagccucgcugcauuugcucucucgauuccccuuuccuccucacugccucccaagcccacccuacuccaaaauaaugugucacuugauuuggaacuauucaagcaguaaaaguaaaugaaucccaccuuuacuaaaacacuuucucugaaccccccuugccccucacugaucuugcuuuucccuggucucaugcaguuguggucaauauugugguaaucgcuaauuguacugauuguuuaagugugcauuaguugugucuccccagcuagauuguaagcuccuggaggacagggaccaccucuacaaaaaauaaaaaaaguaccuccccugucucgcacagugucccaggacccugcggugcaguagaggcgcaccaaaacuuugucucuugugauuucuuuagcggcaucaacauacacuucuaagacucagcugaugugcccacuguggaacaggcacacugcuugggggagggaggaaaaggagggccaucaaaauugcaauaagcugggccccucacacacccaaccccaucucaaugcuguccugugauaaaggaccaucucccccucuccccaaagagaaaggcugacaucuucacuugugguccuggaauaagggaccacuucccccuccccaaagggauaggugcuuuacuuguggucuuaggauaaggggccaaagcaaguaucacuuugggaaagaugagaggaggggaaaaaggugggaguagcccuccaaagagguacuagggaccaagggggugauuucagaacacaaagccuuacuucaggucuccauccaggagccccaaagaaaugaguagugggcaggguggacaguggcuuagacaaugaguaugggauaagaggugcagcguggcgccuucuucacccagcuuaaugcugcaggccccacauccaccaggaccacuacaaagacaaucugccuggccuugcuacucugcagggucuccuggccccaccucaccccagaaaccucucuccccaauacuggguuucugcuuuucccagcaccagccuccguauucuuaggaaugcuuaccagguccguggcccugggcucuccccugccaucacgucagggugggcagugcucggccucggacuugucuuccucucccacuccccagugagucagggcucuuucuacacggggucagcugacugucucaccaaauggcccugccgccuguucagccuugucucuggcuuuaugugucccugucacuacacaccuguugcugggucaacaccaagggagggaguuggagggccauaaaucucucuuccugccacuucuucgaaucccuuagucacagcugucacaaauacuucugaagcacaaaguaccuugcccccuuaagccugaucauguuucccuccccuaagcaagcccuuaaguuucuuagcccaaucaccagcaccucuaaaggcaucuaaaacuucauucgguaucagagaauuauagggguggggaggugcagaucccgguucuggucuugacuuugccaucaaucagccuagggaaccuggacaugucaccuuguacccuucaucuccaguuucccucucgaagagggccuuugagaugccagugaacccuaacacgcuagaaacugccauagcaguggcaaucaggacucaucaggacuugaagaggaugugcaaucugagacuucaucuuucuuaggcuggguggcuauagcugcuaccauagccugaaggugaggcaggucuccucucgccccagugugacucaucagcaggcaaugcccacaccuccucccuucugaaccccauaucuuggcaggccucaaaacugggaguuucugugguuuuccacacuaaacccacagaaucaugaacauaccaacauguguucuccaugaaggcugacccucccuucggagcuuuugagggguaugcccauagccccacugcccuucuugaugcucuaaccucagcccaagugacaagguagcagauuucagggagguaggccaaagcagcaugguaagagcuggcugcucuggacacagcaccucuugugcccccacuuagaggacaagaggcuccugguagccccagagcuuuccauaucaucuuggcaaagcccuuuuccuccauccguccaucagcagggcugugaguguggcaaggugagaugacagauuuccaggcaagggcugcccugguggccugcaccugcacgugugggcuucaaugugcaauguccacuccccauuugcauccuccacccacaaaacuucauguucuggcagcaaacuuaacccaccagagaagacagugcauucacuuuccauccagugcaaugccaugcaaugccuagaugguccaaacacaccuuguuuauaaaauuuuuuccacaaacuauaccauuaaacauuuuauucugauagagagcaaugcgaagaauugaaaaugacuaguguuuuacugcacagcccuuagucacagugcugaacguccccuuugccuaaaccaucauugcucccagaagacuuugcccccacaaggccaaggacagagcagaucgguugggaaggaauugggaauagcucugugggacuccagcaacaggugagagacccuugagacuaauacuccaggauguuaguuucuuagccuaacgaacugaaguuaaguccagagguguuuagguaccaugacuuuuaggggugcagggugcuaugugacacuguuaccuuuaucuguggaauauuugaauugucacugaaggaagggaugucugcugucagggaagggcaggggcaaguuccuugagcuugggcaacggauuacuguuggaucggggagcagguuugcugugagccauuuacuagauaucuauuuugaaauguguaucuccucaggagccaacaccccaaagggagauucugaauuugcaguuaacuucccccccccaccgcccccacccccccucagagauuuaaacgugugcacucaugcacauacacaaaacacuagucaaacaacaaucucuuuuccccccgguaaccucugacuuccucuauaugccccagagacacguugucaccaucuucccugggagugauccuguuuauccuccccuccccgacuugcccucccacagggcccaugcaugccccagcaggauccagauuccugagcauuuccagagcaggaagucagagaggcaggcaacgcgugguucuugguauaucgcacagggacaggcuugaaauggaaugcauguguuucaaagauaggagaacaacaacaaaaaaagacagucuaacccagauuccucuuugaaacaacauauuacagauuaaagguuaaacuguuuuuggcagcaacucuaacaagacuaauuucagauauggaauugaccuggucacuggaaaccgaccaggcuucccgugaucaaaucuuuuaacagauuugcuugacauuaauuagucucugauuuaaaacaaacaagcaaacaagaucuaacacuuggcauuagcacuuaagcuggaacuuuuuuuuggucccagcuuugguguugccguccagaaggcugacgggaugacuggaccaugucaggcagggcagagaagccguccccaacacaccaguucccugaaagggauagacgauccaaaccuauaaacagaaaggcuguuucuuuccgaggacagaccccagucucccaacauucggcgaugaaaugggacacggaggccuggaaggaaacuaaaggagauuuggaaaggggaaggaaaaaacaacugucccccaucccccaugcuuccuuuccaggccauuagugcgccaggcauuccguuccuucagcugcccuugagggccacuccccacgucuauagaaggaaagggaagggauguccacccuugauguaaaguuggagggaguaagaagcgcccgcgacucuuagcagagcgucagccuaucaccccagacaccgaagcggagccucaggagacccucucuccccucacccccacguccccccaccucccccccaaaaaagcaacuaaagcaacgcaacuaaacugauggggacagaaugacaggccucucacaagcugggcacccugccguggaacccggggcugcagagaugguggucgcgcucccagccccgugcccccggcucugccugucucauccugcaagggcgcugaccuuggacaaggccagagccagcacccaggaguacuaugacccaccuccgggcugggaagggaccccccaaggcccaggcuagguccaaucacggcaaucaccugaagccggacaggggcgcccugccuucccgggguaugcggaaggaaaaccccagugacggggacccggcgacgccuaaggugacccagaagggacaauauggcggcgcggccgcauggagggccucucaucccgccccaagcagguugacgccacgguaccugcaagcccugccauggcgccgccgccacugucgccgucugccgcagccugccuccaccucagcucgccaccgacgccgcaggaagccggggagacgcccccuuagucuucu

SEQ ID NO: 21364 - RNA, 5134 nt, Homo sapiens
cagagaaagagugacuuuuguaagcauuuuaaccauccuacaguucacacaaguaacuaagaaauauuuaaaugcuuacucugugcuguuuccaaaauaacaaauauccaggcuuguuuauauuuaucaaauuuauuaaauaguuuuacuaaccaaucuacauagauacuauauuuaacauucaacauaauaauaaauauuuugggauaaauaagugaaaccauuuuagagccccuagggcuuacaaaaagaaucauaaaagauccauauuuauaguuuuaagauuaagaauaauaguuacaauagguagcaaaccauacauucaacaauaaauauaaaauuuaaauauuuaaauaaauagaaggccugauauguuuuaagugggaagcacuuaauuaucaagucaguguugagaugaugcuuugacaaaagguaauccaucuguucagaaauucuacaaugguugcugucucaucagcauauucacacaugaauguuguuucagaucccuauaaaagaaaaauguuaauuuuuuaaaguacagaguaguuuaccuuauauacaguuauucccaauugaagucuuauaggccuguugccuuuauuuucaagcuuaccaaacauauuaauuauucacauuuucuugaaaugaucaaaaugaaugccaaaauuacauauuuuguuaugauaccaaaugauaguaacacagaagcugagauuuuccucauuuguuaauucagucaaugaacacaaaaauuuuuucccuaaauugggugcaaauaaagauuuaaauaaaaauagaucuagacaaauauuaaaugcuggaugugaaauaaacuugaucgcuuuuccucugaauguacaccuauauuuguguaaguuaaauguaugaauugauaugcacauuauacuuucuucuuuucuaaaucuugauuagagucuccuauuuuucuacuuaagugaaucuccuuauauuuuccccaaagcagaacagaacuacacuagaguaagcuaggacaugcuucuguuugggauaaauuugugugaagaacaucuucauaaauacuuacaccuaucccuaccccaucauaguaucaaugcaggugaauuugccaacuuuuaaaaguuuaaacauuagaaauuuuguucuguggacuggcuuuuuagaaauuaggcuucucugcugaaaggagcuauuuaaacgcuuccucuaguugauaagcuaaggaggaaauauuuugauauauagugagauuuaaaagagagcuuuucaaauuugaagugauuccuacccugggaacaaaagcaggugagauagaguguucccuuuaaauaaguauucucuuuuaaaaaacuguugcaguguucuguauccucuuaagcauaauuguuuaaauauugucauaucuugggauuuuuuuauuuuaaaaaguguuuggcuuuugaaacacaguuuucagauuuuugcaugguuuugucuuaaauuuguaucaagaguuaagaaugaguuuucugauguuaauuauuuuagaguaaaacucuugccauagauaaggaacugaaucugucaaugucuagaugacauugaucucaauguauuuuuuuaauucaacugaaacaguccacuaauaagugauucauuuggacacaacuggaguuacuuuuaggaaugucuuuuacuacuauacuuaugcugcuuauuuaggauaccuauuaacucaugaauuuuauaccuuaggagacgggauauaaaaagacaaaagugaaucucuuuuacaucaccugagucccuugcauauuuuaugcuuccugugcauuuaaaaauacuuaagauucugaaaguggggauugccucuaaaaagauuguuguuuguuuaguccacuggccauuuuaauggcuccaguuuuuuuuuuuaagacaaaucucuuauggguaguccuuccaucaaaugauaaggaaacaccauuugaaaagccuuucagguaaucaguauuggcuauuccaguaaaugaucugaaggaauugaaaaauauauaguaaaaucugccugcuuucugugaaacucaacucaguaccuucucucacucccaguuuuguguuaauaugaaaggugauggaguuugggaugaggcuuguccauuaguagaugguaggugcaaacucaguagcuuauacuccccaguuaaucauuuaacauuagaaaugauucauguucacaguguacuuaaaauguaggcuaauuacaugcauggguacuuuacaaauaccaaaaauguuaugucacuuuaaaaugugguacuuuucccccuacuuuuuuuuuuuuauuuccaggagagcaaauaaaguaaugccuuaccuuuaguuccagaacuauuacguugauauugcugauuaagucccugggucuuaagugaaaguuuuugcuuugagcuaaauuuagcacuuccuccagagguuugaguucuucuucuagacacugaagauguuucaguucuguggccuagaauaauaauuaucaucagcucaguuuacauagaggucagaaucagaaauuaauuuccaauuuauuuuauuuggaguagcaguauguaguuuuuaccauucucucuguucucaaugucacuguaaagauggaccaguagaguuuacauuauaaaacuggaaaaacuagggcucaaguaccuaugacuagcguuaagugauaguugacucacugguuuuagcuuaauuuggcuuugcaaaauguuagacuuucugcaucuaaaugccuauuacagauguaggcugauuacuuuuccaaucugcauagaaaaucauuagaaccagaugaguuagaauguggaagcauaaaaaucacauucuaugauuauaauauuugauagucuaagaguuaagaaucacagaauguugagagagaaggaacucuuggaugccaucuaucacaaucccaacauuuuacacuagguaacaauaaucauguaguaguggcucucaauauagccuugagcaagacacauuuuuaaauaugucuuaaauuuuuacuuuucuacaaucacuacauuaagaugcauuuuaaaaauguuugucccagugaaauaaaaaauuauaauacuuugggaggacuuuuggacaggccucuugauucuauauuauauauaauauuucauauuucuaugguauauuacaauuuaaaagaauuuucuccaaaauaggcccauuuacuucucacagucaucuuuugaaguaggcagugaaguaucaucuccacuuuauaaauaagcacacuaaaucucagaauuugaccacauaaguagguagagccagaauuagauuucauuucuuucucauuauagcauuaacauagcauccuuggaaucaaauauuuuuauuaguuucuaaaaucuuuuguaaaugugcaaugaggguuaaaugaacaaaugaauagaguuuaucauuacuuuugguuucaaacuuagauuuccaugaauucuaccacccccuaaauuaugcacauaaucucaucuuucuaacacucuuuagugggaaagguaggucaagacaauaccaauccccugauauguccaucuauugcgcuuucaauucaccacuacaaauucuacaaauucggguuuaaguuuuuggcaugaacaauguggagaaauuuucuucagaaaacagcaucuaguaucuuuauguugcuggaguugcauuauguggcucugauuaaacuagaguaacaucuguaagcugucuccuuuacaucuuucagaaggguaguuagaagcagauuucucuugaauuaauagaauuugagucaaugggauugcaucuguguccccuuaaauccuauuauuuucugggcuuggauucacccuggcacaagcucuuucuggcaccagauuuuguucauucucucuuaacuggcacagcuacuagguagcuuuacacaccuaauguagccuaggagcuuggaugauuaugcuuaugcucuaucugaauccaaaaacaaccuaaugaagcuuuuaaucuuggaaaauaagucauauagcauuauaaaucucaaguucuauugguaaaaagauaaaguccaaaauuuuacuuuguauuucucagugaaaauuuuaucuuuaauacuacuaauaauagcuaaugcuuguaugguauuuaccuuaugccagacacgguucugagugcuuuacauuuacuuacuaauucucacaaagccauauuaaguauauacaguuauucauuuaaguagacaugaaacugaaucacaaacagaguagguaauuugccaaagaucaugaaagcuaggacauggcagagcugagauuucacuucagauaucuggccccagacucugugcuauuaguguuaugcugccucucacuuagaaaccuuuccuaaaacaagaaaagauuuuuaaaagugggcuccuuggaaauagauuuugguauuuuacauacuaaaaugacauaaucaaauauuuuagaguuuuacauuuuuaaaugaaaccauaaaugaacauuuuuguuuagaauugucuuaucgauaaagugagaauauuauuuuuauguuuucuucccacccccaccaacacacaaauauauauuaaaaauauagguaaaacuguuuuaauagaggcuucauuaucaaacuuggguuuucaaaaaaacaaauuaaaguuacucuuuaccucagaugagcugcuauuagucccaucugugcaaauuuucauauuacuuugaauuuuauuaaaacagaaauugaacauaaaauauuguacuuaccuucuugggcauguaaaacuuaaaugugagcauccuggugaguuugggauucuuguaauucuaagaaaguauaaugcauuguuauuaagaaaugaucuccagcuagauuacuaaauguaauaauuuuaguaagaaaggaaauauacuuacauuaauuccauucaaaaucaucuguaaauccagcaguaaaugcuccaguuguagcuguguuuucuuuguagaacuugaaguaggugcacuguuugugacaagugcaagacuuagugcaaugcaagacaggaguugcauccuguacauuguggcaggaguugagguuacugugaguagugauuaaagagagugau

SEQ ID NO: 21365 - RNA, 176538 nt, Homo sapiens
ucguuuuagggagccaggaccauggacuuagcaccagacagggcuacuggccgcccguggcucccguugcacacucuaucaguaucucagcuccuucgaguguuuuggcuacugucauugcuuccggggcaggccuggguccacggggccgagccgcgccagguguuccaagugcuggaagagcaaccuccaggcacucugguaggcaccauccagacgcgccccggcuucaccuacaggcucagcgaaagccacgcccuguuugccauaaacaguagcaccggagcccuguacaccaccuccaccaucgaccgcgagagccugcccagcgacgugaucaaccuggugguccuuuccagcgcgcccaccuaccccaccgaagugcgagugcuggugcgggaccucaaugacaacgcccccguuuucccggaccccucuaucguggucacuuucaaggaagacaguagcagcggacgccaagucaucuuagacaccgccaccgacucggacaucggcucaaacgguguggaccaccgcuccuaccgcaucauccgcggcaaugaggcggggcgcuuccgucuggacaucacccugaacccgagcggcgagggagcguuccugcaucugguguccaagggcggacuggaccgugaggucacuccgcaguaccagcuccugguugagguggaggacaagggugagccuaagcggcggggcuaccuucagguaaacgugacugugcaagacauuaaugacaaccccccgguuuuuggcaguucucacuaccaggcgggggugccugaggacgcgguuguggguuccagcguccuccagguggcggcggcggacgcggacgagggcaccaacgcggacauccgcuaucgccugcaggacgaggggacccccuuccaaauggacccugagacgggacuuaucacggugcgggagccccuggacuucgaagcucggcgccaauacucgcuuacggugcaggcgauggacagaggcgugccuucccucacugggcgcgccgaggcgcugauucagcugcuggacgugaaugacaaugacccgguagugaaguuccgcuacuucccggccaccucgcgcuacgccucgguagaugagaaugcucaagugggcaccgugguggcucugcucaccgugacggacgcagauucucccgcggccaacgggaacaucuccgugcaaauucucgggggcaaugagcagcgccacuuugaagugcaaagcagcaaagugccgaaccugagccuaaucaagguggccagcgccuuggaccgcgagcgcaucccuuccuacaaccucacaguuuccgucucugauaacuacggggcgcccccuggcgcagcaguccaggcgcgcucuucuguggcaagccuggugauuuuuguuaaugacaucaaugaccauccuccugucuuuucacagcaaguguacagagugaaccugagcgaggaggcgccuccgggaagcuaugugagugggauaucugccacugauggcgacucuggucucaaugcuaaucugcguuacagcauugucucuggcaauggacugggaugguuccauaucagugaacauagcggccucgugaccacuggguccucugggggccuggaccgugaacuugcuucccagauuguucugaauauaagugcccgggaccagggaguucaccccaagguguccuaugcccagcuuguaguaacucuccuagaugugaaugaugaaaagccaguauuuagccagccagaaggguaugaugugucugugguugagaaugccccaacagggacagaacuguugaugcucagggcaacugacggggaccugggugacaacggaacagugcgcuucuccuuacaagaggcagagacugaccggagguccuuccgucuggauccugugucugggagguugaguacuauuuccuccuuggacagagaagagcaagccuucuacucccuguugguucuggccacagaucugggcuccccuccccagucaucaauggcucgcauaaaugugagucuucuggauauaaaugauaacagcccugucuucuacccgguccaauacuuugcucacauuaaggagaaugagccuggagguagcuacaucaccacugugucugccacugacccagacuuggguaccaaugguacugucaaauauagcauaucugcuggggacaggucucgguuucaggucaaugcucagagugggguuauuucuacaagaauggcccuagacagagaagaaaaaacagcuuaucaguugcaaauaguagcuacugaugguggcaauuuacaaucucccaaccaggcaauaguaaccaucacuguauuggacacucaagacaacccaccuguauucagucagguugccuacagcuuugugguuuuugagaacguggcgcugggauaucauguggguagugugucugcauccaccauggaucucaauuccaacaucaguuaucucauuacuacuggggaucagaaagguauguuugcuaucaaccaggucacugggcagcuuaccacagcaaaugugauugauagagaagagcaauccuuuuaucagcugaagguaguggccagugggggcacagugacuggagacacuaugguuaacauaacaguuaaggauuugaaugacaacucuccccauuuccuucaggcaauagagaguguaaaugugguggagaauuggcaggcaggucacagcauuuuccaggccaaagcuguggacccugaugaaggugucaauggcaugguacucuauagucugaagcaaaaccccaagaaccuguuugcuaucaaugaaaagaauggcacuauuagucugcuugggccccuggauguucaugcuggcuccuaccaaauagagaucuuggcaucugacaugggugucccacagcucuccucuagugucaucuuaacaguuuauguccaugauguaaaugacaauucaccaguguuugaccaacucucuuaugaagucacccuuucugagucagaaccugugaauucucgauucuuuaaaguacaagcuucugauaaggauucaggagcaaauggugaaauugcauacaccauugcugaaggaaauacaggggaugcuuuuggcauauucccagauggucaauuguauauaaaaagugaacuggaccgugaacuucaagacagauauguuuuaaugguuguugcuucugacagagcaguggaaccccuuagugcuacugugaauguuacuguaauuuuagaagauguaaaugauaacagaccucuuuuuaacaguaccaauuacacauuuuacuucgaagaagagcagagggcugggucguuugugggcaaaguaagugcuguagauaaagacuuugggccaaauggagaaguaagguauucuuuugaaauggugcagccagauuuugaguugcaugccaucaguggggaaauuacaaauacucaucaguuugacagggagucucuuaugaggcggagagggacugcuguguuuagcuuuacagucauagcaacagaucaggggaucccucagccucucaaggaucaggccacuguacauguuuacaugaaggauauaaaugauaaugcucccaaauuuuuaaaagacuuuuaccaagcuacaauaucagaaucagcagccaaucugacacaaguguuaagaguaucugccucagauguugaugaagguaauaauggacuuauucacuauucuauaauaaaaggaaaugaagaaagacaguuugcuauagacaguaccucuggucagguaacacuaauuggcaaauuagacuaugaagcaacaccugccuauucccuuguaauucaagcaguggauucagggacaaucccccucaauucaacguguacuuuaaauauugauauuuuagaugaaaaugacaauaccccuucuuucccuaaaucaacacucuuuguugauguuuuggaaaacaugagaauuggugaacucguguccucuguuacugcaacugauuccgauucaggugacaaugcugauuuauauuacaguauuacugggacuaacaaccacggaacuuuuagcauuagcccaaacacugggaguauuuuucuugccaaaaaacuggacuuugaaacacagucuuuguauaaauuaaauauaacagcaaaagaccaaggaagaccuccucguucaucuacaaugucagugguuauucacgugagggacuuuaaugacaauccuccuagcuuuccuccuggagauauuuucaagucuauuguugagaacauucccaucgguacaucugucauuucagugacugcacaugacccugaugcagacauuaauggucaacuauccuacacaaucauucaacagaugccaagaggcaaccacuuuaccauagaugaagucaaagggacuauauauacuaaugcugaaauagaucgggaauuugcuaaucucuuugaguugacuguaaaagccaaugaucaagcugugccaauagaaacuagacgguaugcuuugaagaacgugaccauuuugguuacagaccucaaugacaaugucccaauguuuauaucacaaaacgcccuugcugcagacccaucagcugugauugguuccguucugacaacaauuauggcugcugacccagaugaaggugcuaauggagaaauagaguaugagaucaucaauggggacacagacaccuucauuguugaucguuauaguggagaccugagaguggcuucagcguuggugccuucacaguugaucuacaaucucauaguuucagcaacagaccuugggccugaaaggaggaaaucgaccacugaauugaccaucauucuucagggccuugauggaccuguuuuuacucaacccaaauauauaacuauuuugaaggaaggagaacccauuggcacaaacgugauaucaauagaagcagcuagccccagaggaucugaggccccaguggaguauuauauuguuucaguucguugugaagaaaaaacuguuggacgccucuuuacuauuggacgacauacugguauaauucagaccgcagccauucuggaccgggagcaaggagcaugucuuuaccugguggauguuuaugccauagaaaaaucaacugcuuuucccagaacacagagagcagagguaaugauuuuguagucauuuauuauuuguugauuugcuuuuuagaaaaaucauucucuuuauauuuacucucuauaauuguuuaccuucauuguuuauuguuaaauuugugaacaggaacaccuaaaaauguucugucaaaggcuaacagagaguuacauaaacuuuaguuuuaaucuugguugcaacuaaacaacaaacuuucuuuucacuuuauauuuuacuuuauagcaaucacauauauaagguuaaggagaaaucuuuagccauuucagaggggaaaaaauccauauaucuaagcuaaauugcugagguaaucuaaauaccacucaauaaggaaggcuaccagaagaugggcacuuucagaauuaagaagaccuauuccaaaaugaagagcuuugguaggaaucagcauuguaccauagcucuucaggaagaguggccauggaggaugggcugacaguguacaccaggacaguauuaacuuucacauccucagcagucuuggcaguuucuuuauagacagugacuaauuuuaaugugcugagccaaguuuuggaagauuccugauuucaucugccuuaacauuuuagacacugucuucugacuuaggauaauccuuccuuuucccucuuaaauuaaggcaugcaaugggcugugaauaaucagagacuagggauuguuucuugacaauacugaguucaaugccaugggauagauacacucuguucuguuuguuggugaguaagaaauuaguguuucauagcauaagccaaaagaauuccaagcucagccuucccuggaguguauuuuaggcuacugccuccuuguaucguugauuugcuuuuuaauugaacuacuuucaauguuauuuugauaaucaacuagaaaugauauagcuauacuccagaaaacucuuguuugcuguuucucaguucauucuuucccuccccaggccccucaaagacauucuagugucagucagccaaaaacacaaacaucaaaugugguuugugauacuuggcagugacccagacacaacaugcaagugaaauugaggcucaugugcuuguuuucuugcuucuuuucuuuuuuggggggaggagguggggauuuucuuuauuuuaaaugauaauuuauuauuauuauuauauauuuuuguauccucugugauuuuuuuucauaguaguugguuaugucuaucuauggauggggaagaauauuuauggcuuaaaggaccauauuaauuagagauauaauucuaaggggaauucaauuuuaucuuuaccuacauagcacugaaaggauuucuaagccaaauaaccucuuuuaccuaauuauuuaaaaaauauuuuaauauagggcuuauauguugagcuauuugguguagcucaggccaugauuuauauguaauugaauuuugauuugaaguuauccaucuucuaaacccacaauccucucucuaacuuucuucucuggaaugaauacuuacaugaaaauauuugauuaguuugaaaaccaaaauauugauugaaggcaggaaauuaagucauuccagacuuuagaugaauuuguuaaacuguaaaacagauuauguuauuagaugcuguuguuugguucaguguaguacauuuuauuagaauacuauggagaaugagaauaaaugcucaguuuuaucauuagauuuauugugucuuuuuuauuuacccauuagcuaugcaaagauuggcuuagcaugaaaguauuaaauagugcugccucugcaauaggcaagaagauuaaaaauguuuauaaguaauuuuguuauuaauaggggaugauuuguuuauuacuuuuuauaagucaaguaacaccaauaugaaaaguuaucauauauacuauguucuauucauuuaaaaaucuggggagaauucaaugugaugauuuuuuuaauuaaaaaaaagucagcauaucuucugugaacuuaagugcugaaauuguaaacccaauuugaguucucaagauccaaccacuuugaaaaugaaaagcaaauguguuucuccaaagaauauugaaagcagugguugugagcuagaauuucauauuauuauugguuggauuuuucaaguguauacaauaaagugcuguuuuccuucugcucaaacaauuaauuuacugugauucugcaaaaauaaguuauacauuuccucuuguuaucaaaggcgauuuuuaaauuguuuguuuaauuggacuuuguccagcgcauuuuaaaaaauuauucauguacacugauaagagucuggguugcuuacucagguuucuggcagagucaugcugaucacauuccaugggcaggcagagagucagcggguaaaagagaaacaauuucaucugcauucuuuuccuagcucugacauuugggguaagaggcuaaugacuaugacucugauauuguucauuccaaagauguguccaguuauacaccuuuacuuacgcuacuuguuauauccaaagauuuggcauugguaguaaugucauugaaagauuguguuuggguuucagacacaagauuaauuaccuuuuuauuuugucucuuuauguucucagaagagcuuagauagucuugauuauguuagaauaggccauguaaaguuuguggcauuuuucuagguucaccaaaaaauagauauauguacuucaguaagcauuuauccuuuaauguguauuacauaggaacaugcaacuuaggaacgugguuagaccucaugauggucaggggcuuguuuuauuggucuuuguuauuucagaccguggcauauuaccugauguauaguaggugcuccauacauguuugcugaauaagaugguagaagaccuaagaucagaacauaugucuuuauaacuugggaauaaaucaccagagaaaagcugaggaaaugaaggaaguuaauaaaucugaugcugcucauuaauugaacucaggucagagcauaauaauuaucucugcucuacaaaugaauugauaacugucaggaaacucaacaaggaagaggaauuuacguggguguucugauauggagcuuaguguuuaaauggaaggaagcaaucuuauacauucagguagucaccaggccauaguucccaaacuugcuacauucaggaccccuuuaugcucuuaagaauugucaaggacaccccuggagacuuuguguaagcaugucuugucuauugauauuuaccacuuuuaacaguacaacugaggaaauuaaaaauauuuguuaauucauuuuaaaacuacauuauauuuuaaauauauaacauguuuauuuuguuuuaaaaaaguuuauuuuuucuaacuaaaaauuaaagaguggcauuaucuuacaucuuuacaaaucucuuuaauaucuagcucaauagaauacagcuggauucucaaaucuucuugggcaauauauugcaauauguuguguuuuuggcuaaaauauacaagcagaauccauccuuacacagauauuuugagugggauaauagagaaauaguuugccuacugcaucagaaguccacaguggcaguuucuuaagacuuacuugcaguguggaauaugaaacccugucagcaaacuuuucauagucuguuacauaaaaauacauuuaucucgcauucguaaugauuuuuuuuuaccuauuccugauuuagaaauaucaggcauugaucauuucaaaauuauugguguaacugauaaggaauuuaucauaaaagucuuuaauauaugacucucaaccuguuggugaugguuagaaguuuuccaaauuugaauuuuuacucgaaagcucaaauuucacuauuaguaacauauauuguuguuuuccuggaagugucaggcuuccuuuguucaugauaaaaagaaaagauuaugcauacucaaauauuuaaaaagaaacaguugcucuuucgaguaaaaaucguauuccacaaaucaaguggcuaguucagcuuacaauucaauuacacauaugcauuucuuugagaaaaccacaauaccuagguacagaguaaugggucuuugugcacauauugcuuugugucacacaggauauugaaaagacaucaaaguugagucuagauuugauaaaauuaauacguuuuuuguuuucucaagaaaacuuauuuaccuuuuuaaaugaaauaguuuuguuuguuuguuuguuuuacugugaguaugugguggugaagaacacaauuacugcuaaaguacuuuggaucuacugcuuugauuugugcuaaaguaccaccaguuuuacccaccauugcuuuugcaccucuagcauaaaugccaacacagugaacaaaggcagaggaugguuugcauuaucauguaaacaguguugauuucccaggacuccuuaaacaggucucugguuugcauggagguccaugcauacuccacagugagagaaccauugguguggguagugagauuuuggcaguucaguuaacaaccaggaaaaaaagagccacucgaaauaauauauuaaaaguauguuuggaauauuagguaaauggacuaugauucauuaaugauuacaaaugaguuuuagcaaucugauaauaaauuaauuuauuuucacaagaaacuauuaagauuuccaagagaaaugauggagacauuugugaggucaguuuuggauacaaacguuagaaaugauuuucuuucacaggguuuugaaucacaguagugcaccuuagauuaaaugucuguauaucuuguguauugaaccucacaagcagaauacaggcaagagagcuggauauauaauaacuguuauuauuauaaaauuuauugaauauugcuauguuuagacauaaugauaagugcauagugauaagugcauuuuuagggauuuuauuuaacccauacaauacuaauaucauuugcauuuuguagcuauggaaacugagucucagauaaguuaauaagucgcuuaaguucauauagauagaaagaaaaccauauccagacuugaguaacuucacaaugcauccucauaacuacucuucuaucaagcuggaucagucugugguuuugguuaagagaaaagcucuuugcccuauagcuaugaugauauauguaugcuuuuuaauaacuuuguuuucacucucugauuuguugcuuaaaaagcauuuaaggccaggcaaaguggcucacaccuuaaaugggaggccaaggcagacaauuccuugaggccaggauuuugagaccagccugggcaacaugguaaaaccccaucucuacuaaaaauacaaaaauuugccgggcaugguggugcacgccuguagucccagcuacuugggaggcugagauaggagaaccacucaaacccugggagcagaggcugcagugagcugagaucaugccauugcacuccaggcugggugacagaauuagacuuuaucucaaaaaaaaauucauaaguauuuuuauguauuguguaaaauaaagggaaacaauuuuugccuaccacagcuaaggcccucagcagaucgguuacaucccuaggcaucauuaguggugguagcaaggagccuaaauugaauuaggaagacuuccaaggguuucuagagcagggaagaagaugagaauuugagagaagggagcugaaggcaaauggagagcaaagguagaugaggggccucuucuaaccuacagcacuauucacuuuggaagcagucacuggaguuuaagaagguggagaauuauuuuugaauuuuuaggugauaaaucaucuucuuuggaauaaugaugggguuggaguggauggagugugaagauuauuuuaaauaggaaaacauuuuacugcuuccuauguguuugaagucaagaguguuucuuuaaaaaacagccugggauaaauuuuuugauuuuguuucuucccuauugguauguuuuuaaauguauugaacaaaaugcugugaauuaaagggcuuuauaaauuuuuaagauggguacaaauguguaugacaaacaggauuauugauggcuaauuauguucaugcugcauauuuuauauauaucuucaggaugcuugauuuacuccugcugcuagauuucuauagacauaacucaucuuccaaugaauuuacaauuuauuacuuuuuuaucuuuauuaaaacccuaaugauuuuaauucuuuuuuguuuuauucaauuuugaggaaucugcucuaggaauaguuuugaaaaauaguuauuuacuuagaauuuuguggaaucaauuuuucauugcauugucugcagcuugcacuuugucaucauuagagugaaaaacugccuaagaaccucauuaguugugagggacuguugcauuagugacuguagcaaacugcauaggcccugagguggguucuguauuucaagaauuaauaaaucuaggcccagcgcuuuauaaaacccauaaaaguaggugguauuccgaauuaggcacucgugaguggaaauaggaaaagaauaacuggcagguaaugugggucaagaugaauauaaaguguccaauauagaauaugguaaauauuuucuaauaauuucaagcuuuauguagucugugacaaaaguagccauuuuaauaguauguugacugagaaggagaguauagggaaugcagacaggugaaaauauucuauuaaacaaacauucuguauaaaauacacacauguaauuauauauuaacacguaugcccccauuguacaaagacuguuggcuuuucuuugcucuuaauauccugagacaaaauuggacaauuaagucaugaagaggaaacaaucuaauuggcagauaauuuauaugugguaauuaaacagugauuauaggaccacaaucuucuucaguuuccagacguguaugcauuuuuaagaaacgaucagugaguaaaaaccaaagaauuuuaaggcuuugaagaaauguugaaagacauuuagaaacaugcuuugcuacuggcaggugggagcaaguggcauuuuugaugauuguuacagauuauuugacauuucucuaaggcuuuuuaucauucacagauucuaacauauauaaaucguuuauguuauuguuagacacugguaaacagucuugccaggugcugucuugccuuugcaaugguucuggagguagauacaacauaucaucauuugacaaaugagaauacugaggcucauggagguugcuuauggaguugguuuaugguggaagcaggauuuaaacccagcagucugccucugaagucugugcauuuaguuccaacacagcacuaacuaaugcuacuuguaagaaugauuauuucuauacauuuguagacauaauucucaccauguaaaaaguuguuuucauauuucuauacuuguucauguuaaugaugaaaaaauauaagauaaaaugaaauuuuggugaugaaccaguaguaggauuacuuuaggucccuaucaaucuuuguuuaggucccuauuaaccuuuauaaucuuuauuaaccuauaaucuguuauuucuucauuuugcuuucuaaaucccaaggcaggaauauauuuccauucuuucaguugcucauuuauuuucuucccuuugcagcaaaacuuuuugaaagaguugccuguaccugcauuuuuucuucucaugaucucuuaaaucuacucccaucagacuuggccccugccacuccagugaaauugcucuuacugaggccacuaugauggacacauugcuagauccaauggccuuucucaaugcucauuguagcuaaucuaaagaauauuugaccuaguggauuuuacuuccauuaaaugcuuuauucgguuggcuuccgagucaucauauucugugacuuuuuacccuuuuuuauuucuuggaccaaucacuucucagccucguucgcaagcaucucaccauguccucaaacucuaaguguuggaacaucccuaaagccaguucuugcagucuuucucuuuuuacucuauacucauucccuugaggaucucaaucucauagcauuaaaugacauauauacacugaugacuccaaaauuuugccuccagcccauaugucuuuucugaacccuacauucguauaaccaaucacuuauucauugauuagcuuccuaacugauauuuuaaauuaacauuuuuaaaucugagcugcugauauucuccccaauaaaaacauauuccaucuucacccaucuucuuuucaguugauggcaauuccaaccuucugauugaucaggucaaaaaucuuagcguuaucuuugacuccuaacuuucuuucucacccuacuuacaaccuuucaguugaucuuguuggcucugucuucaaaauauuucauuucaauaugaucauuucaugauaauuucucaucaugcucacuguuaguaacuuggucuaagacaccaucauucuucccuuggauuauugaagacaucuucuuguugauuucugacaguguuccuauuguucucuucucuuacuuggcuuuaccuacacuggcuucuuucuauucucggaacuugcuaggcacacauuagccuucgggcuuuugccuuggcucuuccuucugcauagaacacccuuucuccagacaucagccuggacaacaaccucccauacuucaaguauuuuuuuuuaucucacauugcaaauuaggcuaaaucuuccuuuaauaacuuauuauuguaacuauccccucaugcugccugauuuccauugccuugcggcauuucuucaucuuccucucccauaaggcuuaccagccuccuucaccaauuucuacuuaucuccucacauguuaaauguuggaaugccccuggaacuaguuguugaauuuuuucucuuuuuaaucaauuucacugaggagcucaaccaaucucauuccuuuauauaaaauaugaacacuauauauguauaggggugggugugagugauauaauuuauugauuuauaauguugauuauuguuugaucugucuucuucccacuggaauuaauuucuacgagggcagauauauugaucugcuauguuccuuaacauaucuuaagagucuagaacauuacuuggaacaaacauaguagacacaauauaaguuucuguugaaugacuaagugaaugaaugaaugaacuggcaucucagccuuuguccuuguccccuucaguuuagucuagcaaccagagugagagugaucuuuuagaucauuucauuugcccaaaaacuuccuauuucacuuauaguaaaagucaaauucuuacaaugacccugaagacccuaguugacugcucuuauuaguuacuguuuggaccucuuuuuuccugauuccccuugccugaacuuguucagcaaccaucagagcuccaggccccagccucaggcgccccuccuuagggucuuuguggcagcucuggccuggacugcucccuuccucacuuuccccacaucauuucugagagucaccuugcaaaguccuucuucccuccaguuuucguuuuucucuuuccuuccuuuuguuucugcuuuuuucuuaucaucacccgacauaacacauauguuacuuguuuauucuguuuauggugugccuucccuuuagaauauauguuucaugaggggaaagcuuuucaucuguuucugcuauaugcacagcaccuacaguguggcuggcucuaggcagaugcucaguaaaucauugauaagcuaaggauuuacuguugauaaugcugcaaauaugcugcuuaagcuucaggagcucaaccagugaugcaugcugaaguaggggagucauuuuucaucucuuaagccaagacuuuagagccucuucugaaauuagggaaguuaacugauuggaaaagacugguuuuccuucauaaaaagauaguggcuacaugacuugauuggcuaagaacguguaacccaaacuucagaaacauuuauggugucugugaaggaaagugggaccacuaaugcuauagauguuuugguaaaguagaacauuuuagaaaauauauaucacaguguaugcuacaccaucucaugucuucucaucuccuucaaccuuaucuaauuuugcuuuagagagcagaucuuaaguuauuguuaucguaaaccauguuguucaucagaaaacaggugaauacauagaaacuuugaaaacauuacuacuuuuaauauugauaacuuuaauuacugucauuccuuuuuucuaauuuaccauccuuguucaacauuucacaucaauaauaucaguaaacuugauuuuaacacgcagcaaagaaaauacugcuggacaaucccucuugccuuaaguuuaguugaaagaaugcaggcuuuugauuuaagagaagcuugauucagauguugucacagcuacucucagaaucuuauuuuccucauuuguaaaaugguaaggauagccuacuucauagcuucuugugagaaaaacaauggcacucuauaaaguuuauuagugcucuuccccuuuuuccucaaaauauagaucugcacaggacuauuaacauuuaagaaaaugucuuucuauuuuuaaaguauuuuagaguuccguuccauucuuuuuuuuuuuuuuuuuccuuucucaauuuccucaacaagccuguaaggaagucaagcauuuuuauguucauuuuaaggaaaagacacaaggaauuucauuauuucuguguggucacaaaucuagacuagcacccagguuuauaugacuuuggucaacaugccugacauuaaacaauacugcccagucugguguuaaugcuauuuuucauccacuauuguauuguuguugacauaauuuaguaauaguuauaaccccuuaagugaaguuauuuaugaauugugaaacuuuuuuaaagguuuaguugcucaggaaacaaacaaguuagaauauuugaauauucaguguuuguuucauuuucauuugauuuaauuugauuugauuucauucaguguuuuguuucauucagagagaagccuuaucucugauuuagaugagggauauucaucucucaauuuuuagugaugguaguaaaauauugacuauuauggaauuguguguguuuguuugugagccuauuuagaaaucguuuuuuguccaugacuuaaugcaguuuucuuaauugaggucgacuuggcuucuccaguccaaaaaagggaaaacuaucuaucuuucgaaacuacucuuuaacaaaacauauaaauucugguaacuuuuuaagugaagauuuucuaacuaaugauuaaaacguuuuccuggacagaaaaguauuuucuuacuucauaaaauauucaaaauaagcaaauacacaaagaagaugggcuuucuucugcucgggguaguguuuuaugguauauacauuuuuguucuuugguuaaaauacuuacucuuauuuuuauuuauacauuggcuucauucuacaauagauuugaagcaguuuacaaaaguauauauacaacaaagagauacaauauuuaaaugaaucucuaaguaguaaaaauaaguguuacuaaaaauaauccugaaauauauaagauuagcauacagauauauguaauuuagguaacucauugaguuuauguuuagcuuucuaaaggccaagucaagcagagaagcaagaucagauauguaagucauggugcucuuauacuaaacaaacacaggguaaacaaaggaaauacagauuuucuaaacccaaggaacuuaauagaauucgucccacagaugcucaaaacagaccuauuuuaaagugaugauuuucuuaauggcaucuucacuaguucaaugacagauuuuuaacaucauuuuaaugugacgucuuuucguguggauuuguggcaaauuguaaaagugcaguucuggcaaauuauuuauuuauggaucaaaagagauuccccauugauaagugcuuuuguuuagcuuuauuucaugaaguggauuaauauuuuauaaccaaagcaagaauaucccuacuggguuuuuucacauuagcauaucuguagcacaucacaggaaaaaucuaacuagagagguuuucuguaaaacuguagcuuaauccuuaaggagacuuuauuuuaagcuaugcugcagugauuaaaaugcuuagcaccaauuucuaguaaucugugucuuagauuguuuccauuuuucaagaaauagaaacaaucauccugugagauaacaaaauuugcuauugaaaacaucggugcuguuuaaaaaugucauauauuuucaaauauuaaaaauauaaaagaauaacuaucacauacacucuaacuuuuccucugguggagucacuaauauccuaaggcuaggaaggugaggaaucaauaccaaguaaaggucagagcucuaggaugggaaugggagucucagguuuuuaauucuaggacagucauuugacaccucauuuucaaaugauaaacugaaacaauaggguuuauguggcccacucauauaacacacuuaguuggcagaggagucccagauuagaauuucuuacuuacugaguauagucaaccuauacucaguguugacuccaguccuuaaacucggagugagaaaaggaggcuacagcuuccucaugaucuucacaucuccaucagcauccucccaaagacaucucccaaaaacauggaauuuaaaguaaaagaaagauuuuuuguuaugcaaaugcggcuucaagaugaagccuuuggaccccgauucuugcucuuucccacaugcccccucaccucuucccaugcaccuguccccaucccauccauauuguugucccuaaaucccauuugcaaagauccuggauccaccaacagcuauaaccuuucuuuuuucaugacacugcuucuaaauccuuugcacaauucugagaaauugcuuccuaucaggugcuaauggcauuuaaccuuuuagggaucuccugucuucaaauuaaaaaauaauaaaauguauucaauucuauugucauguuaauuucaaauuuuuuaacaauuuugagauguuugacaguuucaggagauuugcuuaaaacaagacauguauuucauauauuacuuuaauaccaaaaccaauugugauuaugucuaucuaauggcaaauuugaaacauaauucagaguuauuaaauguuacuugaauugauuauauuauauggucauagaauuuuccucaccaguagcuguauggcaauccuuuaauugcacaaaaguuaacccauagucucuuuuuuuuaagauaguacuuuaaaauuuccacuaaaaacauuaaaauaccaauucauguauaguauagcuauguggaacagaacagccuguguugcaacgccagcuuaauauuuuauuacuucacauaauaaaauagggaacguauuuauccacugagguuguaauuaguuacaaguaaugaaucuuuaguguucuaauuccagagccuggcagauuuagaacaccaguugacccugucuugcuggaaaaugaaggaagugggaguagaauuuucucuguaggacaagacagcuuuggaugggagggacaauagaagcuugccaaaaacaugggucaaacugaacacagauggcuguagcugauagaggugucuauuauuguguuuucuucucagcaguuuucucuuuguuugucaguauuuuuauacuuacaugaagaaauuuuguugcucagcaaccaagagaaaauauacuaauagaauccauuuuuguuggaaaaaaaauguuggugguagauguugaugaugggguugagguaguguugugauugagcaguauuaacguaggaguagaggugauuuucucggagugcuguuuauuauaagugucuaaaauuaaauauaucacauuauccauuuacugcuuagcuugccucugucuuacaccuccaauacuauuugggaaaaaaauggccuaaguaaauguauuccauuaguuaauaauauaauuuauaauacacggaggaaacauuugaagaaauaaaacuauaauuuacauauuuuuuauaacuucaguguuuccuaaagucaauuuuuuaagcuucauuaaaggauuucauguguauuucauuuuuuuuuucuggaggaguucuauuuauuauucuugaguacaucuguuuucugcauggugaaauauuaaaauaaauauauauuugaaagucagaauaguuuuguucaaauacuggcuuaacuuuucaugcugugugacuuuaagggagaagccaaacuucucugaaccacaguaccuuuaucuguuaaaaaaagagaauuccaaucccuuaauaaguguugugaggaaaaugugcaguacacauagcacugcauauuuuccuaaaagacuguuugauuuacuuuuguugaugcuacauucaguuauuuacuucuugugugguccagaaggcaaugauaaaaaaauguaaacaacuccuggucauguaaauagcuacuguucauacaaaaauugugaugacauuuuuaaugauaccacauaaagggaaaucaagaccaaucuuacaaauucuguuucuugguuuuaaggaaauuauuaaggaacugcauuaaaaauaacucugugguaauuuucuucauuguacuguaucagguagaaaaauaauuuuuaaaugagugacuagugagccgcaagacauaaccaagaacagaaggguuauuagcuaacaaagggaagcagauguaauuuuuaaacauugauuuugcauuuauuuauuuuaaguaaacuacagaauuuuuaaauuuuaauauaaugcaaagguagaguagcauuuuccaauuuauacacuauguuuugauaagugucagauacugaaguuauauucuaaauauaauccacccgccuagggaaacgaauaaaaauauaaccuuuguuaaaagauaggguaagugaauuguuaaugacuauuccagaagugagacuucagaacauaguuuggcucuaaaagaccuuucuuucauuuuaauauuauauuugaaacacuuaguaaagauaaauuuuuaaauguucaaugucugaucauuguaagcaaugucauuuugugagcucuauuucuggaacuagaaaaauuacuuugaaaacuguccauucugguugugcuuuuuugaguaaguggucuuaguuguauuuuaauagaggaaaugaaacaagguaccacucuuuuaauguauuuauucugauguugaggcgauauguuagaacaaauuuaauuauacuaugacuaugaaaacaaaauuaggcagaacuagagugauaggcgggaacucauuguugauuuucaacuuaaauaucauauacuuauuaauauaugcauuacaaauauaucauuuaauuaucucaacaacucuagaagguaaguaaugguauuuccauuuuguagauggaguaucaaggaucaugaaauugucaguauauuguuuugugguagagcgccauuugaguucauuugguuccaaggcuuuaguucuuuccaguacacuucacuggucuucaauuguuauaaaucacagccugcuaauuucacagaaaggagauuaaaagcaaaagccauaaauauaaauacgaaguauuugaaugcugaucuauaucauaacuagaucuuucuuuuuuguuuggauuauagugaauuuuuaaacuagaaaauauaagcaaacaguauuuuugaaggauguaauaaccacacuccaaaguacaucaaugaaucauauuaaauuaaccauuaauuaaucacauuaaaaggaaaagcauacuuaggaaacacagaaaauuuauuuuuuaaggguugaacuuauaauuaacugaauuaaaugagauguuaaauuaacuuugaaaggcacauuucgaucacugauauaccuaaacuugccuccuaauuaaauacuuaaaaauaaaugaaucaacauuugcuuuuaauaaugacccugagagaaggaaaauauagaauauuuaacuacaaguuaauaacuaauaauuaguguagauuuaguaguagaagaaaagguaagauggagccaauacuguaacuacauuauauguuaaaacacuuauguaaacacagccagauauaauuauauggagguugcuuuaaggauuacuguuauuacauauaaaauuuuccuuacaagaguaggugaacauaaaaagacuauugaauucaaaucuagggaacuugggaagaaaaauaaaacucuuuuagagagucuauguaauacaugggaagaguaaggacuuuugauucaaacacacuuggguacaaucaugacuuggggaagcugucuuccccaagaguaucacaguaucaguugccucuuuugugaaaucuauuucacagagcagcuuugagaaacaaaacuuaaaaaugcacccaugauacucacccaaaauaaguauccauucacuucucucucauuuucuucauuugcauagaugcugguuuugucauucaucagacaagauugccaggauauaacauugagaacuauguaaaugacacuacaucuuuucaucccuguucuuagaugaagauaaguuugagaauuuucuugggguguuucaguagagaauuaaaccuccuuaggauuucugguuuuguucugaaaugcaagauggacauggaagcagaagggacauuaaccuguuucucugccauuugccuggauguauauauuuacauugcuaagaucuugguucugcacacugucauuuagacaauaacuaaggauuuccgaauuagaagggauaaguguuaacuaggaccuuguucuuauguuuuauuguggauaauguguuggccuuuguacuaccuucccauccucaacuaucauuccaguauucaauaugcgagcuacaguguuucuuacuggggauuuaaauaugcauaguucaggucagauacacauauuucaaauaugcaugguucaaagguaagcaguuaccuuuaacaggauagcuucuauuuauagcuuuuauccaugcccucaagagacuagcaaucuaauaggaagacaaacaucacauaaacuauuaucagaaaaucuaaaagauugcugugaugaaaaaguuucaccagcugauuacgguaacugguuucuguaaucucaacacaauugagauuauuuauccugucugagcuuuugguuuuugcauuucauaaggcuuugucugcauauuuuaaacuauuggaaaugaauuuuuuuuaaucuaugugcagaaaaaauaucaggcaaauuauacccaccuuuauucuucuguuuuuaaaauacugaauaugaaauauuacauuccuauguaauuaaauagcguuugauuuaaagcauguggaccuugggccucauccaagggauacucuaguguaccuuggucugaggcugcuuaucaguccugaugugcuuucccuuuccuuccuguuugaauacagguccauucugugcuguuaccaucucuguccuuaagagcuuccuuugcccuaagaugccccgauguauguuuguauuugaugacauauuuuuacauccuggucaggaaauauaauuauucaucucucuacaacauuaucaacauuaucuccuuuuuuuugagacggagucuugcccugucgcccaggcuggaguacaguggcacgaucuuggcucauuacaaccucugccucccggguucaagcgauucuccugccucagccucccggguucaagcgauucuccugccucagccucccgaguagcugggauuacaggcucaugccaccacgccuggcuaauuuuuuuguauuuuuaguagagacgggguuucaccguguuagccaggauggucucgaucuucugaccucgugauccgccugccucggccucccaaagugcugggauuauaggagugaaccaccgcacccagccuccaacauuauuucuaugguaauaguuauuaaacaauaauagcaucauuauuaauaauuauggaacauuaacagcaacuaccucuaaaacaacuaaaacuaacauuuauuuaaaacaaauggcuauuuaugcuauuuuauucaaaccucaaaauaaugcuaugaaauaguuaucguuguuauuaccauuucacugaugagaaaacugaggcucagggaagauuaguuaacucccuuuggaucauacaauuaggaagaccuagagccaagauuucagccuaagcaaaauucauccuuagcaauagcacauccugaccuggucauauauaagaauuuaauaguaguuucugauaaagauaucgguuuggaaaauuuaaaaaaauaauauuuuauuguacaucuauaauauaauuguauaguuaauuguauaauuguauaauuguauauguguauaugagauagacaguuuaaaaaauauuacuuuaaguccuuuuugaaaugaaucgugaauaaaaauaguuugaauauagaagcaggauuuuaaucaaaugaauauagaaaauauucuuuaaaaucacugacagaaaauacaagaauuucagaaaaugaacguucaacauauuuuuucaagggcucuuauucuuuucuauuuuguggauauucaauauaagcaaaauuuuaaauucaaaaaauauuuaauuuuauauguugauauauuuuaguuugauuaauucucaaaacuuaauguacaugagacucucuuagguggauauuuauuuaaaaugcauauuacuuuucagaagauuucaugaaaguucuugaaacauauuuuaacaagucccucaagggauucugaugcaaaugucucguagagcacauuguaagaaacaacucuuuuuuuuuuuuugagacggagccucgcucugucgcccaggcuggagugcaguggcgugaucucggcuagcugcaagcuccgccucccggguucacgccauucuccuccugccucagucucuggagaagcugggacuacaggcgcccgccaccacgcccggcuaauuuuuuguguuuuuaguagagacgggguuucaccguguuagccaggauggucucgaucucuuuuuaauagguuaggucauauauaagaauuuaauuacacauuugcaaauuuagaagcucuucucuaaaguuuuccaguuucacuaguucuuugaaguaguaguuguguagcaguugcgguggcaauaguaguagcagcagcaguaguaguauuagcaguaauaguaacagcauaguaacaguaguaguaguaggauaaucaacacauggaacacuaagggauaguuaucuuuucuaaugugguugcuacucaaacacauuacaagauuuuggcauuaguugacaagcuauugcaagcaaucauugagauaauaaacuauaacuuaaguaaaaauguacacuguccuguuuauuaaguuuguguaaauguguuauguguuguuauguagcuuuagaauaccuucacugacuuuucagcaauuaccuuuaacagaauaguuuuuauuuauuuuuacauuuauuauacauuuagaaagaagaugagagcaauaguuuuuuauuaguauaaggcaaacuuaacugauuaaaccuucuuaggaaaagcaauaguucugaaagauaugcaagaaaaaaaaugacaaaagugaaagaacucuaguguuucaagaacaaggaauggcucuaugagcuaucccuaggaaagcauauuuaaaaugaacuaaaauaaggaucuuuugcuuagcacagaauguaugagguguuuuuaaaagagguggccugaggcagugguuauaugggaauucauacaaauguuagagauuuguuaguuuuuacauuauacuucuauuaacuguagaauuacuauuaguauagagaccucaaguguuucuuauuucugaagucuucuuaguagugaaaugaugagggguauaguaauguccauuuguaauaaaaaugauuaaugaaaaauagaauuuuuuauuuuuuaacuuuuaggauucaucauaugcugaacaucuuuuuaaaguucugacuguauugugcaaugucuuuuaauucauguguguucuuccuuaucuaaaaaucauuuacauuuacaaauaagaauauuuuuaccugcaccaaucaagauacaauuaguagcuauaaauguaacauucuauauguaacagaauaagaaaacaagagaaaaaaauuguaacuuagcauaauugaaacaugugccuagccaucuggagcacuucugcauaauauaaagacauuugacauuuuaaauaaaggauuuugaaauaaacaagaauucuuuugugucuuccaaagacauugauuuauugagacuauguguggcuuuucaucauauacaaaagauuaaugauuuccuaaaaguccuugcauuucuucauuuuauaaaauguauacacacaguuaagaaaaaugaauccuugaaguccugugaagaaaggugacaggaaauaguucaaaguauuucauuuuaaauaacaucaaauauuauaaaauauaaauuuucucaaaguaaaaaaaugagcuuggcauuauugaauguugguugaaugauaaaugcauaaguuuaugauuaucccaauacuauauaugugauuuuuaucaaacauauuaaagaguacuauaaaauaauuuuaacuuuugaucuauaaauuucuaaaauuucagcacggugauugguguugauaaauuuaaagcaucaaacagaucuugucuuaucaauaagaaguaguuuaaauaaacauuuuugaaaguaaaauuuuuaucaagcucaaauaauuucaaagcauaguucaagagauuagaaagcuuuuaugguauaaaauaugaaauugauacugguuuuguucagaaucccuucauugacuuuucagcacuuaccuuuaacaggauuguuuuauuuacauauuuuuacauuuauuauacauuuagaaagaagaugagagcaauagcuuuuuauuaguauauggcaaacuuaaacugauuaaagcuucaguuaaauuuugccuuauacacucauauuuccuguuaaaaauacaauuuaaauuuagauauguuuacauuaaaacacucagcacauuauaaacuuaacuauugacuuaaaaauuuuguagacgucaucauauauguuugaauuuuauuuuuuuauuacaauaacaauauggucaagaaugaaacacaauuuuauauuacuuuauagcuaagaauguuaaaaugagauaaaaauucagguguaaaauuuugguucauucuuuuucacuacuacuuuuauuucuuaguuauugcauuaaaucaggauuuuagagaaauauuccauccaauguacaguucuuuugaguaaauauuccaaugcaaauaaaucaaugcaauaucauuuugaaauuauaaauuggguuauaauuaacuauauuggcuaauauuaguuuuauaaguguuuuaauaacuacauagcaaaaguucugcccaauuuuaauguaauuuagaagcuguguaaauuuuaaguaaucauuuacgcuuuuaaaaucauauucauauucauauauuuugguuuccaaaauagugguuuuuauaaggccucaauuuuuuucccauguaaauugagguaugcuauugaguucucugaaucugcucuuguccauaaagauagcuuauucuccuucagacagggcggaugauauuuccagaagcaagucaguguauuaaccuaguuacguuaaaccauaucucugcuauuuuagaaacaaugaugaauuaagcagcuucaguucuuggggcagcauccagggcuagaacccauagcaccaaguccaugggcuccucccacuucaccuccugugcauguuaccagccauuuaaucuguuuuggccccuaaaucagucaggaauuuccauaugauuuacaacuccauuugcuaagaagaaaaaaaaaaugaagaaacuuaaauuucaucucuuaauauaguuuuaauagcacuuaauaauuuuaucuuagaauuuugaacacauuuuuaaaacucugaguucgaguauugacuaccuacuaugugaagaacuuuacugcucaagaauauacguuaaaaauacauauugacccagcucugagagaaaauuugagaauccacacuacagaauaaaagaaauacaguagaaauuguggaagaggauacaaaguaaauuaguuaagcauauuauuaggcagguugauucgaaagggcuuucugaaaaaaaguuugaucuuagauuuacaugaauuguuaaauauaaauaaaaagagauaaagcaugagauauuuccaaaagcauauuuaauccaggccugugcaaaaggagggugaagaacaguaaugaauuggucucuggaucauguuguguucuaauagaugauuugauaaagacuugguaugggaugugaguuagaggaauugagcaggaggaguguauuaggagagagagccuuuauugcuagguuaaguaauuuacauuuuugaaguugugggaacaucuuauaacucaauuacuagaaugcaaaaaguugcugaugaauguugagcaaugcuguaaguuuuccaaagcauauccaagagagauugcauuuggauuucgaauaagauuaucuccuuuauacaucuauucuuuuaauguauucuacuauauucuacucuugauuccccuuuucugugguguauggauuucccaacuaccuugaagaauugagaagcaaauuuauuaggugaauuauuccaauuuccuaguaauuaaacagcaugaacauaguuagucuaggaggccugguguuauuuuaauucacuuuuccuugugaguuuacugaaguggagauuauccauuacagccagaggcuuuaacgaccagaaaauucuucagcauaccuuaaacaccaauuccccauguugaaauacuuaaucaccacucuugcuucuuugggugcugaaaagaaguuugaucuuagauuaccugaauugcuaaauauaaauaaaaagagagaaaacgagauauuuucauaaccaaauaguaucugugaugccaaugggcguuauucugcuuuccuauguggaagauuccuucucaucauucacuguuuuggucaagaacacccugaugaaaaaaaucuuugguugccuuccagguagaguuagucucuucuaaguuccaccauuuuuauucacaccauaauuguaaugcuuaccccauugauaaauuacuugcauuucuaacuguccccccugccccccaccaccaugacuaugaucucuuugugccugguguauuucucacucaucccuggguccuccaugucuuacaguggugccuggcacauggcaauaaucaauaaaugccaagagaaugaauacauugaaaugaauuugugaauggaugaguuuugcuuucuuugguacuguagugauuguuauuugcagauuauuucugucuuuuaccuaauuuagaagguccauguguaauuuggucaugguuugaacugcuaguaaaaacaaaggucauccuuuauuuaaauucccacaguagcugcugcuuccauuuacacauuguagauggucaacgauuguuuaaaauuggugagcagaugaauauccaggugcuuccuggaggaaaagugaauggagcagaucauccuccaacuuaaucacugcaauguaauuuuucauaugggaauagaacagcgaaaauauucucugcaaacgaaaaauauuggacaauuaaggugcuaagauugccuuuuuuguguuuuugguuuggggucucuguuugaaaugacacuagugagcuucagguuucuuuccuuguuaacuuuugcugaaggccaaagaggaaugauuaaggacuucuaaagaaguauugaaaaaaaaaacacacaaaaaguggugacaaaaauacuuauuauuuuccuuuaauuuuuuucugcaauuuuguugauguuguuauuacuaccauuuaaauauaguuaauauuaaugauuacuuuuaguagcauuuaaggauuuucaucuuucaaauuacuacucuggcauguauuauuuaugcacuuugaauugcuuugcauguugaaauuuucuuuuggccucuaauucaauuagaaugcccuuagaguuuugaagguugcaguuuauauaacuuaccuuauuagcuauaaauggaauacagauuuacccuuaaaaugaucuaguugucuauauuuuaaucacauauauacauguagugcuauaaauguuaaccagguagauuuuucccagcugccuagccaaagagaacgguauuagugucacaguucaguugagcuguuguuaucuguaugagaucaaucuuuuggagaaggcagugaagguuuucuuauuuaauuugcuuucagcaaguccucccccucuuuuuuuuuauauauaauuuuaaguacugcucuuagugggucauuagacuuugagaauuauucacuuuguuagcccaaacacuaaaaccuugugucuuuuaacucugauuagugacacuuuaauaaagucauuugaaguucaguggacugaauuuuccaacuuuucugauguuucuauggucacgguagagcaaccuguauugaagcuuguacacaaacuuuuaaaugcaaaucuuggaaagcuguguguaauuuuguauaucugacuucaacagggacugcaaaaugugagggauuaaaaauaaaagcgguagcaguguuuuccuucuuuuuguuuuucaaguugggguacaguaagcuuugggaaauagagaaguugucacuugacuaaacuugauucucugagaaaaaaaaacuugcagauuaaaacuuuuauggcuauacuuuuuuuuugacaaaccaaugagcacaaaaccucauuuucuuccacaugauuagacaauaaggguaaugcaaacuauugaaucauaaauuucuuagagauagagccuugaauuuuuuuuugaaaaaguaaagaaaaaguauauucaauggcuauaauuaaaucaugcacggugaacccacuuuggaggaauuacuucauuuuguauugcauugcgacuugagugaacauuuacaacacgugagaauggaaaggaugaaaaauuaugguugucuuucgguucacaagaauucaaggaggcaggucauugaguuaauuuucaugggaagacuaacucuggccugcucgcauauucagaggccaaacaaccugguauugacagccucaauuugggaggggaacaugcagcagcauugugccaugguuuguugaggaaaaacaagggaagauuuaaaacaaagcugugaauaggaacaguagcccuugugucuugaagcugauugacuuuuccuuuuuagaccuuugugaaaguguuacccucuccuuuaaauaagggcuauacugugguaagagaaauauuuaagauauaauucagugacucuaggaaugggagcauuuacacuucuugaaagaaaucaggugagagcuauuaauugcaaaugccauaugaaagcaucagccugagcgguaggcucagugcuaggcaaggcauauauaagaauacuaauacuaauaggcauuuuuuccaaaccauagauauauauuaccaaucauauguuauaaauuauauauuaucauaauauauaauauauggcauauauuaugucuauguauuucaaucauauaaccuauuuacauauuuuauauacagaaacauacacauguagauaaaaagaccaaucaauuaaugguacuaacaaaagaaagaagauaagaaaaaucuguauagucauauuuacagauauuuuuagaaguaaaaauaaaugucaacaguacauccaguggaaaaauaguuuucuagaacugcccuucuuuuuccaguaccucuucaguuuauugaccuuugaagagauggcugcuaacacuuaacuaccaacauuuguuuaaaaaagaaaaauuaguuuguacuuuugaauauauauuugauauauaauuugaauauuguauuuaaaauauaaagcauaaauauaaaucauaaauaaaaauuacuaauaaauuacaauuuguaagugugcucacuguguuauauuuccauuuggauuugaauccacuuaucagacuacaauagaaauuacauuuauuuuuaaaaauuaauacagauuacauaaaauacuaagaugauuucaguacauacuuacuaaaauuuuaagaagacccaagacuuuauaguaggaccucugaguuauaugucugaaaauuaauugacuuuuggauuugaauauauuacuaauucacuuagccaguuuaauuggauuuaucaguuguuaagaguuagcaguuuaucauaauaaucauauugaugcuuaauacccucugcaucuauuauuugggaugucuggaguugaaaaacuccagacacaauuuaaaugaacuagaaaaaaucauaagguuuaggaucagaaggcccagaguucaaauuucacaucacucagucccugaacuagcucaugaugcuguaaaaguugcacaauauuucugaaccucgauuucuuuauccauaaaacaaugauguuaauauuuacauuguuuaguuauuguguguccuaauuaguuaauguaccaaaacaccuaacauuguaguuucuauacgaagcauauuuaaggaaauaauguuuaucacauaaauuggaacguauucuuuuauauauaaaaugcccaauuaauauacaacuuuagaguucagagaacacaacaaaauaguagggugcccacaucugcaauaugaagaacaaugaaguuuuuuauguaggguguaaacuucagaaaguugaaggauccuuucugaucucauguguccugcucaucaguguauccccagcgcugauccugaugccugauaccuagagagcaaucaauaauuaaugcuauauugaggaagugaaccaacacccaggauuagaguggagaaaacuaauuuuucuccacucuagguaugaccacucaagguaguacacuagaguaguucuucuuuuuuuaauaugaauacacaaauuaauaauccuggaaaauauguucagauuaaguaaauagucaaacuuggagcaauuauccaagacagccauauaaggcugucugcauggauaauagccauaauaauguugauaauucuauguuuaauugugaucgaagccgacaucuuuuuccuaaaagggugugcugaguuuauuaugaaauuaaauuuaggauaauuuauauuuuagugaucacaucuuagagaaaacugcaggcauauuuuaugaugcuaagguuggagaaaucuaagaguucucuauaguuaauuuccugaaaauagaaguuaguuuucaaaaguccaaacaaaucaggaagauuagaaacuaaaauaaauugucauauaagaaauaaugaaucuaugcauuggggauguugcauuuaguuuucguuaccacgauuaggaaagauucugaaaaaggauuaaauuauccagagggguuuagaagaguauacuaaaaauaugaaaauuaggacucuuaagucuauggaagaaaauauaaaaggcauuuuuguugaaguuuauuaaaugauguaaauuauuacugaaacugcauuuguuuugaauuuuccaguauauuaaaacaauggcuaacaauuauaguugagagaaauauauuuaggaaaaguaaugcauuauucagcauucuauuaucuauacuauauuaacacauguguuaugggcugaaauuacaccaguaucacaugaggguaaauggguugaaaguguaaguuuaaaagaguuucaaaugaguuugugaauggauaucauacccuuccacaaaugacagagauggacuauuaaaucagaguugguaguuuuugcuuuuguuuacuguguuucucauucacccuaaaugguccuaucuauaacaagcuuuggaaaagcaccaugcaccugaaauucuugcauucugauguucauaccuagagagauuuauggugacauaagcagccaaauagcacaagugaaauuuuauaugaaguauaugacaugcaugauucaauauauaugcccacuuuuaaauauaccaauaguauauuuggacuauaauaaugaauucauuucaaauauugucauuuugcuugacauucguaucaucacauaagcuagauucccguuauauaaagaugcacaaaggcucauuucagaaauaaaaacaaauaacuguuauuauuuuuuacaaaggugaaggacaauaaaaauugacuaaaauccugaaaaaacaauucagagugcuucaguugggcccuaaacucaaugcgcaaucuugacacauauauugaguuauaauuauuuacuacauuauauuuauuuuguaacugucgucaguuuuuuauguauggaucuauuaauuucaaugaaauuuggauccaguaaauuucuauacaauggaguuugguuauuuggcacuucauaaaaauguaccuuucacauaaugaaugaauaauuuauauuaugauuucucuuguguaggacaguucuugcaggaauacaaaguaaugguaaauuuugauuuaaagugcagcaauucaugcacuuuagagccaguuggaugccaaaguaacuugguugguguuuauuucuaguuacagucaguguuuucuuucuuucuaccaaugagaugagauauuugaaggcuuuuuuucuucuuaggccauaucaauucaaagaaaaugagaaaccauagauuuuggguuggccuuacaaugugcugucauuucaucuuuccaaauauaaaaaucaaaacuucauccuacuucacuuaaucuuuucaaagcuguguuccuuaaugcugauuuuuuuaaaucaauuucaaugacuucguuucuuguauacagcagaaagaauccaguuuggucuuuguaaggagugaaagacuaggaaggaaguauguguuguauagucagugcuucagaguugguagauuuugcuuuuguuuacugaguuucucauucaguccgaauguuccuaucuauaacaagcuuuggagaagcaccuuuguccccagagcuggccuccaggaaggcuuggauccuuacaaguuuggaaaaaugguuacuggcggucauccauaggaaaacagagcaaguuuacaaaguuccugcugauuuccuugaaaguacucccuccucauucucuacaguaagccauugaauguuacuagggauggacacuaagcagaaagauuucugaguaucuauucaucuuccccaaucagacaguccuuuaaauuuaaagaagaaugccugacccuuaagacagggagguucaucauauuucccauucugacaguuuggaaugaaaggacacauaaauuauuauuauuauuauugaauuagagguauggguaugaugacugagguuucucagcagaagauuucugauuccaugcuuugcaucauuagacagccaacagaagcugcacuuaguggccgcgugaugugauugauugguuagauuggaauaaaacuuuuuuguuguuuuuuaaauccaauauuacuuuauuuuuauuuaauuaacuuacauucaaaugcaauugaucauaugauuuucuaauuuuaggauuaaaauauauaugaagauaaguuuggugccaccaauuugaaauuaaauguacagauaaaacaauagaacaauuacugauacaggccaucacugauacaguaacuacuuuagaaugcaucauaaauuucauuuucauauggauuugguaaaugugcuuuuaguuacagaauuguuagucauaaaucaacuagcaaaacagaauuucaaauuuuugagaaaccaugaaccaugugaugcauguuauuuuguuauccucugcugucucuuaagaaauuauuuuuuucuagucacauuauuuguaucagccugucugcaaaacugagucugugcauuucucucugucuucacaauaaauucaguuccauuguaugugcaagaguucuuguucauaccauaagcuuuuuagcuguuucaugauagcuuaguuuuguuaauauauagaaccaaacucccauaugaagugaggaaauaaauguguaaugaguaagaaggcagaauuuuguuuugauuuuucaaaacuuguuacugaaagucagaaauguuuguacacauguucuccugauuaugaucagugauuaaacuuuuguauuaagaacucuuccuaccagaaauacucauccuaagaaagaugaauucuucagaauuuucccauuuauuacuaaauucuagacacuuccaacucagaacaaacuugguuuugaggaauaccaaguaggcacaggauuuaaggcagaaauucagcuaauuccagaacgguugaugcuaccuguugaagcauuuuauaguggaauuucaauaaacaguagauauauuaugcccuuugauuuauuguaguauaacuuuuauuuuccccaacaaauccuuuuuuuaaaaagggauuuagguuguuucaaguauauacuaauuuaauugucaugauuugucuagcuuauagaauacuacuuaugaagacuauuauacauugaaguucugugcuuaaauagaauauagcucuaaguaauuacguuagugguaauuaaaauauucuggaaacauuuuuuggucaccuggugcugugauuuucaaacuagagcugaaaaaaaccucaagggccagggaaaacuuugucacuaguacuucucacccucuucaccauuucaaucaguauagcuccaaguguaacagcuuuaaaugauuucuuccauguaacauuaguuauuuuuaauauaauaauuuauuguucucaaaaaaauguuuacacagaauagguaaucacuaaauguuuugucugaaaaugcacuagcaugcaggccaccaacauauuugggaaauacaucuccugugcuugacuguuccucuuuuaaguaaaaacuucuuuuuccauuguuacuuuuuaagccuauugaucaguguuuucugcacuucauuuguguacaucacaaugaggacauuuaaaaaaugggcuucccuaauuucagagacaaguucuucagauugcuuccccauaugugcaauacuuuccucucugagagcugccagucuucuuuguagggcuagcacgcauacauugcccuuuucugaaaugaaacuagggcuuucuucugcuucuucagcauauugcagccuuggcuuuaaaagaaaaaaugccagagucaacuguauaagccauaagacuacacugaauucuacuggaugcagugauguauuaaaaaaaugauuuauuuccauauugcuguuuccucagcagaaugccuuggacauaauaggaccuugaugaauguguuuuuaauuccugguuagcccucuucuguauggaaaucuuaaaaauauuauuucacucuaauuugaagauauugucaaaucuuugugaaauuuuagcagauuguaaauuuuagaaagauccaaaggaaacauuguuaauacuaauaaagauuuuaugugaccaaaaucggaucuuauuuuucaagaaauacucaguucuauagaaaguuuggccuucagucagaaugacuucuucauucaaucaguuuuauaauaauuugaaaaugaaaaccagccagcauuuacugaugauaguuuacagaaguuucaccaaaacauuacuucaucacaaacaaagaaacuauucauugccuguuaggcaucaucucaacaucuguccacuauuggcuuguccauuuuuauauuguuuuagaauaugauauaaauaauuuuuuauuauuuucucuuuaguuuaaaauuguacugugccccaaauugguauuggcucagaaaugagaugaauauguuuuaaaguaaguccuuuucauaauauguuuaguauucuuugucaaucuuuuaguuggcuuagagcuugauauuaucuuuaaaaacagaaauuaauacuugucauuagaguaaaacagugcuguagcagagcucacgguuacauugauaaacuauacauacauauauguauuauauauuuaucuuaaguagaaacuaucagugcugguauuguuguaagggagaucugugguuucuauaauaugacuuauaugcauacauacuuuauuaaaagugaacauuuguuacauuuuaaucguuagaguaaaauauuuagugacugaaaaauuccaaaugaagacuaaguaaaauauguuuugguugaauugugaaguuugagaauuugcaaagccauaaugauagaaucaacccaaaggucccagaaauuuucaauaaucuaucauccuuauuuaaaauuauuauacaauaaaaaauuguguuuuaaucgcaugaguagacagauguuuaugcuguuauucagcgaaucuugcaaaagugaguguaauucauagaauaaaacaauguuggaaauaugcuuucuuaaaggcaauaaaaguugaagucuauguaucaaagacaaaggugggaaauuguauugcauuuuauaauauuuuggaaaaauucuguaaacugcuauuacuaagauuauuuuauaagauuuuaccccagauuuucauagguaauaaaugggcaaauaacuuaucguuuucccuagucagaucgcugguguuaaauuaauauaaaguuuuaauauaagggauuuuuauuaauaaaguauuuugguaacacucaacauguacuuuauuugcuuuuggauauguuuuugauucaaauauagaaaagaauaacuaagauacuuugguguuauauauggauauagucaacuuagaaaauuauacacauugaaucuuuuuauugugcuuacucaaaaaugaauugguuucauuucuuugcugauggaauauugaacacgcucucacucugauguacaguuauaguguauacuagguaagaaaagagagucccaggccaauuuaaacaaugauaggguuugcuuuucugaauucugagaagcuaguucaggggaagaaaugaaaccacaguguagagggucgaauggugaaggugaaaaauuaguaucaagccucaguucaacaggaaaauguguguggaaauggaagaaugaagguaauauugguagaugggagaauaguaaacaagccuuucagaguuuaaugaaaaaaaaaaaaaaaacugguuagaacaguuggguaagaaggaaaauaaaucuaaaguuuaguuuuuaacuugaucagaguccuggaucaaacaguggaccucaaaggaacuguucaaagcaguacuccuaguaugguuucugagacuuucugaauuuuaagauucagaaacgugggaggaagucauacuagcuuagcuucaacugcacauuuauauuaugacaguuuuuccuguuauccacauauuuuuuaaauuuagacaugaauauagagaaauuuaguauagccucuacuuauuaaaauguuaguacuuuacuuuuaccaaauaauucccugcauaucaucaaaaauuuauauuuuuagccaauuuaauuuuagagaaccuucauaugagguauugacaccggauagaaaauuaaaggaauuuuaaaauauauauuucuuuccaagaaaaugauuuauacauucauguaauaauuuguauuacccuaaaacauauuuacaucucuaaaguaaaauuaguuucuaagguggauaugagaguuggcuaguuauaacagaaaauuuggauauccuccacauauuuuaauguaacaaaaaaacaaauucuuuugauccaucucauuacagaauguguuccagauauaauuccaaaugcauguagguaaauggaaagaaaaauuggauccuggaguuguacugaucugauggaaauaauauuacgaacuugguuugagugucagcucuuuuuacuagcuuugugcccuuggucaaguuacuugauuuuuguuaacuuacgcuuucuuaucugugaaugaggaaacaccuauguuugggguuuuguaaagauuagagaauguaauuuaugcaugguacacaugccuuuuaugauacagguaaaauauuucacaucuucaucucauuuguuucuggugauguagaggugguaggucaaucuuuuuuucuuuuuuuuccuccaauaaucaguggacucaauugaauuggagaagggguugcuugguggaagagaaaaaacauauggcacugaugaugaugaugaugacaaaguugauuugcaauuuuuuaacagauuaucuuucuauagggccagaagccauauugucucuuccuuccccagauauucuuacauuagaggauuuuuucuaucacaguugcaccccuugauugacauagcaauauccuauaaguagcagcccugcuguuuggaucauguuuuuuuucugucggcaguguaucacaaguauuuuccucaguggccuaaacagacccugaguggaaggcugguaaaagcaaccucgucugcaugcaucacuuugaaugauuucaaagaggaaagaagcagcugugacaauguucacaugaaccacucagaguggccuuaucuuuguagucuaacaauaauaguacacccuggcugcauuccucugcuugagaagagcaaaguugccuaagagccauccauacauuuguauuccuugacaugucuuaaaguuggauguaugauaaagcuaaugacaucuuuacaucccugaguaauuugucuugaaaguaaauguagagaaaugcucuuuauggauuuauugcauguguggucaauauuuauuuuaugcagauauaugaacuaauauguaacagauuguuauuuacaaaagaaauuugaaguuuuauuuauuugacuagcuaaagaaauauaaaaagaaguuuucuacauaugcagaucauuauagaaauaauauucuucucuaaauuuguagauauaggguguuuuguuuuuuguuuuuuuuuuuuuuuugccauuuauagguuacaagcuauguuuagguauuucagagugccccauauaugaguuauuuuaaaaagugacaauauuacaggugacaagacuaauauaaguagaauauaguugaguuacagaauauguuguaauagucuuuacaaugcacauccaaugaacaucauauagacagauauuaauaucaauauaucuacacauaauugauauauaguauauauuauaauaaauauaagauaugauaauauaacagauaauauaauagaaaucauagauaucuguauaucaauagauacagacuauaagucaauggcgggauacugcacauugcauuaaaucuccacuaguucuuuguugaacauucaugaaucuaaaaauguaaaaauuaaguccccugagggaguaacuaugucuuugcaugccuucuauuuuaauaucucaguauagcucccccaacacuucccauuaugugcuuuuauacaaagcaaccaguaauaaugcugaaugaauaaaagugaacauagcauauaauguauuccauauguauaaaacaauauucacaugaaugaaauugauccaucaguguguucaacuaugagucuguguuucugaguaccuguaaacaaaaagaagcguugaaaccuuuuagggaguuaugagaaauaauagaguaaaaugauaaauacauuuuuacugaauaaauauaccugaaugaguuauuccaguuuuuucaugaauuuaggcaaauguacagucucucgauugauaauaaaauuugucauuuucucaguuaaauugauacagauucuuguagagcaaaaagaccuaaagauaagauuugggauagauuuauaccuuaacccagguaauaaauagauuauucggguacuuuaauaguaacaaaggaaucaaauggaauuuuaauugaaaugauuuuacuaauauggucauuagcauuaaguaaaugagauacauuugccauuucagcuguauuuguuaacauuagauuuucauacaaauacaagagauguuauuuuaacugcucauucuuauggauuuuacugcuuucacuaaagagaaacaaaauauuuuaucuccucauugcaauuuaggcuuagggaguaacaacuaagcauauacauuguugaacacugcuggcaugugcuuugugaauauguuugaaucaagggccuuuacaaagggcucagaccuuccuccuaggggguugucauuuaccguggaugcucucguuuguugugguaaacagccucagaaaacgucuugacauugucaauuccaacagauuaaugaaguaacugggccauacaucccuuccccuuuacauaugaaaggaaaagcuaacuacuucauagagcuguaagauuguuuccuuuuaccccuugguauuaguuuccuuuguagucaguuaaguaugguucuuuuaaguaagccagaccagaauucuuuuaaguaagccagcuugggcgggggaacuccagugugauuauaagugaguauauaggaaaaaaagaaaugaaauuaaccuuuuuuucuuuagaaaucuuguguuuaauuuuauguuccaguguuuuaaauaacugaaaccuuauuauggacaaauuuaccuguuauguuaggagaaaugaguuucauuuaccaucuucaucagcgauccccaaccuuuuuggcaccagggaccgguuucauggaagacaauuuuuccauggacccagguggagggauaguuucaggaugauucaagugcauuacauuuaucgugcacuuuauuucuauuauuauuauauuguaauaucuaaugaaauaguuauacaacucaucauaaugcagaauuagugggaguccugaacucguuuuccugcaacuagauguucccaucuggguauaaagggauacagugacagaucaucaccauuggauucucauaaggagcgugcaacuuagaucccucacaugcgcacuucacaauaggguuugugcuccuaugagaaucuaaugcuguggcugaucugacaggaggcagagcucaggugauaaagugagugaugggaagaugggaagcggcuauaaauagagaugaagcuucacucccuugcucacugcucaccgcucaccuccugcuguguggcccaguucauaucaggccgguuuccuaucagguaauggucuguggcccagggguuggggaccccuuaucuacauccacguuuucuauguuugugaagauuugaugugggguuauggguuugaggagcuaaaaauuauaguuaguagaaggaaagacagcuagaaguggaaaguaaaaucacuuacauuguacuuuuacuaggaccuauauuguagguauuauaaaucauacaaacaaguuuguuauacaaaacaugauuaccuuaucauuguuuuauuaaguauuuaauugugcaugaguaaucauugccauuauugauuuguccauauuaaacuuaugaucagacuuaguggacaaauuuucaacaaauaauagaagcagcagcauaaauaucuauauagaauuagccagguucuagucuggcacaucaucacauaguagcacauuuaaugcccccaauuauucuaugauauagauacuacuaguuuccccauuuuccuaaugagaaaagugagucauagucagguggagauaauucaccccacgucuuaaggccaaauggaaaaaaucuucuuacucuggaauuaggugguuaaguaucuugauuuuaauggauguuguuguuuuccuaauaauugaguuauuuguauuaaaaugcuaaacuggcaauauaugccgauggccaauuuaccuccaaauauauugaguucauacauauucauuaagugggauauuuuggagaauauacugcuuauauguucaaaugcaaauaauuuaauucgcugugauuuauaauacuguuacucaguaaauggacuaaaggcaggguaagauuuaucagucuuaaaaauguaacuaugagaucauuauaauccuauuaucuucuaauuauccuuuuaaaucaaaaacauacuuucauguugguaugaguaucauaaccaaaagagaagagaaacuucaaagagaaaacugaauuaguggagaguaacuuaauuucagaagaaaaucguacuuucauauaaauucauagugaaagguaacuaugugauaccagcauucagggaacaaaugcccuuacguuuuugccuguguguuuguggggagggagguuguuucauuuuguuuuuauuucuugccuguuuaaauuucuuuuacucacaggcuccagccuggaucucugggagggagaaguaguuccaaagauuacagugcuuaaucuuaacucugaaaacacuacuuauugacucuccacuggauuccacucgcccaaauucccuagauggauuuucccucaggaugaaacaaccuaaauucaaguguccuaaacugucuuccucucccuccugccauugccuuuccuuguuucucuagucuaauccaucuuaucuuuuguucuuuucuguuaaucuauuaaucaggucucugacauucuaaaagcucucaugccccuucgcaauauuuccuccuuuacgcauugcuagcaccagcacuuccacuacuccaggaauuaacaccucuuucucucuuuccucaauggcuaagagaucuggagucaucaugucuggguucauauuccacuuucccaauuuacugacuucgugaccuuaccaagucaguuaacuucauuaaauuuucauuucuucauuuucaaaacauuuucaucacguuucccacacaggcuuguaaggaggacacaauuaugucaugaauauaaaguucuuagcggggaguuuggcacauagaucacagauuagccguucuuauuauugcucccucgguagagucccacugugaagucauuauuucucacauaacucacuaauucaggaacucuuuaaucaaaccuauuaugucuaaggaccugaguaaacaguuacuguucucaaggaacucacugucuagaagaagaagaggcugaccagcaaagccauaauuacaauaaaccuaugcuauuuguacugaacaauaauacauaugcacuuaauuguagucaucccccugacuauacucacaaaacuuaacaugucuuuaggggaggaggauggauugcagauaugcuauuagaggcauagccaucuuuacuucauuaaaaguuuaguuuacuaaaauuugcaaauguuuaaaauauggucuugcuuaauuucacaaauucugggauaaauauuuaaggauuuaauauuuauuaaauuuuuuauuuauuuauuauuuauuuuauuuauuuauuuuauuauuuuuauuuuauuuuauuuauauuuuuauuauuauuuauuuuauuuauuuauuauuuauaaauauuuauuaaauauuuauuaaaugagugcacugauguguauuguuucaaauacauuuuauuaaauuuagugucaaauugcuagcuacuguauggcuaaauauuacauuuuuccccaguggggcaaaguucaauucaauuagcugcaaugaauauguauuagaucucaauucucuccugugauaaguguuggagggaauucagaaauaauaaaaauauaucucuguucuuugggauuucagucuauuauuaacuaagcaucuggagcaguuacaccuaugaaacaguuugguauggcaugacagugaaagcaguaacaagguacaaggggaauaaaaagaaugagauccaucaaauuguuaauccggaaggcacagggagugagauggcaugugacagucaaugguuagugaugggguagaggcccauaugcucaugagagauuugagaaauauaaagucauugucuuuguuuaaaaggauggugugcaggugguaaauacugagaggugaucugacaaguguucauucaaacucugcaaccuugauugagacugugcuagaugauauaaaaauacauaugcccuaacagggaggauaggcaaccaaacaauuaauuuuaaaauugugaauuuacaaacuguggguuauuauaugcuacagaagccacacagagaaagaguuauuugcucuguuucagaaaauagaauagaggagaugugggaaggcaagauaguccuuauagaaaaguggucguuuuauuaccugcaaccguucugacccgcuugucauucuaugucuuccuacgucagucaugagcucuauuuguucucaugugcaaaucccagccucacuaggaugcacuccaguuauccauuaagcacggagauucccaugagcaaugggacaaaaugacuauuggacuucuaucucaacugcuuguguagaauguugccuuguuuauuuuaagucccagauucuauuauuuucccuacuaaccauggguagacucuggaucagacuucucauugaaagaccuuugaaauuugcuuauacucaauugccauuucaguccccucucucacuagauguucuugacugcuguaccacucuucagauucaugaugugcugauaauacaauguuuccuugcauuguuauuuuguuauauuuacccuuauauuaucaugguuuuugauuaaaagcguauguguguguuuacacauaaacauuuuuuuuuccuuucucaacuuuuuagggauaugcagacuauauauuucuuuucaagagggcaagacuguaaauagauugagggcaagcaucauguucuguccaguguaagagaacauucugagaaccuagccggacaucagguauacauugaaagauauuaguugaaauuauagguagagcugucaugaugacaugaguagguaauauuuugagaaguuuggugguaugauauuagaagagaaaugauucuucucuucugaugcagggaaaaagauucccaaaaucugcaagcgaagaauuggguagaggaauuauucaguuuaggaucuggucuagagauauacagauuuacauuuacuguuuggccuuuuuuacaugguugaauaccauaugaauuuuaaauauuaguaaaauauccaaaauuacuuuugauagaggaaaauguauugcacuauauauucuucuuugaauagagaacuuugucaaguaagagaauaaaaaauacaggaugauuucuauuaaacauacaguauucaaaagcuaugugagggaauccagcuagugugauuaugucaaaagggaagauagcuggucugaagguaaugaguuaucucaacugauuggucauggccaauuacagacagaacuccuuauuuuacuuccccaccccccgacuacugcacuugacuagucaaaaaauaaaacaaacaccaaaaccaaacuaaagggaagacagucuuuuccuagcuuggcauuaguuggaugguuuauauaaaugugaaacuuuuagaacucauuugaaaaaaaaaauuuaguaaagcaaaaagaaguuuuucaaauaguuaaaaaauuuaaaagacugaaauuaucaaaucauuuuucacaacaauaaaaauuguauacaaggcaaacuauguacauauauguggguguccuuaggaauaaaugcauaauuucaaagacauggaauuuguaaguguuagucauguucucaccuguaauaaagcaauguguuaaugaaauugggugcuuauauauauuuauauauaauuucuuaguuugagagaagcaaauagaagugaauauauguagccacuuuuuaauauuuguauucagcuauaauuccuccugauuugcuccucguuuuagagugauguacugggaauggaauccuaaaauuaaacuuauuuuagauuaaaucauaccauguuaguuuaauuuuuuuuauuuuuucaauucuauaucaauauagcuuuuuuuuaauuuauauauauauuuuuuugagaaagaaucuugcuguauugccagccuggagugcagugguaugaucucggcucacuaaaaccuccgccuccuggguucaagcgauuccccugccucagccucccaaguagcugggacaacaggcgcaugccaccacuccuggcuaauuuuuuguauuuuaguagagacgggguuucacuauguuggccaggaugggcucgaucuccugaccucaugauccguccaccuuggccucucaaaguacugggauugcaggugugagccaccgugccuggccuguagcuuauuuuuuaaaacuagauuugauuuuggaauugcaacgauuauggauuauuauauucacuacuuauuaucucaucacuguuuaguuugcagaaaggcuuacuuaauauuucauuuauauguuccccuauugauaguuccuggaaaacuuuuaaugcuggccauuaauuuaacauauauuugcuuagagucuacugugcauuacaaucauucuagauuucaaggaugcaaaagugagcagaaacaguuguccguuguugauggacugauggagguucuugaaacuugcuuauuuuuugcuuacuuuuguggauguuccuauuccuucucucucucucucucucuuucucucuucucuccaccccaugugugcccucacucuagcuuccccucuuucauccucccucuugcuacaaauuaaauguaguuuuuuucaaauaccuuuucuuggacuuuuuucucucuauagugauucuuguaguaaucuuauagcaucaucugucacauuuauguugaucucuuuuuacuucugucucuucuucagcaucacaaucuguuuaugugcuggaccuagaaauuuagccccccgugaauuucaacuucacccugucuauuaagaaagccaguuauuaauaacguauuuuaauaaauuaugauaagcauaugauaaggagaaagaauaggggacuuucagaauauauuagaagggaacccaaacuagacuguggaucaccagaggagucacuaaaggagucucgguggaagugauauuuaaacugcgauacgaaggaucgcuugaauuaacuaggccaucuucaguggucaggagucaguuuucugagcagaaagaguaguaugcauaaaugccaugagcuggaaacgcauacaacucuguauaacugaaggaagugagguuuuuucagcuggugcauggagugcugaaaggaaacugagaagagacccuggaaggucagcuugggugugagagugaagagcacccaaaguaagacuaaaaguuugguaguucucauaccaaaaugagaagccaucaagaguuuuuaucaaauuauugacuuuaucuuauuuguguuucauaaaaagcuuucuggcuacaugaaaagaaaacaguuagagguugggggcauugcggauuuagaaauugagcauggagaacuuggggcccuggacuaacaguugauaguagaguuggagguacaugcauugaguggagauguguugaagaugugguccugguauuucuugaugacgaauugaauguagauguggaagaugauggaagaaccaaggaagauggcuuaguuucugccuugagcaacuaaguggaugaugaguuagggaauaccggaugaggagucauaacaagaagacaauaaauuaguucaggaccuuguuaaaugugaggucacucugagauaccaguggaaauauccagcaggcagauggauaugugaacuggagcacaacagagaagucuagauuaaaauuugcauuuggaguguaguauccaugaaaguagccacgagcuuggauauguuguccaaaagaauguggacucucuucucaucauucaagcugaaaaccucaacuuuauuccuugacuccucuuucucuuuuuuucuugcuuccuauauguaaauaaauggugaagucuuaucaguuuugcucucuauugucuuuccuauucauaccaccauuucuguuuccaauagucuaauuagguucuuguuauuucugacgagagagcuauuauauacuugaggauagcaagacugguugccaggagauucauagacuauugcaguaagcuggagaguuaugacugcuguuuaaacaagaucauuagcuguaggaaaagaggaaaguauauuuaagaaauaaaguauaugauaaaguaauagaaaaugaauauuugacuaaaacuaguaugggaaacagaaacgccuugaauauaacuaaauuagaauuauccuccuuuauagauuuaacuuuuauuuuaaguucagagcuaaauguacagguucguuauauaggucaggaguucccaaccccggggccacugaccaguacgggucuguggucuguuaggaaccgggacgcacagcaggaggugagcggcaggcuaacgagcauuaccaccugagcucugccuucugucagaucagccccugcuuuggauucucgugggagcgugaacccuauugugaagugagcaugugagagaucuagauugcgugcccuuaugagaccugccccacccugcucuguggaacaauugucuuccacaaaacuggucccuggugccaaaaagguuggggacugcugauauagguaaacuucugucaugggguuuguuguacagauuauuucaucacccagguauuaauuaaggcuaguacccauuaguuauuuuuccugaugcucucccuccucccauccucugcccucuaauagaccccaguauguguuguucccuucuauguguuuauauguucuccucauuuagcucccacuuauuaguaagaacauggaauauuugguuuucuguucccagguuaguuggguaaggaaauggucuccagcuccauccauguuccugcaaaggacaugaucuuguucuuuuaauggcugcguaguauuccaugguguguauguacuauauauauauuuuuaaucuggucuaccauugauggguauuuggguugauuccacgucuuugccauugugaauaguguugcaaugaacauaacaugugcaucuuuacaauagaaugaugcauauuccuuuggguauauacccaguaaugggauugcuggguugaaugguauuucuguuuuaggucuuggaagaauugccacacugucuuucacaaugguugaacuaauuuacagucccaccuacgguguacacauguuauuuuuucucugaaagcuugccagcaucuguuauuuuuuugacuuuuuaguaauagccauucugcuuguaugagaugguaucucauugugguuuugacuugcauuucucuaaugaucagugauauugagcuuuuugucauaugcuuguuggccauauguaugucuuuuuuuugaaaagugucuguucauguccuuugcccacuuuuuaaugguauuuguuauuuuuauguguaaauguguuuaaguuccuuguagaugcuggauauuagaccuuugucagaugcauaguuugcaaauuuuuuuugcauucuguaggauguuuguucacucuguugauaguuucuuuugccauacagaagcuuuucuuuaguuuaguuagaauauaaauaaaccagaaguuucccuuuuaauuuuagcaucgcaaauaugcaucaaauguuaucaauuuauuuuaccacauugcuccacaaagucucauccaccaauuauaauucuuccagguaaaauuuacuggaagcaauuauugguagagcuggaaauagcauuugccagacauuuuucuacacacuguacauauauuaaaucauuuaauauuuauaaacauucuaugaaacaucacauuuuacaggugaggaaaugaagaacacaaagguuauagaggguauuuuucaaggucauacaauuuguaacugucagcaauagacuugaacccaaguauucugguuccagaaucuacacacuaauccaggaaaguaaaggacugcguauguuuuaagcaccuauuaacgugccaagaacuguggaauauaugaaaaauacauaggagucaauauguaaauacacauaguuuaaauagcagguugggggaaaaaauaacauacucuguaacuaguuuuuucaaccguauaucauagaaaguuaaguuauucaguuguucaaagucagucaguuuccaugagagaugguuaaaaugaaaaaccuuccuuauaggugaaauuuagggugaccauugccauuuuuaaucagauauccccaaaauucaccuuuccuugacuagcauuuaagaaaguacugcaaaauaguauaugcaaacauuggcuuugguaacuuuugccaacuaacuuaccauaguuuuaaucagggaaaauggugaguucauguguggaaguucuacucugacucagguagguagagauuaugaacaaaaagggaaaaggcaauuuccuaccugaugguguggaacucucuaaaucugccaguccaguuuuuuucccccuuccguuuaagguuuuauaagacuuucuaaauaggcaauuuaguauuuguuacuaguuuggaaauuauuuuucuggagccauaugaaguacuaaguauuuauagacaaaaauguuggcaaagaauauagagguucuugaaauggccuuucacuguggcagaagaacuugaauacauucaagugcaaauccagauuuguagagaguacuguggguuuauggaaauaaagcauuugauugaaaaagucauuuuuuccaguaugacuuagugauuauuaaauaaccauguuuuuaaucugacucacuggagggaagcuccauagcauuagugguaaacaguuuaugcaguuagaauaugaaaaagacaaagaaaagcaaacuaaaaagacauuuuagaguagagugggaauugagccaaugugccugacugguaaagucuuuggagggaagccaggaagucugugauauuucucuaguuaggauauauauauauauguauguauauauuauauauauguauauauauauauauauaaaaaucauauuggauaaaaaauguuaacccuuucuaucaaauuucagacuuuccugauucugaaacucaaaacugaaugcaaauuaagauuuuuaaaaaguaugauuaaaaaaaauaccgcauacacacaugacaucuggcaaugccuuagaucucucuaaaaugucaagaugggaaaauauccaaaacuuuuuuuuuuugagagagagagagagaaagagaaaguuggcuucuagccauaagccugccgaggaauucuuacgagaauuucuggaaacuguacuuuuuaaggcaaucauguucuccaugcuuucguggccucagauguuacuugaaggaauuuaaaguuucaucuauuugugcuuuguugcuguacacccuuuagacuucaguggucaaguuucacuuuggagaacugacaaaagaaaaauauuguguuuggcacuacacaaucuuagaauacuuuaagaaugaauaugccaagggagagucauauuauauagcuugaauuguauuuuucaugcaugauauguacaucaccuuaugucacacaaaucucuaucagccuuuugcuuuuccauuaaaauaaauacccaucagauacuugauauagauauucugugguuggagggcuuaagugagaugcaguuucagguaaauaacauaaaaucagcagaccucuaaucugaauugaauguguuaaaucuuaucaaccuagaguuuuaaggaagagggaacaacugucuucagugaguaauggcgcgugcauuaauaccaguuacucaggaggcugaggcaggagaaucacuuuaacccaggagauggagguugcagugagcugagauugccucauugcacuccauccugccugggugauacagugagacuccaucucacaaaacaagcaaacaaauaaauaaaaaaacaaaagaaauggccaagaagaaaaaugccuagcuuuccugcaacaauuugggagauuaccaucaucuguauuaauucauucauucuguuguuuaaugaaaauggcuaaagucuggccuugccauugagguuuuuaaaaauucugguaaaauaugcauaacauauaauuugccauuuuaauauuuuuaaguguauuauucugagucauugaauaauuucaaauugcucugcaacuguagccgucaucuaucuccagaauguuuuuguuucccaaacugaaacucucuacccauuaaacacuaacuuuccauuuccuccaaucggcaagcuccaggccaccacuguucugcuuucuguucccaugaaguugacuacuuuugcuaacugauauaaauggaaucauacauauuuguuuuucugugucuggcuuauuuuacuuagcauaauguccuccagguagauccaaguuguaguaaaugucagaauuuccuuuuuuuuuaaagaccgaauaguauuccauuguauguauauacuacauuuuguuuaucaaaaauggacacuuggguuccuuucuccuuuuuccauugggcguauuggguuuuaauauuacacguuuguuauaaaggcagauauagggugauagaauucauacuagauuuggaaauaaucaaacuaggcuuuguucugccacaacuagguaaaaauguuacuucuuucugacuuuuuguaaaaucaggauggaaauauauuucauaucauuguuauagcuaauagcuauuaagcacuuguauguuucauacuguguuaagggcuuuuauauauuucucauuguauuccgacaggaacccuacaaaguagagacaguuccaaauuuccagaaugaaugugagauugugauacauaugacaaacugcuuauuaaacuguacagcaccuaacaacaugagggauuaugccuaauucccuacacagugcauggcauacacaaggacucaugagaugcuguugaagaauaaaagcagcucuacuuuacagccauaggaagcacauacauauucagccauuugaaaacagugugucuugaugaaagaggauugcaguuggauuaauaugaacagucacuaaaaaauaaaugaaaaccaaaccucuaaaucacguauacagacaauauucgcaauauugauaauauucaaauuguguaagguaaaccugauuacucagcagaauuaaaguuucacuggugauauggggugcaggcagugucaucucucugacaaaauuuuucaaauuuucaaaauuuucaaaguuugaaaauuucaaauugacaaaaauuuucaaaaaauuucaaaauuuuauagaaaucaucacaguucucuuuauuaaucagaguuuaaauguuaggccagccuggguggcucacgccuguaaucccagcacuuugggaggccaaggcaggcgggucaccugaggucaggaguucgaaaccagccuggccaacguggugaaaccucgucucuacuaaaacuacaaaaaaauuagccaggccugguggugcaugccuguaaucccagcuacuugggagacugaggcaggcaaaucgcuuaaaucugggaggcagagguugcagugagcugagaucgcgccauugcacuucagccugggcaaugagagcuaaacuccaucucaaaaaaaaaaaaaaaaaagaagaaguuuaaaugucuacugauaggcauuauuuuauaggguuauuuuauagggacuuaaaaauuucuacauaucaaauaucuaacauaaauauuggaucacauggauauauauuaauucugcaaauaauuauacaaauaauauuaaauauacaaauaauuaguuauacaaauaauauuauacuguguaugccuuuuuauagaauuucuuccaaaaagcaacaguggauaaguuggagagagccaugaaauuccccaggagaguggcugugaaggguggccagggauugagacauaggguaucuuccuagagucuauccaugagaaacugacaugauuucaugccaucugcuauaagugcuauaaguaauaauauagaaauaguugaccucacaguuaauuuauuaagcaaauaguggagaagaugcuaguaauuucuagaccuugccucaggggcugugaauauaggaggggauaagauaaaaaguggcucuuucauuggaguaucaauuguggggagagauugaauauccucaauaauaucuuaauuaauauauaaauauauauaagaaauauauaaauugaauaauuacagauagaguuuuuugugaauaaaacugaacaaagugauguaauggagaaugauagcaguauauggggcauauucuuuagauggggucauuuagggaaugucuuccugugacgggggcaucauaaacaacaauuguucaacugcucuauuccaucagggugggaaucacauacucauuguuggcuagcgugucugcagugccuaggacagaaccuggcacuugauaggcauuuacugaauauuuuuugaauaaaagaagaacgaaauggaugacaguaaauaagucuuuuaaaaacguugaaucaaggcugggcauaguggcucauaccuguaaucccaacacuuuggaaggcagaggugggaggguugcaugugcuuaggaguucaaaaccauccugagcaauguagugagaccucgucuccaccaaaaaaaagaaaaaagaaaaaaggaaaauuauccagcuguggugguacacaccugcaguuccagcuaaucaggaggcugaggugggaggaucgcuugaacccagaagauucagaaugcaaugaguuaugcuuaugccacugcccuccagccuggauggcauagagugagacccuguuucaaaaaaaaaaaaaaaagauggaucaacaaaagugauaucaauaguaaugacacuaauaacaaaaaaaauagugaaaucaugacuugcaaguauaaaucacuuuaaaagauuauuuuaauagaaaacauguuaaucuuuagaacuaccugagguagugugauaggaacuauuaacuacauuugaugaauuugagguacuuagaacauauuacuggugaauggggaagcuggcuuaaaaaaaagggagggucuucucagacaguucucuuuuuacauacguggcacaaugauucaugauuuguuauauugugaauguugaauguggaauauuuauaggaaugcaaaucacauuuccuuuacacaauaguauuaaacugauuucaaaguguuuugauauaugcuucuauccuuacaaugguccagugagaaagaaaauaugauauucaucauuguagacauggaaauaaaaguuaagaaaaguugucuugaucaauaucauaugcaauagcaaguggaaaacccauguuuuuaauuuagaauuuaauacuaacagucuaugcucucauggauguuuuauguaguuuaauguuuuuaaaaaacucuaagcccgacaacuucgcuguuuaaaauauuugaaauaaaaauagcuuugccauuuuuuaaauaaaacauuaccuuuuauuauaacaaaauucagaaaauacacaaaauaacaaaacaggaaugaccaccaguuaucauuuaaugugaaucauugaacuccuuucuuucuauaaaauuacaaaguugaaauauguuuuaaaauuuguguaaaaguuagaggaugauuugauuuaaaucuauuauuuaaauuuauuuuuagucaaguaauaauaauucagugaauuguucaaaucagaauugccaugaugcagguuucacauacaugaaacaaguuaauaugaggaauauucuuuccuauacuuuccuuuuuauguuguuuuuaucuuaauuacucuaacagagacaaauuucaucuaaagaggugauaucuaaaggaaauguagagaucagaauauaggacagauuguuuuaaaaaguuugauauuuauuauuaggugccuaauaaaugcuccuucuaguuuaugaagcuuuauuucuaaaacuauaaucuauguuuauguguguuuauugaauauuuguguuccguugguaacaaaugaaauuuaaguguacuauuaaguaaugcuaauacuaauaucaguucuauuuugacaaacacugugcuggccacuauuccaugugccucacacacuuuuaucucauuuaaauuucauaaaaacccuaugacugagguacuuuucuuaucuagagauuacuugauugaagaaacaggggcacagggaggcaaaacaauuuuccagggucauacaggugaacaugaaaaagccaaaaguaacacccaucaauagggcuacggcauucaugccuuccuuuaaaaauuaauugagggcaagaaaccauuguuuaauauguaauuucaaacaucuagaugaagaaaauaucuguauuagaaaauaauaaggacuauguauauaugauuucagacgauuuccuauuuaaauaaauuaggauaaaugacauauuuguuauagggugaaauguuagggaaaaucucaguuuuagucacagaucucuacuaaccuugaaaucagauauaccaauuuaacucuuuggcuugggauuuuuuuauucaaaggcaucagaugaaaugagcucaacagucugccgguucuaaaguucuuugucaccuucuguguuaucacgugguggucugugaaucuuacagagauugauggcuucagucuucuccaaauauuucuccuacaucccucguuguaaaaggaaacugaguguaaggaaagaauguaaauccguaaucacauuuggauaucuuugaaguugcaacacuccagaaauuuggugacaagcaaaugccccuauuuuuaaaaugaugaagcaucaguguauuaguguaaguugauaagcuuggagauauuccauaagagauuauuauauucuuuggaaaaaacucaggaggagaggugcuaucaauaagaagccaucuuggcuucaacagaaauaaauuauuugaauaggauucacguccuuauucuacagacauuaauugcaaaacgacccuuacuuauuuuuaaagaaauuugaaaaauauaauucacaugccacaaaguuuucccuuuaaaggguacaauguaguugucccacguauauucacagagcuguucagauugucccuuauugaaucauuuugcuuauucaagagcaucuaacccagugaaguaugcagugauaguauugcaucaauauuugcugaauucuccacucaaugaauacaagguacagcaaaagagaccagauaauucuagcuaaacucagaugaaauaauuguaaaauccagaauaauuaaguauucagauauauucagauaaagauuccagaaggauacaaguaaaugauaaaaagagcacauuuauuucuaauauuagcugucauauuaacacauagaaaaaaauguaggcuuguuagcaucaaguaaguugccaaauaugauauugccccuuauauaacuugaauaacuuuagguguuacuuaaauucauaggcacauauuggcaucuucagagcaagaugaauuaacacucuggaguuuuuauuuuauuuauuuaaaaauagauuaucacuugagaaaagacagcaucauaacauuuagugacaaagugugaaauuuuccuacaggucuuagugauuuagcaaccacaaaaccaaagaaaggagaguuuaaucauuauuuuagguucccucauggugacucuaaauuguaaguaagaauagcaagaacguuuucacuggcaaccuucuuuaucuuaaaauuuaaugucauaacacguuugguaaagcagcuaaauuauuucuaauguauauguuuggcugaggcaguuaauacaaaguaaaaggcaaaaagucaugaagcuuuuauuuucuaucuuguuucacuugugccuccaaugagcauuggcuuggagugcuuaucgucaugucacugacauucuugcccaggccuuggcaaacuacuuggauacccuggugagagagguuucugggacuuuggccuggaaauaugcauuuugaaaauuauauccagugauucuaauuuguaacuaguuagacaucacugcacuaagaguaaacuuucagcucucuggccuaguucaguaauuuucuuuaucacaaacacgucuuucauaacuugguuccaaaggcauucaugacuuuugaugucauccguaaaugcauuuuaaggaauuaauuucugcuuuuaaccaauuacaagauuuuauuaacaaucuguuuacuguuugacaaguauuagucagcuuuuauuuuaugucauuacugagauuugaagucaccugcacuacguuuaaacaaaaccuauucuuaugauuacaauauauuuaccugacauuaugcaaaacugcauuuuuuuugcauuugggaacaccauuuuauauaugaaguuguugaggcuuauaaaaggucacaaguaacugacuaauagcgucaagacuagaacccauguaguguuggcaucuguuuaggaaccugugucagaucccacacuuguaauggagagcuuaauuucagagaacauuagccauaucuagcuauugcugugaauuuaaauuguuuugagugugcauuuaauuugcaaauuuguauugguuuguuauuuguguaagaauuauacaccuacaaagauuuuaccaaguuuauauuuuuacauuuuaaaguaguguuuuaaaacaaauaaauuaaauugacacuuggugaugcaagauuuuauuuuuccuuuuagaaaaggucuuuacaauauuuaaauuuaaaucaaacaguucucacugaaauaauuagggguaaaauggaccucuguugaugcuauuugaaaaaacuauuugaacaaugagaacacuuggacacagggugggaaacaucacacaccggggccugucgugaccggggccugucguggggugaggggaggggagaggaauagcauuaggagaaauaccuaauguaaaugacgaguuaaugggugcaguaaaccaacauggcauauguauacauauguaacaaaccugcacguugugcacgugaacccuagaucuuaaguauaauuaaaaauaaauaaauaaauaggccuggcgcgguggcucaugccuguaaucccaguacuuugggaggcugagauaggcggaucaccugaggucgggaguucgaaaccagacugaccaacauagagaaacccggucucuacuaaaaauacaaaauuaguggggcgugguggcgcaugccugcaaugggcugaggcaggagaaucacuugaacccaggagguggagguuccggugagccgagaucaugccauugcacuccagccugggcaacaagagugaaacucuaucucaaaaauaaauaaauaaauaacaauaaaauaacaaaauagaagaaauugguuggaugccacgauuaaauauagauuuguuuuugcauuuguaggcagucagagcaaaaugggagcauaguaaauuuucucuuaucauaagggaagaaaaaucuggcuccugaggugguuguuauuuucuuuguguuuuucuucuucuaaauucuaaaagaaagugucaugugggguuucauauaaaugacacagaugucauagaccuuuuuucaauauuuuuauggcaauuacaggcacaaauuaccaacgacuauuuguuauagaacuuuuugaucaaaaacuuacuucauuuuuucucuagaggauuuucaaugaggaaaagaagccuuuacuauuuacuuuuauauuucauauguagcuacaaaguugcuuaaauaaaaugagcauucuuuaucaaaaaaaaacaaaaagcuauucacugaaacuuuggggauacucaucuucauguacaguuuccaacucugauuagaccacagcuccucccuauauuuaugauuugcuugcuuuauaaucaauauuauuucugaaacuagaccccaaacaagucaguuuugguuuugcuaagauuugcuuaaauguaaaccuuuagaaaaucuuauguauauuauuuuaugacucuuaacugaguacauacuugagugguuauucugcuguuacauuuguucugaagaaucaugcacauuuuaauaggcaaguuauuaaugcaaccaaaccuuuaaguuuuggaguuuuauagguaaaauauguuuuucuagaggucuguuucuaaaguuaaaagcuguucuaauaaauaauaaacagauucaaaaaccuuggcaaacucucacaaaccaaaacaaaauuaggacauuuugauugauuuuaauauuacuuuaucuaauaaaaaauaaguuagaugcuauaaaaauauuuuuaaauguggagguaauuuaguucaguuaucacacaaacauucucuccaauauacacuugaguguaaauuauauguuguuauuuacuuuaauaacaguuugcucaagcagaaaaccugaaaaaacuauugcacguaugcccaggguuguauugcauauuaacaccugcaaaauaaggcacaauuaccuuucuauuuagacaauuaaaaacuucgauaacauaagcuuaguuauugccugauaaaaaauaugccaauccugcuccagauuaacagaugucuuauugauucuauguauguaccaaguuagacauauaaaccaauggguuuaggaaugguuagucuucuaaaaucuaaacuguuuguagcaaaaugucauuguaaaagcccaauauaaagaauagcuuuaagaauucauuaaaauguaagguacaugaaagcggaguacgugguugguuuuguucauugcuauauauuuaucaccuauaacagacacauaguaacuccuauagaaauauuuauuggauaaguuaaugaaguauaauuauggaggcauaguuauuuuucagaaaaguaacuauacaucacauaucaaccauuguuuauauaaaaaucagauguaauuucauaugauuuggugagcuaaguauggucaagaagcauguguucuuaucacagauaaucauaaaacuaauuugaaaauuauagaaaaucucaaauuauaucccaaaauggacaauuauuacuuguacuauauuuucucuuaguaagauaauauuuguuuuguuauagaauauuuguugucauuccuacucaucaauguuaguacaauuucucaaauagauguaagcauaacuucuaaauuuaacaaucaaaauauggucuaauaaacuaagaugaauuccauacucaauauuugucuuuguaaccuagaauauuuucucaauugcuacuaugaaaauuaagaauaaaaagaaaauuuuaaauguaggaagugcacugaacugagaagauuauuuuccuaaagggaaauuccacuggcuauggaguaacugggaacucuguccuuuauuguaaaacauuuaugaaaauugcuugacuugcaacuucauugguugccuuggagaguucauucuauaaaaaaaggugcaucacgugaacaagaaauguaucuacacaaugcucaacagaaaacccuugauuaauugaaguauaguaaaugguuauugguccauuccaauuuccuuuaauuugcaguugcuuggaagcauaaagcuuuuuaaugucuuuguuuugacaaagaauucacuuaaaagugagaacaaauuuaauuuauuaauauaauuuaaaaacauguuaaagcaaauuaaaaaauuaacaugcggaacaaucuuuuaaaaaguuuuuuuuuuuuuaaaguaggaaguacacugaacugagaagauuauuuuccuaaagggaaauuccauuggcuauugacuaacugggaacucugucuuuuauuguaacacauuuaugaaaauugcuugacuugcaacuucauugguugccuuggagaguuuauaaaaaaguuauuuauuaaguuagaacuuuaauaaaagacuuuuuauuuuuauuuauuuauuuuuuuugagauggagucuugcucugucacccaggcuggaguacaguugugcaaucucggcucacuguaaccuuggccuccuggcuucaagcaauucuuuugccucagacuacccaguagcugggauuacaggcucaugccaccauguccagcuaauuuuuguauuuuuaguggagacaugguuucaccauguuggccaggcugguauugaacucgugaccucagguaauccacccaccucggccucccaaagugcuuggauuacagguaugagccaccgcgcuuggccagacauugauauuuaacucuuucuuaaucaaauuuugaacuuauuucauaccuuguauauucuaaaaaaaaaaacacacacauauauauguauacauauuucuagcuuauaugcccacguguuuauggaguucacucuuuuguuuuguuuugagauggaguuuugcucuuguugcccaggcuggagugcaguggcgcgaucugggcucaccgcaaccuccaccuccagaguucaagugauucuccugccucagccuccugaguagcugggauuacaggcauaugccaccacauccggcuaauuuuguauuuuuaguagagacaggguuucuccauguuggucaggauggucucgaacucccaacaucaggugauccaccugccucggccucccaaagugcugggauuacaggcgugagccaccgcgccugguguucacucuuagggaauuuaggugaaugcagauaguuaccuacuaaaaagauauaaaucgaaagagauaaacuuuggcuguugggaaaaugguugaaucaaucaagcagcaauauuaaccugcgaaggguaagucacuuuugucaaaauaaaaaggcuauguugagguucuuacagaaaauacuuuuaaaaauagggaccuacacaauguaauguagagguguuuuggcaguuuaagggaaauguaauguaaaaauuugcauaaugcuuuuacauauguaauccauacaauauuaaaaaccgucaauaaaaacauguugaaaguccuuaaucucucuuuaguauuaguuuaacaguuaacagagacuauuaagauuguaauuuauucucuuauuaaaaauuauuaucugauuuacugaaaaaacaaucacagguuuugaauaucuaaaaacaaccacuagaggaaagcaauugauuuccuguaacauuuauuaauguaagcagacugcgagaauucuauuaaucuagacaggagaacuguaauguuucuguugucuucuuuauuaaauuugacaaauuugaaaugcuugcaauucugcacuaacaggauuucauaaauacucuuugcugacacauuuuaauuuuugugcauuuacuggauauucuuaaaaugcaaucauuuauuauauuucagggcaggaaaaccuaauuaguaguaaacgauuauaucaaacauuugcuuuuuuaauaaacuuggcuuuauauuaccuuauuuagauaucaugaauucauauuaguacagacuucugauuaccuauuacagaaacauuccaauuucaauaaaacuaacguuaguagucaaguaguuucucuaagcaacugaaauaaauuugcaagugauggacuaugcauucuuaguauuaacugcagucauauaaggccaucaguaacaugguauuaagagaaaaccaauaaauuuacccaguuagucagucucuugguaugugaguagaagagacaaaaagaaaaaacuaauaauacaguugucacauauuauugaccauuuucugcccuucuauacuuuucuaagcccauaggcugugguuauauugcuaugaucaguuuggguagcuacuugaauuuuugaucuuuaaaugcagguauaccucugagacauuucagauuuaguucuagacaacugcaauaaagugaauaucacaauaaagcaagucauacaguuuuuuugguguuucauugcauauaaaauuauguuuauucuauacuguagucuguuaagugugcaauaacauuacauuuuuaaaaaacaauguauauaccuuaauuuaaaaauacuuuaugcuaauacaugcuaacagcuaccugagccuucagcaaguuguccucuucuugcugguggaggauccuaccuuaauguugauggcugcugacugaucagggugguaauugcugaagguugugguggcuguggcaauuuugugaaauaagacaacaaugaaguuugcggcuuugauugagucugacugucaugaaagauuucucuguagcauucaauacuguuugagagcauuuuacacauaguagaaugucauucaaaacuggagucaauccucucaaacccugccacucuuuuaucagcuaaguugauuuauuauucuaaauauuuuguugucauuucaacgguauuuacagcaucuucaccaggaauagguuccaucucaagaaaccacuuucuuugcuaauccauaagaagcaaaucuucaucuguucuaguuuuaucuugugacuguggaaauucagucacaucuuuuggcucuacuucuaauucuaguuuucuugcuaugucuaccacauccgugguuacuuucaguacugaaguuuugaacccuucaaagucauccuuaaggguuggaaacaauuucuuccaaacuccuguugacguugguauuuuuaccuccucccaugaaucacaaaugucuuuaauggcaucuagaauggugaauucuuuccaaguuuucaauuacuuugcccagauucaucagagaaaucacuaucuauggcagcuauagccuuacaagauguauuucuucgaucauaagacuugaaaguuuagauuacuccuugauccauuggcugcagaauggaugcuguguuaccaggaauguaaacauuaaucucuuugcacaucuuuuucagagcucuuggaugaccagguagauugucaaugaucaguaauauuuugaaaauaaucuuuuuuacugagcaguaauugucaacagcgggcuuaagauauucagcaaaucaugcuguaaacauuugcugucauccaggguuuguuguuucauugguagggagcagguagaguagacauagcauacuucuguggggcuucaggauuuucagaaugguaaaagaucaguggcuucagcuuaaagucaccaacuguacuagucccugacaagaaacucaaccuguccuuugaagcuucaaagccaggcauugauuucuccucuauagcuaugaaugucucauguggcaucuaccaguagaaggcuguucaucuacauugaaaaucuguuuuuuaaugaagccaccuuuaucaauuaucuuugcuagaucuucuggauaucuucuugcagcuuguacaucagcauuugcugcuucaccuugugcuuuuauguuauggagaugccuucuucccuuaaaccuuaugaaccaagcccugcuagcuuccaacuuuucuucuguggcuuccucagcucucucagccuucaaagaauugcagaauuagggucuugcucuguauuaggcuuugcuuuaagggaauguugugguuaguuuucuucgugucagcaauaaggcuguuuuguuuucuuaucuuuuguguguucucuggagcagcacuuuuaauuuccuucaguaucauuuccuuugcauuuacaacuuggcuagcuauuuggcacaagagaccuagcuuuugauuuaccuuggcuuucaacuuaucuacuucacuaagcuuaauuauuuauagcuuuugauuuaaaauaagagaugugcagcuacuccuuucacaugaacacuuagaggccauuggaggguuauuucaauauugugcuucaggucuuguuuccauauuguuguucucaggaauagggaggcccuaggagaaggugagaaauggaagaauggcuggacaguagaggacucugaacacacacaauauuuauccauccaguucacugucuuauaugggugcagcuuguaauucucccaagaaaauaguaaccucaguaaucgcugaucauagaucaccuuaauaaugaaaaaguuugauguauuguaagaauuaccaaaaugugacacagacacaaagggagcacaugcuacuggaaaaauaaugcugauagaaacuugcucaaugcagggaugucacaaacuucuaauuuguaacaauaugcaaauaucugugaagcaugauaaaggcaagugcaaugaaacaugguuuuccaguacgugauauuaaaccauaucaugaaauucuagacucugagauuuacaagggacugacaacucaaucaguucagcuucucauuuccacucuuaagagguaccucuuuaaauaaaaaagccuauuaagaucauuaaaauaaauccauggaaauccuuuuuauuaagcaaaaugugacaaaauuguuggaauaaccagaaugaaaaagucuaucauugucacugcccuaucagacugacauacuucauugagcauaagagggauacuauaaacuguacuaauaugacuuuauuucuuuuuacugcugaauaugauuccauuguaugaauauaucacauuuuguguauucaugcaucagcugauggacauuuggguuguuuucaccuuuugaauauuauaaauaaugcugcucugaacauuuguguacaaguuuuugugcaaacauguuucauuucucuaugguagaauuccuaugacuggaauuacaagucaugugauagcuauauuuaacauauugaggaacugccaaaguauuuuccaaagugguugcaccaucuuauauucucaccaacaacauaugaguguuuugauuuuuguauguacucaccaacacuuguuauuaucuguuguuuuuaauauagccauuuuuaugugugacauauuguauuuuuaauuuucauaucucaaaugacuaaugaauuuaacaucuuuuuauguguuguuuaacuauucuuacauuuucuuuggaggauuguauauucaaauucuuuucccauuuuaaauuggguuauuuauuuuuauuauugaauuguauuaguucuuuauauauuuuggauauaagucccuuucagauauaugacuugcaaauguuuucucccauucugugagguuuucuuucacuuaauaauguccuucaaagcaaaaaagguuuaaauugugaugaagucuaaauuuccagucuucuaucacuugugcuuuuccuuuagacucucuguaauuuuuuacuuagagcaacauguaguguaauuuugguuuaggugacugugcuucuacuagacaguaaaugugaacaccuggguauuuuguauccuaagcaacaagcaaagggccugagcucuaguaagauaucaaugaauguuuguuggauucauuaauggauuuuuugauacuccuuuucaauaaguaaauuuaacacuacucaguaacaaaauaauuuuuacuaaggaaugacaauauuugaucuuugaauaauuaauuuuagaaacacacacauauauauauauacauauauauauauauauauauauauuuuuuuuuuuuuugagauggaguguugcucuugaugcccaggcuggagugcaauggcaugaucuccacucacugcaaccucugcuucccggguucaagcaauucuucugccucagccuccugaguagcuggaacuacaggcucccgccaccacaccuggcuaauuuuuuguauauuuaguagagauggaguuucaccauguuggucaggcuggucucaaauuccugaccucaggugaucuaccugccucggccucccaaagugcugggauuacaggcaugagccacugcgcccugccaauuuuagaaacuucuuggucauccucacacaaaauucagauauugauuccuuaaauuaaauuuuagugugcauauuuaaaagcauguuucaaugauaauauuaaguaguuaauugccuuauuuuaucuuggaaaaagcagaaugagugaugaagugucaucuguuuuauuuuuccaguuuuuuuccauagaacauaccuuuauuugaaaacuaaaaucaaaguaucccuugaugucauaggauacuuugaaauuauagauaaucauaguuauauagucauaaauugaggaagagugagagaguaguagaaaaaaaucaucaaaccguauuauuucauggagaugguuaguuguagucaguauuuauaauugauggcuuuuuccauuacucuggagucuaauuucaaaucuuucauaaguguacagauguuuuaucugauuuugcacauuauuuucuuucuacauuuccauaguaguucagacuucuuaaaagucaauuuuuaaaaaaaauucagcuuuucguccagcuuuuugucauacucuuauuccacuaaaaauguugguacuuugguuuugacaaugaaaaauagaaaacaaauagccuuuuaugcugaaacaucuuauuaaagaaaauuuauuuugugauuuauuucuuuauuuuucauauugaaaaauuuuuccuucuguuaauuaguuuuaacucugaugaucaucaggggauaauucuuaggacuuucauuacucaauguaauuguaauaguugguucaccuccuucuuaauuugcguguguguguaacaauaaaauguacuagugcaaugaacaaacugguuuuuacaucauugaauaaauguacauuaaaugccuucuguacccuaggcguuauauugaaacugaucuaaauguuucacuguuugaaacuuagaaaagaagcaggcuuucugaguuuuguuuuguuuuguuuugauuuuuuugaggcggauucucacucuguugcccaggcuugagugcaguggcaccaucucggcuuacugcaaccuccaccucugggguucaagugauucuccugccucagccuccugaguagcugggauuacaggugcacaccuggcuaauuuuuguauuuuuaguagagacaggguuucaucauguuggccuggcuggucucaaacuccugaccucaaguaauccaccuaccuuggccucccaaagugcugggauuauaggugugagccacugcaccuggcccugaguuuagaaaaauaggaugucuaaauagaauuaaagaacaaugcauuuccaaaaaauugauuuugauaaguugaauuucuuuagaacauauacuuuacaauuuauaucacauaaaauuuuauucauuacuguuuauuagugagcuaaagcuguuucauauaaauuaaauuuguuauuguuuugaaguaaaaauacaacacaagacucuagaaagagacuuuaauuuuauaguuuaagauagcuguuuaaaagauauaaggacauauaacuauuauagaccagugguccccaaacuuuuugguaccagggaccaguuuggugaaagacauuuuuccacauacugggugggagggugguuuugggaugaaaguguuccaccucaggccaucaggcauuagauucucauaaagagcgugcaaccuagauccuucgcaugcaccauucacaauaggguccacccuucuuugagaaucuaaugccgcagcugaucugacaggaggcagagcucaggcaguaacgcucacuugcccgccccucaccugcugcuaugggccggguuccuaacaggccacaaaccaguaccggucugugcccagggguuggagaccccuguuauagacuaauaaccaacugaaauagaauagcauagcuaugagucaaagguuugugucuuuugcaucaaagaauagaaaugucugcaaaggugaagacuacuaugcaaaugugaaaugaggaagagugauuauuuugacauugcagucauuccauaaaagaacuauagccaagucucguguagguucuagaaaaccacuaaagauggcgaccauguuaucaugggggcugcauuguuucuuauuguacuugugccauuauuuuguucuugcaauguucuuuguguuuuuguuuuguuuuuguuuguuuaaauuuucuauucuuaaaaaaacacaaucugaugaacucuccccaaucuaugauucguuccucuuggaucauguauucccaccacuccucuaaucuuuggauuguuggagggggaggaagaacuugauauguauuauuuugaguugccccugacagauagcaguauggcaugguaagugagaauguguagcuauauaggguaggaaaagguauuaauagauucagagaaauaaaacucccaguacaagccauacaacagaucaauauacauuagcuuuuuacucuucuuugugcugcucauguuagaccaguaauuauuuagaacauggaaacaaaguaaaauaaccaguuaaugaauucauuguuuuggcuuuuguaucuguuagcuacugccagaauaauguugcauaauaaagagccacaaaaaucucaaaggccuacaaaaauucacuuuuauccucacacauuucuggauaacugcaguugggcuucucuaggcuagacucaacuaggaagcuuggcuucagucuaaaaaccuuccagcugagauuccucuacucaguaucucuagucuuucugguaguagugggcuagcagaaacauacuguucuagugaccauggcagagguagaaaagaauaaguguauuuuaagccccuucuugugcuauuuuuauagauagcccauuguccaauccaaauauuaugaaagagcccaaaaaaggcaaggagaaaaaucucaccuuuagugggagggacugcaaaguuguuuauggggagggguaacgggaccaauaauucagucuaccguaguuuguaccuuuaauagaaaucaaaccacuucuuuauuuuucaguaguuugaauagaagccuucuuuauuucauaguauccaguacacauuaggcaaaaaaagagaagaaaaaauuuaguggcauuuuuuguuuguuuguuuuauacuaaaauuucccuuugauaugugucuaccacauucagauuaacaucuauugaaaaauauacuacaggacgcauuuguaggguguuuguuuugaagaauaguauaaaaauuuccauaaguuucuuaugcaaccacacauauuuuaacuugauguuuuauucugcauuuacuuuugagcauccuuaagaauuuguuaaaaugcagaaauuaugcaguauugauuucaggaaaaauugaagugguuacacaugguugccuuugccuuaaaauaaauccuuauuugguucuaacuugaacaauauugaaagcacaacaaaacuagcuuuuuauuaugucaccacacauuuagugaguuauggaaagcauuuuguuuuaagaauggaguuaacuauguguuauccacgcuucuagccauucuugucacuccuggcuacucuccaagccugccuguuauucauacauauuucuucuuaguaagaaaugcaucaaaaucccaggaacaugugcugcugacuguuagaagaguuuuaguggugagagauuaauguaauuacuuuuguuugagaaauauaauuggucacaguuauauacauguagcuuauaugagaaguacauucaguuuuaaaacucauuaugauuaauuuuacuuuccuuaaaaaaugaaaccaaagagaaucuaaaauguguaugcuucuuucauuccuaauauuccagaauacuuagauauuuuuaugugaaguaaaugcccagauaucuaaauagauauaauauuauuuaaauuuaagguauaaacuuuuacaugacaaaaugcuuaauagccuauaaucuuaaaaacagaauuauuccaauucccauauuguauguuacuucaucaaauauuaccauuauaucauguuucuuguacuaaaguguuuccugugaaauaacguaauaaaauggccuuuaguaugcaugauaauauuuaaauacgcauuuucuaguaaaauauaaugcuuauucauuuuuuucuucuaguucuaaagaaaaaaaugcaccaaaugcauacacuuacuuuaugauaauuucugaaacuuaaguagaguuugggccugcaacagacuuguguuuucuaguaguuauguuucauucaugcaggugguagugguccuauuaguuuuccuuaauaagucccauauagcucuggccagucuuucauagaaugaguugguaggucuuuccuccaaaguuugauuucucccauuuuuuucacauugcaauuucaaacuuucaguaauaccaucaagaugagacaguaaacuauuauuagaguuaccacaaguuugaacaaaguugauuauacaucgcaaacaaauaaauacuuaaaaccuuguucauagagaucaggccuugcauaccuacauaguccaaacauuacauuccugacauuuagaacauuuaaaugcaaacuguucuuuguuagggcuuucucauaacugaaauaugagucacuugcaaaccauaauagauuuuggcucugcuacaugaugaaguguucuggaugucgugaaacauuucacccagacuuauggcaguagaauucccaguggucacccaaaauagggaaaaaaaugaagaacaaacuuaaaggaaauaugcagacucuggcaccauccuuucguggcaauacagcucuuuauuguuguuaagaaauggaaauauuuagagccuaaacccauaaacuauaguacaauuaggcguugaauuuuuuuuuuguuccuaauuacgaaauuuaacucuauacuugauucucauguuuaaggucaggucauagaguguuucuuuacacaucacccugaugcggucauacugaguugucucccagcacugagcuucucacugcauugugggcaaacucauauuccacacucuacacucaucucaggcaggaaagguggaguuuuccuuuucagggccaaaggaagcaacagcugaggcgugaugguuguacugauauugguguggguuucaauuugguuaguuugcuuucaauuucaacuccucacuugagauuccauacagaaaaguaaaugguaggcuuccagcaucuuguuucacucuggugaauaaaaauuguuuugaauguaagauuagaguuuuuccuugcuuaauuuuaguaguaccuacacagcauaaacugaggcaucauuuagcaaaauguuauugaguugacaucauaaugaccuauuaagggcaauacacauuugaaugagcucaguuauucuuccagguuuacacgugccuuucaugguguuuaguguagcagcuuuugaagcagagaugggcaauguguaggaccuuuuauuccagucuccuaagugggagauauucugaacaaaacauauuaaggauauuuuuucugaaguuuuugaaauuuuaagucaugauucacuuuucaaaagaagacauuuauguggccaacaaacaugaaaaaaagcucaacaucacugauaaucagagagaugcaaaucaaaaccacauggagauaccaucucaugccagucagaauggcaauuauuaaaaagucaggaaacaauagaugcuucugaggcuguggagaaauaagaacacuuuuacacuguuggggguaauguaaguaaguuugaccauuguagaagacaauggcaauuccucaaggaucuagaaucagaaguaccauuugacccagcaaucccauuacuggguauauacccaaaggaauauaaaucauucugcuauaaagacauaugcacauguauguuuacugcagcucuauuuacaauagcaaagaaauggauccaacccaaaugcccaucaaugauagacuagacaaagaaaaugugguacauauacaccauggaauacuaugcagccauaaaaaggaaugagaucauguccuuuucagggaaauggaugaagcuggaagccgucauccucagcaaacuaacacaggaacagaaaaccauauucugcaugcucucacucauaaguggaaguugaacaaugagaacacguggacacagagaagggaacaacacacaccaaggcuuguugggggcagugggaggcaaggggagggaaguuggagguugguucaaucagugcagcaaaccaccauggcacauguauaccuaugcaacaaaccuacacauucugcccauguauccuguuuuucuuuuuuagaagaaauguuuuguuuuaaaagaaaaaaauaguaagucauuauuaugaguaguuacugaauuaucauaaaauaucauuucauaacauaaaaauuauauaugauagcauguucccacacaaaaacuaggaaaucaauagguuugaauugcuuuaaaauaucauuguaauaguggauaacuuugauuaauacaucuuuauaugccaguagaaugccuauguuauuauuacauuugcugaauaugggacuuuaauaaaaauguaaaaaugaccuggauuugcuuaaaaacagaaauauuucuagaggagaauuuacaugcuagacauggauaaguugucagaaugagcaggacacauuauugcucuuggaaucucagaauauagaagucucuaauuuaaguaauauaaaugaucuucaguauccugaagauauuugcaauuaccuauguugguaauauauaaacuuaaaucagagcuacaaaauacuauuauugaaauaaauauuucugacaaaacuguuacuugcuuguauuuaaaagcaaucuugauggcauuaucuuaauaucuuuagagauaacacuugugaacucuaaacauuauuuuuagugcaaaguuugucauaauuuaugugguuuaagugacaauauuacaugagacaauuaauuuuggagugucaguuccacaaauccaaaaagucaauaaaguaaauaauuauuuuugccacuaaacaaaacaaaaaauuaagcacuauuugccuugaugcaucagguguuacuauuuuauaguuuguacaguuucugucuauccugccaacuauuuaaauguaagccauucugaaaauggguauuuauauguugcaucuuuuaagaaaaagaaauagcuuuuuguauacguuuuaauaguaaucacuuucacugauauuuacagagaauuuaacuauaguuucuuuaguuguaauacauaccuauugucuuucugcugaaugucuguuuuccaguggcauugauaagacgaacucucacagauuauuuuaucuuaauauaaauauaaaagaaccuaaaaauaggcaagaagugaauaaaauguuuuuuaaaguagcccaucaaauauuauuuucaucagaaauuauuuucuuguugacauaaaaugcauauuuuuuaugaaagaucauucucucugugcaaagaucagagacauugugucuuaggcacaucauucagcuugcuccacagcccuggcugucuccacuacucuggaaaaaucagugcccucgaguaggaggcuuaacauuguuuuucuuagauaaaucacuugacauuucagugccuuaauuuugacucucuguaaaauaacagaaauggaauggaaauggacuugaugauauuuaacauuccuacaaaaaguauuaguauguugacuugcaaaugaauggauuucugaacuuucaguguacuacaaauccuacggucucccaaaagaaaacaaaagauuguuuuucuucuuuauuugagaaccauuuuauguagauugcaggaagguugugaauuaaaauauguuuagauuuuuucauuccguucauuaagaaacauuugauuuaagcugcagagaggauaugcauuuaagaauauguuuagaauugugguugagguggcaaccaccaugcaauuaucaguuuauuaacaggggaaugaacucauaauggacuuugcuauuuuagucauuuccuuuaacuugaauauaaucuucuacuuucauaauaucaauuuaaauuggggaaauagcauguuuuaucauuagauccacaaauauauaaugguuugauauuagcgauuguuagguaaugauuguuccuuaguuauguaguuguaugcugaaacauuuaaaaaauuaauccccauguauaauaacauucuugauguagagcaaaauaaaaugauagacugcauauuauaaaaaaaagagaaaagcauuauauuauuuuaugcacuauucccacagaaauauuuuuuaguuuuaaaauauccauuugacccuucagcaagcugaauaccagggauuuuauuccuucagcauaaaguaauuugguaacaauauuuaaaggcauauuucuaacuuaaauuuuacuuuuauaaaauuaccaaaagacagaucauuugugaacuaauugguuauuagcuccuuuaaucucagucauguguuugucucuaaauaaaauuauuucauuuaccagaguuuuacugcucagggcucaggugacucagucaagaaagucauucuugugaagcuaccuaaaugguaacaacgguaguggcagugggugauaccuuagcucaaccauuagcugcagcugaaguguuuauuguaagucaagcacagaucuaccaacuacauuucuucuaauuguagcagaugaaaccacacacauuuuuaaaggaccagauaucuaagcacaaaggucaacauuugguaggcaugcagaaaacauggaagugccuuaucuuaacgggaucaugaaucuucaucuuuaaagggcaguuuuuacagauuuucagaauugauaccuuaaguuguucugaacuucaauuacaaaagcuauugccagauuguguuuuguuuuuauucaaaauguagccacucaugaagagaaacuucugaguuugaaaugugauuuguguuuuugcaaaauguuuauuugaaugcaauuuuaccuccagucuaaacaaauguaaagauaaauguaaaacacuaagaggggcaaugcuggcacugaaagcuuaacuauguaguaguauuggguuuguccuuuaauuuuuacaacauaugcuuuuuuaguuuagaaauaauauuguagacuuuuaagaucucagaauuuuaagcuaaaccacuaauaacaacugucuucauuauuuaaagugaucuaaauuguauagaaauaaaaggguuuuaagaauuauaaaaauguaguuauuguuuccugcuuuuuucucuaaacuucuaauguucaauucuuguguuuuauauaacguuuuaaaauaaaucacaccaaaccuuagucuaaagaagguauaguaaugguuggugucagaucugagagugaaccaagcacauguuaggauuuagaaucaucaagauaaauaguaacaccaauggcaacaaggaagcaauuuaaagacaaauuucuggaaucaagaugucaacaguguauuuucccagggaugacugcuucuguuuguaaauauugcuauuaaaguacaucaccuauuuucuacaagggaugcugacuugucuuauuuucuuuuauauauuuuggugacuaauacauacuuguuaugugacagauucuaaaauauucaaugaauaaauguuagauuuagugaccacaucacauguaaauggguucagaaucuugcaauucuugguagauaaaaccauggcacuaaggaucuggauaagugaagaaauggcaggauaacacuuaucuaugcuaaugaguucagaucuucucuccuagauaauuaaaaccgcaggcuacugagauaacuuugccaaaccaugcugaaagcuuuucaguuauaucuaaggaacuguggaguagagaaaagggaaugggcaauuaaggaaaaauaucuagauuuucaagaaauggaauaugaaguuauucacuuuucuuuuuuauucuuuuuugagacagagucucacucugucgcugaggcuggagugcagugaugccaucuuggcucacugcaaccucugcauccuggguucaagcgauucuccugucucagccuccugaguagcugggauuacaggugcacgccaccacgcccaacuaauuuuuguauuuucaguagugaugggguuuugccauguuggccaggcugguauugaacucaggcuuguccugaccucaggugauuccccugccuaggccucccaaagcguugggauuacaggugugaaccaccgcgcccggccauuauucacuuuuagaaugacaagaugacacuaauuuugggaaagaggauagccugauuuauuaaauaaaugaccuauggaauucuuacuaaaaauauaacuuugcauauaucagaauauaaugaugaugaaauggucuagaucuguauauacaacuggucuauauagauucauucaaaaaggugucguuuugaacucaauaauauuuaacuaaauuuacuaucucuacuaaagcaaaaagaaagacuuuuccguauuugaaaugaccaaaaucucacagagcauacgggaucacagacuucuagagcacuauguagugauccccuaguuuaguuuuuuaaaaaauuuugacagagagagauugauuaauaguuaguuaguucuuauguaagugauccagauuccagaugugaaugaaaugcacauuuaugaaaauauauuuguauagcuguagcauauauuuuaaaaacaugauucauuauguuuuuuuaacacacacgcaugagacuguguaaguuuucuuuacugacugauuagcucuguggcacuaggucguuccuuaccacuggacuuucauuaacucaccuauccaaugggagauaaaguucuuaggucauagggcucugcugagguuuuuauauguauauauguguguguagguguguauguaucuacauacacauauaaccuaaaaaaaucagguauguuuauuaguuauuuuauuaaaacuauuaaaauauagaauuggcuugcugaauucauggacccaccaguuacacugagacaucuuuuagguauacucaacuuguuccuagugugugacucuguuuccugaugugccuuugauggucauauuuaauuggugucaaucuagaccuuccuuacgcucaauuugauguucuucccugcacauacacacuuacaugcacacauuuacacacacccacacauacuuacauaaacacacguacauuuuuucacaaagacauuuacaaaaucauacaugcacacgcaugcaugcgagcacacaugcacacacacacaccccuagcaugcacaaggguggcuuguugcuuucccaauaaagucauaagauuacagaugaaagacaauuuagaauuuuuuaaaauucuaugaaucuaaaaguucagaguugaauuaugaugcauucaguuaccuuuuauuuguuauuuuuucuuguuuuaaggacuaugcauauauaugcaaaaaauuuacguguauaaagugaagauauuuaguaauuucugaagaacauucauuacauauauguauguguauguguguguguauauauauauauauauauauauauauauauauauauauaaaauauguauguguguguguauuucaaagcucuucccacaugaaaacucaguguacauucaguaugugccaguugaaccuguaugugggacuggaauucugauuuuuaaaaauaccuuuucucaaagccuuucucuggcucuaagaagcuuccagaucuguccuaacagcuugaaaaccaagaucuugacuuuuuauagaauacuucacucugugccagaaacuguguuaagcauuuucuuuaccuauaucaucaggauuuagucuucacaaaauacucuaggacacauauuauuauacugauuuuaaaaggauggacugaggcuaagagaaauuaagugcccgaguucaucuagcuaauaagugucagacaggaauuugaagucuggucucucuaauucuaaaacccaugauauuuacaacccugcaaggaaguuggaaaugcaucuuccaggcugcaguuguaguuauugugggcauuuccuuaaaggaaauggugucgagaaugguuguugcuagccaaaaucagaagugucagauuucuaacugcugagacuugccugucuucaccauucucuggacucauuugagccauuuguuuuaugauccacucuucuacuaaaagguggaacuagagguauaacaauuauuuaguacuuaauuuuauauauuguuuucuauuuuuauaaauugcucauuuauuugucuagcucuuguauauuucccauucauuccuuuucagauaaugaugacaguccuacuuacugccucuccccuucccacagcuuccauucuuccugggaaaggagaaaucagaauuauuuugcucuccccacuuccuucagauucauccuuaucacucaucacugauggaguuuuuacagcauaauuauaaaagaugacauuuuauccuaugacaaacaugcccugguuauauccuaacuaaauggauggguggguuuuuuaauuaaauggaugacuuaauuuugugauccagcugggaagauuucaguuuuauuagcagcugucuuuccccuuuucuuaccagaacuugagcuauuagcaccuaacucaaaagagaaaauacagaguuugaaguuauuauuuuauacuucacaaauccuuucuucuaaacauuuuuucuuaggugaggaagcaaacaaauaacucuggcuaggaucuuuuaaacaaagcuguuaauauuugcaaccuauauccacaugacaucugaaagaaaugauggcuuagcuuuagucacaaauagagagugcugauacgaguggaaauagaaagaaaagauguauuuuucuucccauuaaagguugagcguggacuuuaaagggggaaauucugagugauucuuaaaacaacaugugaacuuuuuuauuucccccagacauuaguugccaauauguaaacauuucagcaagaaauuuuauaccaccuccucuguuugucaggcagcauuuaaugguugaaugacagacagugcugagccuuggcaguuccauagugaugugcaaaucuggggauuaaaaugacaguuaaucaguggaccuuuucuaguauaaacuccauggccacuauuuaaaaucaguuacuuaucaacaaggcagacgauuuuuauuucgacuuuauguuuucguguaaagauuucacaacuuuucccuagggguaguuucuguuguuuggauguuagaugcaaagguuccaauucauuuuggcagucuugauugcguggauuccugguagucauuuuaauugguaucuugcagacacgugggagucauucacacauuguuuccuuuuucuuuguagguagaaauaacacuucaggauaucaaugacaauccaccaguauuuccaacggacaugcuggaucucacgguagaggagaacauuggagauggcucuaagauuaugcagcugacagccauggaugcugaugagguagcucaagcaugucucugaauuugugaaacuucguagugcagugauuuaucaaauuucuaggauauguugacuacuuuuauuacccaauaauuaagguuaagcaugugugcuccuuuccaaagaacauuaauucuugaaauguaacauaaaaauguuaaaaaagagauuacuaucaagagguaauuuuccucugaucagcaauccacaacucacuugcugcuugcacuuuagguuacuuagccaaauuauuuuuuuucuuuaauaauaaaaauaucuaaagagguaucucuauuuuaugccauuauuauuccccuuugcuaucuuauagcagcuaaggauugguuuuuauuuuauuuguaauuguuaaaagcaaauaauuuaaaacuacagaauuuuaagguuuagauuacuauuuucuauauuuauauauuaaguucagcuauguaauuauuauguuucaaauggcauggaaacaaauacuuugugauuuguauuuuucuuaugaaaaaaacuccauagcuuauuuucucuuuacuggguaaggaguuuaacuaauguucuggaguuuaaggaagagaaguaacuuuccagacaccaguaucuccuuaccucuuuccccuuaagccaagccgaacacagaacagagaauuuaauuuucuuccucucaucuaaacucagaaauaucagaaacuugauuccuggcauaugaaucagugcuuuauaaauguauuucuguaaccuuaaaaauuuaaauaaauaaauaauaaaauaauuuuaacugccaauacagaaagguaaugacuuagucauuuauacauuuugccaaaaucuaacuauuacaaaugaacaaaauaaagcauacacauuuagguaauugcaauuugcuauuagaaaagauacgauguuuuauguuuaguacauucuacucaauuuuacaaugugaaguucacacuuauuucaaauuuagcuagcuuuaaaagaguuaucugacuuaauauuucuauuguugauagauaugugauaucauuagccauaauucaguaaauauuucauuuucuuaaaguuuaucauugauaauauacauuuugauuuaucaauucauaaaauuucauuaacucuuauuugaaaguagcagcaauaacaaaaaacucauguaauuggcauaggacaauugacaucaaauaauugaaauuguaaugacuauuucauugguuauacucuaagaauagagcaaauaaaacucauuuauuugaagugauuuauucuaaucacuuuaaaagaaugaaguaauaaucauguuaauuauaauagauauucuaaugggauggcuauuuacuccauggaauauuauaauuagagugggauuauuuaauaggaauuacaggaaucacagguagaauugcauuuggaaauuuaguuguuuuaaucaucauacugcucucuuaagaaaugguuauuucagagauuccaacacucaccccuuuuaauacuguucucuugauacuguuauaauuuuauuuccuucccaauauuuucucuuuaagaauauuucauguaaguauuaguauaaaugcaaugcugccagcauucuuauuuuucuccaucugacuuccguguguguguuuguguaugugugcacacacuugcauugccuccaaguucaucuuuuaagcuauguuuaccuuuaugaugagacuagaggaagccuaggaagguccuuauacaucuagguauuuagaccaacacugguuuuugugaauuuuuauuuuauuucuacugagcuuuguuuuuuaaguuuaaaaaaaaauguaaguaaccuugcagauguuaucacuuagacaugcuaguuaagaaaaauacagaauguaaagugaugauagcuaggauauauaagaaguacuuuugagaugagacagagucggguauuagggccagaaaaguauaaggcuauaauguuggaaugaacaagagaauuggagggaaggcuguuagcaauucaaggguagagagggaugcugacaauauguaugaggugugacugugccugaaggcauaaaaaucaccacauucuuauaacucgauuuguuugugugcgaguguagaaaggcagagaggauggaagggaguaacuaggugcaccuacaacauuaaaggaaaggggggcauuucaggaaaacuacaaccauuguuuuuuaaagaaaaagcucacaaaguuguuugucuucuuaaaugcauuuuucucuuaaacaauuuaauaacguuuuaauaacugcugacugacuauaacucuugacacgaggaacucacaugucuuugguuucauauuaaguagaauggcugccuauggcauuuagaauuuugggcuguuuucuuuuuguuguuguuuuuaguugcuuauaauaaauauuaaugcuuuuagauaaaccuuuguuuuauuuucuacuuuauucucagcuccuuaccucuuagccaaauuuuggggaaaauauuuuaaaaauuuucucucuuuucaaauccuggcucuguuuucuuucuucaucuaguuugaguaagacucgagauuauguaggucaucagccaauuguguagauuuuuaaaaauuauuuauauacuuuucauuaauuacuuuaccuaacauauaaguguuaguaugcuauaggaacucuuguagggcacuguagaacaaagccuggguaaaggaauuacaauuuuauaaaacaacauguacauguugaacuuaauuuagauaucauuugaaauguguuggaucaagauuuacauguuucagaagcacaugauuccguuugucucuuguucccuuuuauaaauuaugcuaguaaugggcuaggauacucaaacuuugcuucgugguaccauacauguuuuugaaaauacuauuuaagguucuaauaugcauuugaaauuuauagcuauuuacuuuuagaauuccuucuaugugcuuuugucucugugguucauccggagagcagaauauuuuuaaccagcauuauuuccacugcagugaagcugaaacaugauauuuguuucuuguuuuguugcugauauggcauauuuugaauauuuaguaaauagacuuuucaaaagaccuaauuaaaucauuacucuuggccagauauuuucagacauucacuaauauuaugaauucaccacaucagcugauuuugaauaugaaaaagauuguuuuuuaucaacacagccugauauguuuaccucuuuucagaaaaauuauuacaacuuuaggaauauuauuauuuauuacagcccauuuguagacagggcauuucuaaauaucaaaccauuuuuguaauagcauuaaauagguuuuuguuucuuuucuuuaccuuaauuuccaaguacuuacuauuuucaugggucugaauugaauguagcuacuuccauaccucacccacuuuacuaaaauaauggaauuccuagugaaacagaacaaauguacagaguguggucagaugagaauucucacaugcuuauugaaaguuuuuguuaaaccauaaaauuacaauaaauacguuagauauucaauguacaccugaauauacaagguaaauguggguaaugucuuagacucagcuguuccauuauuaaauuuaaaugugcuuugaggcauucauuuuacuaaauguuaagacuggccugaagaaugcaguacaaacuaacacuaaauauagcgggaauauuuuugcuuuagacuguuagaaaucaucuccuuauauguuugaccaugaaggaaaaaauguauguaagcuaugauggaaaagauguauggaaacuguggaugcuguaaucccccacugugucagcuuuacaugccuauacacuccaaacuuaccuucuuccuaauauucucauugagagcucugugucuuuauauuuuaauaaauacauucuuugagguuaauuacaauaaaugguauauuuguuuuagguaaguauauuaaauuaaagaguaauuuuugaagucaacauuucuagcacuacuuauaccuagugucaaggucaauaauaacauauaauaggaaaucugauacuguauuuucccauggauauauggcaacucuaguuauauuuugauuuaaauuauucauuugcagaagucuaagucaucaaauaaauuuaagccaucauguuucucuuauaagaaaauaguaagaauaagaauaaaauaacaacuaucauuuuccugugcuuacuaucugucaaggguuguucuagguuuuuaaaauauauguucacuaaauuaaccuccaaaacaauccuuuuuggcagguaauauuaucaucccaguguacagaugaggaaacaugggcuuggagagguuaaguaugugguccaaugccacaugacuaauaaauggagcacaaauucaaccacaaaauauggccccagagcaucauaucucaaucagcacaggguauauuaaacgcaguauuuugauuguaauauacagaauuaagaaauaucucucuuccuucuucuucugccgauccuugcuucucuucuuuuuucccauuccuucaccaucauucaguccuuauaugaguguuccuaucucuaucuauucuaauuuaauuucugaacgacucuuguggcuucaacugacacccacauaaaaugacccucagauauuuauuuuaaaccucauucccaaaucucuaauugccagauaaccauuucuaugaugcuauucuuuaaucccuaaauacaccgcaaauaaaauuucacuuccuauuuauccugcaucaaagcagguccuauucuugaaauguccucaguaagaguacucucuuaauugccagccaaaguaacuugaaauuuaaaaagacuuuuuuuucuuuuuugcuuuuacuuugcacaugggguuguuaaaaaagugagaauauauauggaaauguugagcaaaugagagagcuauuaguauuauuucuauuuucaauaaucugucaaauuuuacuaauuugucccaugaauugauucagagcaagacggccaggauuccaaucccuuaauuucuuuuaaaaugggcauucuaauaguacuuaccuugcuaguuugccuuuaacaaauuaauuagugcccuggaauugaugugcucaagguggcguuuagcagcuagcaaacacuaugaauauucuauuuuucucuccgccaucucucuaguucagaauuuugagggucacagcucaaagaccugagaguacguaggaaaucacccccauuuucauuuuccagaacagggacuuucauuuuacagaacuguuucagcaacuugggggaaaugaagccucagucucuugggccccaacuguauucacaaucugccuucucuggccucucccuacacuaguccauacugcaauaucaauauccuuaaaagauugcuuccaauuaaaacaauauugggguuccuuggcuguagaauugaggcaaaguuguguuauauuugaaguucucaaaaaauauaccgauacucuaacauuuuagcuugacuuucuucuuuuguucuauauuaaaauuguccacucuaacacacuguucaacaguaagccaaguccaugaauagugaaugacuguaaaauauuguauucauuugauacgcuuuuauuuuuauuuuauugugauaagaacauuaaugugagaucugcccuuuuaaaagauuucuaaauguacaauacaguauuguuaacuauaggcacgauguuguacaguagaucuagaaauuauuccucuugcauaagugaagauguauacccauggcuuauaagcuccugauuucucccuacugucuguccuggaaaaccaccauucuacucccugcuucuauguguuugaccauuuuagauacuucauauauauaaauaccuaccaagcagcauuuguccuucugugacuaucuaauauaacauccuuaaggcucauccauguagucacauauggcaggauuucguuuuguuuuugagcugaauaauauuccuuuguauguauauacagguugaguauuucuuauccgaaauacuugggaccagaagugucucaaauuccuuuuuuuuuuuuuuaaauuuuggaaguugcauuauacaugcugauuuagcaucccuaaucugaaaugucaaaaucugaaauguuccaauaagcauuuccuuugaacaucauauuggcacuuggaaauguuuggauuuuggggcauuuggauuuuggauuaguuuugauuagggaugcuaaaccuauaucaccuuuuuuuaucuauucguuuguuaauggcuauuuaguuuguuuccaaaucaugaccauugugaaaaaaggauugcuggaucauacggugauucuauuuguuauuuuuuugaggaccuccauacuguuuuuccacaacagcuguaucauuuugcauucccaccaacaguguacaaggguuccaauuuccccacuucuucaccaacacuuguuuugguuuauuuguuaugauagccaugccaacaggugugaggugauuucucauugugguuuugauuugcauuucccugaugauuagugacacugaguauuuuuuauauacuuguuggccuuuuuuuuuuugagacaagagucucgcucuguuaccuaggcuacaguacaguggugcgaucuuggcucacugcaagcucugccucccgaguucaugccauucuccugcaucagccucccgaguagcugggacuccaggcuacuggcuaauguuuugaauuuuuuuuuaguagagacgggguuucacuauguuggccaggauggucucgaucuccugaccucaugauccgcccaccuuagccucccaaagugcugggauuacaggugugagccaccacgccuggccacuuguuggccauuuuuauguauucuuuuaaagaaacaucuauauaagaccuuaaccauuuuuuuauuggauuaccaaacuuaauagcuauuauguuguaggacuuauuuauauauuuugaaaauuaacuuucuaucagauauacaguuugcaaauauuuucucacaucccauagauugccuuuucauuuucucgacuguuuacuguagagaaacuuuaguuugauauacuuucacuugucugcuuuugcuuauguugcuuguuuugggagucauauacaugaaauaauugcccaggcugucuuuuagcaauuuucaacuaggaguucuauaguuucaggucuuaauuuuaagucuuuaauccauuuuaaauugauauuuguguauaauguauauuuacauucuuuugcauauggauauccaguuuucccaacaccccuuguugaagugacuauccuuuccccauuauauauccuuggcacccuuauggaauaucaauugacuaucaugcauggauuuauuuauaggcguucuagucuguuugguuugucuguaugugugucuuuaugccagcacaauacuuuauucauuacuguaacuuuguaguauauuuuaaaaucaggaagcacaauaccucuaacuuuguuuaucuuucucaagauuguuuuggcuauuuaggcuccuuugugguuucguaugaauuuuggaauugcuuuaccuauuuguauaaaaaaugcuguuaggauuuugauauaaauuguauugaauuuguaaauugcauagauaacauggacauuuuaacaauauuaagucuuccaaugcaugaacuugggaugucuuuccauuuguuuguaucuuuguugauuucuuucagcaauguuuuguaauuuggggcauacaaagcuuuuaccgccuucguuaguuaguaaguuuaucucucauuaccuguuuaagucuuauaauaucauaugaacuuaaagccaaaaagccuuccuuugucaaauacauguucaaaagaaaauauaaggagcaaugcuuuucuacuuccaauagcucagaugcuuggucucuuuuuuuagggugcaaaugcucucgucacauacacuaucauuaguggagcugaugauaguuuucgcaucgacccagaauccggagaucugauagcaaccaggcgguuggacagggaacgccgcuccaaauauucacugcuaguucgugcugaugauggucuucaguccucggauaugagaauuaauaucacugucagugaugugaaugaccauacacccaaauuuuccagacccguguacucuuuugacauuccugaggacacaaucccugguaggugaugggucucuuauguguauuuugcaagaaucgcuuuugaaccaaaauuacauacuauguuucggcugcucuuaaucaaugauuaguuuuuaaucauauacuacuaguuauaaaaauauauaugcuggauuguuggaucuuuucauuaacgaucuuugguaaaauucucaagcaaauggcuaaauuuuuuaggaugaaugagguuagccauuuaugugucugaaaguauuugugacauggguuauuaauuuucugucaaucacaguuuugguacucuuucugcuuuaaaaacgucuaaugugauuugggggcuauguauaaaaagaacagcaaaaaaaaaauacaugaaaaacugugaauauugauucuaacgcucacuagcugugugaccaacggcaaguuaauucauuucucuuaguuucaauucucuauccuguaaauggaaacaguaauuccuguuagaguuaagguaaaggauaauuuagaaaguacauugaguuugcuaacacagggcuuggguauuagcaaaugcccauuaaguguuauaagaaacugaaucuuuaauuauaaucuugcuucuuugaacauauuauauugugauuuuuuuuagucugaguacucaauauccauguuucugguguguguguguaugcuucauucccauuauuggaaauuuuuauguaaaauuaaaauuuuauucugaauuacauuuggaaugauuauucaugauaagccauacauuuuagaaacuccauuuggcaaaggaauuaaacaucuacaggagacuccuucuaccugaaguuuuuucuucacuccucaagauaucuugugcaaguccuuuauggaaaucccaucacacuuauuucuugacuuaguuauugcaaugaccacauaaguucuagaguaguaucaccagggcauaagucuauauauuuuuuggaauccucaguuccugacacuagcaauaugcuaccuuaaauguugauugaauucaucaguauauuuauggauagguacugcuagauggaaacauaacaucagauauauuauuaauuccucaggaaauuuaugcugaaaccugagguccacuggauaucugauaugucacauacuguauucaaauagggaaaugguaauaucaaaaucugcagaauguuauguucacuguauuuucauagcgguuuucaguuaagauauuuuacuguacaaauacauuuuuuggucucuuucuauauguucucuuaguaauacuucuuacuuccuugauuuuauacuauuaauuuauucuuuugauagguucuuugguagcagccauuuuagccacggaugaugacucuggugugaauggagaaauuacauauauugugaaugaagaugaugaagauggcaucuuuuuccugaauccuauuacuggggucuuuaauuugacucgauuauuagauuaugaaguacagcaauauuauauccucacuguucgagcagaagauggugggggacaauuuacuaccaucagaguuuauuucaauauucuagauguaaaugauaauccaccuauuuucagcuugaauucauacagcacaucuuuaauggagaaucuaccugugggaucuacuguucuuguguuuaauguuacugaugcagaugaugguauguauuuuauuuaauauaauuuuuaaaacaucuauaaacugucaucagauuuauauuacauuuauuuauuguguugagcugucacaaaaaugcauuuugugaauauagguuggaaguugaggaauagaauuauaacugaacuguagaggauuuuaaaaauuaaguacuuuaucgguuaaauucuuauuuauaacagaaaacauaccuuguauuguuuuauaaacuuuaucuuauuuuucccccuaaauguagggucguguuucaauuuagcaauguagaagucauaagaccacuuuuuuuuguauaauuuuguuagauaaauaaaaauauuagguuuacauauguuauuuuaacuugaaaaggauagaauuucaaagcaaaaugaaaccaaagacuuaaguaaaaauacuuacgaaugcaaaaacuaaguuucacauuuuuggcugacaaauagcuaauaauuuuuuuuuuuuuuugagacagaguuucacucuuguugcccaggcuggagugcaaugaugcaaucucagcucacugcaaccuccaccucccagguucaagcaauucuccugccucagccucccgaguagcuaggauuauaggcaugcaccaccacgccuggcuaauuuuguauuuuuaguagagacgggguuucuccauguuggucaggcuaaucuccaacuccugaccucagaugacccgccugccuuggccucccaaaguacugggauugcaggcgugagccacugcacccagcccagcuaauaauauuuuaacuagguuucauuucagcucgaacagucucagaucuguuuaauuuaugcuaaugaucaaguuaaaauuuugcauuaaauuuauacuuuacauguguuugauuuguauuuauugcaaaagcaauuggcaaacuuuauuuuaauagcugacuccuuuggccuuucuucuaacaccuguuuuguaaguauacauaucauauaauauagcauuagagaaaacauuguauggauuaucaaccuuuaacugaauugucuggaaaauuaguacguguuuuucccuuauguuggaugcaacuaaauugucucaucaauauauaaaacaagggacaguacuuugaagaagaaauaggucucuauugacaggcauaucuaucucaauuuagaauugccuuauucuuaugacuuggaugauuugugaaaucucagaauacuauucuauuuuaacauucuauucuauacuuacuuuccuucucauagugucuauaaauggcacuuggaacgauaugagaagcaaaaaggacaguauuuuauauauguuucaauaaguaaaaugggaaauacuuucuuuagaauucauugaguaagagcauuuugauguuuccuccucuaauuuaagugcaguuaaaauugggcacaaagauauaucuaaaauagauacagcuguaaugcuaguacuacuacuauuacuacuacuguugcuaguaacaauacuuuaauguuaacgauguuaauaagaaucucaagaacugacaucugccaaguguuuugcauguacccaguccuggccuaagaacauugcacacucuauuucauguaccucaucccaggucuguggauuggcuccaguuagauaucuguauauaauugagguuagucccuauuuuggagauugguuuaucugcuauaacuuuuaguuagucuaccuauuccauagauaagaauauuuucaaagcuaaucauguauucuuauuuguccugugacugugcucaacuuuucuacagagaagaauuuuccaccauguuucuuuuugauuuauuaguuauguauuagagagagcccauuguuucauagaauuguauguuuuccuggaauaaguuuuauuuaccaucauaacuuaaaauauagggaaacugcgaagauaccaaaaaauuaaaaagaaaaagaaaagaauuuuguuugucaaaaaccugcuggaauauuccaugcacauguaagcacagaaauacauugaccauugucucuaaguaaguuuuugugauauuuuuucuuuaauugcauugaguaaaaguuucaagcuauauuuauucauuguuuuaguuuugaauacguuuaucaguguaauuuccugcaccuugacauaaaauauaugacacaauuccuauucuuucugaauuucaaggacagugauaaggcuauacaaagguaagcuuguuuguaaaacuuuccagcucaguuacacaaaagggucucaaguguuucacagacaauauuagucagacauuuuuuaaaaauaacaaauuaacaaauaaaucucaaucacugaucagaagguuccaaugagguaauauugucaucuuuuuagaugaaggaauuuuauaugaaaauaaaugucacaaucuguuaucugucuauggauucugucagaguuuaaaauuuagcuuacaugaugauuucauaaacauaaaucagaucuuuuacuguuuucacaagaaggguaauaccucuguuagcaucaagacuacuaagcaugcgguauuacauugaggaaauaucggagcaucacggaaauauucuggcuuugaugguuauuucguuauccuauaaauuauuuacacuuuaaauauugggaagucauauuaaaauguuuugcuaauaauacaauuggaauuuuugcugaauaaauguagcuauauaauauugguguacaauacagaccauugaguuucauauauuccagugaccugaugaccuuguugaaacugcuuuauaaagauggguguuauucaaaacacuucuauguguugcagcuaugugaaaaguugacaaauauuaguucuuuauagaaauuagaagauaacauuuauagauugugaguaaauauacauauuuuauagcaugaaacuauacaccuauacuuuuaaaauauauuuuacuauuuauauauauuuuuauauauuuauaauauauauuuuaugugcugugcuucuuagaacaaaauuauucaugagacugaaauacuauauauagauaucuacauaucuauauauaguguguguguauguguguauauauauauauauaugacgaaaccauaaaaccauauguaugcaauaaaacugccaggaagagucauguaacuaaaugacuuggagaacauugaacacaaaugguucacagugggcuguuugaaguuuaaagaucuggugggccauuaaagcccacuaaauuuaaauugcaacacuuauggcuaaagcuuagaauucaaaacaauguaaaaauaauaauuuuacaauaauguguuuacugucucaugguucagauauuuguugaaaaaauagaaaaaaauggucugagcuuaguauuuuucaguauacuucaaauauuccgggagaaauuugaguuuugcuaugucugcauguauuuuuuagauguaguguauguggccaaagucacuuuuuagacuugucagaaaugaaaaguuauuuucuuuacaguaaaguaaaugcagauggauuccaugaccuguaauugcagcaauuaauuuucaguuccugagaugagagcuacuucuucuauaauauggcaauauuuuauguaaaaauaguuauauuuuuuauuuguuucaucaacaauaaucuucaguuuauuuuuaauguuguuacuuaauauauuugucauuauguauuugaauauaaaagcaaauuuuucuuuuguuauacuuuuaguuagcuuaaaauuuauuacuucccuuacccauucaucuaccaaacuuuuugccuuuauaaaagaggcuguucugcuguuuacaacaacgcuauaaaauuuugggaucguguucucuuuuugccucugcaauuuagcuguuuacucaaggaaguagcauacaugauggacuaaggaugaucagauacuugauuuaauugcucccauuccuguugauuuauguagaaauguuaggccauguaaaaugucaguauuuuuaauguauuuugaucuuagauaugaaagauuuuauaugcuucucuagaauuaaauuuuauaucuuugcuuguugguauuuauuuucauucauguguuuucauaacugcauuucucaauaauagucauguccccaaaagaauggggauucaauauuuacugaugaacuuuuuuguaggaaaugcagaaaauuuucuuaaaaaguaauuaaacguaacuauauauguagauguuaauagaaacacacguauacacauaauuaaaaauaaauucuguguguauauauagauacucaaauauguauauguuauaauguuugaguaaauauauauacacacacaauauaauguauauacguauauuuacguuguaaugaaaguccuaaaagcuuuauauauauauaugugaagauaguggaaauuuuuauccucuaaagccuguggaauuuuaagacaagggguugaaauaagcuguuaaccuuguucuagucagauucuacaauucuguuucuuuccugcgggugaauugaccucugacaccuauuagcuuuauuuauucauauuuuuccugaucuucagacuccuaaguauucugaacuuuguaaucucuuccuuguucacuugugaguagucuuaaauaaacuauaaagauuaaaagucacaacucauaaugagggggaaaaaauaaacuacgcuuucaacgauuuacucaaucauuguuuauccuagaaauuuuuguuaauaagucauugucugaaaguuauauucauaaauauuuuucccauguuucaaauuaggcaaaggauauuagagacaguaaagucacagaauaagaguaaguguggcguuuuuaaaaacauugaguucuacaugguagaaaaaaaucucauacucaaguuaaauuugacuucuuaaagaacuugaugaaguucaaaaaaaggcaaaaguuaacugaaguauugauagaauaaugagaaagaauuuuuuuaaagaaaagaguaaaagggugauuaaauuguucuagacgacuuuugccaaaagugaacaucacuucucauagguagaauucagaaaccuggauaguugaaauuaauguuagaaauauagaagcuaauuguagguaauucagguuagucaguagauauuugcuagucccagaauauacaucuuuauuaaagauagauuaccuggauguacaguacguuuuuaucauaauauccuguaauuuuuccaaugucauuaggauaagauauaaaaaugcacaucguuacaggccagagaagaaaacaucacucugaggcagaaacugacuucuuucuguuuucacugcuuauuuguuauuuaccuuuaguuacuaaaacaguaagaugauguauaugcuccacaucauuuuuguuauaagacucucugcaaucauuuucugaagugaggauuuagaaacaauuuuuaaacuaaaaaaugacacaugauccuaagaaaaaucaacaguaucuaaauacaguucaauaauagcaugagcauuuauauuuggaaaguuuuauguauaauuuuacugcuaacaauuucuuuaaaaauacuuuuuagaaacuuuaaauauguuuaauaaaauuugaaagagaacuauugucucaaagguccauuacuuagcuagacacuuaauaggaauuaauaaguauuuauugauuuugacacgaaauauagaaguacacuuacagcauucaugacuaaugccauacaucagaacauuuuauuacccuuucuugaaaauuggugucagccucccuaaauuacuaaaguuacaaauguuugacuaauaguauagcguguggcacuguuaguguuggaccaucaggaauuaugugauagaaacaaggaaauauauagaaaaauaucugcucucuggaauauuuuucuccucuuuacuuuuguaauuuaacauuucaacacccuaguaaauagcaagcaguauauagaucauuuguucacaggauuuccuaaaguguguuuggaugcacggcauaucaaacaugccaaauuacuugcuaaaaguuuugguauagcuuguucugcaaucagcauauguuuaagaaaauuuuuucuucccuuuaauuucaggcaucaacucucaauugacuuauagcauugcuucaggugauagccuugggcaguuuacuguugacaagaaugguguacucaaaguccuaaaagcuuuggaucgggaaagucaguccuucuacaacuugguuguucaagugcaugaccugccacagauuccagccuccagauucacaagcacugcucaagucuccauuauuuuguuggauguaaaugauaacccaccgacauuucuuuccccuaaauugacauacauuccagaaaauacaccuauugauacuguuguuuucaaagcucaagcaacugacccagauaguggcccaaacagcuauauugaguacacucugcugaacccuuugggaaacaaguucaguauugggaccauugauggugaagugaggcucacuggagaacuggacagagaagaaguuucuaauuauacucuaacagugguggcuacagacaaaggucaaccaucucucucuucaucuacagagguuguaguuaugguacuugacaucaaugauaacaaccccaucuuugcacaagcuuuguauaaaguggagauuaaugaaaacacacuuacuggaacagauauaauacaaguguucgcagcagauggagaugaaggcacaaauggacagguucgcuauggcauuguuaaugguaauaccaaucaggaauuucggauagacucugucacaggugccaucacugucgcuaaaccuuuggauagagaaaagaccccuaccuaccauuuaacuguucaggcaacagaucgaggcagcacacccagaacugauaccuccacggucagcauuguucuacuggauauuaaugacuuuguuccuguauuugagcuaucuccauauucuguaaaugucccugagaauuuagggacacuacccagaacaauucuucaggucaguauauuuaaauaaagcaaguauugucuuaauuauaagacaucuauuugaaaaccuccccucuucuacagcguuuacgcuuccccuguucucuccucauucucauccauaaaugcucaauugcagauacagcaaauuuugaaaaggaaagguuuauaaacaucauaccuaagaaccucuuaauuuccucauugaugaaacuuuuguauuuuacuagcuuucuuuuguguauacucauguugcacacauuuauguauuuguguuuuugaauuuuguuccacaaggauaauaucugcacauaguaaaaaacuaaaaugauggaaauguuugaaacuucguuauaaauauuguucuacucuuuuccuucauauauuuaacuaccuaggugaaacugcucuuaaaaauuuuuaugaagccuuccaaaaaugcugugcauuagcuuuacacauauuuuuacacaaauagacucgggugauauauacuauagugugccauuuuuauuuuuuacuugaaaaucuaaaaauauaucuuuggaaucucuuaacauaguuuuaccucauuuuuuuuuaauggaggcauuuuauuucaugagaugcauuguuuguuuuacucacaucuugguauguacuguucuacaggugguggcaagagaugaugaucgaggaucuaacagcaaacucucauauguucuguuuggugguaaugaagacaaugcuuuuacucucucagccaguggagaacuuggaguaacacagagucuggaucgggaaacaaaagagcgcuuugucuuaaugauuacagcuacagauucagguaaguccauuacacccuuguucauuuguagauaauuucuaggccaggcacgguggcucaugccuguaaccccagcacuuugggaggccaagguggauggauuacuugaggucgggaguucaagaccagccugaccaacauggugaaaccccaucacuacuaaaaauacaaacauuagcuggacaugguggugcgugccuguaaucccagcuacucagaaggcugaggcaggagaaucgcuugaaaccaggaggcggagguugcagugagccgagaucacaccacuguucuccagccugggcaacaagaacgaaacucgucucaaaauaaacaaauaaauuaaauaauaauaauuucuucauaauaugaguaugaaguauuuucuguuugccauuaaaugaaauauuuguucacuuuuacuaaugcuugaaauucugauugccucuauguuauugauggcacaucauucacuuuaugacauuuauauauaaguggcaagggcuuaaggacaucgccaccuaagcccuauucccauaaaacagaaugaauuguugcccuauaagcuuauugaguaccucuggaugugaccuuacacucuacuuccugagcuaggggcauuuaaaguacuuuagcuuuggaaacauguagaugguuccaaccacuucucuucugauagacaugggugagugagucuguuaggaggagcuuucacuagaagguggcucaguauucagugaagcauuggucuaaaugugcaggcugcucaagaacaaaguccugguuccagggagccaaacuauaaguuccugaugccaucagccuugaaaaucagggucagggggaaaccaggacuuggaauuauuaguauaaguauaaauaacagaagucuaacccuaauuucuauuaaauaagaaauaugcagaucagaugugugaagauucugcccaauagaguuauggaggauucuaaguuauggagggugagcaaucagauuaucaguaacauuaugauauguggaagccugucacucaaagcuuuaaaaaugaugcugaagaccaugaugggaggcacaaaugaguuucagugacauuaguguccuaagucaugguguuuuggcagcucuaaaaaugaaagcauuaauuaaaccuuguuucaaagcacagcucucuaugggcacuguuuuucgagucgcucugaaauagacuggcauuucugaggccacugguggauaaauacucaauuagaugucugaaguucacuuuuaugagugauacagaaaacagaaguugugaggaaaguugaacugggugaucuugaaauuaauucccuuggauacucuugauaugaauaaccacuuuuuucaggagaaugugaguuuuagacauccgguuuuagaaucuacaguuuaaucuuauuuuccaagaaugagaucuuugacagaggacuuaaauuacauauucacuguuuucauucaaaagucaaacuuguagaugacaugagaaauuucggaaaaauauggcagcuauuagaucccagaugcaauguuuuucucaaaucuguaguguucuaagggccuggaaaauaucaaaguguuucaaaaaaauuuugagaguuuaauucuuuaucucacaaaucaccuuuccuuugcauuuuuuuugaacuauuaccuuagcccagagauaggucaacuucaucaguauggcacagauugcaguggcaguuuuuaaucaugcaaaccacuaaauguuucaaugugggagggagaaaacauuaccauuuaaacucucaucauauuuuuauuuacugacugcaugguuacagaguagcacauuuggaaacucuaacuacuccugucuacugcuccaguaagcuacaaccacaguaucauauguaugcagugcuaaaaguuacauuacuaaauuacaaaaccggaagaggguauaauaauuauaucucauuuuuccuguagauaauuaaauugcuaaacagacuacaauuccauuacugaugauauguugcuuagcuauaacagaaaguauggauauucggccuucauuaugcauuacuuauaguuauuucuucuggaaauauuuacuguaccaaguagaaacucauaggaggcuaacacauccaccugguauaguaaugcagguacuacuacaugguuuaaaggagaauuugcucaaaagcaguuauguccuucauauggguuaggcauucuacuccuaaguagccuuucuuacaagaguuugccuuaccauuuucucauaugugcaauaaauaaaauaauguuuuaaauggagcaaguagcaggaaauuaucagggaaacuagaagaguauacuuuaaaaaaugaauucagauaauuaauuuagaaauggaaguauaucauguaguuaaauacauagacuuuauaguuaaaccccaguucacauccuaccucugacauucccagcuauaugaccuucaacaacuuuacuauuccuucauguuuguaucuaugauuggaaauacuaauaucuauaugaaaguuuauugaucaaauagauaaaaaggaauacuuauucuagcuauuaaugucagucagcauguuuacuagacauuucaagcuuaguaaggccaaaguaacacuuuugacuucuauucaccucccuaccuuaaaugaauugcuucauagaucauuucacaauugcugaaggcaaaccuuguuauuauucuucauuccucuuccucuguacaccauauccaacaaauucauuaacaaggagacucagcuucaaaaauguccaaaaguguccugaauuuauccacuuuucuuuaccuccaaaacgaccuccuuagucuaagcugggguaguaugauagcuugcuaacugccuaucuuuucuccugcauggugcauuauucaacaggcaacccaagaacauuuaaaacuauaaauuagauaaucauacccuaucucuugcauagacagcaugcagugauuucuaagaauaaaauuuaaaugucuuaccauugacuacaugggauucaauaacuuggucucuguccauuuaucugaaccccuccaccaccaccagcugccaccuuuauuuugagccagagucgugcacuggccccagcucacccuuugucuccugucaguucugcauuuaguaucaucacauuauuagauuguaauuggccaacauggaaguauuuacacccuggaaaucaguaagugcuuugaauguaguuggccuguuucuugaaagcaguugcuaaacauuuacugaauacugccaaugccaaccaaucaaucaggcuuccuuaaaaaugccaaccuuucugccauguuggccuuuugcacuuguaguucucucugccuggaauuuucuauucuacagcgagcuguuugguuugguuuggugagggagaagggcauccaugucauggucauuuugucauuauuuuagauaaaaugucaacuucucagagaggacuugucugaccaguaauguuauguuugcccuuucccuuuucccagugucacucuaucaacuuccucuuuaugauuucuuaacacaaauuccuaucuaaaauuguguucuucuacauaaaauauaugaguauauagaguuuguuuaccuuauccuucucuaucagauuuccagagaaaguaaacuuccuaagucuuauucaaaaugggauucucagaaacacuuagaaaaggaccugcaacauaauaggugcuuaauaaauauuuguugaaugaguaaguuauauauguugaauaaugauaguugucauuugaaagacaaccuauuauuuuaauaugcaacuguuauuuauauuuauuuaacauacuuauauuuaguuuauuguuauauauucauuguuugcagauuuuuuuaaagaaacuuccaaaagaaaaaagugcaaaucauuuuuaauucauggcugaaauuccagaaguuuuugcuacauuggcuguggucauucaaagugaccucucuuuugaaaagcagcacaaguguuuaaagcuuugugguguuuagugugaugugacaaauugcagucacauguaaggacccagugaagcauuuuauggcuuuaauucaguuucaagugcuuaaaauacugcuugagcuauauucucaugacuuuccccugaaccuucuggcucugauucaauucuguuaucuauuagacguuucuagacaggucguauugcuacucugugcuuuacuauccaccuuuucuuacucugguucauaagauuuaauucaaaaccugcaugagcagaaacuacaugcuucugaauaguuuuuguuuguuuguuuguuuuggagagggagucucacucuguugugcaggcugguguguaguggcaugaucuuggcucacugcaaccuucgccucccggguucaaacaauucuccugccucagccucccaaguaacugggacuacaggcacaugccuggcuaauuuuuuuuuauuuuaguagagacaggguuucaccauguugccaggcuggucucgaaccccugagcacagacaauccaucugccuuggccucccaaagugcuaggcgugagccacugcgccuggccugaauaguuucaccauucgacaauucuuuuauaccugguuuucccaaagcaaacaauugugaaucuuccauaucucccacauaucuaagcacuuucuaagcacacguggcaauugguuucacauagcuuaaauauaagggcccaucauuucacaccaacuuaauaugaaaaauuugcuuguuuuaaauuuuauuauggaaauuuugguguucacauaaauuauuccaacagauauauacuuacgcaaguaauuuguccagaccuuuuagaauuuuuuuaacucaagaugagauuauacccucaaaaauaaauuuaaaugcugugaggcauuaauaucugccacuacucuuucagggaacugaauuaaugugcgagaaagcaguaaaacaaacugguaugacacuuuggggaugcuacaguuauacucagaggaguuuuuaaagaaagcuacauaugaaaaaauucuaaguuagagaaaucugacauuaagugaugguuuuuuuuuggccaggagguuucuuggagaugagccaguccacuuccuuuauuuuccagauaagaaaauugaaggcugggauagauaagcagugugcuagaacuugcagacccagguaguagcaaagucagguauaauauuuagaauuucugccuuucaacuaaauucuugcucauccauaucauauuuauuaaauuuuuuuaaggaaaucaggauauuccuuaaaauauauugcugacucucuccaugaaauaaauuuauaaauaugcaauuuaaaaaauauuuucuuuuuuacuuuauucauuucacuuuaauaaaugaaacauucaacugcuauuuuucuuuccccaaauaaauaaauguuugaaaacauuuuuaaaugaagccaaauuaaguggaaucaguaauuucaauauugguauuuugaaaauaagcuuaaauuuagacauuguuuaaauuuaauuguuaaauaaagaagauauaaagaauuuguuaggcuuuaugccuagaagaugauaauauugguaauuaucacugccaauuaucauuuugcauuaauuaaaaucaaacuauggugcuaauuuaaugcacuuuauaaauaaguucugauuacaguuagugauaugguuugccuguguguccaccaaaucgcaucuugaauugugguucccauaauccccaugugucaugggagggaccugguggaaaguuauugaaucaugggggcaguuaccuccaugcuguucuccugauagugagugaguucuuaugagaucuaaugguuuuauaaggggauuuucccccuuugcucagcacuucucucuccugccaccaugugaagaaagacgugauugcuucccccuccgcugugauuguaaguuucuugaggccuucccagccaugccaaacugugggucaauuaaaccucuuuccuuuauaaauuacccagucuuggguaugucuuuauuagcugcaugacagcagacuaauacagguuacugauaucagagagaguagggcacugcuguaaaaauaccaaagugacuuuggaacuggguaacuggcagagacuggaacaguuuggaggguucagaauaagagagaaaaauguuggaaaguuuggaacuuccuacagacuuuuugaauggcuuugaccaaaaugcugagguguuauggaaaaugaaguccaggcugagguggucacagauggagaugaggaacuucuuggaaacuggagcaaaggucacucuugcuaugcaaagagacuggcaacauuuugccccugcccuagagaucuguggaacuuugaacuggagagagaugauuuaagguaucuggcagaggaaauuucuaaaugacaaaggauuuaagaugaagcagagcauaaaaguuuggaaaauuugcagccugagauugcaauauaaaagaaaaacccauuuucuggggagaaauucaagcccacugcagaaauuugcaugaguaaccaagagcugaaugauaaucaccaagacagugggaaaaaugucuccaaggcaugucagagaccuucucgacagccucucccaucacaggccuggaaguccaggaggaaaaaaugguuuccuugggugggcccagggcaccccugcuguguaaaaccuagggauguggugccccacaucauagucacucuagccauggcuaaaaggggccaagguucagcucaggcuguugcuucagaggguacaaacccuaagccuuggaaguuuccacaugguguugagccugcaggugcacagaggucaagaaguaagguuugggaaccuccgccugaauuucagaggaugaaaauaagcuuaaauuuauacauuguuuaaauuuaauuguuaaauaaagaagauauaugccugcuggggcauugccucauggagcugugagaagaaggccagcauccuccagacccuagaaugguagcuccacugacaacuugcagcuaugcaccuggcaaagcugcaggcacucaccaccagccugugaaggcagcugggagugggacuguacccugcaaagccacaggggcagagcugcccaagaccaugggagcccaugucuugcaucagcaugcccuggaugugagacauggagucaaaggagaucaauuuggagcuuuaagcuuuaacugccccucugcauuuuggacuuucaggggccuguagccccuucauuuuggccaauuucucccauuuggaauggguguauuuaccuaaugccuguaccguauuauaucuaugaaguaacugcuuugcuuuugauuuuacaggcucauagguggaaggaauguaccuuuucucagauaagacuuuggacuuggacuuuugaguuaaugcugaaauaaguuaagacuuugggagacuguugggaaggcaugauuguguuuugaaaugugaggacaugagauuugagaggggccagggacagaaugauaugauuuggcugugugcccagccaaaucucaucgugaauuguaguucccuuaauccccauguguccugagagggaccuagugggugguaauuaaaucaugggggcaguuaccuccaugcuguucuccuaauagugagugaguucucaggagaugugaugguucuauaagggcuucaccccacuucacucugcacaucucauuuuucucucuccugcugccuugugaauaaggacauguuugcuucugauucugccacgauuauaaguuuccugaggccuccccagcucuggguuaauugugagucaauuaaaccucuuuccuuuauaaauugcccagucccagguauggccuuauagcagugugagaagggauuaacacagucagugagacuauuauacuucuaugggcuuauugauauuuaacaagucucuuaauauugcuuuuucacaaaauguuuauagagcacucuacuccagauauucuucuaggugcugaagauaggcuggugaagaggucucugucuuuauacagcuuaaauuacaaucacaaaaauagacaguaaaaaauaaacaauauaguauauagauugggaguguuaugaaacaugaugcgguuaaauuaacuggcgagagaguguuaaguacuuacguauuuuacccauuuugaaaguugaaucuuuggacuugaugguagaaucggaaggauaggaagcugcaaaaaggcacgaaucaggcaugaguccuagaauauuuggaugaacaauuuggagauggggagaaaaaagauuuuagggcaaauuaccaagacuuaguuuuuggacauauuacguuugaaauauuauaacuaauugagaugucacguagaaaguuaaauauaaaaguuuaguucucagggaagacauucaaguagagauacaucuuagaaagucauaaacauuagaugauauucauuauaugcacacuuagugcuuguaaguuccagaauauguauuauauuaucucauuuaaucucacaauagcccugaaaguuagggacuaguaucucaauuuuauugauuuauaaaacaaccaacaaaaauuuguguuauaaaaacuaaacaacuuguacugcccauucagcuguuugucagugacuacaggauuugaggccaacccacuuaacaggugaugauuucuuaacaauuauuuaccaauucccaaaugucagccugucuaccauauucuguuuuauauagacuauguuuauacgaauuucuucccuuuggauuaaauuuuauuuuuauauuaaagagaacauugguuuaggaagcaaaaaaucuugugguucucucuaaguaaaauagcugguaaagucauaauauucaugaauuagaaaucacagcauuauuccccucaauaaauaaaaaauauguauccaaggguuuuauuaaguauaaaguacaaagcgaaucuuagauauuauacuaugaacguacaauacauaugauaugcucauaccugcauagacaaugcaguuaguugggcuguauguuugcauugaauuuggggguaggagauuaaucugcgcacaaauuaaauauguuauccuuuauccuuuauagauaauucucagucuguuguacuaaagggauauagagauucugucucuagauuuggcacaaaaguuuaguuauaaaguauuugugugucagcauaaauaguaggucuucagggaacaguucaguuauuagcauuucuaauuaagggcauuuaucauccaacugaaagggaauauauuucauucuuaugcagggauugaaaauugcuuuuuaauggagggaaacaugcuguuuuugcaaaguuaaugcuaaaagcuaaaaggagugaucaucaugcuuuauuuuauuggugagcaccugguaacauuuugaauuguugucugucacauuauuuaguugaagcuggucauugcauuauaaauggcucuguaaucaaaagagaggucagaauuguguaauaugacauuuuacauccgaagauaauuguuuuuaaauauuccagaaagaucacauuuugucaauauuauuugugggaauguaugauagaaaaguuugccuugucuguuaugaucaacauuuuuaauaaugaaaauugcuugaaaacuuuuaaggccccaauaauucuauaaaucaaaucaugcuagaguugccuucaauuaccagacaugaaaugcauuugacuuaauuuuauuuuugagucucgggcagcuuuuguuauuuccauuggcauauuugucauagaugggaaucuuguuuccaaaguugauaacugguuauuguuuuaauuccucuuauuuguagcagacuuucuaugaaguuuguuagugaucuaaauauuauucuaaaucauuuauuuaaauagcauucuuuuaaaucagcuacucuuuagucagaaaaaaauauuucuacauagaauuuuauuuguguuuucuuaagauaaaacuccagaaacauuuaauuuccaaaauuccauugaauaagagcuaaaguugccaucagguuccauagaauugaaauuugauaaaacaguuucaaucuauuauccauuuacuccaugugagcuacaaaucugaguauacaaaguaaauuaaacuuugaaauggcaauaaacuaugauuaauauuuaugauaaaauuuauagaaacugaaugauaaagauuauauaaaaucaaaaccaacaugauuucauuaugaggauuucauuauuuucaaaaaaguuuucuaauucuaucuuuuugaaacaaaccuuuuuuaaagcuuauuuugauaaguauucuuaaauauauaauuugauauuuucacucaggaggcaggcagagguagguugaguuuaaaauuaggugguagccucuaguguuucagaguuucaauaacuguguugaaauuuuuggguuucuuuaauguccuccaaauaguaauuccucauaugugcuuuuugcaggcauaaaauauuugguuauuauuauuuuuuauuuuauaauuuuuaaaaauuaugauaagauguacuuaucauuacauuucucauuuuaacgauuuuuuaaguguaugguuuagugauuaaguauauucacuuuguugugcaauuuuucaguggcauugucauaacuuuacuaaaguaauuauuuuaguuuuacuucaugccuuuauuuaguauguaauuuaucuuaaggaaauauaguguuuuugauagauuccuaugcaaaaauaaugaaaaaaauauuaaguguguauauaucuaauuuauauaagcauauauguagaacuaauuagcagcaauacauuauuuuauaaaacagaauuuuuaaaauacagaaguguuguuaauauuuaaauuguuacauaccuuuuguuuuauguauuuuuuguauucaaauuuuaaucuaaccacauaaucuucaaugcuaauauaggaugacugaauuucaauacauuuuuuaguggauggcuuacuuacugugagaaaaaugaguuuacuucauggggaaaaaaagaagcuaauacuuuauuacaacaaacacaccgcuagucaggggacccauuuaccaaauauuugaugucaagaaagaaaauggcuuuguugcaaagcaacagaauuaaguuaagcagaauucuauuucugcugaauagccuuuuauguuucagagaaguauuuuugauuuauaguugcuauuauaaaaaauauaaucuuccugacauuugaacuucaaucguuuaaacucauucauuacacuuauuaucuguguauauucugauagagcagugaccugaaacuuuuuucuuuuuucaaaucuuauuuuaaguuuuaggccaggugcgguggcucacaccuguaaucucagcacuuuuggaggcugaggcaggagaucacuugaggucaggaguucgagacuagccugaccgacaaggugaaaccccgucucuacuaaaaacacaaaaauuagccaaguauggugacacaugccuguaaucccagcuacuuggaagguugagccaggagaaucgcuugaacccgggaggcggagguugcagugagccgagaucacaccgcugcucuucagccugggcaacaagagcgaaacuccgucucaaaaaaaaaagucuuauuuuaaauuuucuugaacuucauuugauauauuugagcugacuaagcuaccagucuuaaaggcaaugcuaguuauuaguuuaaugguuuuucauacuuaagaguauaaaaugugacucacacaaggcccaggguuaacugugguaucauaaauaauuggaagauuaaccugugcacagucucucucucucucugucucucuucccaugagugugugcaugugcacaauuugguuuguguaaauuuuaagauaugccauucagaauuuggguuuucuuuuuuggcuauuuuaugugaaaacugaagaagaauuuuaucacuuuuuccauguuuauguuauauuuauguuuauaugaauacauaugugcauacauauguacacacacuacauacaacuuuacaaauuuaaauuugaaauuuuuucaucugacuacuaauuguaauuagguuuuugacuuuucacuggaguucugacuucuaauucaaauauccacugcaucuucuuaaccucuacaauuacaaguuucugagaccuucacuuuuaauuuuauuuguauauuuuaccccuuucauuggcucacuguccucuaucaggagcccgugucauuauauccugccucuuugugauugcaucugguuuucauaaaucaaucccagguggaauugaacaauuuugcccuauuacaccacuaccuauauaauucaucauuaucagaucuauuugagcuaaacauuggcccuaguauucugacucuucucaugggauucacguuuaauugggaccuucuguuucuaaguaguacacuaucugcaaaacuuugaccuuugucuguagucuuguucucugaccccagccuuaggcuaagucccagacuauaaaaguauaguccuagauuguauauuucuagaaguguucaauuaugugaacuuucauccauguagaccagguuuucauauagaaaauuagagaaagaguuaauacagacagagcacaagaccuaaugguaugcauuaugggcuaauauaaaaauuaauuaaacauaauuauuccuguuuucaauuaacuuauaacuuaauaggacgugacuggaguacguugauaauuauaauaauauagagcaaaacaucugcaauaagaguggcagaguuuuaucugagcuuaauuaacuuagaaaagauuuuuuuuaagaauucaaaacuggcucucugucuauucuggcuaaauggaaauugguucaguucuuugggucuuaaguuguuuaacaaaaucaaacaagaauaccuacuuuauggaaucugugcauuaaaugagcaauacauguauaaaauauguauagaucugguaucaaauguguucaaugaaauauguauaacacaugcauguauguauaugcaccuauauuucaauuuagauauaaauauaugagcaagguuuacagauaaugacucugauuucaguuuuugacacacuaauguugagacucuucaguaacuugcaagagcagaccaacaaaugggcaguuggaucugacagcccagaggcagcagaaagcuuuggacggaagauaaaguaauaguaaacauuaugcagcacuucaaauaggauguauccacuacacggugggaaacaguaauacuccggagaaccucuccacacaguuaaaaggaaggguuacaucacacaccggguucuguccuggggugggaugaggggggagggaaagcauuaggagauauaccuaauguaaaugaugaguuaaugggugcagcacaccaacauggcacauguauacauauguaacaaaccugcacguugugcacauguacccuagaacuuaaaguauaaaaaaaaaaaaaaaagcaaacacacagacacagaaaagcaacaacaaaaacacagcgucuucauucaauuagcacauaaaagaagugccaagaucuguggucgccaaggacuagggaguuugugucacucaucuggcacaaaugcagugaaaauaagauucacuugaaauuaagagacauuccauuuuucucccuugauuucauuuuucuguguaaagcugauuuggagguuaugcuaucagucaacaagcaagauguuguagugggauggaggguugguaagccccauucacaggaauaauagucaaacacauuggaggcacgauucaaauuucagguuaauuaaaucucaguaaaaggcuuagaaauguagaacaaaauuucuguaagguuuccuaugaaaaaaaauuuuuaaaacuaacaagacuugugugcacauuuccugggguaauaagaaaguugagacaguugaagaaauuguacuucacuuuucuugaggugggaaaaaaaaauaagaagagaacuccaagugcuuaugaaguggguuguggcugauaauaaggggagaaaagggauacucuggagaaaguucuuggcuugaaaacagacucauauagauguagaaucaccuauggggcugaucguggcuuaaggaucaucugccagucuugagaaucauuuacuaaucucaaggaucaacaaaugauccucaagccagaauugucuguugucaccugagugcuuugaaaaucaucuggaaaaauaaguugauauucuuugguaugaacacagugagacugaacuugcuguaagcuuuccuugauaaacagggcucauuuuuuacuccccccagcauuugcuuucuacaguaucuacaguaauguaucaacaguaguaauguaucuacaguaauauaugguuuacagacaaagaaagaaaucacauauucuuguccaaaugagucagucauaauuuaaugugguuuuccauauguguaucaccagacacuuuagaauaccaaauauuaauguaaagacuuugacuggcgguuacuuauuuucuaauugugaauuacagcacaauguguauaucagaaauauucagaucuuucuugaaaucucacuguaagucuuaaaauaccacauuuaaaaauguccaauuuacuaugucuuccauaaagcugugaauuuuuagagagcuaaaugucucauguauuuuuaccacaagugaaucauugagaugaauuauuauucaaaauauuuuccugaauaauaugagacugaauugaaagguuuggggagggggcagaauccugagagcuguaauacagaaaacuauauaauaaaaaaugacuuuuuauagucaauuucugugaguuuuuuggucucuaaaacaaguacaagaagaacaauggguaacauagaauauaauuuaugugcuagguaguguccuaagcacauuacauuuuucucaauaccccuuugggguagagucuauuauaauucucauuuuauggaugaagauugauuuuuagugaguagagugaaauaucaguaaaagagauuaaagaacccugcaucuccucccauccuuugccucucuggaaccuugauuaauguauccccucuuucaguuucucucucucuuccaugacaccuccuuuugcucacacaaaugcacacauauucccuagguaauuuuuuuuuuaugcaacuggugggaauucuacuaacauuauucagagcauuaacuuccauuucauaaaauuguauauagugaaacacacauucaagaaauuuaagccaaacauugguacucaacaauacacuccaaacuguuuauuuuagccuuaauauauugcuugugagaaauuuaaaaucuaugccaagauuauugugcucaaaugucccacaaacuuaagcuggccaguagugaaggucccucccuguugggccucuucaccuccugccuggugcucuucuaggcucagcgacagagcugcuuguccagacccccaaagcagcgcaggaagcagcacuguucccccuacuggcaguaccuuccagcuucuugucagugguaaagacuccagggcugcuuuacaugggucacaucucagugacauuccucacuaggucuguggccuugaaaaagcuacuuaaacuuucuaaacuugagcuuacucauauaccaaauggagaugacagcagugcugauuuauggggauuagauaagacaguuuauguaaacuucuuaaaccagugcaugcauaucuaaggacuaaacaaauauuuacuguuauugauauuucuuucaauauguugcauggaauuuugacagucuuauuugauguguuucuuaucguauccuacauucauaucuauuuugugugugugaaauauuuguugcauaauuuuaccauugcuuacaguaagcaaguacuaaaaaggcauuuacauuuuuuuuuaguuuauaguucauuaugcauauuaccaauagauugagggcuauuuuucccuuuaguguaaaaucaaacacuaauagguaagauuucugaagucauaaacuuuauguuaaauuuuuagauauuucuuagacgucaaaauuuuuugacuuuguauguuaauuuaaaugaaacacuuaauauaaaauaucuuaugauauauauauauauauggcaacaaugaucagugugcagucuaaauuuaauugcaucauuuucugggagguaucaugcuucuuuauugugcucugcucaacuggguauacacauucuuucaucuaaccuagaauucacaaaaauaacagaucuccaaaaccauuucauuccauaauuuccccaucuguugauuuugguuccuauacacacaucugagcauaaaagcucauugguacuaggccacgaguaauuacaaucuaagaacauagaagaaugauugaauagugguaaaggaaauaccagcaaaucacuugacuauuagaaaauaauaugguaagguugugaaucucaauaccauucugugauaaugagggcacuccauaaacauuuuacaaauaaaugaaugaguggcuuuauuuacagaauauugaaugguaaaguuaaguagaauuuaaaugucauauuaagggaaauaacuuuauugaagguaaaguaguaucuuaagcagaaaaggagaguaucugggguuuuauuuuauuuuacauaaaugcaguuaaauggaucuucauuguuucuauuuagaagaguuugaguuugaaaaacgguuuugaaaacacaaccaacagcagauaauuugucuuucaguuauggggacagcccacagaauuccaacacauauggcaucuagccuucaccacaaaauuagucuaguacagauaguguggcccaaguguuuggcaaauguuggguuuucaccauauauugauagcagcuggaacaggaaauaaaaaugaaucauuucacguuacauugaauuuuaaguagaagcagcacacaugauucugaguuagcucaucauuaugaaguuauucuagcacguagaagauaacacuuuugagauauaacuugaagcuauuuuuuguuucccacagacaguaugggaaagggauuuaaauaccucagagacucuggaauuugugauaguaacaaugauagucacagcugagaguccaguuuuuaacauugccuuguuaguuggccagcucuuccaugccuguggguauucuucaaaucugguuuugugcuauuuuaauguaauuucagagaaauuaccggcagugccucuuuuguggcauucaaaugauauuguuguguucuacauuguugaaucagcaccuuuaaaauagaauaagagcaugacauauacuuuucgugcagaguuacuaggaaagaguugaaauucuaguucacaaaugaaaacauuugucuuguaacaaaauuaaaaaucacucaaucacuuauguguucagaaauuuuacuuugauguuuccuaaauucucuuuaguaauucugucuacagcuaauuuuuguuaaauuuguuauuuuuuguuuauaaacauugagacuugauuuucuuuucuuuuuaggauccccugccuugacuggaacuggaacaaucaacgucauaguagaugaugucaaugacaauguccccacauuugccaguaaagcguauuucacaacaauuccugaggaugcaccaacuggaacagauguuuuauugguaaaugccucagaugcugaugcuucaaagaaugcaguuauaaggucaguacauuuuccuuuguaaaguuugucuguuuucucauuaaacauuaguuuuugaacuacaugaauauaauguuuaauuuaaaugaacgucauauuaacacauauccucuucuuguuauccauugcugauagccaacaauucauuaaaugaagauucaaacaguaaacauuuuacuuauuacucuaagauuuuauuuaauuuuuauuuuauuuauauuuuuaucauaucucaugguuuugugguuugggacuacacugggugcuucugucucaugagguugacugguggcacuucacaguauuuacauggugacugaaugaucuggaggggccaagaugacuuugcaugccugcugccuuggcaggguugguuggaagguucaggaucaucuuggcccccucuguccucaaguagucucagaacuuccugaugugguucuuuagcaaaguaguuggacuuuuuaguuggugguucucaacuccaagagccacaagugaaagcucccagaacucucaaaggucagacucagaugugccauagcagcacuucuauaauacucuguuggucaaagcaguggugaccagcucagauucacugugaggagaaacaugcaucacucguugauuggagaaaugucaaagaauuuugaccauuuuuauuccacuacuagcucuaauaagaauauuuguguauucuucauuuaguaaauguauuuuacuuugcuuaaauccucuuaaaauugagaacacaaauaugauaacuuguucagagaggaugugaaagaaauuugaguugcaacauuuuaucaaccuagauuguccccuucuuccauaucuauucuaaacuacaagaaaugaagauuuccaaagguucuagagaaaaacucacacacauaaauauuuuauaccccuccuccacuuucuauaggcugguauuagguaaauuagaguugguuagauggcuaugaaaguaauggagcagaagauaaaauuugagacauuaagaauuaucagcuauggguaccagauauacggauaugguaaugagcugauucaugucuuauuuuguuguuuguuaccaauuuucuuuuaacaaaaucauuuuggaaaacugguuuucaccacacaaauuuuaagaaacacauucagaccacaauacuuggucucucuaagaaaugaccuuuaagcugaaaggacugagcuauggaauggaauuaaucucguuguuuuaucuaagaaggucagcaugucuggaccagagugagaaaggagucagagagguaggcaggggcuaaaucaugcaggccauauacaggccauauaugucacgauacagaauugggguuuuccaauuuaccuuuaggugagaaacuacuggggaguuuuaaacagaagagacacauaaacuggucuacauuuggauagaaucugaugagagaggauuuacggagagaaaccagugcaccauuuaggcacuaauuaauauaguuauccaaguagaguaacuuuguacuuacguggagaaaugaaaauugaguaaauagauuuggggcauaccuuugaaauuggaugugagacaggaaggggaacaucacacaccggggccugucauggggucgggggagggggggagggauagcauuaggagauauaccuaauguaaaugaugaguuaaugggugcagcacaccaacauggcacauguauacauauguaacaaaccugcacauugugcacauguacccuagaacuuaaaguauaauaauaaaaaaaaaacaaagaaauuggacgugagaucaaaugaaagagagaaaucagaaucaucuaaguuuuccacucaaacaccuaggcagaucaugauaugauaucauuuacugaaauggguagcauugaaggaggaacaguuuugugagaagucagaaguauucuauuugaauacaguuucaaaugacuguuacucauucauuuagagauaccaguuaggaagcuggagauaugaguguggagcuuaggguugggguuagggcuggauauacacauuugagagucaucaguguuuagaggacauuuaaaaccaauaaacugaaugagaacacguuugcggaguguauuagucuguucucaugcugcuaauaaagacauaccugagacuggguaauuuauaaagaaaaagaaguuuaaugggcauauaguuccacauuggcuggggaggccucaaaaucauggccgaaggugaggaagagcaaaaucacgucuuacaugguagcaggcaagagagcuuguacaggggaacucccauuuauaaaaccaucaguucuugugagacuuauucacuaccacaagaacaguaugcucgaagcugcccccaugauucaauuaucuccaccugacccugcccuugacacauggggauuauuuuuauuuauuuaucuauguauuuuuuuugagauggagucuugcuuugucacccaggcuggagugcaguggcacaaucucagcucacugcagccucugcuucccagguuccagugauucuccugccucagccuccuggguagcugggauuacaggugcacgccaccacacucggcuaauuuuuguauuuuuaguugagaugggguuucaccauguuggccacacuggucuccaacuccugaucucaggugaucugcccacuuccgccuuccaaagugcugggauuacaggcaugagccaccaugccuggccgacacauggggauuauuacaauucagggugagauuugagugaggacacagccaaaccauaucagagagaguauagcaggauaaggaaagaggcacuagaaccagucacugggaauucuccaacacuuuaaagguagguuuaggaggaaaggucuccaaggagacuaggaguuaagguaggaguuaagaaggucugaaguuaaggaggccuggcuagagacaacagaggaaaugcaggacagaaugaauuauuugcaugcauugcaaaaggauggaaagcuauauacaaauuucuuucagugagcuacauacagauuucuuucaguggaccaagacuuauuccaagagaagaguugaguucucagaguccuguaaagucaaaucauagaggacugagaaauuucuguccagggucauaacccguuugagucauuguacuuagcaccaaccagagagaggcagguacaacugaacuucuuccagguuaugagcuucaaaaggccacuaaauacccuuucuuuuacuugucuuauaccaaagcauagaaauaauaaaaaucauaucauaagauucaauccaaagucuuuagcuuaacauuaagaguagaaccuugggaauuaaguuguguggaauugaauccugacucuacuauuacuauugcauuaguaugggcaaauuaacauuucuggacccgguuuucaguggauuaagcagaguaauaaugaaacuaacuuuaaagagaguaaguaaaauaauuuaagugagcugguuagaauagcaccaggaacaaaaaacaaugcucaauaaaugucaacccauauuguucuaaucaugcaaagcaccuagcccucuaccugucuaucauuuguuagugcuaaauaaguuucugauaaugauuuuggaagagaugcccuaucuauuguaauguuauaaucuaauaauucuuuaucugccaugcagaugcuguuucuuagacaguauauagaauauuaccaaucagauauagggaaauucucuuguaugagauguauaaauuccugaauaugaaguugaauguuuacaaacuugauccugucuuccauugagucauucauuuauuucuauaauaaaguaaaugcugugaugaccugcuguuuuuuucuagugcauguuaaagauucauugcaaaaugcuauccuaugcuugugaauuaugcuuguaaauuuggucuagaaaaauuguauucauacucucaaacuguuuuacaaagcuguacugguaggucugaugggauuguuuugcuuugguaguauguauuuugguuauuugauugguugauuaaauuuucuucuuuuaacaugagaauuaacauuauacuuuuacauacauugaaauccaaaaaccccaucagugaaaaucuuaaaaugacucuacagacuaucauauauucaguuaaaaugaaaauugaagcuauuuuugucuugugaauaaaaaacauucaauucacuugcaaauuaacagggcaaacaauuauugcagcuuaaauagaaaauauuuucacagacaaaguaaauaguuauuauaaccucaacuuuauuuacucugguuugauaaaaucuuaauggaauauaauguauuuuaugguugguguuaauaacuccuugcuauucaugguauccugaagaaaaucuauucuuucuucagauuaaaagagcuauugguuuaauuauuuaucucccauuuaaauuuuacaugguucgguuauuuacugaacuacuguugggaucuccaggagcauaaacuuuuaugugucuuauaaguuaauuuuuuuccaaugaucuagcaugauuuugcauauagcauccagccaacaauguuucuuuuuuacuucuaccuauuugaucaaacuuuguauuucuacaaaugguguacuuacuuuauguuauacauuuuacuucaccuuuaguauuuucccuuauagaaaaucagacuguauuaauucuuagucuuucucuauccagauuaugucuuugccuuccacauaucuauuccagagcuuagcuuuuacagauauguauccccuuuucucccaacuggaccaaaucucuauucaagccccacuucuaauucuucuguaucacaacccuggagacagccacaaacuccacugacaaagucaacauucuaaggaagauuucuuuucuuuuuuuuuuuuuuugagauggagucucgcucugucacccaggcuggcgugcugcgucgugaucucagcucacugcaaccuccgccuuccagguucacgccauucuccugucucagccuccugaguagcugggacuacaggcacccaccaccaugcccggcuaauuuuuuuuuuuuuguauuuuuaguagagaugggguuucaccguguuagccaggauggucucgaucuucugaucucgugaucugccugccuuggccucccaaagugcugggauuacaggcgugagccaccgcgccccggccaggaaaauuucuuaauaugugcuauuaaucucuucccauucaauuuccuccaacucuuuaauucaaaaguuacucauuuuucuuguguuucuucaaguucucucucuuccuugaaccauguagauaucuauauaaaugcucauuuacauaaguuagcguaucuacagaaaugcucagaauuucuguugaauucugguucuuuuauuugccucccauggccuaggaaagucauuuuagugccucaaaggcuuaguuucugcaucaauaaaaaugaacauaaaaauuuauacuuuacaguuugugagacaaacauuuacuaaccaccuacuauguaucaaacaguauguauggaaucaguuaauauccauaaaugucucuggcauaauuauuaggacauagaagucacuaaauuaauucaagguuucuuuuuucuuuuuauucuucucauaucaucuuuuuuacuccuaauauauucuuucuuuuacaauaucugguacauaacagugguugucacuuaaauaaaugcauugaaugaacgauuuuaauauucucuggaauggcugcuuuuacucauucuauuuuuacuacaacauucuugaaagcuucacaaccuguuuucucugaccauuuauuccugaaaaucuuuagucugauuuuuuuuuuccuucauugcuuuacuaaaaaaaggcccugucagaagacuacugaaauuuuucaaguccagugacuuuucuaaguccuuauucuccuuuacuuuuugcaauguucacacuacaggccaggccaucuuuucuuuuuggcauuuuuuccugcucaaugucuauauaaauauuauuucuuaucauccugcaucucugaucacacacaguuuguuuucuguuucucuuuucucucucuggaaaguaauuugaauacuucucacugcauuauuuucucaguacuugugugugugugugugugugugugugugugagagagagagagagagagagagagagagagagaauuuauuccauugcugcaagcaucaauucugugaacaaaaccuccaaaucuguacuaucaacucugauuccacuccaaaauuuugcacccauauuuauaacucgcugauagacauauuacacuggagguucuguuggcaucauaaacacaguguaccuaaaauucuuugcuuuuccuguuucucauuuugguuuucugcuuuguuuuaauaauauugucuugguuuguuuuuuaccacaccuugcagcuaagggucauccccucucuuauacucaaucaguggacaaauucucauguuucuucuuuucuaaugcaucuggcacccauucuuuucagugcaucccuucugccaagauccuaguucaguucauaauuacaucaugccuguacuauuauaauaagaauuaacucacuuccacgccucuaguuucuaauccuuccaaucuauguaguacacuguccuguaaaauuaugaagcccugacuaugcaccaaaaauuuauuaaacucucaggaguuuggaacucuagggcccauaagaagugcaauuuaauagaagagauaauuuuguaauuucuuaaguguaguaccguauaacaaguauaguuuaagcacagaauagguggaaagaauaguauggccaaugauccuucaaugauacuaaguagaaguaguuuauggagaaauaaaggaaugaaagauauucuaggcaaagacaguaucagguacuaaggcaaagagcuaugcaaaaaacauggcauuagagaaagaaaguauuuccauaugguugguguggguuaggaauggacuuuguauaccauauaaaaaauucaaaauuucuuucugcaucuaaggagagaaacaauggaaauguuuuaagcagcaagcacaaaaacaugccuaguuauauuucauaauuauuucuuucccagcauuauaggaaauaauuuguacaaagcaaagcuggagucagugaauuaaagggcaauggcagaaguaugcaucaacaugagcaucucuuggcucugcuuuaacaauuauacuuccuuccucaaaaucuuucaauuccaguuugccuaugguauaacccccagucuucaaauucuagucaccccauaaauggccccagcuaauucugcaaaacucugcaacauauggccaaaaguucaguauuacuggaucauuuucugcucaugggacaaggaucugugcuuucccaagccuuauagguuugcucaauuuauucuauaucuuugaccagggcuuggcaaacuacuaccugcaggccaaauugggccuagugccuguuuuuguaaauaaaguguuauuggaacacagccaugcccauucauguaccuauugucuuuggcugcucuugccauaugaugguaagcugaguauugcaacagagaauauaugaccuguaaaacugaauaucuuuacaaucuggcccauuauauaaaagguuugcugaccacuagccuagaccuucuuuuguuucugccuuuuugaacacuauugaaagauggguagccccuuuacaacuuauguuaaauuuaccuuucucugaggaagcuuuauuuuaaucauuccagucaagaguguucugucuucugaauaccuacagugacaccucuuuacuguuucauagcacuuuacuguuuuguaauuaccuuuuuuuuauaucuuucugucauaaaggacauaaacuugaaaccaggauuuuuuuuaaccuacuuaaccgugucucuguuuugaauuuuuagucccuuuauccauuuaacuaucuaaauauagguugagcaucccuaaucugaaaguccaaaaucuaaaaugcaccaaaauccuaaacuuuuugagcaugaacaugaugccacagguggaaaauuccacaccugauaccuuugcuuucugauguuucaauguucacaaaccuuguuucaagcaauuaucaaaaauauuagauaaaauuaucuucuggcuauguauaugagguauaugaaacauaaaugaauuuuguguucagacuugagacccauccccuagaucucucauuauguauaugcaaauauucuauccagagaaauccaaacaccccugguuccaagaauuuuggauaauggauacucaaccuauguauagauagauauggauagauuguauguaauagacuauuacguuauacauauauauuauauagguccuauuauguugguaaacuuagacuuuuaaaggcucaccauuuaucaauuacaaugccaagugcucuuuauacaaaauauuuuuaauagucaaaacuaccaaauaaaaaguaaaauaugaccuccacuuuacagauaaagaaagaaggcuuaaaaauguuaagaaauuuuugugaauuuaagugcuauucaugggguuuaaauuuauguccaagugaacuauguucuaaaguccagucucuuaacuaaaugaucauauucucccagcagacaguauaaugccuauaacccuaguagaucucaggaagaggcaaagaaguuuuacaaaaucaaauggggauauuuuaacuuuacaaaagcaauaguugauuuaggguucagaucacaguggucucuguuuaugcaaauaauuugaaauaguaauguauucucaaauuagaaaauaauuuaacguguuuauugauuuucauugaacuaaaugugaacaaauucuauauugacacaacuugagcaagaguccauguuggccuucgcaauugguacauuuuccgucuucacuacauucccucaguugaguuuuaccuuccuucuacuguggaauaaugggaaaagugcauggugaagucauaaagacagaaauucaaacucuagaucugcuauuuauagauuguauguuucuuugugcaacuacuuuagucucuguuagauucagauucauuaucccuaaacagucaaaacuaaaacuaaacuauaaggauaguuuugggauuuaaauaagagcauauauaaauugcccaguagugugcuugacaugcacuaagaaaucaauaagcuccuggaaauauuuaaguaacagcauaaauguuuaacuguuaagaagauaccacaagacacaaucuaauaaaguuuuuaacuuuacaaaaauuaaugcaggccagagaagcaagagaggucaucaggagggaugagaauagaaccaagccucaaguaagagauguggcaaaaaucuagacauauuaucuuaacugucgaucuacguacagagcuuauuguguuucuucuauuuuuaaaauuagaaguauaaauuuucauccaacugguguuauagaacaucucauauuuaaaauauacuuuuauaugcuuuagaaucuagugaagucuagaaaaaauuaauuagauauuaaugacuauuugcucauucauuuuaaaaaauacuaaauauauuaccuacuuuaaaauagacagucauacgggcaauagcaugugcaauagcauaaaauuaaaaaaucagaauuuauaccauagguuucuuugucuguuuugugcugcuauagcuacagacuggguaauuuauaaagaauagaaguguauuuggcucacaguucuggaggcugggaagucuaagggcauggggccugcuuuuggugagugcuuccuguguguuauuucauggcagaagggcagaaggcaucacauggugagcaaucaugugagacagagagagggaaucaggcugaacucauucuuuuaucagaagcucacucccucaauaacuaacucccacuuccgugauaauggcauuaauccacucauaaugauggaacccugauggucuaauucaccucuuaaaggcccuacuucucaacauuguuacaacacuguuacaaugacuaauuucaaggaacauuuaaaugauagcaagucuuuuugaauggaucauuuagugaaacuggacuaaaggccacaccauuugccuaucaacacauuacgcuuaauaauacaccauggucuuggcauauacaaaacauccagaugaaaauuuauguuuuuuaucaaucucauuuuauuuuuauuugugaauauuuauaggaauaaauauuugauugaaccuugauccuugccauuauaaaacuaaaaaaguuuauggcagcauggcuuacuuuauuuuccuauuaaauuauuugauuauuucuacauccacugacagcaacaagguuccaaaaauaaaauuacacaauucucaaauccaguuuucuacacuuuguaaaacguuaagguauuuugauuauuuugugaguccugaauuuucaaguuuuaagaauucauguauaaaacuugauauuuauauuuugauaaagagaauauauauuaucuacuguaaagggcaauaauuauaccuaauagucacuucuggcccaauaacuauaguuaaugcuauuuucacacaugccugauucugucgugugauuugccaagcauauuaaaaaucugagugacacaaaguauuuuaucaauacugaagccauuucucaaccaaaccacuucucuauucuuucccuguuuugcuaucauuuuauaagacuucuaauaguuuuaaauauaagguccucaacaguugauuauuucacuaaaguaggauaaaaaaugcugaaauauuuguuuuaagcugugagcauaauaggagaaugaacauacuacuggcugcaauauaguuuuuuccccugcaguuuauauuagauauaugcuguugcuauguuuauauagacacaaagcaaacuguagaaacaugcagccaacuccaacaaggguaucuauuuguugguauaaaagaagaaaacuuuuaaagauaucuauuuccaugcuaucuuucaacuuuaaaaauuacggaccauagccaauuucugaaccuucaagcuuagcuacuucuuuccuggcugaucuuugggaccucaccuuauacacaaaaucaggaauauaugcagacaacuguacucuucagaaagaagagagaagcuuuucucaguggaaacucuugcccguuaaccuaucugguuagcaucaaaacauccaugaagaugucauaccucuccugacaagaaagcaacaaaaccauaugaggaaugacaaagacagaauuaaucacuagaaaggucuuuguauaaauaaucaguccuugaguuguucugagaagcagauacaugucaaauacagguuuugucuuaaaagaauacaauuuucaacugaucuucucugguuuauuaugguauacagcagaaaaauaauuuuuaguuucauuuaaaagauauucauuuguaauccuggcuacuaaccacaauauuagagcaaguccccugauuuaugcuuuuaggcucauuuauuuaaagccuuagggguuuguuugguggccuugcacaacuuaagaguccuaaaaaccuugugaagacuuccuugacaucacuggacaucucacgauaaagacugucaaugugauguucacagaaaauuugaaauauuuauuagcuagacuaguuguauucuuuccaacauuguuguaugaucuuucuuguaacguuuucuugcauuucuaccucaguuuuuuaauuauaguaaauagaaguuacgauauuaaaacuauaugacauaucccuauuucugcuuucugcuuuaguuauaggaucaucgguggaaacucucaguucacgaucaacccaucgacaggacaaaucaucaccagcgcauuguuagauagggaaacaaaagauaauuauacuuugguaguggucugcagugaugcgggauccccagagccucuuuccaguuccaccagugugcuugucacugugacugaugucaaugacaauccaccaagauuucagcaucacccauaugucacucacaucccaucuccuacucuuccagguaaucaaccaaauucugaggccacauggauauaaacaaacuauguaucagacauuucuauaaaaauauuuaugauauuuuacauacauauuucugauauagccuaauuuugcaaauccucuaaaauucagguuguuuugucugauggaaaugaaaaaaugcuugaaacuugaaaauuaacccuuucuugcuagacuaauuguguauaauguuuuauaauuguuauguauuauuauuucuuaauauuacuugaauauuauaaauaauuaacauauauauuacaucaucguuaaugauguuuauggccugagguauaacuuuguguaaguuugcuaagaggaggggcauugucucuauuuugcaugccauaugccacuaccugaaacaugauaugggagauaauaggcauucaacuauguuugucaguggaaaaugaauauuugacuucaauuuuucauagauauguuuucaaaaaguuuaauaaauggauaauucuuguuaauauuuauuuuauuccagguuuuacaaaugaaaacuguucuguuagcaaguuuauggauccauuuaugaaucauuuucauauugacaauaugcauuuauccuucuguaucucuuuaaauuuaguuugacauuugcuaagaaaggcauacucuaagaacugcacaaaucugccauuuuaauuuuuaaaaugaguuuucaaagaggaaaauauagaaauauagcucauuauugauuuaaucuuccuugcucggaaauauuuuuaauuauuagaagaaaaacuuaacagauagaguuaacagauccuccuuucagugaucuuugaucuucuauuaaucugagaaugauaccaaucuaaaauauaggauucauaaauuuaugugccaacuuucuaucaaaggaaaugucaguaucaaaaugauaaauaccugcuaaaggucuucagaugaaaugauguuggcaggcaugguucuaauuacauccaaugugugguggugcaagauaaaauuuccuauguaaaaugagguaugcuuaagcaucuuuuccucauuggacuuauaaccacuggccuuuuuaaaauuaaagauauuuuacuuuuguuaccguuucuucuguaggggugagagugcagguuugggaaugguuucugaaugaguagauugaaaauauguccuuauggcagcuuuucugcauauuuuuacgacaaucuguuucauuggcacucagucuaagcacuaacuuuuggaguccaaguugaguccauuaucccucaauucuuauuucuuacuacuuuacaauuauuuuaauuggcuuauguauauaucuguguauguauauacacacacauauaaacauacacauaugcacuuuuuuuuccaucugauaauaguucacguauaaaggaauuuugucauaaaacaguggggacaaggaauaaaugguaaugaacaugauuuuuguugacaagauuacauauaaagugauuggaagauauuuuaagacacacuagagcaacgguaucauugcauuggguagaggcauagcacuuugcagagcucgcauauuauguuucuuggaauguuguuuuaugugcagauuuuucuccuagaaacuaugauuuuugaacgauuagcaaguucuuuucccuaggcuucucucaaaggcauacugaaaaguauuaaauccaacagacuguauaaauuuuaguuagaaaauggcagguuagucucugaagacaaucauagagcagauuugacuugugaaccucggagaaaauauaggagauacuguucucccuaguaaucaugagaaaauaaggucacaucaagcagcaauagagugucuuauaugcacuuaucugcuaccaaauauuuuauuuaaauuccacgugaguauaacugcacacuuucucuuuuauagguuccuuugucuuugcgguuacagucacagaugcugauauuggaccaaauucugaacugcauuauucucuuucggguagaaauucugaaaaauuucacauugacccacugaggggagccauuauggccgccggaccacuaaacggagcuucagaagugacauuuucugugcauguaaaagaugguggcucauuuccaaagacagauucuacaacagugacuguuagauucgugaauaaggccgauuucccuaaagugagagccaaagaacaaacguucauguuuccugaaaaccaaccagucagcucucuugucaccaccaucacaggauccucuuuaagaggagaaccuaugucauauuauaucgcaagugggaaucuuggcaauacuuuccagauugaucaguuaacagggcaggugucuauuagucaaccucuggauuuugaaaagauacaaaaauauguuguauggauagaggccagagacggugguuucccuccuuucuccucuuacgagaaacuugauauaacaguauuagaugucaaugauaaugccccaauuuuuaaggaagacccauuuauaucugaaauauuggaaaaccuuuccccucgaaaaauacuuacuguuucggcaauggacaaggacaguggacccaauggacaguuagauuaugaaauuguuaauggcaacauggaaaauaguuucaguaucaaucaugcuacuggugaaauuagaagcguuagaccuuuggacagggaaaaaguaucucauuauguccuaaccauaaaaucaucagacaaaggguccccgucucagaguacuucaguaaaagucaugauuaacauuuuagaugaaaaugauaaugccccuagguuuucucagauauuuagugcccauguuccugaaaauucccccuuaggauacacaguuacccgugucacaacuucugaugaagacauugggaucaaugcaauuaguagauauucuauaauggaugcaagucuuccauuuacaauuaaucccagcacaggggauauugucauaagcagaccuuuaaauagggaagauacagaccguuacagaauucgaguuuccgcacaugauucuggguggacuguaaguacagaugucacaauauuugugacagacaucaaugacaaugcuccaagauuuagcagaacuuccuauuauuuagauugcccugaacuuacugagauuggcuccaaaguaacucagguauuugcaacagauccugaugagggaucaaauggacaaguguuuuauuucauaaaaucccaaucagaauauuucaggauuaaugccaccacuggagagauuuucaauaaacagaucuuaaaauaccaaaaugucacuggcuucaguaaugugaauaucaacaggcauaguuuuauagugacaucuucagaucgagguaaaccuuccuuaauuagugagacaacaguuaccaucaauauaguggacaguaaugacaaugcaccucaauuucuuaaaaguaaauauuucacuccagucaccaaaaauguuaagguugguacgaaguuaaucagaguuacagcaauagaugacaaagauuuuggacugaauucagaaguggaguauuucauuucuaaugauaaccauuuaggaaaauuuaaguuggacaaugauacgggguggauuucaguagcauccucccugauuucugacuugaaccaaaacuuuuuuaucacagucacugcaaaggauaagggaaacccuccacuuucuucccaagcaacuguucacauaacugucacugaggaaaacuaccauacaccugaauucucucaaagccacaugagugcaaccaucccugagagccauagcauuggguccauugucagaacuguuucugcaagagauagagaugcagcgaugaauggcuugauuaaguacagcauuucuucaggaaaugaagaaggcauuuuugcaaucaauucuucuacagguauauuaacacuagccaaagcucuugauuaugagcuaugccagaaacacgaaaugacgauuagugcuauagauggaggauggguugcaagaacugguuacugcagugugaccguaaaugugauugaugugaaugauaauucuccaguauuccucucugaugacuauuucccuacuguuuuggaaaaugccccaaguggaacaacaguuauccaccuaaaugcaacagaugcugacucuggaacaaaugcugugauugcguauacuguacagucaucugacagugaccucuuugucauugacccuaacacaggagucauaaccacucaaggcuucuuggauuuugaaaccaagcagagcuaccaucuuacugugaaagccuucaauguccccgaugaggaaagguguagcuuugccacuguuaauauacaauuaaaagggacaaaugaauaugugccccguuuuguuuccaaacuuuacuauuuugaaaucucagaagcagcuccuaaagguacuauuguuggagaaguguuugcuagcgaccgugauuugggcacugauggggagguacacuauuugauuuuugguaauagucgaaagaaggguuuccagaucaauaagaagacuggacagauuuauguuucuggaauucuugaucgagaaaaagaagaaagggugucuuugaagguauuggccaagaacuuuggcagcauuagaggugcagauauagaugaggucacuguaaaugucaccgugcuugaugcaaaugacccacccauuuuuacucuaaacaucuacagugugcagaucagugaaggggucccaauaggaacucaugugaccuuugucagugccuuugacucagacuccauccccagcuggagcagguuuucuuacuucaucggaucagggaaugaaaauggugccuuuucuauuaauccgcagacaggacagaucaccguuacugcagaauuagaucgagaaacccuucccaucuauaaucucucaguuuuggcuguugauucagggacccccucagcuacagguagugccucuuuauuagucacccuggaagauauaaaugauaacgggcccaugcugacugucagugaaggagaagucauggaaaacaaacggccaggcacuuuggugaugacccuucaguccacugacccugaucucccuccaaaucaaggucccuuuacuuauuacuugcugagcacagguccugccaccaguuauuucagucugagcacugcuggaguucugagcacaaccagagagauugacagagagcagauugcagacuucuaucugucugugguuaccaaggauucugguguuccucaaaugucuuccacaggaacugugcauaucacaguuauagaccaaaaugacaauccuucacagucucggacgguggagauauuuguuaauuauuaugguaacuuguuucccggugggauuuuaggcucugugaagccacaggauccagauguguuagacagcuuccacugcucccuuacuucaggaguuaccagccucuucaguauuccaggggguacuugugaucugaauucccagccaagguccacagauggcacguuugaucugacuguccuuagcaaugauggaguucacagcacagucacgagcaacauccgaguuuucuuugcuggauuuuccaaugccacaguggauaacagcaucuuacuucgucucggcguaccaacaguaaaggacuucuugaccaaccacuaucuucauuuuuuacgcauugccagcucacagcugacaggcuuagggacugcugugcaacuguacagugcauaugaagagaacaauagaacguuucuuuuggcagcugugaagcgaaaucauaaucaguaugugaaucccaguggcguagccaccuucuuugaaagcaucaaagagauccuucuccggcagaguggaguaaagguggaaucuguggaucaugacuccugugugcauggcccaugucagaauggagggagcugucuacgaagauuggcugugagcuccguauuaaaaagccgugagagucuuccagucaucaucguggcaaaugaaccucugcagccuuucuuaugcaagugucugccaggauaugcggguagcuggugugaaauagauauagaugaaugucuuccaucaccuugccacagugguggaaccugucacaauuuagugggaggauuuucaugcagcugcccagauggcuucacugguagggcgugugagagagauaucaaugagugccugcagaguccuugcaagaauggugccaucugccagaauuuuccaggaagcuucaacuguguuugcaaaacuggauacacagguaugacaacguuuguacuuuucucacuaagacuuuagccaugucaaguauauugaaacgaaauaauuuuaucauuuuccaaugauuuucauauaaaugagcauaauaguaacaaauguuuuuaaacauuuacuguuggucaaauacuguucuaagcacuuuuuauguauuuguuuuguuuacuucuuacaagaaaacuuaugagguaggaauauuuuccaguuucuauaggcaaggaaguugaaguagagaguaaguaauuagguuuucucaggugauucaguuacuuugcuguaaugucacuauucaagucuacacaguuaaauccagaacuuaagugcuuaaucucguagcgucucuuacaagagcaaaaaagagaauaauaucuacuuaaaagaguauucuagauauuaaaggauaaaauauauacaaaacauaagauuuggaccauuuuguguguuaaauaauuguuaacaaugauuguuguugauucuuuaucaucaucguuuuugugaccuuuuaaaaucauagucgucauuauuaucgaaaugugauccacaucgugagaagagcgagaaucauguuuucagauuuagauuaaaaugauguguuauugggccaggcaagguggcucaugccuguaaucccagcacuuuggaaggccaaggcgggcagaucacgaggcugagagaucgagaccauccuggccaacaugugaaaacccaucucuacuaaaaaugcaaaaauuaacugggcgcgguguugugcgccuguagucccagcuacucgggaggcugaggcagaagaaucacuuaaauucgggaggcagagguugcagugagccgagaucgcgucacugcacuccagccuggcaacagagcaagacucugucuuaaaaaaaaaaaaaaaaugguguguuauuccuaaugguuggguagaaagcacaauaggcuuauuucucaagaaagcuagaacacaacugagccacagcuuaucuugacagacuagaaagcagcauuaaacauagcaguaaaaauuuugaacuagucuuuggcacccuagugggauaugauguccauauauacauagaucucuaccuauuucuacuccaugucuauaucauuauuaucuaucaaccuaucuauuaguuaaucagugguugauguuccuucaaaugugaauaaauguuaugcuauugauaaguucgaggagagcaaaauucuaucuuauaacuugcacauuauacauuuguaaagcaugcauauuacauugaguuacucugcaguauuuauaaacauaauuuacaguacuaguaguauagguagaaucaagauagauugcuuuaacuuuuguagauguauuacagaauaauauuuuaagcaaaugcauuucuauguuauauuuucaaaaguguccauuauguguauacugaugguuuuauauuuggagaauugaaucacuugaggaaaauauagagcaaguuugaaaauguugaaacagaacaugcagucuuugccuucuaaugaaauaacuuugaaauguaaaugaagaaaaaguggcagaaaacauguguaauagaaaaagugauagauuucacagaaucugauuuagcuauagcuuuugggaagucaccuaaccuuagcugauucuucauuucucuguccacaaaaugggaauaaucauaaguacuuucaggguuuuuguaaugaguaaauauaauguuuguaaaacaccuaguacaggccaggugcaguggcucacgccuguaaucccaggacuuugggaggcugaggcagguggaucaccugaggucaggaguucaagaccagccuguccaacauggugaaacccaucucuacuaaaaauacaaaaauuagcugggcgugguggcaggugccuguaaucucagcuacucaggagacugaggcagaggaauugcuggaacccgggagauggagguugcagugagcugaggucgcgccauugcacuccagcccaggccgacaacaguaagacuccauuucaaaacaaacaaacaaaacccacgugguacacugugcaguauucaguaauugcagucuaauuaguaguaguaauaaugguauuaguauagugguaguaauagaggaguaccacagaauuuuuaaaaagacaugaaaccuguguagcggaaguuaacugugagucuuaugagaguuauuuauaugcuaagaucaugaauaauagagcuauauacaugcugaggucaggauuucuagaacacuucccucacucuuucuuacccauccccaaaauuacuuuaucggcugggaauucaacaauaagaguuuuuauauucuacauuagucuaaugcauuuauucacacuuagguuuagauugaguuuacauuuaguccuagaaugaagaaagugcaaauguauuagguauggauaagaaacauggaaaguacuacuggugugaacaaaggcaccauuugcugauuuuagcauaaaugaugaguaaguuacuucugucuggcuuguuuauuucuuuguuucauuucauuuaaauauacauugcauacuuuucuaaacgugauaguugaaacucuuaaaaaugccuuuccuuacaucauaaaauauuaauaacauuuaucaagcaguuauguaaagcacuuuuuaaaucuccuugcauuauagacauuauuacauuuaguucuuacaacucuguaagauggauauuaugauuauuguuccaauuuugaagaccaaaaaauuaagucuucgagucauuaaaagagauuagacaacuugccuccagccauggcacagaaaguguucuaacuaguuuuuuacuagaaacuuggcucuggugccucugcuauuuauauacaugucgcacucaucacacuuugauuugcacuugcuauggaguguuauggugaguucuauggugauauuauuuaagaauguuuuguccaucauucuauuaauacuuaauccucacagaaagccuauaagacaguguauugucugagacugaucagaaaucggaacuacucucagacuuugaggcaggaaaguauuugcuacaaggaaacagcuuacaaaaucuucaaacuggcuaagaauacaggucaggaacauucaccaaugggcgcagcaauaaagacauggcaggcauugcaagacaccgcugcugauccucuugcccaccugcagugcugcaccaagugaucugaggagaaugguuccugcuuugcuuuuaccauucagauaucaucacagucuuuuuugcuggcagaauauaaacuugaaccccgcuggaagggagucuggaaaagguaguuuucagacuuccagcccuugcaauauggaaagguaggaacgaugcugaaugucagcagaugauauguggcucaggaagauguuauuauucuuccuguuuuacacuguaggaaauugagccuacagucuggugacuccagggccagagcugccaaagucuauaucauaaacucuuucuagggaagguuguuugaaguuauacauuaacguuacauacuucuccucagaguucacuucagucuucauuugcauaguaggagauaauccaacugaucaggaaugauauaaacaaacauaaaauugaaugauuaagaugaaucuuacauuuuuuaaaucaaguuucaaauucuguaugaaaaaaaccauccaguaaaacuggcagauaauuaaugucugacaguuuuauuuccuuuuuguauuuuguaggaaacaauaugaaaaaagcauagugaguggcaaauguuaauccauacuuuaaauuagaaauguauugcuuaaauuucuauaguuuguuaauuuuuuuuguagagguaaucucugaaggaucauucugaguuauucuuuuuaccuagucucugccagauagccuggcucaggaagacagagcuaauauaccaaaacaucuuaacaucuaaccuagucagagcuaauaaaccauaagacaaaauuuacacauaacuguaugugugccucauagaaugauuuuuuaaaaaauuacucauaauagcuagauuuuacuucaguuaacaugaauuaaauuguagugccuuaguaaagcuucacuucuucaaggucuguauauaauuuuuggccaucagaauuauuuuaaauuacuguauuuuucauacucuacuuuugugggcuuccaccugcauuuuaucaauagguuucaaagucugugaaauuacaaauuggagcugcacaauuuucugaacuuucugcuuaaaauaauccucagccacuacccauacccaguuucucucauacacacacacacacacacacacacacacacacaccacugaguauuuuauguggauuuagaaauuguguuaaggauuagaagaguaaguggcuuaugaguugaugcaaacuaagagacuuuauccccagaauccccuagggugugauuaaauguuagcugaauggagauuuuauguagagaacaacuuauaaggacgcaaguaugaaaaugauaaucauggaacaaaaaauaggaagggauauaguuauuaucauacugucacaaguuuauuucugaaauauucuuaaaguuuauuuucaagucuguaaccaugcacauaaguauaaaacaacuauauuuuuuaaugaaugagugauuuagagggaaugaauuuguauaacauguauuucuuaucucuuuuccuuaguuacuggaaaaagaaccaaaagaaaauugaaaaaaaguaacauauucaguuauaaucacuucauauguuucauuauuaagaaaauuuucuuauaauuuuuauauuaauaucaccauaugaagcuuugauuaacuguaacauaaauuauuagaaaagauggauaaaguuuauuauaguauaggccaugugaaaaauuaauuucuaaauuuucacaaaauguaaugacaccaaaaauuaacaucaguugucaguaugccucagugaauaaaaacuauuauuccugccacauaagucuagggguuccuagaggaaaacuuuagccuaauaacgacacauguaguauuuauuuucauauacaaaugaaaaugucuugcacuuaauagaacacuaauuagaaaguacaguaauaguaaccacaucaacauuugucuacugcugccagguuuucgcuguuugcaucacauuccuggcauuaaauccuucaugggaauggaugguguuauaaaaugcagcauuuugauagagcuuauuuauaaaucuggcuaucuuauaacauaauuaguucauagucucuuuaaccuuuuccauucacuuucacacaucuggaugcauuucagguguaguauuuggaauaaugccggggguuuauuaccuuauggagaaguuuuccuauguucucaauuaagucccgauauuucaggaaagaugagguuuguucauucaucacuuuuaugucauuugacaguauaaacaguaaaauuuuuucagacauaccaacuuauauacagaauaugcauaguaauuuuacugagaaacuugccagauauuugcuuucauaaagauggaaagaguuacuaagagugauucuuuuaaaauuacuacggucauguauugguguuguugaugaucaugugaccggaaaaccauauaauauaaaagaaauuuaguaaauauauaugaaauuaaauuuuguuugagauaaagaagaguggcucauguaagagacaauaaagagugcaauuauuuuuauuuaauuugauuccugaaagcagaauuaggcaguuuacauuagguaauacauuaacuuauaaaagcauuaauaacguauguuucuaagaaguagcuuaaaugcuuauuucuguagaaaauaagcauauauuuauaagcuuaugaacauuauguguguaaucauauguaaucauuuguagucucauugagguuguguuugugcuuguuuuacaagacaaagguaaaaacuuuuuuugguuguugcuuuuguuacuggcagcccuuauuaaaacaugguauuuuugcuuuuguuucaaugcaaaaaagccauaaggcuauugaacaggauacuuagacuaucuucauagcuccuuaacaauaaugggaaacauuugcauacugugcaaaagacagcuacuuuuugcuaaaauaauuuggaaaauauauaagauaaaugccuagaaugaauagcauauauuuauuauagaauuucuuuauuaauaacauaaucaauuuagaccuaaaauggauuuuuagaguugcacauauucucccaucuccucuguguagaaauacaggagauuuaaaaauaauauuuaugguagucuaauauguauauauaaucuaagaucuuaaauugaaggcuacauguaucauaggguaucaaaaauuaucguaucuucauggagugguccaauuuagcaguugagaauaaauuuagcucuauuucacauaauccaacauuaaaaugugcuuggacaagugaaacuugaauauacauucuuguugaaaagaccauaggugauuacaauagauucaguuuauguucaacacgucaucacaucuucugcccccaaacaugaaaauagacacaaaauuucuccuguaaguuuaggaaagucugcggauaccauggauuccuauuaugcauuuauuuucaccuuaagcuauucccacuuuccaugugcuaagaauuuacacuucuucaagcacaucuccuucuaguuaugauaaauaguguauggcaacacaauuaauugauggaugucaaagcaaugagaucaauuuauucuucuaaacagcugcuauggcaguaaacauaucuuaauggaaggaggccucuugaguucaagaggaauaaaugccugucuuugugcaaguccuaucagcauacuuccaagccugaaggcguuuggcaaguauuguuaauugacuuguagcauuaauuaaguuaaugauccaagauuuuguuucacagugcuucaacacaucagauuauuguaccaagagcauguuagaguaauucaaacuacugcauucucugauacucauuaugcuauuaacacuacaauuuaaguagauagacuugcacaaaacaauucagaauuuuguuaauuucuaauuggguaaaaaagcauaaacuuuccaaaccugagaaauaugcauuuagaagcuuucuuuugauucuaaguaaaauuauggaauccuuuucucacacaaaagacacagguguuuuaaauaauaauuuaaauuuaaaucuguuuuccuacuaugucuuugaauucaaguaucugcuauggcaaccucugaguucaugaauuguaaaaaauuuuuacucuuuaaauggagaacucaauuuuuaaauaguaaauaauuuacauacucuaccaccaacagauaagacuauuuuuuccaaacucaacaacaaauuccuuuauuuaaccccaaacaaagccauuuuaucuauuuuuuuaacuuauauuuuagguucuggguacaugugaagguuugguacauagguaaacucaugucacaggguucguuauacagauuauuucaucaacuaggaauuaagcccaauaccaaauagugaucuuuccugcuccccucccuccucccacccuccacccuccaguagaccccagugucuguuguuuccuucucuguguccauguguucucaucauuuagcucccacuuauaagugagaacaggugguauuugguuuucuguuccuauguuaguuugcugaggauaauagccuccagcuccauccauguucccacaaaagacauaaucuuguucuuuuuuaugacugcauaguauuccaugauguguauguaccacauuuucuuuauccaaucugucauuuaucagcauuuagguuaauuccaugucuuugcuauugugaauagugcugcauugcacauucauuuguaugugucuguaugguaaaaugauuuauauuccucuggguauauacccaguaaugggauuguugggucaaacaguaguucugcuuuuagcucuugaggaauagccauuauuaauuauuuguaauuauccacuaagacaaaguaaaaaggaacaaccuuauuuuuaaacugaaauacugaaugcaagguugaauuuguuuuuucuuaacaauuucuauuucuauuuguguauacuugaagaaucagauucuauugagaauuuaaguuuuauaggaaauucguucucaaaauuaguauuuuauugguuuguaacaucuucugccacuuuguaaucacuguauguuuuaauaaaugaauaagucuuauuuguguuaggauauauuuccacuccucacucuggaguaacugcaauagccuguauuuuauauuuaaauuaaacucagaugucuauguuaaaauauuuuauacaggguuaaauaagaauugauucauauaauuauacacaaaaagaacaacacguaaauuucauuuguugcuauuuaacucaagauuuauaaagguaguauuuguaaaugaaauucaaaaaacauauaguagcuuuauaggaacaaugacuugggauuuauacucauauauuuuugucagagagcacauauguccaauuauuugaguaaguauacauagcaguacccucuacauuuguuacuucuuauuuguuccucauuuccagucguuaagaagugaagguggcaauuuuguaacccacuaacauguuuucaugauaacaaggcuauauugaacacacuuauaaauacauauauaagucuauguauuuuauacauguuacuuuuaacacaacucuaaaauaauuuuuuggauaaagaaaggaaugaaagaaaguaaaacuguaccuagucaaaaagcacaagugaaaauuaugugugcuuuuacagugaaaaccaaauggaaagaguagaauauuacuuuauugaugacaacuaaucaaaaauauggccaguagaccuuauguauuugcaacugggaaauacugugcuguaagaaaaaaaaaucuacaucacuaaaauggccuucacauaaucaguugaaaaacaaaacaggaaagaguucugugaaaccgcaacucucuggugagaaaucaagcacuauuugaaguuuuccugccuauuucuccaauguaguacacugcuacaauacuuaaaaccugauuucugugcccauaaauuuguaacuuguuuauuuucaugcccuugccuuaacaauacaaagguauucugaaauuguuagcucaauguuuugccuuauaaggagguucccaauuuauuuauaagggaaaaaauguuguguuuaugauucugugauguacagaaaugggcuuaguuagcaucaugagaucugacucacacuuauaauuucagaccagaauaaguguggcuccguaaucaagccacaaaaacagaaccaauuuaaacaaaauuuugacuguguuuuaagcaaaguuaguaugaugaaaugaaguaucuaugcucagcaguaggucucguugugcauauagaaugcauaucauuuccugagcuaucuaauaaaugcauuagugaaauugggcugggaaguagaaaguaacuuccagaaacaaaugauguaguauuuacaauccuacucucaaugaaaagaaauuaacuaagaauucuguaacaucucacugcauuaugaaauuugaaaauuagauccuaacgaauguaucaaaugauugcaauacuuuaaaguuauagaacagugguauuagaacauguuuaaguuuagguaaaaauaaguaacaacaacaaaaacaagugggacuuauacuccaaguuuuauacaccacgugaucaacuaccauaguuuugugaaaccuggauaugggagcagaagcccuaaauuggucugugucauaguuuuacaguuucacagacaauauauuagccuccaagaggcuuuuauucuucacuuuugaaauguaaauauuuccuuuguauggauuaauacucccuacugaaauggaaacacagucugaagacacuuguuugcuuucuucacugccauaucccccuccauuaucaugucuggcccauaauaagcacucacucaauauuaguugauucaauuuaacaagaucauguaugagaaaagucuuuauaaacugaaaaauaugcuguuuagguauuaucgcuucagacaaaagacaaaguauacauaaucuguagucaagaauaaauuuucauaagcauuugaaaauaugauguguuuucuuauuucuuauucugcuuuacaacagauauguguaauucaagugauauuucuuaguaguagaaagaguguaguuugauaaauaagauaaguuauuaucuuugaaauaccuaagucaagaaaaucucugcagugaaaagaauacuguaaguuucaacuuucuaucuauaaaauauaaaagaugaagggacauugacacagaaaauaaauucagugaaagcauuuaaauauguuuaucaugucauuucucugcaaacaguauuuucuuccaagaugauuauguaaauuauuuccuaaguauuauaaugcacauuuuacaauaggacaacuaaacaagauuuuaaauucuaagauauuauucuaauuuccuuaugucaaguaaaacguuuuuauauuucuuuucuccgugauaugccuuaggaaagauuuuuacguaugguaaugguguaacgguguuaauauauuuauguaugagauuuaaaaaaaacugaauuugauauauuuuagggaaaaugugugaaucuucagucaauuacugugaaugcaaccccugcuuuaauggugguuccugccaaagugguguggauucuuauuauugucauuguccauuuggugaguaaaacuuauuuguugauauaaaauauaaguuuauuuuugcacacaguuuagcaauuuuguuuuauuaugaguaugaaagaccaaaaaauuauuguuuuacauggaagguuuuauuaaaauaaaaucuuaaauguuuaacauuuguaaaaguuauggaaaucccauugaauacauugcauuggucauuacuagaaaaagagucaacucaagauaauugaauuaauauuguuuccauaggauauuuccccccaaagauuuauggauaucuucuuuucagcugagaaguuaugaaauaaaaaaauucuguaagcacucuuucacgucacucucuauuucaaaucuuuaagaguagucaaaguaagguuuuuuguuuguuucacuuuugugaauuuugcuuuauuuuuuauuuuuguuuuuuacauuaguuuuuaauuuuguuuuuuauguuaauucagccacuuuuauuagaaggacuuaguaacuauaccugacguuuucauaauaggcuuuuuguagcugauacuaccugacuaauaaaauuucagacuaaucugucuuuuggauaagaaaaauuguuaaaaagaacuuuuuuguauacauacauauuuauucacccuaguggaaugaacuaaaagauuccuuccaggucuuauccagcuguuacccauuacugugccagccaaaaaccaugagauucagaggaagcauuuguauuagcuuggcuuguuucauaaguuugugauuauuccauucuuuuuaaaggcugcuuuacaccacagcauagaauccaucuccaaaugacucugucucuuuucuuuuuuuuuuuguccccuuuguauaucuauuuauuuauuuuuuuauuauacuuuaaguucuaggguaaugugcacaacgugcagguuuguuacauauguauacaugugccauguugguuugcugcacccaucaacucgucauuuacauuagguauuucuccuaaugcuaucccuccccccuuccccaccccaugacaggucacggugugugaagauccccuuccuguguccaaguguucucauuguucaauucccaccuaugagugagaacaugcgguguuugguuuuuuguccuugcgauaguuugcugagaaugaugguuuccagcuucaucuaugucucuuuucuuaagcaagaaagagcaaggauauuuuucuagucuuccuuugggcauauaacugugcuauauggaccugaacaguaaagcucaaucuauaguagauaauagaauuuaaaagacauacgcaguuccuaauaaccuguauaauuuacuagguauuuuuaauuuccaaacaacuucaugacuaucuguuuuuauuaagcacauccauagaaugauaaagacaaacaaaauagaaaaauaucuaauuuugaggaauguauuuuaccaaugguuuugaggcccagaaauuggcugauuugcccaaagucaaaaaaugaaguugaggcaaaacuaccccaagacgauguagcaacuagaacacaauuuuuuauuuucaguccaguaugacauucacagaaccccuuuuuauacaauuucuuugaaauucuaacaaugccugugaaguaaugaaagguauaucaaggucaaaauaaccacaacuugagauguccaaaaacuuuuucuuucuuucaauggugucucaucauuuuaaguggugcugcuuucuacagauaaccacagucaaauuucaugguuuaacuuaacauuuugagauaaaagauaaggggauuagaguguaaacuagaaaugauuuucaagugacugaacagagauguucauauuuuuagggaucccuuugcaaauuuuaaggauuuaaguuuugaggauuuugaguugcaaauuuggggauuuaagaaaauugauacacaauaaaaacaaguugcugcugcaguguagugguacaacugucguugccuauuaaguggaacuacuugaggggccaaauguaccuucuugucacucuguagacaucgccaggggaagaggaauagcacaauguaaauuaaaauagacacaaaucacacauagccggcagugcaaauuucucccccuauuccuuccaggggcaaagacaaaaaacauuaucuaaacuuagauauugucaguugacaacauaagcacuuacaaaagaaaacaaaaaucacugaaacacugcuauguaauuugaaacuaaagagauagaagcagaaacaaaaaugauuuuuguucucaaauggaauguggaugaaagguacaaauaaccaugucagauggcaugccucaaauaaauagccagagguagguaguuacacuugcauccuuuaaaacaaaacuuuaucauuuugaaguuagaaaaaaguuuuuugcacuguuuagcuucucaucaauaaaagauuggcuauuuggauuucaaaaaauuuuuucgauacuuagauuuuuuaauuuaaauuacaucuuaggaaaaacauagugcuucagacauuauaaaggcgacauguauaauuauaacuucuuagaauuaagaugcgaccuuucugugaaaacaguaccaaaaccuuuuaagaauaaauauuuuaaauuccauaaagaaauauuuucauguuugaaaauacaguaucaauuugaauuaaaauguaaguaucuauauacuuucuccauauauuuacacucaaauauucagcacauuguuauagauuuauugaaguuuauucagaagagaccuaagugaacacauaauacaaauuuuuucaguaguauuuuuauuucauuuauaugcuuuauuuuuccuuuuacuuuaacuucacuuacucuuucugcauagauagcauauuuauauacaaauuauuaauacauacaaauuauaaauauuaaauauagaugccacagaaauguauaaaauacaaauacaaauucuacaggauagauauaaguauauaauguauaagauuauacuauguauaaaauauuaucucuauauaucauauauaugacauaacauauauaucaauaaauaucauuucuauaauuccuuugccuuuucuucaacuuugguuaaagauuaaaaauuaaaaauuauguauaauuucuuuuuuuuuuuuuuugagacggagucucgcucugucgcccaggcuggagugcaguggcauguucuaggcucacugcaagcucagccucccagguucacgccauucuccugccucagccucccgaguagcugugacugcaggugccugccaccaugcccggcuaauuuuuuuuuguauuuuuaguagaaacgggguuucaccguguuagccaggauggucuugaucuccugaccucgugauccgcccaccucggccucccaaagugcugggauuacaggcgugagccaccaugccuggccaaaaugauguuuaauuucuacucauuuauaauaaauauuauuucagucuggacagaaaaggaaaagauaaauaacacaaacuuuuauagcaacuucuaggcuguuuuaauuuuaaaaauguucugauauaacaugugguagucaaaauagcuagacaaucaguagaucuggccucaaauuuuggcuguuucucuugguucugugaccuuaggcaaguuuuaaauacucuauaaaauaauggcauugguuccuucuagcugaacaauucucucacucuaaauuuuaugcauuuaugggacauauaaagccaaaauuaagaaaugaaacuuuugcaaguuaauaagaaucaugagguauuggcauggguuaauuuuccaaucauuugccacagucuacuaauauuugugggaaaagaauuuuggcauaacauuguaacaucaauaaaacucauuuuucaaguuugaaaaagaaccagcacaaacaaaugggaaugcugacuuucagaaaaacagacagcuauuuuaaaguagccugcuauaaaucauacccacagaggguauaaaacaagaaagagauaaaaacuuaaaagacaguuauuuccuuuccuaaaccaaugauuccacuugucagauuuuguggcccuugaaaauaacaugaauauagguacugauuuuaaaaaaaucaaaacaaaugcauuugccaucuucaauugaguugaaauaguuuuuaagaacuauauauuaugaaggaaguauguuggcugaaaauuguagcauaauacaacuuuuaaaagaucaacaaauuugggccgcuugcgguagcucaugccuguaaucccaacacuuugggaggcugaggcaggcggaucaccugaggucaggaguucaagaccagccugaccaacaaggugaaaucucgucucuauuaaaaauacaaaauuagccaggcaugguucccggcaccuauaaucccagcuucucgggaagcugagacaagagaaucgcuugaacccaguaggcagagguugcagugagcaggcacucuagucuaggcaacaagagcaaaacucugucccaaaauaaaaaaaauaaaaaaaaaaucaaugaauuuugaaacguuucugggaaagaaaucucuucagacauacuccauuccacuaagccuuucauuuugagaaacaaaacauacuuagauauguucccuaauuagacaaugaaaaauaauuacaucaguuaaucauuucugccauguuuuaaagaucauucauucauaaagaucauuaacuauuuuaauuuuaguuuagaugaaauuuuuuggaaaguaaaaaaaguuguuaaaagauaucucauuuuauaauucaaaaauauuuuaaucaaaauauauaauaaaauuuucaugaaauuuuaugccaguuugucaauuuucccuccaacaggugucuuuggaaaacacugcgaguugaacaguuauggauuugaggaguuaucauacauggaauuuccaagcuuggaccccaauaacaacuauauuuaugucaaauuugccacgauuaaaagucaugccuuauugcuuuacaacuaugacaaccagacaggcgaccgggcugaguuuuuggcccuugaaauugccgaagaaagacuaagauucucuuauaauuuaggcagugguacauauaagcucaccaccaugaagaaggugucagauggacauuuucacacugugauugccaggagagcaggaaugguaagauauuucauuuuauuguuguuguauauccaacuggaucuucaaauaaaguaugaauuggggugcaaaucauguuaaauuagguuuauucauuaaaugaacacuuuaguuaugaaaaacuuagacauaauauuuuucuuuugcucaugacaacucuguucaaaaacaauaaaaaggagaacaauugagaauauagccuagugcgugaaauaauuucauugauauuuuuuguauguuuuuaaggccaugucaggacuauacuuaaaauaacuaccuuucuuuccuaaguauuucugccuugacuaaguauuucugccuugacugaagaaacaauuuaggaacagaggagacuuuucuacaaaaucuacauaaaauaacuuaaucaaaaacacuuuauuguuaaaaaaugguaacaauagucuuagcuagucauagucuuuuugcugguggagggucuugccuugauauugguggcuccugacugagccagguaguaguggcugaagauucguggugggggcuauggaaaugucuuaaaauaaaacaacaggaaacguugucacauugauuaacuccuuuuucaugaaagauuucucuguagcauuugaggcuauuugauugauaccauuuuacccacagaugaaauuguuucaaacuugaagucaagccucucucaaaccuugaugcuaauuuauuaauuaagccuauggaauauucuaaauccucuguugucauuucaacaauguucacagcaucuucaccuggaguaaguuguaucuuaauaaaccgcuuccuuuguuuaucccuaagaagcagcuucucauccuuucauguuuguuuugcaagauuguagcagcucaaucacaucuucgggcuucacuucaaauucuaguucucccacugugucuaccacauuggcaauuacuuccuccauugaagucuggaagcccucaagcucauccaugagagucaaaaaucaacuuccuccgaacuccuuuuaauauuugauauuuugaccuccuuccauuaaucaugaauguucuucauggcaucuagaauggugacuccuuuccagaagguuuuuaauuuacuuugcccagaccuaucagaggaaucaucaucuguggcagcuauagccuuaugaaauguauuuuuuaaauaauaggacuugaaaguccaagugacucuuugauccauaggcuguagucuggaugcuguguuagcaagcaugaaaacaacacuaaucuccuuauacaucauugucagagcuuuugggugaccaggugcauugucagugagcaguaauauuuugaaaggaaucuuuuuuuccgaguaguagaucuuaacaguaggcuaaaaaauauucaauaaaccaugcuguaaacagaugcacugucauccaggcauuucuguuuacugauagagcacagaugcaguagauuuagcauaauucuuaaagacccuaggauuuuuaauauggaaaaggagcacugguuucaauuucaagacaccagcuauauucaccccugaugagagagucagccuauccuuugaagcuuuuaacccaggcauucacuucuuuucucuagcuaugaaaauccuagaugacaucuucuaauaaaaggcuguuuuuuuacauugaaagucuguucuuuaguguaaccaccuucaucaaugaccuuagcuagaucuucuggauaacuugcugcagcuucuauaucaccauucacugcuuugcuuuguccuacuaccuuacagagaugacuucuuuccuuaaaccucaugagccaaccucugcuacauuccaacuuuucuucuguacuuuccucaccucucucagccuucaugcaauggaagagaguuagugccuuuuucuagauuagauguuggcuuaagggaauguuguaacagguuugaucuucuauccagacugcuaaaacuuucuccauaucagcaauaaggcugucuugcuuucuuaucauuuguauauucacuggaguagcaccuuuaauuuccuucaagaacuuuuacuuugcauuuacagcucggcuaacuauuuggcacaagaagccuauuuggccuaucuugacuuucgaaaugccuucgucacuaagcuuauucauuuuuacauuuucauauaaagugagagaaaugcaacucuuccuuucacuugagcacuuagaggccauuguaggguuauucguuggcauaauuucaguaguguuuuaucucaagguacaaggaagccugaggauagguagagagaccagagacagauaauugcuggaacagccagaacauaaauaacauuuaucaauuaagcuugccaucguauauggcacgguucauguugccacaaaauaauuauaauaguaacauccaaggacacuucacucaucacagaucaccauaccacauaaaauaauaaugaaauauuugaaauauugugagaauuauucaaaugugacucacagucacaaaguaagcacaugcuguuggaaaaauggugcugauagacuugcuggaugcaggauuaccagaaaccuucaauugguaaaaaauaaaauaucugcaaagugcaauaaagugaagagcaauaaaaugaggcaugcauguauuuauagauuauauugauuuuauuauguggcuuucauguuacaagaaugacauaucuauuuaggacuuguguuuauuaaauaaauacuuuucuuuauaaaggaaaaugcaucacaucuuuucuuuauuaauguuugaaaauauuugacauaguauaauagaauggaauggcuuauuuauuuuuuauucuuuauuuaucuucacaacuaucucuccauauuucccccaucucuaacagcuaucaaggauuuuuaauaagaaaaugcuaacaaaucugucuuaaaguauuuuugcacuuuaacuuugagccuuuaaaaguguaguuacugguggccaggcgggguggcucacgccuguaaucccagcacuuugggaggccgaggcgggcggaucacgaggucaggagaucgagaccauccuggcuaacacagugaaacccugucucuacuaaaaauacaaaaaaaaaaaaaaaaaaaaaaaaaaaaaaaauuagcccggcauagcggugugcgccuguagucccagcugcuggggauaggcaggagaauggcgugaaccugggaggcggagcuugcagugagccgagaucucgccacugcacgccagccugggugacagagcaagacucugucucaaaaaaaaaaaaaaaaaggguaguuacugguaagauuuauaauucacccuagauaaaggaauuguguaaaauguuaaauugucuguuaaaaagaaagccuagccaaaacaacaaaauaagugcccuuaaaucauuuuaaaugaaaaaacuugguauguaaaugauuauaauuguauuucugacuucauggcaaucuuuaaaauauaugacaacuuauauaguccuuagacugaucauaugaaucauacauuugugugacuauagagaaauuuuugccacuaaauguauggaauauguuauauugcugaaugcauaucagcaauauucagaaguaauauuuaaaauguuuuuaaccaagcuuuugcuaguuuuuuucccuaugacacguaguuaauuuuaaaggcuaaaauuuaugcaaucuauaauuaccaauuucauaagggcauaagacagaaacuaccuuauaauauuaauuauuuuugaccaguacacauaacagacaaucuauuaugaaagaacaaaauuugucauuugaucucaggaauauuuuauaaauccauguuuauuuugaauuggcaucagauacaaugacauuucucuccuccacucuaauuuacuacaacauuaaaggaaauuuaagcaaguuuuaaaauacagaacuauuuuuaauuaugagggggaaaaagaauaaugauuagcuuuaaauauaaccaauugauugugucaacauggucaaggguagcugcucagacaugucauucacggauaucgccacauccaucaaacugcauucaggguccuaccagguuauuaaauguauguuacuugaaauauuggugagaaaacaacagaaguauuguaugguuuuuaucaaucauuuuaguuauagaugguuuuccauuuccuuuugaacuuaguguuaauauuuuccagcuggaacauuuuucuaauauauuuaauuuauauaguguuuacuuaauaaaauuacccccaacauuccaaaaauguugucaagacauaauguuauauuuuauauuuuaauucuaauaugcccacauuuccauauuauuguaaagguuaauauuaaucauaauuaaaauuuuauuucugugaauuaggugcuuaaacagguguuggucacccugaauuaucaccaacacaacccacauauaaccuuuugaaguaaaauaauggaauauuuuacuugaucuuggucucaaugaaguuuacauuaugaguagugccuaaaaauccaccugacuuuaaugaacauuaguagagguauaacaaacaaaucuuggauaaaauauauuuucugauuaguauagguuacugcacugauuuuugcuugagauuuuaaaaauccagcauucucuggaagaauauagauuuaaucaauucuaguauuccugaugauugauguaaccagaaauauugggccuuaaagaauuagaaaaacauuuagagauugauauauauagauugggcucacauuagccauaauaauauccuaaaacugaugaguaauaguagacaucaccucacccccauucuccacacauauguaagauaaccauauuucugauauguugucaaguauacuauaauguaaaauaaacgauuuuaccugaugaccuccaaggucucuuuaaacuucaugagcauuugauucuaucagacaaggacaugggaucaagaggugaguggagaaggaugcaguuucauuuguauuauugugaccauagucaucaauuuuuaauaauaccaaaugugaaaaaaacucugucauuauuacuugagucauaggaaaaaugucuuccuguuucagaaaacauccaaaauaaggccccuacuggauucugaauuugucauuuucuacauuucaaaauaauuuugguuggaaacuggcaaaaucauuaaccucuaagcuuuaagucauugcauaguugggauaaaacauuuuaauuuauggugguaaagcuauaaaaauucaacaguaaaagagaauuuaacucugaagauuaaauugcauaagcuuacuauuaaaauaaaacaucuccuccauuauucuuucuuugaguuguaucagcaagcuuuuagauguauacgaaauauuaacaaugacuaaaauauaauuauguuauccaagguuauuuuucuaauugaggcauuuauaaauauccaugugguacuuucuaguuuaugauacuuuuagggaucucuacaaggauacuugcauaauauauguggagagauguguucaaucaaguagucaccuaagcagcagaaguugaauuauaaaaaccuaauacugcuuuugagauuggaugucaccgcauuuuacagauaacugaaaauaaucauaacuaucaaaagaguaaacuaaauggggcaugaaugacuugccagagaauuggaaguauaaauuuuuccuacaaauguuaguauuuauuauaauuuacuugaaaaaaauggcaaaaaaaauuccauguggcucacaagaguuuacuguauagagcuuauaauaauuaacuuagaaacauuuaagaauauguuagccaguaauauuugauaaacaauuaauaaauggauuauacauucaccucagucuuuguuuuuaaaaugugagauacuucagauaaauuuuuacaagucucccauuuaaauauauguuuuauggauacugccuaaaaaucauaagcaauauugauaaaaguaggauauuaaggaaauuaaucauuuucauuccuaaugaaaguggccugauuuuuuaauacagaaaauuugauauccaaaacuuugcauuuaaguuuggcauguuauuagucaacuugcuuaacuuccugcacuguuuucuacauuugcuuugcucuuauuaaacugaaaugauaagcauccugauaaaugaauaguugcauuguauuuauauuucucugcuacauauguaacaaauuuggauuaacccugucuguggcauucguaaauuuagaauaacgcuuuauugucugcauugggagaaaccuuucaaccucuuguccauuuggauaaugaauuauugcuauuccugugauauacuggcacuacacuccauccuucuuacaauuucagcaaguaaagugugcaaaguuugucauuugucaaauuuuaaugaaguuuggggaacaaaggagguguaucacaauagcauuggagauuacacaauaauauagauauacaacuuuggucuuagacugcacugcagccauccucacuugcugguacucauuauacaggacucugacuuguaugguuaucauguucugaggccuuuuaaccauaaauuuaugacuuuguuuaucaaucaaaaggaguauucauauguucuacuaaacagaaggcuuuugucucaagggaauacgcaucccuuagaaugcaaaaauacuacuuagucauuauuuaaauacuauuggggauuuuuuacuguaaagugaucuacaguaauacauccugauuauacagaaauaugcuguaauguuauuuauaaauaauuauucuuaacaaaaaugagaggagcacuuacuugauuuaacaaauuucaaauuuuaauccaaauauuuaaauuuucauagauugcuauauaguauuuauauuguauuuuccuaaucuuuuuguaaauguggcugaaaucauauuagaauaagacuuuugaaaaucaaaaauuaagugucuuuuguuaacauagcuugacaguacaauaaacacguuucuuaagauuguaaucuacaggaagauguuucagaccuauuguguauuauucuaaaaaagauuaacggcauuuuuaucuuuuuucaccuauaaaacaggggagcaggagaggauuuuuaaagguacccuuuuaccucucauagguauagauagucauaauuuuaguuugagauaucaaagaaacaugugcccaugauucaauauuauaauuaugugauuuauacauuaaaucaagauguuaucauaguuucuaagucauguucacauagaagcaagucauggguaguguuggcuggaaaggcuaauagggacgguagaacucaaaguugaauguuucuuucucuugcuucguaggcagccuccuuaacuguggacuccuguucugagaaccaagagccaggauauuguacugucaguaauguggcaguuucagaugacugguaaggaauaggauuaguuuaauuuuuauuauuacuuaaaauuuuuuaaaauaaacuuuauaccuaaaaauaauuauaggaugcuaaguaguacauaaagcuuaagauauuuuauuucccucuccaaauuuucauaauauaaaauagucaauaauuacugugcaaaauguguuaaaaugugugaaaugaagugguagaaauaaggauaaaauuggagaaaaggaaauuaaauauagccaguagucuuuggaaagauucaugaaauaauugcauaugaccuucauucugaaaaacauguaggauaaagaccucaguucuuucaaaugcguuucuaaaaguuuacgugaaaauuauuaacagauauuuuuccauagcacuuaaagcugagcacagcaguaaucuaccagaaaauaagugauuuuaauaggaaaaaugauaaacagagaaaaauaaguagucacgcaucaugaugcaucauucauugccucaaucaacuuauuggcaucccuugcauugaucaacuuacugauauucuuuaucaucucuucagggaaggagcaguguaaucuaacguaaauauuagaguugucacuaauucuacagcauuuuauuuucccucugagaguaugcuccuucuuguugacucaguauugugauaauauacaucuaacuugacuaauugaaaacauaauuuccauaaauauuauuauuuuucauaauucggaagucuaacaacucuguguguguauuggacacucuucuacauauuuuccauugaaauuuaucacacuauaauaaaugucaaaaaaaagcuauauucacucuuuuucgaacuaaacauuauacuaaaaauguaaucuuuugacacuaauauuuauaucuuccauuauuuauuuaggacucuugauguucagccaaauagaguuacaguuggagguaucagaucucuagaaccaauccuucagagaagaggacacguggaaagccaugauuuuguuggguguauaauggaguuugcagucaauggaaggccucuggaacccagccaagcuuuggcagcacaaggcauccuagaucaguauggcgauuuuauuucuuacuguuuuaaagaaaaaaaaugcaaaaaaguaugcuucagugagcaucaaaagaugaaauuauuaugcucaaaucucuaaaaauaccaaaugauuuacauuguuuugaauuuuaaauacuauaccuuugaaauuuuggcauaaaguaugauauuuaauuagaaaauuaauauguuucuagauucuuauacauauauauauauauauauaugcaugugggcauguauauguuuuauccucuuacagagaguugugaagauuaaauuaguuaaguugguaaauuauauaaaaaaggguuccagcacagagagauauguagauguuagccaucauggacacauagaacuuuauuucacauuaaauaguuuuacuuauagacauacauauuccuaaaaacuugauacagcuuuaaaaacaggcaauaacuugauuaauuaugaacuguaaggcuuuuuuauuugauuauuaauuagguuucuagcaauaacuuagggauguuagaaauuacauauuuuauuuuaaaauuccuuuuguucauuaucgaaguuugaaaaauucugaaaaaauacaaggaagaaaacaaaauuaaccuauaaucuaaccacccagagacaacuacucuuagguuauugucauguuuugacugcuuaguaucccaagaugugaaugugcuauauuuuaacuguugcuauacacuuuaguuauuuccaauuuuauuaauauaccaauuacccugugaugaacacauuuucacaaaaaucuuugcucacauuauuuuuuggaugagauuaccagaaauaaaacuauuaaaggcaaagcuaggaauacuuucuaauguuuguaacuuaaguauuuuaauaacauuuucuauuugccuuucuuuuccuacauguuguuacuguuuuguuacaaagucacacuaguucguuauuauuauuaaucaaacaguacagaaaaacaaaggauugggauugccaccauuguuaauacuucggugugcauccuuuuauaucuccguguucacacaaguacuuuuuuaaauaucaauuuuuuuuuucauuuagagauauuuugugaacaucuuuuuaggucaaaaccuacugaaacaaaacuuuuagacuuaccuuuaacuccucuguuucuguuagaccuuauguccagaaugauguuucuguuuguuuguuuguuugcuuuuugagacagagucuuguucugucgcccaggcuggagugcaauggcgggaucucggcccccugcaaccuccaccuccuggguucaagcaauuaucugccucagccuccggaguagcugggauuacaggugccugccaccacgcacagcuaauuuuuguauuuuuaguagagacgggguuucaccauguugaccaggcuggucuugaacuccugaccucaugauccaccaccucagccucccaaagugcugggauuauagaggagagccacugcacccagccuagaaugguuuuuaaaacauaagucaguuaacuuuucacuucuuggcucaaagugcuucaauagcuucccaucucacccagcuucaaagccaaaauccugacccugaaugaaaacauuuuuaugaucugccaucucccuucacuuccugaacauaucuaacuauucuucuucuugugcccugagcuccaaccauguugggccucgguguuucucaaacauggcaguacgcuuucacuucaaggcuuucucacuggcuguuuccucuagcugaaaagauauucuaccagauauacuucauucccuuauuuuauuuaggucuuaacaaagauuaagauuaauucacugccuaaucuaaagauucagcaaacccgcaaacucacuauacccuuucucaccuugauuuucucuauagcuauuuuuuucuuuauuuucugccucuuccacaagaaaaaauaaguacuuccucaguacacgguuauuuuuucauuacuuuacuuccaugcuuagaacagugcuuagcauaugguaggcauucaauaaacauuaguugcaugaguauccugauagacaugugucaaaaaauauguggucccuggaucauauguauuaaccaaaguguuuauuugaccaagguauuuuauucaaguaagaauuaauuuaaagaagaaauugucacagcuuucucauuauuauauaagacauaauuuuuuuugaaucuucuuuagugugaggcagacuauguuuucuaggaaaacuucugguuugauuaguuucuccaaauguaguuguaacuugagcuucaaauaauggagugcuugaaauuaaacaagcuaauaaaaguguauauugaguuuuagcaaacuucuccucaucuuuuaugugcguuauuguucucauuaugauuuauuuuagaugcccuaggcuggaaggcgcuuguacucgcagcccaugccaacaugguggcacauguauggauuacuggucauggcagcagugucauugcaaagagggacucacugggaaauacugugaaaaauguauguaaggucuuccgucuuccccuggaaauuuuaauaacuaugaaaaguaaaauauaugcacccaaguauguaaucaaauuaaaaauuaugcuuucauucuaaauauuaaaauauuaaauggacaauaauugguaaaauacagugacauuuuaaaaauuauuuuuguaaccugaagaagaaugauauccuuuuaaaaaaucguuuacuaacuaaaucucuagcuuccacuuuaaagguauuuuauucacuuauuuuuguuuguuuuauuucuuagaauucuaggcaaucuaaaagaucaaagguuauaguuaggcuuuuuuucauauuaucugccuuugggggauauuuuucuggugaauuuuugugcauaaaaagguauacacacuaaaucacucaacacugagaucaaaacaucauacagagccaucauaauauguuaaaauuaauguugauacuuucauuuuaauguacaaguaguagaauuaauuuugaauauuacuuuuuaaaauccuuucaucauugucuucuaagccuaauguuauuauuuagacauuaaugauguucauaucaucauuagaaaauggugcucucuaauuucgagcugcacaucucacuaacuaacccuaaugguuccucuuuuguaaaaauucuucauuuucaaacaagugguuacuacuuaacuccauugcagguaucugacuacauuuaaggagucauuugauuaaauuauauuaugaaaacaaauagaaaugcauaauaaaauugaggauauaauauaaucuaaaaggucuuagcagaaaguguaauuguguguaauaauauuagauauaaugaaaacauagaaaauauauacugucaugugauuuucaauguaauaaauauuuauuaaggagccuaauuauaucugaaauaugagucauuggcuagauaaauaccagagacacuuuuucuuaaaucaugauauaacucacauacuauaaaauguauucuuuuaaaguguaucuuucagggcugaaauccauuugagcucauuuucuuaauauucuuucuuuagcuauauuauuuguuucuauaacuuaagcuucaauauuucuggaauguggauuuuuuucagauuacaauaaacuauaauauacauacugauuauacaugaugauaaauuauaugugaugauuacugaaaauaaaguuaguuaccgauguaaauacuugauugaacacuucuuuguccuaauuuauagcauacuagagacuaaagauuacaaaucauuuuaaccaugcaaacguauauuuuggaaacacagugaaaaugauuacaaacaaauuuuucaaguacauauuaccaacaagugccugucuuuagauauucauaauuuacguaauguggcaaauaguuuaguaaaauauuucccaaaugguuaaugacugucauagaguauuuuaaguucaugguucugaaaugcauuuaaacaugugaaaucaacuuauauaaugauucauaaauggaaauuauuuuuuaagaguagaguugggggacauuaauucccaaaacgacauuuucauuguccuuuuuauauuuuugucacuauagaaaacacuccaagaaaugccaaaugaaugcauucauuuucccuuuuuuccuuugacuuccagcuguuacuccugacacugccuuaucauuagaaggcaaagggcgcuuggacuaccacaugagucagaaugagaagcgggaauauuuguuaaggcaaagcuuacgaggugccauguuggagccuuuuggugugaacagucuggaaguaaaauuuaggaccagaagcgagaauggcguuuuaauccauauccaagaaagcagcaauuacacuacugugaaggugagauaaaagcuaauggugacuucauuugauuagaccgccugccguguagugguuuaaaucacuucccccauaauuucuguccuuuucuuuacaacccauuagaguuccgacuaaugcugggcacuauuccaaugucaucuaucuuaacuauuccccaggcauuggccagaguaacaaagaucugaaugguuugguuucuacacacuuuuguguugcuuuagaguagagaacccugccagguaggccagcacacaaagaauuaguugcaaucuauuuuucugguaagaauuuauaucacuucuuuucuuacuuuuagacaaagcaaaccaaaaauauaauguuuguuugaaauacaaaaauauuuuucuccaacaauuauuucaaauauugauauguauaugucaauugacaggauuagaauaaggaaaaacauuuugaaauaagcaaaaacauuuugaaauuauaugauuucuggagcauauauucaauucucuauauaaacucuguggaguaaaguauauuuggaauucauuauaauuuuacuuaaccuuuccaaauaauuuuuaaauaaucuuaaaaauuaugcuucaugagaacaauggauuuaucauuaggcuuuuacauaauuuguuuuuucuuaucuguaaauaagauacuagacuuauauacagaugaauaauuucauuagauauccauuuuugcaucggcccuuagcuuucugaaguuuuaaaccuauguucugcuuucuuucccacaaauaagucaucuccuagaccaacaguuucuuuaguuuaguuauauuuacugccuuccauuaauauuacuuuguaucauucuacugauaauuuuuuauauaaauuuuaguaaauucuuaagauaacaaauccagauuuccugaauuauuuucaucuauuagucaauauuuaauaacuacuccagggauaguucacagagaaaaagagcaauuuguucagaaaaauuauuugguuuaauucacauauaauacuaaaaauaaaaauagauguucacuucuaaacuucagccucuuucauccucaaaauuuuucucugugcaagccaaccaugauuauguugcauauaaauauauuuaauaaguaguacaaaaaccaauauuucuuaccuucucaaaugauaauuccucuaguccagucauuuccaacuaggauagauuuuacccccaugggacauuuggcaauaucuggagacauuuucaauugucacgguuaggaguugggagaguacuucuggcgucuagcgguagaggucaagaaugcugcuaaacaguagcacuucacaacaaagaguuaucuggccccaaauaucauuagugccaaauggcagacacucuacccuuuucccuuacaagagaacaucuucagguuuuaacuuuaccucuauugaagcaaaggacccaguuccagaguuaauaaaacaacuguaaaagagaacacauaagccauuguauuacauuauuaucugguacuuauaauuuucauugaaaaugguauuagaaguaaacaaaguaaagaagcaaaaaaagaaauagauccucaucuucuauaagaaacauauuuuauaugguuugagaggcuuugacauugaggucuguguguuaucuguuaaguugcuuccaagucuucgugccauuuaaaugacauaugaaauauuucuguacuaacguacacuuaaagccaaggaauucagucaaaauacaaugugguugaaaaaaaucagagacacauuuuuuucuucacuaaggaaaaagcugaaugucaggauccauuuuugucaccauaaauucuucuacuuccaacaggacagcgcauacaacuccagauuuuguuagcuugguagcaauaacuuaauuuuuuuccugaaaggaaaguaagugcaaauuaauaaaaaaaugaauaauacagaccaaaaugcauaguuuuauaugaaaauuuugaaaagaagcuuuucaaaggggcuuggcagguaaagagaauagguaagaaaaaauaacaacagugaauuaagaauaacuaaguaaaccaaaagaaaguggcuguuguaagcaggcaaauuauuuggaugauaggaguaucaagugcuuauacagacuaggaagcuaguuaggauggacuuuuacuuaucaauuagcuuauuggucaccaagaccccaggguuccguuuuuuuuuuuuuuuuuuuuggcuccuuuucugauccuuucuuuaacucuuucuuaugguuugcauucucucucucucauucucuuuucuaucauucuuucucucucucucuacagacacacauacacacacacacacacacacacacacacacacacacgcagacagaagaugaggacauuuugugaaaaaugaggaaggguguuggguaaaugggauuccauguggcuagaagagagagagggugucagugucaggugugggcagcaauagugaugagaggagagagaagaauauguagaaucaauugggucuauucagaaaaagaaaaaauuaagaaaagaaaguuucagagagaaaggcaaaaggaaagcauaauuguguaaaacuuuguaggccaauauuuaacucauuucacaaaucucucuucauucauggcaugcccuauagcuccauauuugauguucuguaauaauaguaaugugauggacuuuauuucuacucuaaaucaguucuuuuguguuugucugguuuuuuuaagugggcaacauaggugauacagaauaauuggaauaaggaauucaaagcucuauagauucaaauuaaauaaaugaacaaauaaaugcagucaugaguugcauaaugacaggaaugcauuucgauaaaugcauuguuaggugauuucauucuugugcaaacaucauagagugaacuugcucaaaccuagaugguacaaccuacuauacaccuaggcuauauggaauagucuauugcuccugugcuauaaaccuguauggcauguuuacuguacuaaauacuguaggcaauugugacacaguggaaaguauuuguguauauaaucauauccaaaaauaaaaaagguacaguaaaaaggcugcauugaagauuuuuggggggaugggggacagccugggcaacagggucuugcucuguugcccaggcuggagugcaguggcaugaucucggcucacugcagccucugccuccugggcucaauguauccucccaccucagccucccaaguagaugggacuacaggugugcguaaccaugccgggcuaacuuuuguauuuuuuuguagggaugagguuucacauguugccuaaauugcacuuacugugacugaagcuuguaggacugaaaguugcucugagucagagagucauuaagcaaguggugggucaaugugaaggccuaagacauuauuauacacuucugcagacuuuauaaacacuguaugcuuagguuacauuaaauuuaucaaaaauauuuuucuucaauaauaaauuaacuuuagcuuacuguaacucuuuuaguuuauaaacuuaaaauuuuuaacuuuuuucucuuuuguaauaacaauuaaaacacaaauacauuguacagcuguacaaaaauauuuucuuuccuuauacccuuauuccauaagcuuuuuuucuauuuuaaaaguuuuuuauuucauuuuauuuuuacuuuuaaacuuuugcauuaguaacuaagaaacaaaaaaacacauuagccucagccuacacagggucaguaucaucaaaucccugucuuccaccuccacaucuugucccaguggaaggucuucagggacaauaacacagauggaacugucaucuccuaugauaacaaugccuucuucuggaaucccaccuaaaggaccuggaugaggcugguuuacagcuauuuuuuauaucauuagaagcaguacccucuaaaauaaugauuaaaaaaacgguguaguaaaugcauaaaccacuaauauagucauuuauuaucaaauugcaugugauauacuuuuauacaacuggcagcucaguaggcuugcuuacaccuguauccccgcaaugaguaauucguugugcuaugacauuacaauggcuacuaggucacuaggcaauaauaauuuuucagcuccuaugguucaucauugacuguuuauuaauaaauaaaaccaagcaaaaauuagcaugauguuuuaaaagugaagaauuauauaaguguuaaguacaguacugccagggagaaggaaaacauuaagaauguuauaaugggaacuuauauucuuauccaccccaauuugugguauauuccaagugcucuuucaucaaaaauuuauugaauaaaaggaugacaugaugaaaucaauuaggaggaaagagcugggagaaggcuuuuccuuuuuuuuuuuuucaaaaaggacuccagcuauaaccaaagaaaguugcuguuuuuacugugugucaugagauguugcccauuugaugaaauguuauugucauuuagcuagaauuuucuguuuuuuuuuuuuaguuugguacugaaauauauuauuaucuggaaaaauuggcuuuaauaaaauauugcuauaugaauaacauauguaaauguguuagacaucuuuucgguaaaguacaaaugaacugauuuuuaguuuuaccagauguguuuguuacauguagaaauagcauuugaucugagugacaaaauaaacugauccaucuuuucauucccguuauuugaggaacagugccacugcaucccccugccaacacaccagcucugucuggcagugguaacaggauuaugcucccugaaccaaauguucaucuugccucauaaauuaucucauuuucuaaaauggucuacucaggauacuggaaacucgguagcuggaaacuggagugggagcacccuguuacccaauguucuccuggacaaaauaaaauaaaccaaauauccuuuagauaaauuguaaaagacagccaaagugaaggcuugcccagacaccucauuaagaauucacucuuuguucaucauaguuuuugaucucaauaaaugauauaaacaauaggcaucauuuuuuccuaaaauuuguguguaaaagaugagagguaaaacaauuauuuucaucuuuauuuuuaaacuaugcuucccuuuuagcugagcauucuuuuucuuuuugcaagugguuuucacaauuuuuuaguacuaugggccuuuuacuaaacgaaccagcauaacacacuccaauggcagguugucauuggaauacaaauaauuuaaaaagguauaauuuaauuaucuuaaauggacauucgccccuuuauuauuucaauuguguucuggaaaauaauucaucaaguuuugagaaauuagguauacauauaagaauacguugaaaaccauugaaacuuaaauguaaaaguacauguugccuaaaauuagagacaaaguguguaaguauauucuaauacaaccagauucuucagcuauucuaucugcuguggacuggucaaaaauuuaaguuuaguuuuguuaaugauuuuuauuuaagcauaccauauuuuaauugcauacuauuuuuaauauguuuuacagauuaagaauggcaaaguauauuuuacauccgaugcaggaauugcugggaaaguggagagaaauauuccugaaguauauguugcagacggccacuggcacacuuuucuaauugggaaaaauggaacagcaacaguauugucuguugacagaauauauaacagagauauuauccacccuacucaggacuucgguggccuugaugugcuuacuauaucacuuggaggaauuccacccaaucaagcacaucgagaugcccaaacagguaaaugccuuuauuaaguagagucacaagggaaguaaaauuguucuucaaaaaguaauugcuuuuucuuguggcaagacuacacauuuaacaugaaucucauauacagaacaauuucauucaauaaaauuuauguuuaaaaaaguaguuugaugucugauaauaucaauuauaaauauccuaagaaugucauaacuaucuucagaaaguuuguaauaaacuauuagccaccacuuucucgagagcuugcaucuuucuuaccaagguuguaauucaguccauaguguuuugaugcuuugcuuguccaccaagcauuucauauacauuuguucauuuauuuauucauucacagccacucucuucauagaccauuaauggagacaaacauuaaucaaauucuuacacaaguaacugcauuauucuaaugugugauaaauaauacaaaugaagaauguagaauucuaaaauauagugaaaaaagagaaaggaaggggaauuuugcuguggaauugacauguauacauaaaucugaaugaugaggaggaugaaaguguacgaaagguuaauuuauguugauaggaauuuuuuuaaagaaaucguuuaagccaaaguuauagaagacaacacauuggaggcuaacaucauaggcaaaugaugaaguuggagaaugaagcaacuuccugaccauguugcaguuuuggucuuauuuacagagcaaugggaaguaauugaaaacuuuaaucacaguaggaucaaguuagauaugcaguaauauuacagaucauucaggcuacagcauggagaaugaauuggaggaggacacgaguggaucuacagaaaugaguugggaucugggcaagaugucuucugagcuccuacuagugugguggcugaggaguuagaaagaaauggauaggcaagaaauauucugggaacuaaaaucaaccaaacuguuagugauuaugguaaaauucaaggagguuucuacuucucaacucaaagaaggguaggucagcaagagaggaaacugcagaacccuccaaaagcagcauaugucugagaaauauuagauuugguuugggacauuuuggauuugaagcaucuuugagaaaauccuuuggauggaugggcuggaaaucagaaauagacuuuagcuggaaauauauauuuaagaguggucagugucaagcagguaacugaaguacuggacauggaugugaucaccuaacaugagggcguagagugaaaagaaagccugggacgucaucuugauuaaccguaagaguuaaugguuauguagaggagaauaagucggaaaagaagacuaaguaauaggaagaaaaucaggaguauaggaacaaaaagaaaagaugucacaaaagcucauggaaaaaauauaucaagaaugagaaugucacuaugguagaaugaugcauuaaauaagaggaaaaaaaugcaugugagacuaauagauuuaaggcauaaaaguuaaaguccaggucauaaguccuuuuuauaugguuauuauagaauguugugagaaaacaaaccaauggaaauuacgcuuuuuguagugucaaaauagauuguugggcccugagauaggaauaucagcacuguuaacacacucaaguguaaugaaguguuucuuaacuuugcauuuuaucuuuaucauuccccuaaggagacacuuaauauagucuaaacuuugccauccccaagucauaaaauguuaacaccagagguauguuuuuaucugccuuuuagaggcccacaaaccauuguaauagcuaagauuuuuuuguuuugcuccccaagaaccuauguuccacaccuuugguguauuaucaccuucaaugggaaugcaugauuuaguaguugaagccauuggccuauuucauguucuuuacaaauuuaaaaaauauauauuuuauuuguauguaugcaauuuuugguauaugggauguaaaaaggaaggaaauugauaaauaaaugaguaagaaaaagaaaauucagccugcccaagucauucauaaaucuucagaaugagugggauucaagcaaucugacccauguuuggucaugguaaucuuaacgcaccuugcuaaguuauaagaugcacagcuuaauuaucuuucagcuggaugaugguucugagacugagguuucuguauucauguauucauaugaggugauuguggagcuucucuuuacaagaacccagcaguguaguauaagcucuuuuuuuuuuuuuuuuuuuuuguaaaaagccuuacuccuucuucuucucccagcagguuuugauggcugcauugcuucuaugugguaugguggagaaagucuuccuuucagcgggaagcauagcuuggccuccaucucaaaaacagaucccucagugaagauuggcugccguggcccgaacauuugugccagcaaccccugcuggggugauuugcugugcauuaaucagugguaugccuacaggugugucccuccuggggacugugccucccacccgugccagaaugguggcagcugugagccaggccugcacuccggcuucaccuguagcugcccagacucgcacacgggaaggaccugugagauggugguggccugucuuggcguccucuguccucaggggaaggugugcaaagcuggaaguccugcggggcaugucuguguucugagucagggcccugaagagaucucucugccuuugugggcugugccugccaucgugggcagcugcgcaaccgucuuggcccuccugguccuuagccugauccuguguaaccagugcagggggaagaaggccaaaaaucccaaagaggagaagaaaccgaaggagaagaagaaaaagggaagugagaacguugcuuuugaugacccugacaauaucccucccuauggggaugacaugacugugaggaagcagccugaagggaacccaaaaccagauaucauugaaagggaaaaccccuaccuuaucuaugaugaaacugauauuccucacaacucagaaaccauccccagcgccccuuuggcaucuccagagcaggagauagagcacuaugacauugacaacgccagcagcaucgccccuucggaugcagacaucauucaacacuacaagcaguuccgcagccacacaccaaaauuuucaauccagaggcacaguccccuaggcuuugcaaggcaaucccccaugcccuuaggagcaagcaguuugacuuaccagccuucauauggucaagguuugagaaccagcucccuaagccacucagcaugcccaacucccaacccucugucucgacacaguccagccccuuucuccaaaucuucuacguucuauagaaacagcccagcaagggaauugcaucuuccuauaagggaugguaauacuuuggaaaugcauggugacaccugccaaccuggcauuuucaacuaugccacaaggcugggaaggagaagcaagaguccucaggccauggcaucacaugguucuagaccagggagucgccuaaagcagccgauugggcagauuccacuggaaucuucuccuccagucggacuuucuauugaagaaguggagaggcucaacacaccucgcccuagaaacccaaguaucugcagugcagaccaugggaggucuucuucagaggaggacugcagaaggccacugucuagaacaaggaauccagcggauggcauuccagcuccagaauccucuucugauagugacucccaugaaucuuucacuugcucagaaauggaauaugacagggagaagccaaugguauauacuuccagaaugcccaaauuaucucaagucaaugaaucugaugcagaugaugaagauaauuauggagccagacugaagccucgaagguaccacggucgcagggccgagggaggaccugugggcacccaggcagcagcaccaggcacugcugacaacacacugcccaugaagcuagggcagcaagcagggacuuucaacugggacaaccuuuugaacuggggcccuggcuuuggccauuauguagauguuuuuaaagauuuggcaucucuuccagaaaaagcagcagcaaaugaagaaggcaaagcugggacaacuaaaccaguccccaaagauggggaagcagaacaguaugugugaaguuuauguacuggcacuauaaaauauaaaaacaagaaauaauacucaaaccauuguaaaguugcugacuagguugggucacauuugaaaaacaggccaguauggacuagugguggagggaaaacuuuaaaaauaauaaccacaaugcugcugaaacagacucacaacaacucuuaauuuaaacaugugugguugaauuuauuucccugcaugcauuguguuuuguaacuaguuauguggcaugcagcauuuggaaaauuuuucuuauuuaccaguguuugauuugugauuuuuaaaaauugauaccuuuaccauugcagaaaagaacuugugcuuucccaguggcguauguguauuguuucaacuguauuauuauaauuauauuuugcauugcaagauucuugauguuaaaccaauccuuguaaaguguaaaaaggaacccuccuaucguggaaugaaagauuaaguauauuaacacuuuucagaaugauaguuucuguauuugauguugcucagaaaugucucaguauuugaguaaguuuuacaugacaguggguacugaaauuaagucauuuuguucagcacuuuaacgcuuucuuauagaauugucuuaaaacuucuggauccuugagcaaaugauuauagucuccugacuuucaugaggcuuccauuaggaacagaaugauugcauguuguccccagaacacugccaccuugcuaugcgaaugauguucucagcagcacuucuaagaaacacucuuaaaaguuauuuauugaaaauuuuucguaugcuuuuaauauuuuaaagaauugaccuaaggaaagcuuaugauuggacuuauuuuccaaccagauaacauuuacucuaaguacccaguuuuuauaauuuauaugaaaucagauuucaacacuuacuuugucauuuuguagaucauuuuuuuaaaauacuguguaaaaacuuuuuuuacaccuaagcuguguuuuugauacugauauuuuccuaugcugaauaguuuucuuacuuucagggaagguaagaaaauacuuuuuuuauauuuguuacuuauguaacauucauauuuuucucauuuugauauuuguaacauacuguaugcuuucuacuuguaaaugucaacaauagaauuaaaauauuuauuuaa

SEQ ID NO: 21366 - RNA, 73345 nt, Homo sapiens
uuaaaauguauugcaaaauguacagcauuuauucacauacagacaaaaaggcacaauucuacuaaauaguucaacaaaaaaauacagcuguccucaacuaguuuuauaaauacuuucaaaaaggggguagaaauaaauacaggauugggucauguaauauaaaauagucaucucuacauauacuuuaauuugauuuuuaacucuucaugcaccuuuuuuuuuuuuucaauuuuagcugaauggacaccaagcuaggcacauagugaaaaauccucuguacaagguuacaaauguaaugacaaguuuguccauuucaaaauaagauuuguacacaacacauaaaacccuucauuuagaucuuguguuuauaaccuaacaaaugacauuccaggcaacuuuacaaaaguuuaacuagccuacauuuugacauaauacauuaaucauaaucaaagauauuucuuggucaggaugcacaaggaaagauaaagcuuaaaaaaaacaaaugcaaaugguuccauacuaauagaacgcaaguggguguuugggcugguugcugcuuauggccaccucauagagaguucccagcaugacaugaaacuaacucacaaagcuaucauuauacugucagagaaaccgugcucuauccauuugcauuucgaagcaggaauaaaaagugugggcuuuuuauuuuuguguguuuuguuuuuguguggguuuuuuuuaauauuuuuuguuuuguuuuuguuuuguuuuuuuugguucagcauaacuuggaacauuugaaagcuuuucaaccuaaauguggggaaaaaacagguaaggcauuauuuuugcacaaaacuagcauuccuaauagugcaaaugaaucugauaccucuuaaaauggugagaggucauacacuuacuagauuaauuuagauuuucuuucuauggcuugacaaauuaucccucuauaaauucuacucucacccagagcuguugcuguaaucaaaagauaacuguagauaaaguccaaccuucuccuguauccagcaaaagguuuuugcucauaugcaaaaaaaaucuaauuuuuaaauuauccuacaagugaauauacaacuuggauucauaagaaccuucuauuaucugcagcaacaagcugaucuggacagcagucuuucaaaaugagccccauaacucaaaaauagucagucaaucuaaaaaccugcaucauucuucccccuccccugaauuagcuacuaaaauguccuugaaaaguuaagacuugguuugaaaaugucguacauacaauggggauguaucagaucuacuauuugaucaucugauaaaacuugcauagcaagaugggauucaauaagccuuuuuuguuguugacaaucaucuggaagacuugaaaguuaacugcagaacuccucaaagcauuauucauuaaguaucauaaugucccugccauauggaaacagauguauaaaugaaucaggaaucugaauacugguauuaacaaacuaaggagaauuuaggggaagucgggcuuguuccaaaggcccauaauucuguaucucauugcuauuuaaacguuccuuccuuaaguuugauucacaaccacauugaauuccaaagaaaauuaacaggaccuaaacacuauccacugucuuaauacauacgcacuauggggagugcaaaaacaaaacauuguacucaaauuuaaugcuaaauuuauuauugcugauaacuuaauaguuauugccauuugcaauuagaaaguccaaguuacaaauuagaguuuagaacucugacuacagaaaaccuauucaaggguacacuucagucucuuuccuguauaaccuuggucaauaguaagagcuuaucgcaacuuauugccuuucuauuguuuuuaaaauauaaccuauuucgcuuuuuucucuuuuuuucuuuuuucuuuuuuuuuucuuuuuuucuuuuuuuuuuuuuuuuccuuuuucuuaaggaauccauucauguuggaagcccagauucccuaacauaugcacuagugguuggcucugggaaguaacagucaccagagucuggaaguucuucgcuugaacuugaguagccacuguacuauuggaagccagauggccagguauuggcaauggccagggaaaucccaagcuggcucaagagccagugguuagggaagaagaaggucaaguggacugguaaaaauucuacuucaacugcccuuauucauagauacaacuuuccuaacagucucacucuccaccagucccauauccacaacccacucacaggcuucaagcagcaggaccuugccauauuacccuaaaucuccauauugcagcagcucuacccuguccccucagcuucuucaauaaugaccuuuuuuaaaauucucuucccugacugcuauauuuacacauaaauuucuuaguguuacugaagcuucagagcugcugccuauaugcuauaaugcaacaaaaauagccuugagggccaaauauaaauaugauuucaagaucuaccacaguccuagaaaauaaacuuuaugggcugugaaugguaccaugaggguuucucaagaaccauaucugguucccuauauucagguaaccaugaguuugugcuuugggaagaaugcagagggcuauaaaaauucaugaggcuuauuuaagccuugccuucuuuaaaacauuucauuuuuauuuuaguguucaguucggguucuagucuuagcagugucuuaugguuacaaucuacucuucuguuuccucaacaaguugcaaauaacacaaacuucucacaaaaaugauuuaaaaaugacucuggaaaaaaauuaaucugaauugcaaguaaauguguuuguguagcucaggauuaauggguuucugcuucucccccacaucagagcucuccucuagcaaacccaaugacgagcccaaagggcuuccgcaucaucucuguugcaucaagaagccaagaugcuucuccugauaaugucuguccuucugcugauagugcugcugguguguauacauuucuuuucugaugccucacucucugagucacucauuuccacaucggggacauacccgucauucucauugucggauuuuaauuugcuuuuugcccuuuccuuggcuggaacucggccuaagcccaaauauggguagucugagugcugguggcaggccccaucgugggccucucccugcugcugccguucccccuucuuuggaauccggaauccuccccaguuuuucacugggcuggcagguguuguaggcacuuugacugcagucugauuauaguuuacuuugauuagggagccauugcacuugggcacuaucuccuuccuugugccaggugcugacugccccacuccaggggagguggcagcucuuguguuguccagaugccucugggacacaucuguggaccugagaggcuugugacucuguuuaaaagauuuguccuuuaagucuccuuuaaugagaucacaaugaaaacgauugucucuucuuuucccauggucuggcaucaccacaccauuuuucuguugugcugauaugagacgugcuucugcaaaggucuuuucuaaacccaaaaagcucucugggaccaccauccccucccuucuaccacacaggucuggcugcuucagcaggguuuugccuucacuuccagggcuauucugcaaaggaucucgcuuauggggcuuuuucagcgaaugaaccaaggaaguacccauuuguuuucugaagaaugcagaaugccacuucaaguccucuaucuugggagcaucagggccaacagaaggacuguuaaacaaaagcauguuuuccagugaggaggaggagcaggaagaaggcacaccuauaaacauaaaaccacaaauaaagaaaaauuacagcagaagcaaauccaaaagaauaaaauucuacacccuuaguguggcccaauugaugugaacuccccacccaacaacacaacacuuacaccaccaaguuuguacaaauuugguuuuuauagugaagagaugaccugccuugagaaucuccauucaaucugcagacucaauaugccacauuuucuaaaacagcugaagcucacauaauuuuucauaaaacuagaccuccuccaaacaaaauaacugaucugauuuucagagcggacuccaugcagaacucaucagguggcugauggcugccucugcucccucuaccugguuacagagcagcaccugcgccgcgcuccuccacgguccagucuucugccucccguacgagacugagaggacccaaaaagcagggcucggggcuuguaaguuucucuaugugucuguacccucacagggcuauuacgaggacaaguacauguaaacaugugaaugaauaaaggaaaugugugaaauaauucuugacacauaguaagcguuccaaaaauguucauuauuauuaugugcaaaauacauuugugggauucaacugaauugucauucaacuugaaguaaguuaaauugauguuuuucguauuuuuugaugcaaaucacagugacuaaauuccacagcaugaccuaguaagaguucacauuucacgaaauaauauuaacccucaucauuugauaauguacucugacauuuccuauuauacuuuacuuguuuuuaauacuggucaugacccacugaauucaucucacaacccacuaaugaguuguuaccccuagcaggugaauucauaacacauuaguguuugucauaaagaccaugauucuacaacagccucaagaucaucuagaaagagcaguucucauguuuucugucucccauaagauaugagccaccaagaaaacaagguucagcccccagguuaugagacaggaggccauaugagaaccuagugcucaccagacacagacacugcaagcaaaugaaacauagcuagcgacucagaacacagagcugucaugaccacaggagguguuuuacaaccugcugguuuggaaaugcugcuuucucaagaaucaaucauuagaaucaaccuucacaucacacugcauauauuucuuuuacucaaucaccugccacaggaaaagagaaugguaagaagaggcuaacauuuucugaacucugauuucuaucuccuugacuguaauccaugucucuaaagagccuccaacucaugacccucccaccccccauaagcacuguugccacugaggacacucucagcaaaugacccuacccacucucagaaucacagaguuuaaaccauggacccuaaaugacauauaaaucaugaccaucugcucuacuucaggcaggagacagccuuuaggcaugaauaagaacacgacugaagccuaggacuggaaaaagaaaaaaagcacccuaaaggguuucaacugcauuacucaacagaauccuacaggaagauaaauguuuucaacugaucauaccuaugguucuuacaucagaaugaaaggaagauuuguuuuccuuuucugaaauaguaggacuucugaaugcagaucuacauuacagcucuguuaccacaaaauaacucccagacuuauuaagaauaucauucgcucacccaguaaaaaccucagccaugaaaugcaaaaaccugccugcaauauccaugagaaauaacucaaaugaaaccagaugaaaaugcucuuuacggcuuauuuuuacagggaaucacucauuacauaaugaccuaagaguugcagaaagcccuccaauggcacaacuccacaggcacaacuuguauuagugaucccagcucagcauuugcugcuguaggcucggugaucugcaccagacagucuuccaaggcaguuaaacagaucucauuuauuuguauucagguaggaaucaugaagagagagcucaccuuagggaaucugaaucgaccuacuuuuacauaugacacccuacuuagaaaauuuauuuuuaaaaucuuaacaauuaaacugcaaguuccagcuaaugauauacacuugauucaccuggaaaauacuuaaucuugggaagaaaauaucuaggauaucaacaaguuauugcauucaaacuauguaacacuucaagaacauuauuuaaaccucccuaaaccuuuuuuuauuucuucagaugaccgagcucccucuagucgcacauaauugguuagauaaaccagaauuuggauuucaacacaacagguuauaacaacuucuuuguucucugugcaccauaauaaucuagauggagugacaaaaagccacaaaugcacaaaaacaagagugaaucaacuaugauugcacaacgcaagcaccaagaauggugcagcuagaacuuuaaagggcaguccaaggcaggagagaggcugacuaucuuccaaugaaguccagucuaagaccuaccuguuccaugggucccuaauucugccugauccacacucagcagcucugcuucucugaaauccuuauacuaccuacuuuugggggcuuaugaucacagaauauagggcucaaaugcacuuaaggggucuugauucuaaaacaaacuuuaagaucaacggaaucucagagagguuaaacaaccugcccaacuugaucuuugcccuugaucucccaaguaacugauguguuguccagaguagaggaaguauauacccuaguuuucuuuuucuguuugccuagcccagggcaauauaaaauagaagacacuaaauaaauauuuggugcucaaucucagaaauagucaacaauccaucuacacaaaaaaaaucuacugugaacauuaucuaaaaauggacugugucuuaaguacagucuuaacauauauugaccauauuuaccauguuacagauagagcccaaggcugaauauaaaccuguuagguauccccaugauguguuuaccaaguacuguguaauauauaagucacuguuucauuuuagucucucaauuccaagagguagcuugcgauaucuccauuuugcacaugaagaaauuagggagacucaaaagacuuucauguguuugcucaguaagcagagaacacaggauuccacccauauuuauagagggcaaauucauagcuuuuucccuuaaacaugaugccucaaauuaaagacuuccuuuaaauaugaacgucuaugcuucuuaaauucuucuauaagaaaauuaagaaaugauuauuucuuccucaacaguguuaaagcuuacaaaccccugcccuauacuuugaccuaccagggcuuaaugcauaccugaaacucuuucuugcuccaaaagcuuaguguaaagauugaauaucuguuccuggacuuugcacacagaccguuuaaucuuuucccugcgggucaccauguaagugagguuccgaaccuagaauguagagaauaaagauucuaaguaagcaauacaguauaacaguacuuuggugcuuuuuaaauuucuuuaccuaagagaaauuacuccuacuagggccuugacagauacuugaaaucaauagguacuuuaaacauuuuauccaaucucugaucuccuuuugggcagauaagaaggauuccacauauagcccucaacauaggcagaagcaacaucgaagaggguuagggacccacaggagugggagggacaccuagagaacuccuacaaaaguccugccuccuccaucacaccuaacccaucccggcacagaggccauugguguccaagucaaaacuugcaaccucuugccagucgacuuugcuaauuauugcaucaauaucuucuauuacuuggauggccaauggcuuuaaagcaguucagaagccacuucugcacuuuaucaacuaucuucugaggcugaacuggguaaacauggggccaagggucaucaaaguggagcccccugcaccaggcccacuggaagaccaaaugguuaccaagaauccuaguaaaugucuuugucaacugcacacugaacucacugaaaggccuggaguuagcagguagcuuauguguugcuaugaggugugcgaaugccuaggaaauuuccagcuuugccaaugauuugcugguuagacaucuccaguccaguucucugcaucaucacuugaaaaacugguauugcccucucccgauucgcuuguaacugaaaagacccagugcuaagaguuggcucuacuuccuaucugaugugugacugcuuuggaucacauaacccuaaccuaugcucaguaaucaacauuuagauuuguuccccaccugucaucacucaauacacaaaacuuaaagaauuagucucuaaacuccccuaauccuucaguccuaaaaucuucuauuggucaaccugauuagauuacacggaccugcaaacacagaugucagacacagcacaccaaauacacaauuaaacccuucuucaggaauauguggacaagaccuccuaaguaaucucaguggcaggagugguagcaucuuuaucugaccacaucuuucccauuagcuccuacaggcaugccuucacuuuccuaaaaauaucccauuaugagcaaacucuuccccugacaccuuuauaauuuuuuccccauaaacucaauaaaguaguaucacccuacuuuaaguggaaaaaguccaaaggucaccaaccuuuucuuuuggcagugaggacagcaacaagcaucaacaagccuugugaagacacaaaagauuuugcacucugguguagagcguaaguguagacuaaacccuaauaauuccagcugugcugaaggcagucucauuugcaagaggacaugaagcauuaagagagacagaacacaggcuuucacauuugcauuaugguaauaucuccuggccuaaacaggaaaaugccaagucaggcuucuccugccccuaacaaauucacuuuacggaucuucccaucuuuuuuucucuaacaaucccuuaugucacuaacauuuccugucuuauuuuaaauuuaaagaauugagaauaaaaacacucucccugucucauaguaaauauuacauggaugucaaucagccuaguuaagguaguuucuucccuucucugacagcugcacacccucaauccaagaagcagguguccuuuauagaaauucucaccaacuugggaauggaaguggcuaacauccuccucucuucgauauuguuccacccaggggaaauuaagagugaagcucaagaacgaggggccagaccuagauccauagcagauucaaaacuucuaggaaacagaaccauuuuuacauuaacaaggaaucugacuccuggaaauaaaaaauggaaacaaauccugacaucuuaggagcagacagguugcucucauauucaaaucagacauguaauagaaauacuuacaucucucuuacuugaaauuauccuuaaaaauggaaaacggggaagccagggaauuugaacuuuguauauuauucaaauuuaauuuugguagcuuugaccacaccauggcugcuaaauagaaaaaucccacugcuauuccucaugaucucugaugggaaauaucuaaauguaaacccaaaaagcaaagggcaugguuuucaaucggaacaaaucagcccugaccaacuccacuuuauaguagugaggacucuaaaccugacuucccuuaugcauaaaguucccuauaggacaacgcucagcaaccuccaccugcagagcuggacugaugcucucccauccucaaaacacauccagcuugucccuucuuccugcacccguuccaccaagcucccuccccugcuuuaucuucucccaacugccugcaaggagguaucuuaaaaaacauuuaaaccaucuccaggugcacucucacaccaccuuaaaccugaucaucccuuuccccuaaagcaguguucccaaacagaaacaugggguacccacaaaacagaaccacccuuuggagguggggcccaugaaucugcauuccuaaguuucugggucagggacaacacccugagauacacugcucuaagacaucuaaaagugguuucaguguuuucuugaauccaaaacuguuugcagcacuaaaguugaacgugccuuuuguucaggggacacuguagccacuaccagauuuucaaaggugaccauuccacugagugacuacaggacugcccccaggacuuggccacuuuccauaacgcuagccagagugcagugguagcacgucuuuaucugaauaaauacucauuugcugaacucacauuuacugcaucuuuuaggggaaaggaaugagagugaaguggcagccuugggaaugacauggcuacccaccacaucagcaacugugucuucuuaaaguugugugcucccaagcccuccugaaaucuacuccugucaccuaacuuccagauccagaacugguacccagguaugcaaugccccgaggugugugucugaaggaagagcagucaccauaauuacucaguugucugcauuucuaaugauggcuacuuauuugucagucugagaaugaucauaugccuugauuguagucacagguauuaaaugauuuuugaggaucugcuauaaacugauauugugugaauuaaacagaaaacuaacuuacuugagaaaacaaguugguaguaaugauugguuuuuuauugucaccccugcccugauacacuuacuguuuauaauuacaaauaacugcaacucucugggcaaggcaaagauuucaauuguuuaaugccuucaccaucacaggcaucauggcaaauuuuggguagcguauuuuuuuucauuacaauaagcccauuuuaaacugagucuaaggcuggguacaguggcguaaucccaacacucugggaggccaagacagguagaucacuugaggucaggaguucaagaccaaccugaccaacauggugaaaccgucucuacuaaaaauacaaaaauuagccaggcaugguggcgcacgccuguaaucccagcuacucaugagaccgaggcaggagaaucacuugaacccgggaggcggaggcugcagugagccgagaucacgccacugcacuccagccugggcaacaaagugagacucugucuugaaaaaauaaaaauaaacugaauacaaauucuuuaaaguuccuuaggcuuuuuaauaaaguaaauguaaguaaugccacacacauacacacacaaauccugauuuauucccuguuucucauacaucguuggcauuguucuacuuaaacagcgacagugaugacuccaaaaaaaauguuuagaauuagaagugcauguuaaucugaguaacuuaaguacagaaaagaguuaguacaccacaagcauuuucuacacuuuuauuuuguggugauugugagacaaacacaguccaaacaauagacuucuuguccucccccucccaacaacuaucugacuccauagcucaugcaccccaauuacagcaggugucgggcuggcauaaaggcuucuuaccaggauuccaguuuauccuucucaauccuuuucucaucucuaacaaaaaugccacacauacauguaguugugagaggcaaagucuucuuuacacucaccaccagggggcguaugggagcacaaaagccucacaaaacugcuccaggauccugccucuuccagggccggaauccgcggccuucccaggaauccuaaccuggucugggaaggggcaucacaaauaagcuggcacucagucguguauuaaaaggaucucuaaugcucccuuuaagacuuucacuucuacgccaucucuaacagggccaugcaggucuccaugagaucaggcuuuuuugguccaguguuucccaggucuuucccuacacuguuucaggccacuuggguaccuuucagugcagacugcuucaggccagaaaaccucacucccaccucuuucacacuaaugaauuuaaucgguagccagcagccaggggaguugauguggaagaugcucuaagaagcauccccaauuagcaagccucagccagaaacuaccuacagggagcaggaggcccuagcgggaggcagcccacgccucauuauuccuguagcaggaagggacguccagacgggacuccagaggugauggaaagugggggaggcacaaaagcagcaaacagcagaaggaaaugccagcagcugaggcucggcagccaacagccacgacauucagcaaucucagugugacaaacaacacaucuguagcgugcugagcaugacuggggcuccucagacagaucugacaccccuguccaccaggaaucccacccauacccgcacacagacacacaacagagacauggauggacacgggcacgcgcacacacacacacacacacagccucagugaugacuuagcaccucacugccaggaguaucuucuguaacagauauaugcauguguacauacagcucaugcacacacaucagcacccacugccugcucugcuccaugacaguacugggaauuccccugugaauuacccaagaaacaaagugggggccagugagcagccgugcuuagcuuccuucauaagcccaucaccagcaccuagguguguuuccccggacugaacaagaaauuuucccaucucuggcccccuccauuagaaaugaaauccguucugguuuucuaaaucagucuguaaaccauccugagucaacuccuugggucauuuucuuggggcucauucacucuagcucuagaaugaaggaauggggguggggaagacacaccccauuugaucuuacaaaacaguaaagauuaaugggaaaguguuuuuaaaaaaaaaaaaaccacaaagaagcuccccacucaguagcaguuuugcacauauguacaaugaguuuaccagcccauaaauauuuuuaaccaacacaaccucaugcugugguguguacaagggucugagaguauaugacuggcuaucauuucuugcucugggcgagcguucgccucuuugcaucuucuucucuaagucacuauaaggugucagugucaaucauuacccucuccagguccugccgcaggugcgugaacagcugcagccuccuaaauaagacauccugcucccgcuuggcuagauuguccucuucaucuuucuuuggggugaucaggggcuuguugaaguugaccuuccucuucaacuuccaguacugguacaggaaauccacuacuuccucaggcagccgcagagcccuggcaacauccagcagguugacgaagguguagaacucauccuccaacugcugcagcuucugcuuacggacacucacccggugggccuccucccgguucugcucaaggcuggcaaagggcuccagcggauuccggggggaacacucaggggccccauucuccugugcagcccccuugccaagacucuccucggguuuccuaugugagcugugcuuugggcaauaggacuugaacuugacuucaucauucucugcuaagauggucuucaucuccaggccccggucaaaagcacaggucacauggaaggcugugcggcaguucuucacagagcacugucaagaacacacaaagaacaugagaauagaccauuauagagcaaugauggcagaaggccugcagugcuaggcaccccauguacacaugcacagagaagagccaugcuucaagcaugugccaugacaggaaaguuguacguggauuaacccugcaagauccugucauguuuuaaaagagguaaggcuuggaauuuuuuuuauagagaugaggucucccuauguugccuaaguuggucuccaacucuugggcaaaagagauccgcccaucucagccucccaaagugcugggauuacaggcgugagccacugcgcccagccaagucuuggaauuuaagggcccucuucaaaugaaagguuuaaucaaccaaacccuaacuuccucagaaaaguaacugcauccaaaucccaucuuggagcagacaugauuacacaaaugacauguguagagaaaggagguguggcacuaggaucauauucaaaagaaucuguacucaauaugcaaaguccacuuucaggcauuaacuuggguuuucuuacagauuugagcucuuuuggugcaaaccugaauaagaaccuccuugggaagaaugacuacuacucacaguuugaacauaaauccugacuccccagccaggaagagucccaacacgagugagaaaaugaacagugcacuuccuugaagcagcacgaaggagaaacugaauaaaaaccccaaaaaauaggagacaagaggaauccagcacaggaaagguagggaaaggucuucacacuugcgaagaagcuucaccagaugcauggagggcucugagcccugagaucggugcacgccgauccuggccacugaagagaggcaggagaaccgugaaagauccuucccaugcgucacagggaggucaacguagaggccagguaucagcaaccuaugcagaagaacacuuccccucucacugccuaaacagggccacaauuuagugccuuugauccagacaacaagccucuggucuagcaggagcaaagugauuaacuccuccuccacugaucuugcugagcaaaucccuagaaggugguuccucauggugacugaagccagucccugaaaagcagcacugcauugugugaagccaagugaucaccggggcaugccaggggcugcacagagcuguagaauccagcggcuucaagccaacugagaaguugaauucaacucauucaacagauccugaaucacaucaccaaggauggcagaggcuagagcugaggcuuucccccuaaucauuccaguauuuaagaggaaacucacugccaaccaggcuuucuuccauuacuaugaggucucuuuuacugagaagaggagaaaauccagcucccuucaccauuccacccuuacaaacacuucaaccacagagacugacauaaaucuguauuuucucuauaaauaaccucaauucuaagaaauguaugaaaucagcuuugguggcagaacacacacacaagcacgcacacauacacaccuggccacugucaugagaagacaaagugucuucccuuguagcacacagccaagugggaaguaaaagugggaacagaugacugagacacuaucuguguuuggcuuaaacuacacuuaacccaagcgcucuaacccuaaagagaaaugaacugcagcagaauauuuauacaggacuuuguaaaaacgccaaauggccuuccucuggguuuucccauucagguugacucagcaaacagauguuacagaaacguaaaccagagccuucacagcugcagacauuucagagaggaauucuuuuaauaaaaucaauccauucugugaagauaugaaaaaucaucagccuucuuuggccucuucuuuagauuaauguucugggaaaaagaggucaauggcaacaaaaaagucauuauaucaucucucuucaaaagggaaacaaagaucccauucgcccaccucuuuuaaacauuaauuauggaccagauuggcauacucaggcaagggcauaaauucuacgcucagaacaccggggaauguggucugcugcagccuguuuccugccagugcacacgugcauacacauacuuacacacucauacacaugcacacucacacauacacgcauacucacacacauacacauauacacgcaugcauacacacauacacaagcauacucacacgcauacacacauacacaugcauacucacaugcauacucaugugcauacucacgcacucacgcgcauacacacaugcauacauaugcacacaugcauacacacgcauacgcacucacgcaugcauacucacacacauacacauucacacacgcauacucaaauacgcauacaugcauacagcauacauaugcauaaccaaauacacaugcauacacacauacacauaaccacaugcacacucacacccccacacaugcacacauaugcaugcucacccacauacgcauacucacacacacacccauacacacacacucacacaugcauacacacacacacucaaguucaucagcucccugcccuuuucucuuccugcuccacucuuuccuccuccuuccccaauccaacucgggccagaggcguuugucauguauucacaugccaaaaauaucuccacuauuucaagguccccagccaaaucccaccagcugucucaugacccacccuccaaauauuucuguuauauuuuggauucuugaacacuagucaaagugauaaagaagaaaaguagaaccacuuggcuuguuaaaaaaauuuaaaaauagccaggcgcgguggcucaagccuguaaucccagcauuuugggaggccgagguggguggaucacgaggucaggaguucgagaccagccuggccaacauggugaaacccccaucucuacuaaaaauacaaaaaugagaauuagccgggcuugcuggugcgcgccuguaauccuagcuacuuaggaggcugaggcaggagaaucgccugaacccgggaggcggagguugcagugagccgagaugaugccacugcacuccagcuugggcgacagagugagacucugucucaaaaaaaaaaaaaaaaauuuuaaaaccaccuucccaaaaaguauuuaucagucaaaauacaaaccgacuuugccaaaugaggucauuucuuuaaaacccauggcugacaggaugaccaugcucucggagcuuaugucugugcugagcugcuuugagaaagaagccaucccaaaacagugccucugcucccagaauucaaugaggaaaccaaggaagaagagccuguggccugugcuaguacauccgagaagauccaaacuuaaccugaagggcccccaucagccacacagcacugcaggccucucuaauccugacugucuagaugucaauaaugugaggccuaaaaacgaacuucucaguagggucuuagaccacaugaaaaacagcaugccaucuauauucccuccuuaauuccccuaucucaugacauccuauacuugucuguaccuggauaugcaaaagcaggcaggcaacauguuuacacacaggugugcacgcacucuuucgcucacgcucacacacacacacacgugcaugcgcgccuggugccauaaagaaucagacauccaaaugaugccccaaugagaugacagcauacacaggaacuccucacagaugccccucuacccaggccguguucaaagagucucuguuuuuccaacugcaaaugcauuagcauguccccuugauuacuaacagaugugcgcacaccauggaaaccugcaaucucaggaggccgccacagaggugggccagggucugcagcuacacucagugacugcaggugggaggguggccaacucucaaaugccgugucaaggaacaucucacuaagacugcuaggagguguuggccuauggaaagaaguugcgaugcuagacuuugggcagaaaggguagcgagagacaaacugcaaccgccucacagcucaggggaacuucugaacuacccugugacugugaaagcuuggguucuaguuacaccggauacaguuagccuauuaaagguguguguacuggggcuggagucaccccuugggaaccucguccugcuuccuggauucuaguccccucuccaaacccuuggacaguucacagagccuucccucauccugcuccccaccacgcaggaaaggaaaaugaagccauucuuaggaagcuaauuaccuguauagaggccccaaacuucucauugcagaggcugcacacuagcgcccaccggcugcugggaaugugugacaccuuggugaugggcuccaucuucucugggcugccaaugcucaccuaaaggucggaaaacagcaagacaggguggcucaggucgucaaaggcugaacaugaaugucagaaacuaaaagauccauuacuuuccuacaucucuccuaccagacaguggcaaggggcacccacucaaagcaaacccuuacuuuaaaagccucagaacagccccagugacaacugagcucacagcccaguccccaucugacagacaucccugucugucaaaaacacuuagauaacugaguuuucacuucucaccggagcgucugaugacaaagagucauguaccaggacaaugccgucuauaaucucuagcucauaacaaauuggugaagacuaaaaauccaucuuaaaucgauucaaauagguugucaacaacaggguaaguaaauauaaccuguuuuuaaucucucgccaaaaaaaaccauuuucuucagucugaaacaugacuacauucaagaugggaaauuacaaagauaaauaagguaucaucucugcauucagccuggaucaccgaauuguaucccaucaauaccaaaccacgagacucagugcuaccaagacccgaaucaugaaaccucaauccaaaucauccucaaauaauauuccccaagaggaaaauguaccaaaaucacacccaaaacaugcuggaauuugaauagcaaauuauauucucacacugagcuaugcaaauuauauuagucaaggucugagacuagaaauaaauuagaccagaccugaaauuaaaaagguugaggcacaauaagaguuuaaauaaaaaucaccaaaguaugccuaagaguggugguuuuuuaaccaugguggugccucaacucaaguacagcuugccacacacaggauguacagcugauccuuggggaaugacacacccaggccacagcuguuuaagugcuacaggucugcuccugagagugagagucgcgaugggaaggcucacugugauggcugggugaccaccacuaacuuccagucccaagugacugcugcuuccagcuaacauuuccaugaaucuacauuccaugacaagaugagagugugcuuaagauucaguuuuuccucaaggaaaaagguagcaacuaaaagguaucuuuuuacucauagcugcaaugcugccuauuuaugcaugguucuccacccacccacuaaaucccaguuaaaagccaggaccuucugagcuaaggugcuauuaaaaaccaugcuugaccaggcacaguggcucacgcuuguaaucccaacacuuuggaaagccaaggaaagaggacugcuugaucccaggaguuugagaccagccaggucaacaaagugagauccccucacuacaaaaaauaaaaaauaagcugggccugguagcacaugccuauaaucucagcuacucaaaaggcugaggugggaggaucacuugagcccagcaggucaaggcugcagugagccaugauccagcucacugcacuccagccugggcgacagaguuaaacucugucuuaaaaaaaaguaaaaacaacaaaaaaagaaccacacguaccucagggauccacagagcacagcuaacguggacccacuugguuccgcuacgggugggcuucauagcuccacccuucuucggacacagcagacauuuuggcugaacccccagggcacauguccggcacagccagcugcccucugguaccuugaggauuccauaacaggccugugaugccacggcacaucccagaggaauagagagaaagagaaaauguuauuuuucccauuauaucuauucauuuuaaacacuuagaaagauuuuaacagaacuaccaccaaagcagagacgcucccacagcuuccuggcuacgaccgucuccccucgggaaaaugcccggcagccucacaggagcauuuaggaggugaauauguauucauaauagaggugagcucugcugacacaauacauauuuauuuagcagagggugguccuggaaacuacuugaggacagaaagguuuaaaugaaaucugcuuugcuguguugccgcagaaacccauccauaccaaguuucuaaauauugagcaguaaguccucaguaaguccucgaaacacuccacaggguuccgugagagaagcuauuucucuacuuuacugacagaggugggguggaauacagaguguggagaaaaagcauacagcagcugagagaaucucccaaagcugcugaaugagauggcaauggaacaggagagaagcaugcacacucccuaggcuaagcaaacuccauaccaacuagaucccagcacucucccagugaacaaaacagggcagaaaaaggagaccuucuacacaggaagaaugucgucuccuuagcugguauuuaaaacaaauucagccuuucagaaauggagacaaaaaaaacaauuuaaauuaaaaaauaaaacaaagccuguuuuguacaagauggcaaaauuaaacaagauggcauaaacugcagaaaucaaggcuauuacaacuaaaguaauuaagacaguucaaagacagaaaagguuaauguuaaauaacugaauaaauaaaaaccacgaugguaccaggagcauauucagagagcccuuuaaaaacccaacuguucagcacuuuauucauaaaugaccuggaagucaggaagucgagagucacaguagcauagcucuaauucuucagacagaaaaaacacagccacuaugcaaucugaauacccacgacgaugcaaagaggaaaccacaaggaugagaguugagcaaagaaaagucacacuucagauggaagccucagagugcuguuugggggccauaaauaagcuaccgucaacgcagacuuacuagaaaaaaauuuuuaauggaguuaagugacacuauaaagguuucaaaacacuaaaggucuguaucagacauucuacagccacaugugaaggaagaaauuuuuuuccuggaaaagcaggucuaaauuaauuuaggagauuacauaaaguaugccuuaaagauaagccaugaaggauuucucaaaggaaaaaugaaguaaauguugaggaaaagagaaaaggugauauggcagaaagaagagaaggugagaagggggcauccaaaagccuuaaguuacaacucugccacacguccaccgugagagcuugcacaagccugcccugacaucaguuaacucacugauaacacagggguugaccaguuuucaagcagaaagcuuuuacucaaaaaaauuuuucauggggaaaaaaauagcaaguaaagacaagaaaaagacugagaagucagccaaguaaauacaugaagcaccagcaaccaaaaaagcaacacuggucaucaggaugcucaugucacagaacaaagccaccacaggaauucucacuaccguaaggagacuucccagacagugugagauccagagcaacagacggcgaugacugaagcaggagucgcaggucucccuaucaaggagccaggacugggccacagcuggggaggucuucagacagagggaaagccuaggaggucacaaauuaugaagcaaaggguaaucaagaacuucauggagcaaacgugcuucuucuucccaagaagucaccaagcaccuauuccauacaagucuuucuuuuaaguuugcuuuaaaucucagcaucaacaggugaauuuaaagaaaguacuucaggauagccuuuuaaauccuaagaauauacgugggcacauguccccacccaaauccaaauuucuucauuacugcauuaaaaacuaaauaaaaaagaggcacugagauugucauaaacuuuuuaaguuaccuagcgcccauccuccugaaaucuaaggguuucccuuucuguggaugguagcaagcaaucaccaaaaccuacuguccuguuuuuuaagacaggaaaucgucuucaggaaaaggggcugcuuuccucuaacagcucagcuuauacccuaacacaugcucacaaauaugacggcaaauuguguccucuaaaagacauguugaaguccuaacuccaaauaucucaaaaugugaccuucuuuagauuuagaaguagucauugcagauguaauuauuuaagaugagcucacucugaaguagggugggucucuagucccauacgacugguacccuucuaagaagaccgccauguggaccgggcacggugccucacaccuguaaucccagcacuuuggaaggccaaggugggcggaucaugaggucaggaguucgagaccagccuggccaacauagugaaaccccaucucuagccaggugugguggcacacuccugcagucccagcuacucgggaggcggaggaggaagaaucacuugaacccaggaggcggagguugcagugagccaagaccacgccauugcacuccagccaucucaaaaaaaaaaaaaaagaagaccaccaugugaagacagagacacagggagaacacacaugaugaugaaggcagccgcgagccaaggaaugcccaagauugcccaaaucaccauaagcuacgaagaggcaaggaagggcucuccugcauguuucagaggaagcacagcacugccaccaccucaauucuggacuuuuaguuuccagaaccacaagacaauacauuuuuguuguuuuaagcacacacagucuguaguaauuugucuguuccacagggcagcuguaagaaacuaauacagcacacuaaccaccuuuucaaagguuuguuuucucaguguucuuaauaccuaaauuuaaguguuacaguaggacagagggggcucauacauucuuuuuaaguaaacuugacuuuuauggauaagaauaaaacacugugaagaaagacgauuuccacagagggugcuauccuucuggcugcaaaagcagaggauauauuucaaucacuguaagaaccuacuagggaaaaauaaagucuauagggcacauuucuuuaaaucguagaaacacagaccccauucggaggaagaauccuggacuccaggcauacacucccacagcagacaggcucaugccccagguuucuucuuucuggccucccugccccacauaccuggugcacacagauguugcauuugucacagaacaccaucucauugccguccucaccaucaggagacuggcagacaucacagacaacaucuucaucauauucgauccccaggccuuccucagucucuauggcaugauucauauugucguagcaucgcugcucaaauuccucuaggacccucuccaugguguauucaucuaguucaggcauuccugaaguuaaaaaugccacaaaacccauuuuaauaaauccauauuaauaaauauuacaaaauaguacugguuuauuuauacuuaaaaauaauguauaaugaauaaauaauuguacaauaaauaaauccaaucacuggccaggcgugguggcucacaucugagcccaagagcucaaggucagccugggcaauauaguggaaccccaucucuacaaaaaauaugaaaauuagccagacgugguggcacacaccuguagucccaacuacucaagagccugcggugggagaacugcuugagcccaggagguuggggcuauagugagccaugacugugccacugugauccaggcugagugacauaagaccgugucucaaucuaucaaucaaucaacccaucgaugcauccaucucugagggccccaaaauuuuuuauuaaaugcuuaucagauccuucuaagaaacaaucuucaaaggggagagucuuccaggaaacuguuauuuuccuauggucagguagugaagaugcaguguaguaaauggaaaagcaaaagguaaauuuuaaaaggauucaaggauauuaaauacauacauuguugaauaagucauuucauuauacucauuacacauaacaacuaacacguaagugacuucaaaaccaugacuucauauaaugguauggauguuuuuaaaaauuugccuuucuugguagguaaaacaguucucucaaaacagauuucacuuugggcacucaaauauuuuuaaaugguuuaucccuccucauccucuuacuucuacaagguugaaaaacauaguuaaccaaaugcaaaaaagacugaaacaccaggcgcgauggcucaugccuauaaucccaguacuuugcagguagaucauuugaggucaggaguucacgaccaaccuggccaauacggcgaaauccugucucuacuaaaaauacaaaaauuagccaggcaugguggcaggugccaauaaucccagcuacuugggaggcuggggcaggagaaucgcuugaacucaggagguagagguugcagucagccgagauugcaccccugcacuccagcaugggccacagagcgagacuucaucucaaaaaagaaagaaaaaaagaccaauaacagcuaagacaaacauauuuaagcaugcguuccguuuauguuauaaaauuacaaaauuaaucuugccaauguauucaacaguaucuucaaauauggauuagcccaguucuuauuauuuaaaccauucauaaaugcgaagagucuuugggcugaguccucugacuuaacacaggacaccuagauuccagucaaguguauuacacuggucuuuauaaugugcuuacaacacagcagaaacuguaucaucugugaagcuaaaauuuaguauucaauuccaaaagaucucugagaacuccugaacucaugccauaaaaccaccuuguggccugcuaauguuuuggccauuaauaccuaaagcaggaccaagaagaaggaagucuauuuugucuauaaaaacacuugaguaacugagcgaguagaagacaacaccaugcucagcucagucuacauuaucacucccauucaacagguggugagccuaauggcaggacaagcaucuacugcaagccacacccuaugcuacguucccuggaaagacgcaaaaggucuuggcccuucaaggcugugaaauccaccaugacaaaaaucuugugauuuuuuuuuuuuuuugagauggagucuggcucuguugcccaggugggaaugcaguggcacaaucccggcucaaggaaaccuccacccccucaagugacuugagaagaaucaccucaagugauucuucugccucagccuccugaguggcugggaccacagauacccaccacgacgccuagcuaauuuuuguauuuuuaguagagacgggguuucaccauguuugccaggcuggucuugaaguccugaccucaggugaucugcccaccuuggcuucccaaagugcugggauuacagacaugagccaacaagcccggccgaucuugugauuauuuacuauguccuagauuacaauacauggcccuugccaccaccuccccaccguguaccuacagcacaaaagcuaauuaauccucacaguuuuucacacugagcccagacuugacuccacugucuuguucaucaagacccucaaggcaacccuuagcaaucaggacuggcaugugagaugagaccuauacgccaucccagucucaacaccaugagaugcuccaacgucuacauacgcuaaaaugagcuugcagaaaagagguggagaagggcugggcacacagcuaaugucaggcuucacugaaggaaagccaggacagagauaaacggagggaaaaagaacuccagguuugcagcaugacauaaggaaaaucgcucaaguuaaaacacacaugaugugcuuggaaauggggagcaugccuggaagaguguucauuuagagaagcagcaaaccacggcuaaagaaggaauccgaauggcaucacaggaaaaaaacacuagagcagguaacugugggccaugcccuuuugucacuucguuucccuggacuucagcuuccuuaagguaagugaaugagggaguuagaucagagcggggaugggaaucccuggugccugagccgaggagccuugcuuccacucugaaaccaucucagcacaucugacacagccaaacaggcugagaucuaaggcagggcugcgauucucacugacuaaagcuaugauggagcugccugcaacuggcaauaaggagcuuucugcuacucaccuaccugccuaaaaugucucuauucaucauugguuaauaaaauaauagaauacauggucucucacccaucuccuuaaauucuucauuggucaguuccagccaugcagcauccaugucauugaggucauagcgacacacgcugucagccagcguccggauguccacauagcccaacucgggaggcucagagccugaugacacgauguacuucuugggccugaugaacaugagggauuucucuucagacacaacccuggauaauaaaaaaacaaggcagccagguuacccuuucagccacagacaaugaagugugccacaaggccccaaaugucuuccucuuccaacccuuagagccccaggucaucaccagaggcugaaaaccugaaugucacugcuaauaaaaccuuaacuagaaguuguuaaagccugcuaacaggcaauagauacaaaugaaaacacuguagaagccuucaaaaucugcuucccgggacccugcugugcccugcccaccaccucugaccacucuggccugcagccaacaccaaaacacacugacccauacauuucaagaguuagucauuaaaucacuuucccuuaaccagaccugcccaucccugcuggaggccauuagaaccagggcaccacacaggcagggcaggcgcagcagacucugagaaccagagggagaaacccgccaacccucacaccucacaaaaaaaaagagggagagagggaaaagaaaaucaggccuugggcuggggcaagguggcccaagccuguaaucccagcacuuugggaggccgaggcaggcggaucauuugaggucaggaguuugagaccagccuggccaacacagugaaaccccaucucuacuaaaaauacagaaauuagccagguaugauggcacacgccuguaaccccagcuacucgggaggcuggggcaggagaauugcuugaacccaggaggcggagguuguagugagccaagauugcaccacugcacuccagccugggcaacagagugagacugucucaaacgcaaacaaaaaaaaggaaauaagaccccggccauuaccaaaaaaucuaagaaacagagucccagccaagaaggggacugacucucccaacauauacccaugaucccaggaacaaaagcacaaguuucuccuccugguacugccacacaaucucucccgaccuuuaacaccuggaguggugccuuccaacucaccccacucaaaauaagacugcaugugcaagagcaaaucacucccgacuuggaaccaaaaaaaggccaucuuccuaaucacagaccccaggccucaacaaaguccuuccacauaugcauuuccacaguuuaaauuacugucaacaggcugcccagagucugucagaguaccuucaucacccuuauauuacgggagugauuuuaucuacgugacacugacauggacaaacugaagggauuuauuucuccuacucagccaagagcagggauccaacuugcucagggcuccaacuuuaauacagcuuguaaaacuuccacaagcuguauuaaugcucacuucuguccuggcuccccacugaaagugaagcauucagcaagugauuccuggacuggggcugccagugcugaaucaggugaugcugcaucucagacacaggcucugaggcagauaccuggucugccccgcagggccccaugaccacuccauuccacagguccagacucuagccugugggggccauccuggcacuccugacuggucaccuaaaccugaguaagacaggggcauuugucaccacuggauagacuccccagagaucccaaaaugacaacucaaauuugauaaucuuaagugcccaaaaaaagagacacaaagugggugagggccaggaagcaaguucaguaaugacucagcguggagaaagacacuauuucgcaaagcagcagccaacugaugauggcggagaagccaggugccggcugagcacagagggcacucaagccucccuccuaacaggacucuccagguggcacagaguggcacagugaggaaaugaguaaacuagcugcaaccugauugugaggagagucggcagggacucgacccugagggauccuuaaagauaagucaguaaauccagagaacguaccccaagaauaaugugaccagucaaaauaaaucccuccaaaacuccccucuccacaaacccuaacugacaggucuccuaacaccuguccuccuccaaaggcagaggcaaccgcaguaggcagagcagcugcccgcgcuaguucccaacaaagccagaugcuucucuccaggagagccacucuccagagcgaauacggagggcaggaaaagaggaugcagacgugugaacacccaaauuuuccuccccuagcccaucacuucccaggaugucuuggaauuugccuuccucucauaagaaagcagcaccuccccacagugguggcuguaauguuaaguuuggaggcucauggcccucaaaaccacuacccuguaugccugaaguauguugcuccugaauuucuauuuccacuugaggccucaugauauuuuaaugcuaacucagaaacugucucuucccacagaaauugucucuucucagaugccugcugucagggaagaagagcaaggguggguggagaggcuucuguccucagggcaucucuaccuggccacaggcugagggaugguccccgggcucacaggcaccuggaccccuuucucccauuccugucuccagggaucugccaacacauaguacucauccggauucagcugguaggagucaugcaacuucauggcagugaucaggucuguccuaaacaccuggaaaggaagagaaagggacacugacauuugauauuugcauucuuauucagagugcuggcagcugcaauguaaccauggagcugccauguaacaaggucacuguaucaacauagaacaagccugaccuauuacagaaaaacuuugccugacacgccuuuuaccucacucaggcaugggggguggcagugcugagggaacacugcccucucacucccucaguccauaguguccacaacaacgucaacaaaaacaacaaaaaaucuuguuguccgccucugaaaaaugucucucaguucaccaaaagggcugcugaaaacauguaccuggaaaucucugaagggagauacugcacucaagggugcucuagaaauauaacuccacuaaccauguaacaacuucaagccaaaacccagaaccaccagggacucaucuccuuuuuuuuuuuucugagauggaaucuugcucugucacccaggcuggagugcgguaacacagucuuggcucccugcaaccucugccucccagguucaagcuauccuccugccucagcacccccgaguagcugagauuacaggugcacgccaccacgcccagcuaauuuuuguguuuuuaguagaaacaggguuucaucauguuggccaggcuggucucaaaccauugaggucaggaccucaaaugaucuaccugccucggccacccaaagugcugggauuacaagcaugagccacugcuccuggccagggacucaccuucuauaaugagacugcccccacccaggcccuaccucccagggcaccaggguuuaugguaugguagcuggugaagucaaggucugggcuggccuagaaaaaucuggaagagaagcaaccacaggccacuggguugaugggccugcaaaaaacauguuugcacaccuucaccuggcaaaacuucuaccugggaagaguuauuuguggggaaaggaaauagagaaagucacuacccucuccccacucugccaaaaacaggcagauccaacagugccccucuaccgagagagcuccccaauuccuuaucacaggccaaaugaaggaaaccacaggaaaggcagccaucccagugccuaugccacugcagacuccugggccuguggcauucauccuuggucagugaggccugccccugggguggagcacaacaccgccucccagccagggcugcacagcuggcucccucucaagccucguccuuggcccacuggugucuaaggcugcauaagaaagcucugaccuugacaucaggaccagcccaaaguuguguuuggcaucgagcaagcuugcaucuguaagcugcccugucuguuuacacaagucacaaugcugaacucucuuuucucaggacagggaguucuuucuugugcuacuaagcacaguucacaucauacgccugcuaauagguccauauuuguuuuuccugguggcuuuucaggcuagugaucacuuuaauaaacuuccccauaauaaagucugaggcagugucugaauaaagaggccauuucuccugccugucauuuuccauacggacuauuccccaguaugccacucuucauuucuaaagaccuauuaacaagcaagaauuaggccaugcaccucccacaaaaaucacguguaauaccaggauccuucccuucaagcauagagccgcagaagcaggugcccagcccaguggacaccaacucccuggcccccaagagaaaaguacuuuaaaaccuaagagaugggccuauaccuucaagagccaaucagguaaaaacauauuccaacuaacugauauaaauaaaaaacaaaggaguuugccaaaaaagaaagaaaaucaaacugaagcaaugaaaugaaaaaaaggcagccugcuauuccuuugcucaaagacucagucaagaacugaaacaaaggcccucaaauggacgucaacucuggagucucugguagaguauguuagugccauacauauaguuuggacucaggguugagaaaaacaucuggaccaaaauguagggcugggacaaagccagcacagcaacccgugcugcugggcccccuucuccaugcuuggugucacugcuggaaguagguuucgaacuacaccacuggggaccagcccucgucacaccaggucacagcugcuaagucccccuuguauuccugugcugaaguaacaggaguuuagugugaacaucagaaagguauuuuggggguuacagacacagcacaaggaauuaagaaauaaagagcagcagagacacuccuuggcaaagaaaaggaagagagcacuaaagguucaaaggaaaaaaggccugaaauaaaguaaggggaagaaguggcuaccuucccaaguacauuugaucucaugcuaaagugccuccugggaugguuuuccacaauucuaaaggauguaaacuacuuccucauggaggaagcuauuccacaaccaaauaacuccuccacuccacagcagggcagccuucugacguucccuauuagagccugggaaguuccuccaaggaauaucugccuaugcauugccauuacaggaugaggcuguuugugaacucaucccauaagaagcagcacaaagcaaagcauucaaccaaagaaacucuuccuauaaccuucucacuugaaaacugugauaaaauaaaauguuuuucuucgaugauuuaaagccuagcaaaagucuuuagaauaaacagaccucaggucucauaaggaccccuaaacaaagaccagcagaaagaaaugcaccuaaaagcaacuuuagauagauagauaacaaaaguuagggagcagaggaaacauaagaugagaaacaaauugagaaagaauggggaaagccuucagcauaauccccuaaacaaaagucccagaguuuugcuuguugccaaauaagccacaaacccauggcuaaaacuaacuugaggcuggcagugacuuggcagcagcugaaccugcugauauccuggccagaggaagaaaaguuguugggagccagcgaagaugcaacaagaaaggaaaaaaagaauguaauuaauaauaauaacuaacauuuacugagcacuuuuuaugugccagcaacuauucacaugcuuugcauguauuagucuaugugaauuaacccacuuaauccucacaacaauccuaugagguagacacuuguguucuccccgucuuacagauuuggaaacuggagcacaaggauuugaauaauuugcccaggacugcacaaauagauaccacucaacuaggcauaugggauagcauauauucaugcacggucaggcaagcauucaagaaguaccucugaaggcuuucgaucuucaugucuggagcaggagcuucuccuaugcugggaucgggaauucugggaccaaguaguugacaggccuaaagaaacaaauauccaaauaagaaccauuagaaauugcaggggucacugaguguucucagggguuuucuuacccaaacucaucccaggcucaccucagcacugcaccaugagaccaccugugaugcccuccuggcucucacagagcucuuccacguccaucaguuauuuaacucucaccucucauaagcaggccuaaugugcucauucugugcagggaugcuguaucaaggaccacacccaacagaagagaggacuuuaagaacaccaugcagguguagucuucacccauaagccugcacugaagagguucaaagucucaugcugcuaaauacaaauugaaaaaauaucaggccagggguggcggcucacgccuguaaucccagcacuuugggaagccaaggcagguggaccaccugaggucaggaauucaagaccugccuggccaacuuggugaaaccccaccucuacuaaaacuacaaaaauuagcuucgcgugguggcaggcaccuguaaucccaccuacucggaaagccgaggcaggagaauugcuugaaccuaggaggcagaggcugaagugagccgagacugcgucacugcacuccagccugcgggacagagcaagacucugucaaaaaaaaaaaaagaaagaaagaaaagaaaagaaaaacaucuuacugaguuuucaggaagcuuucuaaaacacuguuuuaaaaaaagguuucacucuacaaggccuaaaaacuuagcaaucccuagacagggaaccucaggccuaugguguaguaaauagcuagcauagugccauaagaagagaggacgggagguaaacaaacuuagugaagacuaaggggccaauugccaaauaaccuuuaaaauuugcuccacuuucccaugaaaauuccaguuggcucuguucucugccuuucuuccaaaggggggucuacuccuaucaucuggccucccccagaacaugguaccuaacugcugccuaacagggucucccaacugcugccaagucugaucucuucucugcccugacacuucucagcaccaacaacuccauccugccugaaauacucccucagccucaguggcaauucucuuuccacucuguggguuccuccucuccauguaccccaucaacauggguuucuccugaacucuuugcucuuuucuugcuccaaauauucuccccgggggugcucacccauguccacagucuuacccagcacacccagaggaaccugccagaccuacauucccagacuaaccucccucccaagcuccagauccaguuucaccuucacauaagacaucaauccuaagguauuccuuagaucugucaacucagcauuauaaaaacugagcucaacauuuuacccaaaccuguucugccucuuacauuccuacuuugaugacuauuaccaccauuucuacuugacgucagaaaucuaagaguuguccuagacucuucucauucaggacacaaucaaugguaggucaauucaacuucccaauaauuccagcuccucuucuccaucucugccucugccuccuguuaauuuguuacaaagacaacuuaagugcaaaaccuuccauuugugggugccguacugcugccagagaucugaaacaacccuaacacccacauguaguauuuguccaacuuucugauaauucaccuccaccuccuauuuuuaauaaucaucaccccaauccugaacaccuacuguaccauuuuccagaaauuaacaaaauccagaaaaauaaaagccaaaaaagcuuaagguuaacugccauucugccagugaaaucauuugucacucagacaggaagcucuuaucucuacagauuccagagacaggaacagagaaucaaagcacccuuaagaccuuggggaccuuaagaaauagauucugcacauaagccuaucaucagauuugcgaugaccaagaccaaaugggauugccaugcuucccugacagggacaacaucggcacuacccuugagcaccaguucugaggcucauuacuaggucaacugacugcuguuccaccagcacaaucagcagaacuggagcuccugcugguggccccauggcauuucaguaaauguuuuagaaaauucuucuuuaaaaaaauacuaagugugccucuuuagacucuaaaugaacaagaauauuucacucccacacugaaagaaauauucugggcacacuggggugagcccaaccugcagaaguucuaaaucuggucauuacuggaaaaaaggaagacagacgccaaguuaggaaccuggagaugaagguggcuggguggcuccuagggucuauaaagaggccucucuuucucccucuuguccuggaggccauccuccagccgguccacagccugaaagaagagacgaggaaaagcacacgcagugucuggauggaauuaucagaaggucuggggaagggaagagaagcagaacaaaaagggaugguccuccucugcuuugaauuacuauggaaaagguuauaaaugauaaggaacaaagccagaaauuuagagaaucacuccacugcuauacuuuaaaaauuaacaugaaguagggagaagagggucuucagagucaaauacuuucaggguuaaagcagaaacaacaaauucauucauucucagguuuucugacccucuugucucuuccugaggaucugucaggaucccucccaaguaguuuccaagguucccaggaagcuugcagcuuugcuggcauagaacacaacccaaauaaugacacucauuugaaaacuuuuccuaggacugcuuucauaaauccugaaaauugcugucuaugccacauuugcuuuuaaaaacagauauacaaagaugcuacauacuugguauccaauaguaauaaccaagagaaacucuaguccacccaaaaauagucuguuccuuuuccucuuaauuuaccuaguguugauacaauacagaagaaggaaaagcaaaauuaauccuauuaaacucacuuugcagacagggaaagacugguaaagaaacuaaauuuaaauuaucacuggcauaaggaaugcucuuagcagcuuauuuagaaaagccaaaaaucagaaacaaccuaaacauccaccaacagacugugaaugaaaaaacucugguauauccauacaguggaacaccaucacaguggaacaccauccagcaauaaaaaggaaugagcuacugauacaugcaaacaugaauaaaugcugaaguaauucuccugagugaaagaagccagaccaaaaaaaaaagaguccauauuguauuauuccauuuacauacaacucuagaaaugcaaacuaaucuauagugacagaaaguagaucaguggaagacuagagaaaagugggagggaaggauuaucuugauuucaaugauuucauggguauaaacaugucaaaacguaucaaaguacacaauuuaaauauaugaggcucagaggcucacuguaugucaauuauuucucaauaaagcuauuaaacauuuaucacugagauaccauccacuaacaguaaggggaaaaaaauucuauuuuacuuuacacaaguggucuguauaaaaccuagacuuugcugaugaaccaagugagaaucugggaggggguugugaacccgagggaacugcucugccuuccaucuccaggagcagguauuugcuggugaucuauuccuucucauuuucuuguuguaccaaaaaguuaaucuaucaagagccacugguauaagacgcagaauuuacaacauagagcauagcuaaguuagucagugcugugcacacagcagauucucaauauuucuuugaaaaguagauaauuuuuuuuuaaaugucauuguugaggacagucaaucaugcuguaaccauugcuguaacccaugaacugaagguggcaggcacuaagaauuuacuccuguuucaccuaauagaagacaugcguuugagcucaaggaaaauaaagcaauaauacauuuaaagauagauuuguggagccacuguuuccugcuuggaaugcaccuacaucuacagaaacauucauggaaggccacaggcuagagacucaaagggagugucuugacauugcuacaccaacaccucucccuacagccaggcucuccccagacauucccaggaggucaggaagcuaccagaauauuauuaaaaucaaaacacuccuuuuuaauuaaaacaaaauuuauaaacacuuucuggaaaauauugggggugggacaguggggucaaaccagaaauuagaauauuuuaaauacuaaaaagaccaggagucagugauuuauacuacagcaaaacaucacgcacuuauuaaaaacagugugcuugcuauuguuaaaaaccgcgugguaagauuacacuggguugguuugcauuuuguuuguuuccagagugcugauauuuaaugacaaacuaauuuaagcacaugacgaguaaaauuuuguuuuacuuucuuuucgcuuucaggaaaggaguuaggaacucuaaaaaucugcuaauaaugucuaaaaguauuuuacugccauucacaagguaaaauuauuaccuaaaguuaaguucacuuuacugacaaauuuaaaggacuuaaaauucuugacauacacuguuaaaaacaauucuauauuacauuaccucauguuaaacaugggaaagacugaguggggaaaaacauugucuuguuuuuaauauccccaacuuccauuaaaacagaauccuuuggguuaauauaaaguuauaaaaggcacagaguuuguagcaccaugagcauggacccugcccgggcacaacguuccuucagguccuauuauacagacaucuccaacacucacuccccuuugaaauauuaaaaauagccaugcugucuugcccuagaucuaaaauaaggaaaaccugaagaguaaaucuaacacauacugcacacaccuuccacauuugguagcuggugugugauaagcuucucauguugugccaugcaugaaagguucagaaauuagaaugaauggcagucuucguguuugcugcaccacaaaaugcaaacuaugaaagaaccuugccacugaucaaacagcggucauccugucucagucacugcucuggacacuaaauaauaugcugguaucugucuuuagggguguuaaaccagcuuaacaaaguaagaugcuuaaaacuggcaaguaucgaguccagcagucuggugucacagcaagggcacacagaccugacaaacgcaucuaugaguuacuuaaaagccaagcuagccuuguacuagacuaaagcaaugcuguguuaauucccaucucaaauuagggaaauuuaaucuaguuacuguuuauuuguuuuagcggcaugacagaagacaagcaucugauauaacugucauuuagaccagaggcugacccuauaccuaccauaguuuuuuaccccagcguagcccagcucuacagccaaacucacuuccacuuccaacaaacaaaggcaucauacauacauucaaagaacuggcccagaaauguuucaacauacuuaaauacacuuaggccuucaaccaacugacacacaaacauuugacacucacccaccauuucugcugagguccaaguacaagucagugggaaaauuacuaauuuucaauuucagcuggcuuccuuucugcccauuccuuaucacaggugauggggcagagccuggcucugauaggugggaagacagacugcuuccacccuagcucaggugcagaaacagggagaccagagagggcccacauggagccuggcuccagaccuucuucccaaagaaagucaacaaaucucugaaauuuaaggaagucagacaagaauaagaaguccugcucuauaacuuuaggaaaaucuuaacaguaugagcacacuucuaucauucuuugugaaguaaggaaugagaccaaucucccuuuggaccuuugagagacaccaaaguuuaagaacaaccaaaaccaacaaaaacaccauuugcuacauauauauaaagaugcugaucauacucagggggcugaugcaggaaaaucacuuuaaccugggaggcggagguugcagugagcugugagcugagcgggcaaugagcugagaucaugccacuguacuccagccugggcaacaaagcgaggcuccaucucaaaaaaaaaaaaaaaaacagugcugaucagagcuacuauuugccugagauaaacaauaauauauaauuccugauaaaaacaagguuacuugauguuuaaauuagccucuacagguuuacugaagauaacaugguauguccuuuagguuuuagaaacauaguugccucuugaacaacacggguuuuaacugcccaguucacuuacgugagaauuuucucucugccaccccuaagacagcaagacccacgccuucucuuccuccuucuccucuucuaccuacucaacaugaagacgaaguugaagaccuuuaugauuaucuacuuucacucaaugaauaguauauuuuauauauauacauauauauuuccucuucuuuaugauguuaauauuuucucuagcuuacuuuauuguaaaaauacaguauauaauacauaugacauauaaaauauguugauuuauguuauuaguaaggcuuccgguuaacaguaggcuauuauuaguuaaauuuuugggagucaaaaguuauacaaagaauuuugauuugcaggguagggggaguuguucaaggaucaacuguacugaaaguaguuaguggacccuauucccacaugugccaaaucccuaaggacaggauccugggcuggaaagcagaaaauuaaggacuuguuucccuuggccaugcucuggcgcaaugcguaacuucagagacuggcugagccacccagucccagaagcccagcaacugcagacgcugccugcaaacaccccaacauuauuccauccaacugcagggcugggccuccagggcaccuggagaaaggcuucaacuaugacugcagcuguauaagggcuugcaccuggcacagaaaaugccuguccguccccaacuguaaauaccacacugguauuccucuggaccaggccagaaaacaaggcaaagggcuccagaccagaggccagcaagucccagccauggcuguggcucgugcugcagccccaugcugacgucugcagcugccucuccuucacuuggacauggugugcacugggcugggaagugcugccaaaauucugucaggccugcaggcuggagaggcugagguguggccacugcauagacccuaucuuucuuguaagcagaacuuuccaaaugcacaggcccggcugaaggaaggcagaguaugggcaguuaacccagguagggcucauuuuguggaccugaaagcagggacagcaggcacaccccaugacgcaggccacccaguuauauacaaaaggaaggcuccagugcaaaugagugaguugguggcagaggcugugaaccagcugccuucagaggggauggaaagggguguguuccauggcaaugaguaugugcaucuuuuuauaagccuggcauuucagggguucuuaaugagaacucugcguuuaccacuaccaucauccaccuuaucaaaucauugagcguggacagacagcauggcuguaaagcaucaauauauacuuuauauugaaccagcuguaugacaaaaggacagccaaccuucuacuagcaacuaucauuccucuccuccaccaccagauuuccauguuuagccuaggcuaacccuuugauaaccuauaaauauuuaccuuaauucuccauccccagcuucuugacggaggccaguacagacuugugaguugacagacacacuuuugguggggacuguggacacucucuuccuccuuccuaaccagaguucuagguggaauuuuuuuuuuuuuuuaaaauagagauggguucucgcuuuguugcccaggcuggucuccaauuccugggcucaagcaauccucccagcucagccucccuaagugucaggauuacagucaugagccaccaugcccauccugaacauauauauuuuagaugaaauauuuggccaggcgugguggcucacgccuguaaucccagcacuuugggaggcagaaggugggcagaucaugaggucaggagaucaagaccauccuggcuaacaugaugaaacccugucucuacuaaaaaauacaaaaaaguagccgggugcaguggcggacaccuguaguccuagcuacucggaggcugaggcagcagaauggugugaacccaggaggcagagcuugcagugagccgagaucaugccacuguacuccagccugggcgacagagcaaagacuccaucucaaaaaaaaaaaaaaaaaaaaagaaauauuuggucuucuagggcuuuuaugggcugaauuguacccccauccccaaaugcguacuuugaagcccuaaccuccaaucucagaaugugacuauauuuggagacagggccuugaaaggggugacugaguuaaaaugaggcuauuagggugggccauaauccaauuuagucacacugaggcacaccagcgaugccugugcaaaggaaaggccaaguaagaacacgugagaagaaguccaucugcaaaccacgagaggccucagaagaaaccacaccugccaguaccuuggacuuccagucuccagaacugugagaaaacaaauuucuguagcuuuaaacuaccgggggcugugguacuuuuuuguagcauccugagcugacuaauaugaggccuucugcgcuacuaagacccucuggacaacugaaagggacuaaacuaagccaagguccagaacuacacuguccaacacaguggacacuagccacaugugucuucaaauuuuuuaauucauuaaaauuaaguaaaaguuuaaaauucaguuccucaguugcacuagauuaggacauucucauccuaugggacaaugcuaguccagaaaagagaaggcucuaaaucugagagaacauccaggagaaacuuuucuaacacagcucucccaaagaagagaggcagugacgagagcagacagagugagcauacaccugaugcucaaugccaagaaaaauauuuaaauagggcucuuaagcuuuuauugggcauuaucuuuauauggagguaauucaccaagcagucuucugacuaauucucacccuaaaagcaagaauuuuuuuucgagacggagucucgcucugucgccaggcuggaguacaggggccacgaucucggcucacugcaaccuccgucuccuggguucaagugauucuccugccucagccucccgaguagcuggacuacaggcacacaccaucaugcccagcuaauuuuuaguagagaugggguuucaccauguuggccaggauggucucaaucucuugaccuugugauccacccaccucggccucccaaagugcuggggaauacaggcgugagccaccaggccaggcaagacuauuuuuuuuaauuaauguaggacaaaauuauguacucaagcaaggagcauuuauagaguacuuauaacucacaaagacacuuugauaggcgccacacaggggcagagaagaaauucccaaugauguuuuugccucaaggaguaaaaugccuaaaacuauaaacguuagaaaacagguaggcaggguuaugaaacaacaagcgccucagaaguucagaagguggcaucccaaaggcucggacagguggcuuuaccugccugcacuuggaaacagaccuuuaauaccuuucucugaaauaagaggaaaggucuuucgcucuggagccccuacacccucucucaacuaguucacuucucuccugcugccaacaucagcagucaacccuaaaacucucaauuccuuagagguccucauugcaagcccuucacaccugacacucucccauaacggccaauucuccuccccaaaagccccgugccugugccugugccaagcacaccaaccgaaauaccacauugaguucuguuuuucauauuccugguccccucuucugaacaggguggcaccuacagcagcaaagccuugcuuucuaaugugcagcuuuuaacuugcugaaaacuuagagcacagaaaacugaaaauaacccuauuugccuaaaaaguauuucauccuuaaggaucuauacaacuuucaucuccucugcagguuucccugcccuccccuccucugaaucuguaucuguaucuguuuccacagugcaucaaaaagacaucucuauuacugcccugaugacuuucacaucagagcucuucuuacauaugucuaaagcagaguuccuugaaagcaggcccagcuccuuucccaucacacauucuuucaagguguccuggguuuaauuuguaauguaaaacauaagcuaacgggcuagagcucaggcacugugcuagguacaaaauuucccucuguuaucugaggggagcucuucucugaguagucuguuagcuucucaauacacagacacugugugauauuuauuuugacugccuggaagccaacuaacuucugguucucagcugcacugugaaaauaugaaguugccagagagcugagauacagacagcaguaguauucaauauagucacauuaaaaccaagugaagagcagggacuuucgaccuauuaagaaccuguacuuaauaauuuucacaucacacuaggcagucuucaaccuccccuuguauugaguugaaccaguuaaugauuaccuggcuuugauuaaguuccccuuucauaaagcgcaacugcgaaguaccauaaaugauguuuaggaaaaccagacacaccagugacucuuggaacuggauuauuccucccaggauaacaaauaggaagccucaggaaugcuugccugcagucaaccuuacccaguaagaucugguuacagaccugcaguaucacacucagguacguuucuccaggcuuuggcuuucucugaccugccugacaugcaaagggccucagcaauuuaaagcauuacauuaaaaaaucauguuuuuaccccgacccaaacccugguaggcuccaagaacaacaaagcaggacuuacugccauugucgucagaauccucacugcugcugggaaggcgaccucguuucaugaucuccccgggaaacagcaggcagccugcaaagcaaugagacagcacuuaacccaagaugauaauacacaaucaucaaguugugcuucagauggcagcccaggauuuacagcaaacaaaagcaaacaaauggcuuuaaguagcauuugaauuguaaacaguaaaaagaccaaagauacauaauuaggugcaaucauuaacaaaccagguuaaaaaaggagggggagggguggagaagucacauaucaguaggucucccaaagaugccagguuucuuucuauauuccugugacauuauuacuauaacuacuccaggaaucuuuagcugacuggcagcaagcacugcagaaaaaaauccacagcaaugaacacuguacugugcuuccucacuacagacagauucauauuuuaugcguacaugugggggguggggugggguugugccuggaugugugaauauuuacacugcacugggcaugauuaugcuucucaggcaaauuuuacuaaaauaacccuaaaggcgaaagaaacaaaacaaaucggguaauggaaugcaaaugucuccuccagccaucucuaaccccacagagggaacaggaaggaaccacagacauuauacaauuuugauccagaccccucccuuucacauuaggaaacuaaagccaagaaagguuaagcagcaacuuccccaaggucacguugugggaauggagcuucuaauuccaaauccaacacuauuuccacuccacuucaccucagcucccuucaggacaaauagacccaaauccagccaaaauaagaagucaguuuguacaaagacccagcgcaccuggccaacuccucccagguagcugaugauaacagaauucuagcacuacccucaaguaugagaaaggcugcauuuagguaagaaggcagugaacugagacggaauggccaguaaugaacuuauacagauggucucgcgguuauauucacacagggcagcucucuaaacaaauacaaaaagcuuuuccaaauuaaaauuacugaucaaccugacaucuuuagggcacuggucugucaguucaaugaauccuaaaaaugaaagggagcuuuuucaagugagaaaaaguaugguaguccaucaccuaccuacccauccacccucucagaaaaguacaucccaaccuccuccucauugggaaucacaauauguaugaugugguguuaacaaugcaaauguggcugggcaugguggcucaccccuguaaucccagcacuuugggaagcaaagacgggaggaucacuugaggucaggaguuggagaccagccuggccaacauggugaaacuccgucucuacuaaaaauauaaaaauuagccgggcgugguggcaggugucuguaaucccagcuacuuaggaggcugaggcaggagaaucgcuugaacucaggaggcggagguugcagugagccgagaucacaccacugcacuccagccugggcgacagagacccugucucaacauacacacacacacauacacacaacaauagaaguggggcacauaggaaugguguggagaaaaaaauguggaaaaccgggcugggugugguggcucauaccuguaaucccugcacuuugggaggccgaggugggaggaucacgaggucagcaguucgagaccagccugaccaacacggugaaacccugccucuacuaaaaauacaaaaauuagccgugcgugguggcgcgcaucuguaaucccagcuacucaggaggcucaagcaggagaaucacuuaaacccgggaggcggagguuggaaugaguggagaucacaccacugcacuccagccuaugugacacagugagauucugucuugaaaaaaaaagaaaaauguggagaaccacugugauagaacaagaaagcaauuuuaaaaaaccaaagcuccacucuaaaaaggccuacaaaagagcagucaaaaaagccuaaacucccuuuuccuuugacuagucacuucacaauuuaucacccucuguuaaaauuguauauaagccuucaggucuaacucuucuuggguuuuuucucuucggugaagucuccuucccuuuacccacaucuggcacauaaaaauaucaacaucagugaaguuugccuuuucuccuguaaugucuuuugucauuuaauucagacucgcaugaacugaaccuaaaaaaguagaugaaaaguuuuuccuauacuacacuuaaaaaauggaucuacacaauucauccaaauauuuaggucccuaaucuauaauugcaauauuuuauauuuucuuccugagaaacucacccaguuaaaguuuuuguuuaucaauugauucuucaaaagccauuaaaaugauguaccaagagaaaggcugaacauaaguccugaucaguaugggucaugagcuauauuauggacacgcuuuacaagcugggguuucaugcuguaggcauagucaaguccuaaaacccacuccaucccuuuuccaaaagccccacucacccauaaccaggcaaucugcaacuuggccugggguaagcccacuccagcccucagguuccauaaccaagaaacaccagugguccacucccuauucaacuguuuucucugcccugugugugccaaaaacaccaacugcagacagguaagcucuccaaccuucuagagaaugcaccucuggguccccucaggauccagcaagagguaaaagggaaaagggaaaggcagaagaccacucacuccuaacagcuucagcuccccaaagccaacauuacaaaagagugcuaaaaaaaauuaguacuaggcuggucgcgguggcucacauguguaauccuagaacuuugggacgccagggcaggaggacugcuugaaccuaggaguugagaccggagugggcaacacagggagaccccuaucucuauaaaaaaauuuaaaaauuagauucaccuaacagaguagcuuuuaagaaucuuuuugaaucaaaaugcuuacuuuccagcuuucaaacacaacucccugaggaagcacuucaacagucacuaaauaaagaacgcaagcauuggccaaaauacaaugaugcaccuaaacacacauaaauacucucuuaagcaaaauuauucaaguaaaagaagaguaaaaauaguauuuucuuucuaaugaaauccauuuucauccgcugaagaucuugaguaaugaggguuugagagugcuguauuugcuucuccagggaacuuggcacaguauggggguuagugcucagcagaauuuccuccucuguggcucuaaaguacuuaaaccuugacaucaagcugauuuaucucacccaggaugacuuacuguaucagaaaaucaaaauacauguuacuaucuuucagcuacacaauacagugguuguaugcugcaaacaucugccccacuaaaagccagcaucugcaucaucaccuuuccugacucucagggcaauggcuaauuacuaaucuagacaguaguaggauaaguaauaaucaauuaaaauggcuacucacaacaccccaaaguagcaagaagauauaauggcacauaaugcagccgacaaacauuugaauaucucauauauuaggaggugcuggaugaaaauuacuaacccugaccucacagagcuucuggccuaguugggcagacaggaaaacaacggaaauucacuacuguuugugccugacagugguaaaugcggaguucuacaggaauacaaaagguggauaagagucagaggaggcugguaagacugagcugaguccugaagaacaaagaggagguagccagaaaaaggggcauguuuggggcagagcaccguacuuaccaacauauguguaacacagcauauuacucuggguagcaucuucauacacauccauucucaccuuauagccaauugccaagguuuacugauucauaauguuaugacucucugaaguccccauaugcccuguggguuugcccuucaacuacuuguaccuagaaagcuuuaaacaccuauucuccaaacuaugaucucuucccacuuccaauuauuaaaacaacaaauuaacuacaccccaugaggcaaccucaucaaaauacuauaugcagaucucucccuccauuccacauuacaaauaggucuaaguccaaaguguccagccaaaaaugaaguuuucugacuucucacagcuuuacucaggcaucuguucuagcaagccccaaaacccagagcuugcauugguugggccaggcuucuucccugaacacucugcuuacuuucaguucucauucucugcuaaugcugcuccuguugcuccuugcucccuauccuaaucccaccacuuuucuggggcucagcucaaagccacugaccacuccaacuccaaacacuuauauucuguacugcucaguucaacuuucuuccucuuuuagaacuuuuucaccuugcuuuucaaugcacuguuaccuuaauaguaucacugaaaaaaauuccucaugacacuuguuagaaaugguaaagcagauuuuacucaagggggaccauggugguagguacagggaacacugcaaugggaucuugcagagggggauggagauugaacccaacucagauuccaaaagagguggagauuuauaaccaaggaggaggguggggccgguggauaggagacugacuacuaaacagaaauaucaaggauaagggguuuauggcuaauuugauaggauuauucuugaagacaggccaggauaagauaggacagaguggucagauacccaggugaagaauuuucccuaaacugauuuuaacaggauuuuugcuucaacuggauucaacaauaauacaaagagaagcccaagguagugcccauucacgcggaggaccggaggagcgugacuaaaguuuuggucaaaggagucuuugucaguauucaaucaacuacugccuugcaucaugacuuaaauguuucaugugugugucucuaaagauuacaguaauuucuggagaacagauucucucaagucaaauaugaaauaaacauaacauagggccaggugcaguggcucaugccuguaaucucagcacuuugggaggccgaggcaggcauauuaucugcaugcaauagauagagaggagccacuaugugaagccuggaguucgagacaagccuggccaacaugggaaaaccccgucucuacugaaaaaaaaaaaaaaaacacaaaaauuagccaggcguggugaugcaugccuguagucccagcuacucaggaggcugaggcaggaaaaucacuugaacccaggagguggagguugcagugagcugagcgugugccacugcacuccagccugggugacaagaguaaacucuguuucaaaaaaaaagacauaacagagaagggggaccaugaugguagguauagggaacacugcaaugggaccuugcaguacgggacagagauugaauccaacucagacuggucagaaacaaggccucucagcguggcuacaauagaugcccucagaacucuggauccagucgacacggcucacccugacauucuguuuacauuuccucaaaacugaugcaaaguuauccagcuuaucggagccuggaguguccacuugccacgagaaacauaauagcuacagagacaaaagagcuaguuagugggcauuugggaguuugcccaaaaagaggaagacuaccuaggaaguuaaauuaaaaacagaacacugccuggaaaggccacuggccaaagacccuggcuggaccaguuacuuaacaauccucuggugucucuacuccacucacugcacgaagagaugcaccaagacaacugagcaucuguggcagcugccggagaaccaucuccucaggaaaugcaaacacaggcuuuacccacuggcccaaaccccuauuuagauuauaugcagauuacucucuccuuggaucccuucugucauguggguuaaaaugcaguacauuagcuaacauaauaauuugaggaaaauuuuaucaagguagacgucagagauacggugaacaagauauggaaugucugcacugcaggagcacacagucuaccuggaggaaacaucaaauaacuagacaaguggcuucagugugguaagugcuauaaaagucaccagauuacugcuuacaugcacaugagauagcaaggcaccugaaaaccuugaaauuuacauuccucugacugaaacugggaaaaaucugcaugcaauagauucagaggagccacuaugugaaggaacccaucccuaggguggcucaggaauuugagcgaacaaguucagugaccugggcguggucaugacugaugugaugauucuaagaaagaaugagaacgucauggacaaggagagaaggacuuuuacaaaagaauaagagggcugggcacaguggcucacgccuguaauccaggcacuuggggaggccgaggcaggcauaucacuugaggccaggaguuuaagaccagccuagcaacauggcgaaaccccgucucuacuaaaaacacaaaaaguuaaccagguuuggugguguauuccuguuguuccagcuacuugagaggcuaaggcaggagaaucgcuugaacccgggaggcagagguugcagugagucaagaucauaccacugcaccccagcccgggcaauauagcaagacucugucucgaaaaaagaaacaaaaaaagggaaagguaacuaagaauuugaggauguuuauucaaugcuauuccugggaaacaaggacugauuugaggaaaacaaacuguccaguuacuagaauuacuuacucucugugguggaacagggcccauuuaucaggccauaaacucuauagcuauaauaaggauuacaaccuagugauuuugucuuauggcucauaugcagaaaggcugguuucucucucaaaguaucaguuuuaucuacuguuuccauuuuuauuuauuucacucaagaaguucuagaagguacucaauuaaagaccgcuacauacuuuuauauaucacccaaugcaauacuauguauuaaaauaaccuacuggaugaaugccuuaguucccguacuguuaccuuauguucacuccacuuuauugaauuugagaugcuuuuacuuuaauaucuaauugaccuuuaacuggaauaacuucuccuguauucacuuuuaaauuuauugaugcccuuccauucugucaaauagcuaaaaucuaauaccuaaagguacuaaagaauguauuuucagaaaccagguggucuuauauaaaacuaaguauuuuaugagcuacuccuuucucuuuuauuuuauuuuuuuugaguuggagucucgcucugucaccuaggcuggagugcaauggcucacucagcucacugcaagcuccgccucccggguucacgcuauucuccugccucagccugggacuacaggcgccugccaacacgcccagcuaauauauauauauauuuuuuuguaauuuuaguagagacgggguuucaccguguuagccaggauggucucgaucuccugaccucaugauccgcccgccucggccucccaaagugcugggauuacaggcgugagccaccgcgcccugccacuccuuucuguuuaaguucacauaguucaaauuauuuuuuaaacacuagguaccugauaauuugauuccuaaauuacugaacauagaauacucccccaaaaagauacauuauauucuuaauaauuggucacuuuugucuucuauggaauauacaguucuaaauacccaaauauaaugaccuauaacuucacaauaaaaucuguccaccugccccuaaaugaaugugaaggaaacccagcugguuucuuaccucaguuuuuaaaguaaacauuaaucgcuuaaauaugaaguuuuccaacuggcaacauuaucuaauucauaugcucacagaaucuaaaaaugcuacuaugacuauaacucaaacacagauucucaauuuaacuaaaggguuauaucuagucaaaaauaaagucauacauuuaacugacaaauagcuuaacucuuaagcguuaauguuuuaaucuugucuaaauaucucaagcaaaaaaaugugcucuuuauaacgucauacaucaaaacuuauuuaaggaaaaugcuggcccaagcuaauacagaaccucuggaaggagguaaaacuuacaaauauucagcugacaaguuuacauuagcaauagccaccuccuccaaaagaaaaaaaauuaugauaacugaccacauaauaaauaacuauaauauuuacucuuaggagcauuacucauaaagcccauguacuauaauacauuaguucacuuuaaauucuuuauaaguuauuuuugaacucagauuuaaaaaccaagaaagcauuucucaagacuuuaaggaauuuuaaauuugagugguucugaaugaaucacaagcagcucucauuugccaauguauaaauaauccaaucacugcuuaugagcucuaaggcaaucuauuaaaccccuuccaggacucuguaauugcugacucaauuaagagucagcaacugaauaagagcagcuaugacaaaacauuccaaucauuuguacuuggaauguauuuuuuuaacuucccuugacaugggaguaaaugaauucacaaccaaacaaaaaaggcagucagucaccauggucuccaaucuugagcuuuuauccuuauuuccaucuacucagaauucuuuucuguuagaucuaaaugcucagauguggaaagaugcccaagacauauuaggggagaaaaacaggcuaacugcagggaaaaaacccaaaauauaagagcauuuauauauaauaggaggagagaaaauaccuacagcaauugcuuguauauucauagaacauuucugaaagaauauaaauguucauaguggucaucucugagaaaugugaccaaaggguuccaagacagacugaguugggaacuuuuccuccucuuuaugaccuuuaauaugauuuuaacuuuuuuuuuuuucuugagacggaguuucacucuuguugcccaggcuggagugcaauggugugaucucggcucaccgcaaccuccgccucccagguucaagcgauucuccugcuucagccucccuaguagcugggauuacaggcaugugccaccacgcccggcuaauuuuguauuuuuuuuuuuucacuagagacgggguuucuccauguuggucaggcuggucucgaacucugaccucaggugauccacccgccucggccucccaaagugcugggauuacaggcaugagccacugcaccuggccaugauuuuaacuuuuuacgaugauuguguacuacacuuauaauaguaaagauacuuuuuuuugagagacagagucuugcucugucacccagacuggagugcaggagcgugaucucugcuaagugcaaacuccgccucccggauucaagcgauucuccugccucagcuucccaaguaacugggacuagaggcgcacaccaccacacccggccaguaguaaagauuuauuucuucccugcucuucacuauauaaaagaccuggaagcacaacuucuugccccagugcaaagcaccagccuauaacuaacgagcaaccaucaauaaacuauguauaugccaccucuuuccugagaugcaguaucaaagaauugucuugcuuuaaaagaauaucugaugcaaaggugcagaagaaaaaaaagagaaaagguaauaaugccauaaaaugcuauuauccccuauuugcuugauuaggucaucacauacuucaaaagcuuaaguuuuugaaacagguaaaaacagccaacauuagaaggaggucacuuaaaauauaugcaauaauaauagaaaaaaacuaacccagacaagaaaauuaggguuuaaacuauacacaggcugggcaugguggcucaugccuguaaucccagcacuuugggaggccgaggcgggccagauuaccugaggucaggagcucgagaccagccuggccaacauggcgaaacccagucucuacuaaaaauacaaaaauuagccaggcaugguggcaggcaccuguaaucagguugguggucucaaaccuagcagcuacucuacucgggaggcugaggcaggagaaucgcuugaacccaggaggcggagguugcaguaagccgagaucgugccacuguacuccagccugggcaaaaagagugagauucccucucaaaaaaaaaaaaaaaaaagaagaagccauuucaacuccuuauccauuaucacaguaguacuacuuuggaaaaaauuuaaaaaggcuauguucaagagguagcuggcaauuaugccauuccuuccaccuauggcaaggcaugguugacaaauuaggucauucuuuuccacacccccaggcacauaucuucagaauccuccuuaacacagugcuaucaccaagagagauaaagcccauuugcccuauaugucuuauuccgcgucucaguuuucugacaauuuaucagggaaagcuagggucagauuaaucucuucagaauauacaaaaaugaaauguuuauuuuuuaaagcauuucacugaaaucaggaguuuguguuccauucugccuugggggucucugaaccagguacuaauuucuauaauacaaaccuacacacuucauaucaaacucuaaaagcucauuagacacuuuaggaaaaccaagugcuucugaaugaacgaagguaagaauaagcaugagaaaggauucuacaacccauuauuccauccuugguggaguaagccaauaaaugcuaaaugucuacaggguaauuuuaaaagauuuuuaaaugcucaaaccagauguucuuauacaggauauacaaaucagcuucugcagaaaccagacuccaccagcuaaugacaauuacacugugcacagauugaaaugcagcuguuuuucaggaacuuuguuccuugauuauacccgguugucagaaacuauccguuaccacuaacaauguuaagucaccaaaaauuuuuaaaguacuguuuuaaaaaaaaaaaagagagagacucccaauguuguauauuugaaaaccuagaugacacacuugacaaaaacaacauuuacacaaucauccaaguuacauaugaaaacaaacguuucaucacaauuguacaagccucguuauuaugaucauggaaaccuaaguuggucucaaaccuagaagcaaggucuagaaagcacucucugaggcugaagucucagucucacaacguagacucugccuacaagucucacaacacagauugugucuagaagaaaucuucccaaaagaaagccaggcgugguggcucacgccuguaaucccagcacuuugggagggugagguggguggaucacuugaggucaggaguucaagaccagccugaccaauauggugaaacccugccucuaccaaaaauacaaaaauuagccaggcaugguggcacaugccuguaaucccagcuacuugggaggcugaagcaggagaauugcaugaacccaggagauggagguugcagugagccaagaucaugccacugcacuccaaccugggugacaaagcaagacuccaucucaaaaaaaaaaagaaaucuucccaaaagaaacccauaaaaucauaauuaacugcagagcuagagaggauuucaaaaacaauuuaaaauaauuuaauccaccuuuccuacuuuuaaagaggaguacauggauuucugcauguuuaucaacuugcacaaacacacauaaguagaucuagugcaaaggcaguggaagaaccaaagaccaguuccccagguggguggaggggcacucuccuccugugccagccaccuccucccagauuccuggacuaugggcuucuuccuccuggauguacacugggauuuaaaaagaggucaugugaaugacuaaggccaugauacguuaucagagagcaaaaacugaaaauguaaucaaugaacaacagucuguuaacuugaaaacugaaacacagauucauggcaagauggucacaaaugccauucauuuugcauagugaagcacacaaaagguaaagcuggaagaaugugucagcaguuccuuaaacacuaccacaggaguaugaguucucccggagugguaggcauuaacuucugauugcugugacacauacacccuacuugacauuaucucccucuguaguggaacacaaucuuauaauacauauccucuuacacaggucuucuuagcuugacccccccggagggugugagagaugaccaagguauuuguucuuacacauuuuauccucaaaagggaucuaggaucagaaucccagcuacuccagaagcuaaggcaggagaacugccugagaccagaagguugcugagccgugaucgugccacugcacuacugccugagcagcagagagagccugccccccaaaaaaaaaaccaccauugcacuccagccugggcaaaaagagcgaaacaaaaacaacccacagcccucagcguagccaacuaccuccaaacaaacuucuaauuucaacuugcauuuucagguuccuagaagggagcucagccaccagcagaaacaaucaaguagcugcugugucuuacuauaaaucuggggaggccagggagugauggccaaagugggcagaaccuuugagcucaggaguucgagaacaaagaaacauagcaaaccccaucucuacaaaaaauacaaaaaacuagccaggccuggugugggaugccugcagucccagcuacuggggaggcugagaugggaggaucaagugagcccuggaauuuacaccacugcacuccagccuggacaacagggugagacccugucucaaaucaaucaaucaaccaaucaggggucaacagccuguuucuguaugguuuuugagcuaagagugauuuucacauauugaaaugguugaggguagagggccaaagaacauuucaugacauacaaaauucauaaaaauuuuacauuucuauauccauaaauaucacuuucacauucauuuugcccaugguugcucuggcacaacugcagacuugagcaguugcgacagaccauaugacccacaaaaccuaaaauauugacuaccuggcucuuuacagagaaaggcaacugaucuguccuauaaaucaaccgaucaguaguaugauguuuauaaaccaccauuaugcguguuuaguucaaugugaaucaauuaccaggugcuggacaagcaaccgaaagcuuacaaaauuaaggaucagacacaaucacuccuuaggaagucccuaacuauggccggccaugguggcucacguuucuaaucccaccacuuggggaggcugaggcgggugcaucaccugaggucaagaguucgagaccagccuggccaacauggugaaaccucgucucuacuaaaaauacaaaaauuagcagggcaugguggcacacgccuguaaucccagcuacucgggaggcugaggcaggagaauugcuugaacccaggagacagacguugcagugagcccagaucaugccacugcacuccauccugcauaacagagcaagacucuaucucaaaaaaaaaaaagaagucccuaacuagaauaaucaaaaggaaggcauugaggagaccucuaagcaacuuaaauaaaggccacaguaaaaccaguggguuuuucucaaaagaaaaccccugaggcuccuacuuggagccaguguacacaaguuuuaaaaacuucuaacaggcuucuuauuugauuuucaaguuaaugaccaauaagcagaaaaaucacuguucucaacaggcauuuuaacuacaauacaugguaacaguggcaguaaaaggaucacagagaaaucauaaaaagaagucaccagaauuuaaacacuuaaacuagaauccaaggaugugcuuaaggaaacacccauguuuucugggggagagcuuccauggguuucagugucaaguguccccaacuuaaaaaguuacaaccaccaacacucagccucuauauguuaagugcaucauggcauuuccacauggaaguaacugaugcucguaaagauuaugacaaagaguaaucaauaaaaaauuuaaauugcauuuaguguacuuugugcuaaauuaaagcaagccaugaaguucaaccucaagcaacuugcuaauaacauugcuauuucuuguuccuuacccugguuuaagugggaaacaaacaaacaaaaagauuauuuuaugccucaguguggacccacaccacugaaaucuucacuuaaaguaaguccuuauaaacucucauggaagaugccaugaauucucaaaauaauaaaaucuccugcacaggagacacuaaaugaucaauaguuuaaaauauuacuuccaccagccacacaggugcacacuuguaaucgcaguuaggaagccagggcgggaggacucagcucuggaguucaagacuagccugggcaaccugagcaacauagugaaaccucaucucucuaacaaaaaauacaaagagacagaugucaauugugagcgcuuucaaaguaauagaaaacuggccagucauggugguucacaccuguaaucuagcacuuugggaggccgagguaggugggucacuugaggucaggaguuugagaccagccuggccaacaugguaaaaccccgucucuacuaaaaauacaaaaauuagacagacacggcggcaugcgccugugaucccagcuacuccggaggcugacucacuugaacccacugcagugagccgagaucccaccacugcacuccacccugggugacagagcaagaacuugucucaaaaaaaaaaaaagagagagaaaauguaguuuacuucccucaacaaguaagcccaaaaaaaucuaagguuuuaaaaauuaacuuucuucaacugcucucuaucacauuauguccuaccucuaccugaagaacuaaaggcaaaaaguaaauacugaauucguuuuagaguaaccaaaauuuggucacugaacauuuacugugugcacaucguacacuaugggucuaagggauuaaacguaaaaauacauggccccuuuccuagugauaaaggcuuuccaguccaagucugguaaucuuuauguuugugcuuugaggugaggaaaggauccuuaauaaucauucaaguccugggcuaggaaaggccccaucauagccaaaguuuuuagcaucaauuucuuccauucuauuccaugacacccaaccuuaaacuuacaaauugucacuucuauguguaauuaaaaaggcccuccaaggucauuuucuugcauuuauuaggagagcagaguaacuugcuucaucagggcuaugaacugcaaaaaaagaaaaaauaaaaauaaugcauacacccucaugaucacaaaccaaaguuuucauaugagaaauacacuaggcaaaggacaauagacucaauagacucaacuaaaucucaacuucugagauauuacauuccacaaacauaaaaagaauuguccagauuguaaauacauggucauauaaagugcugcaaggacuugaaaacggagaaaacagauuuaagacuuuuaaggaaacaacuuaccugucucaggaauuaaaauacuuuccuaauuuaagauugcugauaccuucuaagaaaccagaaacuccaagcaaacccacccuucauguuuaaaaaaaaaaaaaaaguauuguugaauauggugccaauucucuaaaggcuuguacaagggaggaaauaaguuuaaacgugacguaacuuucaccguuuuaacaaucaagcuaaaccucuuaaugccaacccaaauaaaaagcaagguguguucgcuaauaugucauauuucccucuauaacuguuuuauaaaccucacaggaaaaccaguuuuauaaugcaaauucugacagaccauuaacuguaaugcuguaacaggugccccauaauacuaaaugacagggaagagcuucacaaacaagaaaguaaagcagcaagcagaacugugacagauuccuaugccuccucuucucugaccaaacccuaaagagacaggauguaaucuguauuugauaucuugauguuuacuguuccaaccaccucaguacugaaacacaaacaucugauaaaucuuuuuccaacaagucuguggaaaguaacaucaagcaagcagaugaucuccaaauuuaagauuuccaaauuacaauaaauaccauuuggauuuccugcuuuuuuaaaauccaggcaacuuuauuuccaaaggcuugccuccucagugucagauauucugucaaaaaguuacuuaagauugccgggcacgguggcucacgccuguaaccccagaacuuugggaggcugaggcgggcggaucacgaggucaggagaucgagaccauccuggcuaacacggugaaaccccgucuuaauaaaaauacaaaaaaauuagcugggcaugguggcgggugccuguagucccagcuacucuggaggcugaggcaggagaauggcgugaacccgcgaggcggagcuuacagggaggcggagcuuacagggaggcggagcuuacagggaggcggagcuuacagggagccgagaucgcaccccugcacuccagccugggugacagagcaagccuccgucucaaaaaaaaaaaaaaaaaguuacuuaagauuaaaaucgacuuaagggaaacaaccaaaugcaauaaaugguccuuuauuaggcagugguuuagacaaagcuucucuauuacagucuggggcuaaauggggaaaucuggacauguuacaguaauagauuauauuaaaacuaaccaagcuagcugacagaaaaaaaaaagguccucagagcugggugcgguggcucacgccuguaaucccagcacuuugggaggccgaggcagguggaucaccugaggucaggaguucaagaccagccugacaaacauggugaaaacccgucucuacuaaaaauacaaaaaauuagcugggcgugguggcgggagccuguaaucccagcuacucaggaggcugaggcaggagaaucgcuugaaccugggaggcauagguugcagugagaucccaccauugcacuccagccugggcaacaugagcaaaacuucaucucaaaaaaaaaaaaaaaagaaaaaauccuuacagaugguauauucauguaucucauuuuuauuaaaacacacaugcacaugcauagaaaauuaucugaaaaguaauacaguagucaucuauggaugguagcaauuuguuuuuauauuuguuuccuuguauuuucuaauuuucaaaaacguacauguaacacuacuuguguaauaacuuuuuaacagcuaaagucaaaaauuaauaucggucacgugccuacuauacguaagacgcaauggaaaucugcuuuuacucucaccuaguccuccaaguuuguuuuuuaggucaucuuucuucuccaacccccuaggcuaagcaacaaaacacauuuccucaaacuccaauagguuuucucccucuaguuucacccagacacacauacuuuucauugcugucccuguauagcuacucuuucaaccuggauaacuaauauaagcacagcacugguuuacaggcagaaaaccagucaagugaagcggggagaacuaagaagguggguuuuuuuuuuuucuuuuaaaugaacacauaucuaccuuuguuaaagcuaaaauauaugugcagccaacccaacuuuuacuaguaagcagucuguacucuuaaagguggaaucaaguucaaguucuaccuuacuuucagacacucccauuaucucugcuaaauagggaccaaaggaaauagcaggaaaccuaacacuuaaacagcuuaaaauuauauuuauucuacacauuaaaaugacaaugccaaguaaaagacacuuauagaaguauccaaacuuugaagaagacagcaaaauaccaagcagaaagucaucugauuuacaagugaccguaagcaggcugggcgugguggcucacgccuguaaucccagcacuuugagaggccggggcgggcggaucacgaggucaggaguucgagaccagccuggcuaauauggugaaaccccgucucuacuaaaaauacaaaaaaaaauuagccagccgugguggcacgcgccuguagucccagcuacucagggggcugaggcaggagaaucgcuugaacccaggaggcggagguugcagugagcuaagaucaugccacugcacuccagccugggugacagagcgaaagacucugucucaaggaacaaaaaaaaaaaaaaaaaaaagugaccguaaguaaaugagacuaagaucuuugggauaaaaggacaauaaaaauucuggguugcauguacuugcuaagaguguuacucacaaaacaucccauuuaacuccccccacguauguugcccaccuacaacaaauuauuacaucaaaaguguugacucaaugcaaguauggacauauugaaugcuuccuuucuccaccuuucuccaccugugauuaaaucuugaucaguugugauaugaucaaaaugcaacuuacuauaaaaucuguaaccacuggggagucacuaccuaaaucagcuuucagggaaauaauuucccucuaucuuaaaacuaguucauuagcuuugaaagguauuagccuugagcuacaaguagcaagagagcuagccuucauggcggguauuauaaaaaggaaaaauaguucaccuaauaaaaaaccuuugggaaagaacccccuaagcauucccauuaauggaaaccucagauccucuccuacuuuccuaaaaacguagcugucucaggucauucacugcagcugucauuuuacaaaagaaaauuuaaauucccucuuggccggggcaaauagagggcgacagccccucgccccugccgaaguaaggcagggcgccagcccucucguuacuagaaggcaagcuaaagcuccuuuuaaacggucuccggaugacgacgcauuccuaacggguuucgaaggcauguuuaaaucgcccgcuuuuuuguuugcucucagcauucaccggcgccgggacugcggccgcccccacccgcuuggggugggaaaccuggggccagcggagccuggcgcgggaggaauccuggggcgaggggagacccgggacgcgccaagccgggguugaggacucgagaauaaggagcucuagugggaggguggcggagugagaggggacgugagaaggcuaaggaucccagcaaggggggcaccccgggguugugggggagcucggccgccgccccgcagcggcgaacgcuccgcgcggcucccgccgcccgccggggaaugcgcagggccgcgguuccgcgcggcgccgaccccucccucucucccaauccuccuccuccuccuccucccgaggcgacagaaacaacagcgcgggaggaggggaaaguaacucccggcaccuccgccggaauuagccccggugcagugaugacaccuucucguggcgcaaccaagccccgcucccuccgcagcggcguccccgccgccgccgcccucuccauuugaaaguggccaccccccgccgcggcagcuccucccgccccgccgccgccagcugcaccaauccgcucggccccaguugcaaaucaaacgcucccucgcguccagaagccacuugcgccgcuggaaacggccgcgccgucccccuccccgagucccuccggggcggcaccuucgggcuggggcgggcgcgccggcgagaaacgguuuuaagaugggagcggcagcggcggcgaggagcuccgagcgggcucggcucccgcucccgcucccgcccccagacaguucuggaaacuguguaucaccucugucacaggaagccauccggcgaggaaggcggcgcggaaccaacaaacaaacgccugcggccgcccgccggaaccggcgcggggaccgcgucgggcuucgggccguucccggggcgggggcgcagcggccacccccgcgccgcgggcuuugugcggggcgggcgcggcgggccgggcguccccgcccccgcaaccccccaccccggcccgggcggcgcagcugggaccguuaggugacgcuccggccgcagcggagaagcagcgccucggccgccgcccgcccccauuuccacacugggccgccucuccucaaacaccagaggcgggcuacaaaaguuggccccggggccacccagcaccugcccacgugccgcggaggcucgcucccgagucucccccgguucccucccccgccgcccucggccgccaggucaccuauuaccggugggaggggagagaggcugcuauuuaaacgcccgcggaaguugaggcacccccacuggcgggugccgugcaccugccucccgccgccgcgcuccgccacuuugagcagcagccgcguccucagccccgccuccugcccgaaggcgggcgggggggagcgggaaggagguggaagggaucgaauuucuccagcaaaugggaccguuccgacaggauucgguuccccggucaacauuccacauuccaucccucucccgcauuugcaagccaaugccgagcaacccggaaagccugcuggcuaccgaacaacagcccccaacucgcaaacacagacucacaggcacaagacacgugcacugaagggcucugcaacuugcagucccgggguacacacuacacguucauuuaaggaagcaaggagaccaagagaccccacccccacaauuugcagauggugccaaagguugcaauuugcaauccccuuuaaguucacgauuaaucgguacuuugcucuaccaacgccaacuccuaccccauuucaucgauuaagggguuuuacacuuuacaagcagucgcgcuguaaguaaaagaucugaucacuggaagcccaguucggaagaaucuaauugccaaacugucccuccacccccacccccaccccccucucacugcccuugaauugaugcaaugaauauuuuggacauguggugacgcggugacaagagccagggcugcggccaccacacacagauguaccuacgcacaccuauguuuggacaaauacagucccaccacacacacggucucacacacucuggauucauauauguacgcgaaccugcguucugccauugccaucugucuaccaaguugcuacuaugcuuuccacuuucaugcagccuaaugcacuuuggcuuucuaaaaaaaaaaaaaaaaaaaaaaaaccuauaaacuaaagccaacuuaaacugggcuucugcuccuaaacgcguuuaauugaugauucaccugaaaaccgcauguucuucgcaaauccaaaagaagaaauagcucuaagucuucagccccccaaauuugaaaaaaaaaaucauaauaaaacuuacugauccaacauagaucaauucucaggauccaaaaaucauccucuccuccuccuccggcccccgccccggcaaugcccaaguuacuggugggauaguaacgcugcgcucagcggcugccucccucccuccucgcuacagaucgagaacccaaucuuuuggcgccauauuaaugacguauuauauuauuuccacuaggcagcgaccuucggcauuaaauuacucccgagaacucccgagcaaagcaacaaaaccaucaaauauggcugagccucucggcucguccugcagccgccgccgccgccgccgccgucgccgccgcgggaccgggacgcgcacacggacccacacgcggacacgcgcggacacacgcgcggcgcgcccaccccgcgcgccccccgcggcccgcgcgcguaccugcugcggagggguucggccgaggcgcugggcugggcgccgcucgcucgcucggagcugcaugaguucgggccgcggcgggcggggagccgggcgggccccugcucucgccggcgcgcacacaccgggcacucgcgcacggaggcacucucggucuggcguuuggcuuguuauggaggaaggacuaugugaaucaaacucauuucugggucacugcugccacaggggggagcacuuuaaucccuugccaaaacgagaggguggggacgggagggcggagggagcaugcggggagcccgcggcgcuggggcucggucccucguuaacucuucgcagcccuagccgcagccggcucagccugcgccagugggggcucgcaaagaacggcacuguucagcucuuagucucuuuccuuacuucacccaccuugugagccuagaaauucuugaggugucuccaagcaaguggguuuuuaaauuagccccuucaaacugcugucccaguuucaacucuugucugacaucuagaaauggauucuuucagaauaguuuaaaauuacguagauuaaaauauggcuauuaagaugugucauuugggugaaagguuuuauuuuuaggcugaguggcaaaauaguuguuuguaguaacaguuuuagggaguugcacauuaggaugacauuuuuaaauagagagaauccaauucugaauaacaucuuuaccuaaauuuguauggaagugaucauugcaaaugagcauuaauucauuagaagauauuauuuauaaauugacaccacuuuauguuacacauuacuacagaauuggacaucuucucccaaauaugaggagugagccuaaugcuaaaacuagaauugcagacuaguaucagaucagucaucggagauucauuuggggguauuuauguguaaaaaggagugguuacugauuuucugcagaagacaagcuugcuuuuucauauagagggcaacauacuucuuucauggauucaucuagggaaauagagggguauaugacauucaacuucaauaagaaaaaaguacggauuaaaaacucccauucaggccgggcgcgguggcucacgccuguaaucccagcacuuugggaggccuaggugggcggaucaccugaggucgggaguucaagaccagccugaccaacauggauaaacccugucucuacuaaaaaauacaaaauuagccgggcauggugguacaugccuguaaccccagcuacuggggaggcugaggcaggagaaucgcuugaacccgggagguggagguugugaugagccgauaaugcgccauugugguccagccugggcaauaagagcgaaacuccgucucaaauaaauaaauaaauaaauaggaacagugaucacuaauuacaaaauugaauaucgaacccaaaaggcauauguguccaccggaagaaucuuucugaauauaucagguuugauuucauguaaucccacaccagcccaacuacccacauccagacccacauccagaacguuauaaucugauaaaugcgacaaaacaaaacuaauugagccuuucaguuauuuuucagaaaacaaaguaagccaguggaaauccuaaguacuguauauguccucuccuguuucgcuaaugaagaguagaaagacucccugccaguccuauucauguguucacuuaauccuguucaaagcgaucacacauguaaagcacuguguuaacuaucauuauuacuauucuuaguauugcacuuguuauuguuauuuuuacugguucaccucgcacauacucucuguagaaguuaaaguacacaggcuuuguagccagacauggcuggaucuggcucuaucaguuagcaguuugugugccugugggauaaaagaacuuuaucugagccucaguuucuucccugguaauaaaauuaaguuaacagcuggccccuaaccugaaggguuguuaagaggaaucaggcaaccucauaacaguucaggaguagaggcccuggcaguaggagguuguccacucccucggccaucacucaacuccuucuugguuuucucuccaucaaaaauugcaacuuuucuaaauuccaaacagccuuacuucacgcauucauguuaagaaaauuuuugucgaccgggcgcgguggcucaugccuguaaucccagcacuuugggaggcagaggcgggcggaucacgaggucaggagauccagaccauccuggcuaacacggugaaaccccgucucuacuaaaaauacaaaaaauuagccgggugugguggcgggcgccuguagucccagcugcuggggaggcugaggcaggagaauggcgugaacccggcaggaggagcuugcagugugccgagaucacgccacugcacuguagccugggcgacagagcgagacucugucucaaaaaaaaaauuuuuuuaacucacauuugcugcuuacucuuuuauuugcuuuuucuaucaaaaacaucaggcaccaacgaaaguauugaauaaaauggaugacaaaaauaaagggauaaaauggcacacaaacuccccacacugacacauugaacaugagugaaggugccauguacagagucucaauuaugccguggcuucagaauacucauccacugaaacagugcuaugugcuauaaauagcccuggacaagaagucaggagacucccaccaacucccaauaugacucuuugggcuuuaguuuccccacugagaugauaggaaaaauaaugccuaaggccccuuucucuuuaacauucagucauuucugauuuucuuaccaaacuuagaaacgugaugauuauuugaagaaauggcggacaacuugaauccauaaggaacauguaaaaauauuuugucaucaaugaucagcaguuggcauuucuuaaauaauaggugucucuugccaucagaccacaaaggaaacuccuauacaaccuauuucuaaaaugggaaaggcaaugauaugguuugccuugcggcagcacagauaauacagccuagaauaagaaguacuaagcuggcaauuaggaaagcgaguuucugauuccacucugucacuuacugucuuaccuugccaaaucauuccggaucaucauuuccuagucucuggaauaguucuuuuuaauucacaccuuauuaucagagaugaaaagacauucaacaaaauagcuacaagguacucaguguaauagaaauaucaagauucuugucuuuccuguucguggugauaauuacaauucuauauauccuguacauucugcuguagucauaaacaguuuaauuauuuucuuccauaauaauggguuuuuaugaaauagaaauuuggauauuuauauucauauuccugauuuugaaaccagacuugauuaaaccucugaauguuuacuuagucauuucaucuacuucucuguagguaaagaauuauaaggccuugauaagagauucagaauuguucauauuugaaaugaagggaugcauacacuaaaguccuguauuaucucauuccuuuagggaaaugagcaagaaauucuuacuggcaaauaccacugucaguugguauacauuccaacgagauaauuuuuuuuuuuuucaagaucagggucucacucugccacccaggcuggaguucaguggucccaacauggcucagugcagccuccaccuccaggccucaagcaauucccccaccucagccuccaaaguagcugggaacacaggcaugaaccaccacaccugacuaauuuuucauauuuuuuguagagacaggauuucaccguguuucccagacuggucucaaacuccugagcucaagcgauccgcccuccucgcucucccaaagugcugggauaauaggcgugagccacugcgccugcacccagagagaagaauuuuuuuuuuuuuuacuguaaaagggcaaucuuggauaaaauggguuguauccuaaaaguuuauuugcauguacuuuaauuuuuuuggaauuuugugccaaaaaugucuuguuacuaaagagggcuuagauuguuguuuuuaaaaauaauucuaauaacuaaaugauaaaaaauaacuuuuuauuuuucaaccaggcgugguggcucacaccuguauucccagcacuuugggaggcugaggcggguggaucacuugaggucaggaguuugagaccagccugaucaauauagugaaaacccaucucuacuaaauauaaaaauucgcugggcgcgguggcucacgccuguaaucccagcacuuugggaggccaaggcaggcggaucacaaggucaagcguucaagaccagccuggccaacauggugaaaccccgucucuacuaaaaauacaaaaauuagcugggcgugguggugcauaccugucaucccagcuacuugguaagcugaggcagaagaauugcuugaacccgggaggcggaguuugcagugagcugagaucuugccgcucuacuccagccugggugacagaccgagacuccaucucaaaaaaaaaagaaaaaaaaaaaagaaauuacccaggcgugguggcgcaugccuguaaucccggcuacuugggaagcugaggcaggaaaaucgcuugacccaggaggcggaggcugcggugagccgagauugcaccauugcacugcagccugggcaaugagagcgaaacuccaucucaaaaaaauaauaauaauaacuuuuuauuaacuuuguugaguaauauuguaugagggagggauguaguucaaagaggaauaaggacauauaauucuuuuuuguuuuuuaacaccccuuguccuaauguaugguacauauaauucugaacaagaaaaguugagagccacagucaacaccuaucugaacuccgugacacaggagaugaaggguaagagauuaggacuagaauuccuugucugaccuguuggugaagucaccaguccuuaacaacauuuuagcuccuccaggcaggucauuacaaccuccaaauauauggaauauuuguuucuuguuggugucaguaccaacuaaauuacuuucuucuugagauucuuucuuccccuucuuuuuguuuuccuuugcuugcuuuucauuuugguuguuuuaauuuuguugauuuccauacuuuuagugaaaguaaaaaugucaaagagaaguaaguaugaaaugggauaacaggagauaauuccaccagauggaaaugaccaaagcugaggagguucaaaauaaguaaagcucuucccuaaucaugaaaggaauacaugauaaugaaauuuugaaaauuuagaaaaaugaaguaauaaaacucaaccauauggauaacuauuauaaacauuguccauuuuuuggucuuuuuucuaugcauuuuuccuaaaauuggaaugaugcgacacauuccauuuuacauccuuccuuuucacuuacaucuuucaauuuuuccauuuggguauuaaauacuuuuaugcaauguuugugcauuucaggucuuugacccccucuguguuauuauaccuuccuccacagguuacuuuggcuauucauucucauagcuacucucccuggaccuugucaacuacuggaaauuucugccaucuuuauuaucaaacucaaguaucucccauuuugaccacuaccuuucagauuuccaaagucuauacaucccaccuuacccuucuuuuuaucugaaaguccucugaucuaccccuccagccuuuucuuaccaacaacagaacggauguaacucauaaggucucuaaucagcagcagcagcaccugagaacuugucagaaaugcauuauuuccagccccaccccagaccuacugaaacagaaagugggauccggcaaucuguguuuuaacaacccuuccugguaguucugauccacacucaaucagaaaaacacuuauguaggucucacucccaccuaccaccucuaaccaacuguuuucugaacuuucuugucuaauguuucuucauuccucagacaaauguguuaagcaauuaguaugucccaggcacagggcuggcuaggcacuggagacaagguaaaacaggcaaguaggccuauucuuuguccacgggccaguagaaaauauuaaaaagugauuucaauaaacuccaggguuugggggaggcauauagcauacaccugaucugccuggugggaagaggguggucagagaagacgucagucuaaaaauaagugacacuaaagcugaaacccgaaggcaucagccaggugaggaggaggaggaugggggccaaauguugacuuuuuacaagcccuuuggcuucaggguagggaacuggauggguugggagggcggcggguuuguagacuggagagaguaagccuaguuaggaggcuagaugacaguugaaggcaggcugaacuaucauuguugauuguggagugcagauaggcaaacaaaccacccugugaugagggcaucguuaacacugucucagcucuucagaggccuccagcucccccaguucuggagcugcugcucuaagggguaccugggggaugucucugggguuuacagagucccuggggcaugucaggaggguguccacaaggcagaggcaguguuuggggcagaaagcaacauguaggggaaacaagcaaagcuccugaugggcagugaguagguggaaguccugguacagggggauccaaguccucucccagcacccagagcugaggcucaagcagcauggcugagcagaggaggccucccugacggugcguggggaggacucgggccccucauagggguccugcuccaaccccucuucuuccaaaaggccuggaucagaucccaggacucccuagcauccuggggucaccaccccauaguuucuuuaucccuccaccugaaagcuucauuuuuccccacuuucuuccacaauucaccuuaauggcccauuauaaccugagcccaaaucauuagcaaaugaagaaccagguucacuuuucucuaaggcagagcuggcuugguggggaggcgggagaggaagcagggagggagguacucucccacugguuuaguucuaauguuaaugaagcaaaaaaaaggagguaaagcagcuaaguuucuguguuaaaacugcuugaaaauucacuuuugugugugugugcaugucggagggaguguguguguuucugccacgaaacauauuuaaauguagauaagacuugauggguuagaugucagagaugaaggagaaguuggaguaaaagaugacuccaaagucuguggcuuagagaacugaguggauuucuuuuuuuacucaaccaacaguugcucauugagcacugaguucaggaucuauaaugguagacacaaauccaccccugucuuucuaguguuuacuuuuauucucggagacagugggaauaugaugaguucaauuugaggugcccaggagacacccaauugaagaugccccagaaggcagaugggaaccagaagaaaucugguacuggagagaaaggcuggguugcaaauauuggauuaggagccaucagcauagagagauuaacugaggccaccagaguggaugagaucaauaggacguuuccauaaagugagaagaaaacagagccuaggcuagaaacuaaaaagaagcauuuaaagaaugggcaaaggaagcugcaaagcugcaaugguuuccuugaagacaguccuagaauaauucaaacauauuagccuucuucauugcugaauuuggacuucuaagcuacuggagaaagucacagaucugugcugauugguuccagaauacacucauuaucccccaccuccacaaugcccugaaaucacucuguuuuccuagucaguucagucugcauucuccugccaccugccucagcacuuucacuggagcuucuaaccuacgucacuaucacggagguaacaagccaaugaacaagaaugccuucagcuucagcuucuggcaccaaacuug

SEQ ID NO: 21367 - RNA, 110275 nt, Homo sapiens
ggcggcggcagaucccguaagucgggcggccugguagucgcagcagccgcugccgcagccgccacauucaacaggcagcagcgcagcgggcgcgccgcuggggagagcaagcggcccgcggcguccguccguccuuccguccgcggcccugucagcuggagcgcggcgcaggcucugccccggcccggcggcucuggccggccguccaguccgugcggcggaccccgaggagccucgauguggauggccccgcgaaguuaaguucugggcucgcgcuuccacuccgccgcgccuuccucccaguuuccguccgcucgccgcaccggcuucguucccccaaaucucggaccgucccuucgcgcccccuccccguccgcccccagugcugcguucucccccucuuggcucuccugcggcugggggaggggcgggggucaccauggccgaggcgccucaggugguggagaucgacccggacuucgagccgcugccccggccgcgcucgugcaccuggccgcugcccaggccggaguuuagccaguccaacucggccaccuccagcccggcgccgucgggcagcgcggcugccaaccccgacgccgcggcgggccugcccucggccucggcugccgcugucagcgccgacuucaugagcaaccugagcuugcuggaggagagcgaggacuucccgcaggcgcccggcuccguggcggcggcgguggcggcggcggccgccgcggccgccaccggggggcugugcggggacuuccagggcccggaggcgggcugccugcacccagcgccaccgcagcccccgccgcccgggccgcugucgcagcacccgccggugccccccgccgccgcugggccgcucgcggggcagccgcgcaagagcagcucgucccgccgcaacgcguggggcaaccuguccuacgccgaccucaucaccaaggccaucgagagcucggcggagaagcggcucacgcugucgcagaucuacgaguggauggucaagagcgugcccuacuucaaggauaagggugacagcaacagcucggcgggcuggaaggugaguggacucggcgcgcggccggaccuugggggcgcggugggucaggcgagggcgcagcugugcagguuugcucggccugaaggugcggagcaggagggcagcgcguucccaggagggcgggcgagaagcgguggucgcgguggccucgcccggguccggucggggacggcaguaggugugcgugcgcgccagucaggaguucgcgugggacgcgguaaggggcucguuggggaacuaaguaaagaaagugcgccaagaaguggacgucagagcgaggccgaaaaguuugccagugaaaggagaaagggguucgcugggagcggcaacccccggcccgcgccgacugcuucggcugccccuucccucccggaccuccgcggggggagggcggguucucuccggccgcgccgcggagcuguuuccgccgggcgcggcgggggagggcgcggcgaggggccccggagccucgcugccccgggaccgggcugcagguggaggggacaggcagggcgcgaccggccggggacggugcagggccugccgggcaguuucuggaggcggugcgcauuuugcuuuguuuugguuuucuccggaguggccucgagugccgggggcccggcgucccgagcccgagguggugccuccgacacgugcgaaggggcggccaccgccugcggagcgccggcgccuggccgcgcggggcgagcuaaaguucaagugugacccucggcgggggcgggcgcgggcgguggcgguggcgguggcgguggcgugggaggggccccgggcgcaggaagcccgcgccuuuaaagggccagcgcgucggggccgggcgccguggggccagcguuucuccaugcggggaagcgcccgaacuuggucuugccccugguaggaggcuuuuaguuagaaacacagaggcugcccugaggggccgggggcugggaugugugagucuuuuccugccuugccacccuauucuugagcauggaggaccaggcgggggggcuuugcgaccaauguuuugagggagucggaguggcggugcgcgucgagggagcggugccuugaaggaggauuuuugccauuuuugccuuucagagcguggccaggagagacuuagcgugggggcaggcacuucccgacuccgaggagaaggcccgggggcccucggcuccggggaggcuucccgggggcgggguccagucguggcgcggccuccccaagcugacaguuucucacugucaccgguggcggaauugcuguaaaggcugucuaguugagcuaaacaccucccuccccuccuccgagacggagucucgcucugucgccaggcuggaguaccguggcgcgaucucggcucacugcaaccuccgacucucugguucaagcgauucuccugucucagccucccgaguagcugggauuacaggcacgagccaccacgucgagcuaauuuuuguguuuuuaguagagaccggguuucaccauguuggccaggauguucuggaucuccugaccucgugaucggcccgccucggccucccaaagugcugggauuacaggcgugagccaccguucccggccgagcuaaacaccuuuuuaaaacauaccuuucuucgccucucauauuggacuccacggcauaauaaagauuggucuuugcugcgcaguuguuaacaccaagguuauuuuacacacagugucaucccugugguuaaugcgugucaaaaggguuaaguuacucacaccuuauugaaguuccuuuagaaggaauucaagauucauuuuauuuuuuccaaaguguguuuuagaguaaagguaucacuuaucgcuucauuaccaggcauuacaugcaauuuuaccaaguguuucaaaaaaguaaagugccuucuuaccguuaaguucagcauauauucuauuaagucacaaaaucgaaauugucugccaaaucuuguuuuacuuaacauuugaauuuaaguacuugacuuacuugcucaucuaucaauuccacuucagcuguuacagaguauuagccauuuaaaaaaaaaauccuccccccuuuuuuugcauucaaaguacaguguguacuuacaccauucuuuaguccuuggaaauggauacaaccuacuucaacuugcuggagugccuuucuuuaaagauaaaggaaguguuuugggauauuuuuaguuuugcgucucaaauggcauugucagaguguuagucuuaaacuaggaauaugcuuacacuuuuuaagauuuagguuuuuaaaaaauagauucugauguuaaaucaucuuuacaaccauuuuuaucagguucuuguucugauuuuuuuaaaaaugcaagaauaauuuaguuuuuuuuuaaauuuauuugccagagcuaggagaccuguuaaguuaucugucuggaauuggaggcccuugggcagcucccagugggagccuaauggggcuuugcuuuggaguaggcugccuuucucaaaugaguaaguguuucagguguaaugucaguugguuuaagucugauugcagcaaguacauuuucaguuugaguaaaaggguauuuuaagaagaaaagaaacaaccugagcuguucuaacucauaacuagucuuuugguuaguuucauaaaaaugaguuacuuguuaaaaccaaguuucacucucagaucugaaagacuccuguucuaagagucauaaaagagaaauuuuacuaugaauuuuaacuuaaauccaguuuuuaaaugcaaagcaaccaaaacuuaacuguuuuaggaccgaggagagguugcuuuggcacaaaauauuuccugugauuuacuacugggaauuaggcugaaucuuuaauuaaauaguuucuugugugcugcuuccuggggccugccugaaaguuugagucauuugcauaggacaaacuaguuggaaaacuguuaaugaauucaaaaacuuuuaaugucauucuuuagauaguuaagugcugguuauauuugaaggauaugcauuuuguguuuguggggaugguauguuaaaugucuuacacuuguuguaauauuggcuagaauugcuauaaggucacacacaaaguggaaccuaagacuuuuggaaaacccgggaucuucuaaaucuagugcaguauuuauaaauaaugaaacuucauuuccaugaccuguuuuuucacauagaaagccuucuaaagcuugggaagugguaguuugaacucugauuuuuuuuaauaaauggcaguuuugaguugacucuuuugauauuauuaggaacacuuuagguuaaaagaaugacuuugacuauaccacuuaacucuuguuaaauaaauuuuuagauuguuuuauuagagguauccucuuugauuuaaagauaaauaucuuuuuuuuuuuuuuuuuuuuuuuuuugagucagagucucacucuguugcccaggcuggagugcaguggcgcaaucucggcuugcugcaaccuccgccucccagguucaagcaauucuucugccucagccucccgaguagcugggacuacuggcacgugccaccaugcuuggcuaauuuuuguauuuuuaguagagaggggguuucacauauuggcuuggcuggccucgaacuccugaccucgugaucugccugccuugaucuccuaaagugcagagauuacaugcguaagccaccgugccuggccccaaagcuuuuuauuuuuaagauaaaucuuuaauugggagugauguuucuuauuuggccuaugaacugacaguggauuuccuuauguuuugaaauaaauauucuguaauuuggguauaaucuauaggugaguaauugaaccagccacagagaucccguuagaaagauggcugcuuuuuuguugcauggucacauuugacuuagagaauccuggugagaccgagugguuagaggaucugagacaucuuuccuacuucuggauugucacugaaauuaccuuaaagaaagccuugauaggcugggcgugguggcgcacaccuguaaucccagcacuuugggaggcuaaggugggcggauugccugagcucaggaguucaagaccacccugggcaacauggugaaaccucaucucuacuaaaauacaaaaaauuagccgggugugguggcaggugccuguagucccagcuaucgugccaauaaucccaacuacucgggaggcugaggcaggagaaucgcuugaaccuagaaggcggagguugcagugagccgagaucacgucacugaccuccaaccugggcaacagagggagacccugucuccaaaaaaaaaaagaagaaagccuugauaauccuguauauguacuuggggaagcgauaaugaagaaauaauuuaaaauggaugaggggguuaugcagcuaaauguagcaucuuauuaagggcugaaaguuaccugaaucuauuugagagcuaaaacauuuuguucagaaauuccaaaauagaugccaaauuggaauacuucauuucagacucccaagagcuuuacuuuuuacgcaugguuuuguggcauguccuugguugaggggauggcgagaagaguggccucuuuuugaaugauucucauuuuuguuguuguuguuguuguuguuguuguuguuguuguuguuuuucugagccagggucucacucuguugcccaggcuggaguguaguggcuugaucucagcucacugcaaccucugccugccccuggcucaagugauccucccaccucagccucccgaauaguugggauuaucggcacgagccacugcucauggacuaguuuuuuuuaagugacaaacacuugacuauugaaaauaaggcauuuuaauucucauguaaacuugaaaaaaguuaaaggucuucaagaucccaaaauugcugaaaagguaucacauuagcagcagacacauagauuucaugcuccgcacacacaaggaaucuucuccgaggcgauacgaaaugggaugagggggaagaauauucaguggcaaguuagaaugccuugcagacuguaaacauguugccuguccuugugcuucuagccccuucauccaagcaucuaaacugcaguuuuguguuaggcuuucuaagauagcagcuguauuuggcuggaauuucucuggggaagccugaaugauuugcauuuuucuggaacacucugcccuuggaaacuacccaguucccuggcaucaugggaauuuacccagccauuuuuuuggccuauaugugcuguagcuuuggggcuuuuuggggauccucuuggaaaggcaguguaaauaccacauagugauuggggaaggcagaauuuucaauugugugggaguuggucugcuucccugcaguucaagauuugccuuugccuuuguagcaacaacuugcagagacuugcccagcccccccaggaucucccuggggucauauaaccaagcaccuuuucuugguacauaaagaauucugaugcuucuggugguguuccucagcugugaaacagaagaccacauguacuugaaaaaguauguauuuugaugccuaagggauaugcuguguacaaauacuuagaguguggaagacaucuuccucuuugccaguugcugaugaggaugaacaaaaaucaagucaguggcacagaaauucuuuuguagguauuacuacuuguuauuuguagucuucuaaggaacauaggaaacaugaaaaacacauuuuuguacguuggcuauuuuauaugguucagccuuuuuaaaaacuugcuuuauucauuagcaucccaguuuacucuauuccgucuucucccugugguuuaucaacuuguagguuaagcaccgccaauaguugaaucuaggguugacuuauucuugcuacuuggcaggcauuugggcuacuuuuuuuuucuuucauccauuuuuguauaguuuugauaaaaacuaaaaaggaaaacaaaaaagcaaguuaguuuugauauuaagucaaauacuacuaaaaagguaaaucugcagcuccucaucauacaauuuagugaauuuuuaccuucacuuauuacuuuaauaaggacauaaguucaaaauguguccuuuauuucaagccauauucauuacaggaaaaaaaaaaaaucaagggagagcuguuuagggaauuagccuguguagcccccaauucugguuuuuguucugaugaucccugaagcuacacucuuuaugagaguugggcgugugugugucuaagucuuccuuuucuuuucuuuucuuuuuuuuuuuuuuuuugagacggagucuugcucugucacccaggcuggagugcaguggcgugaucucagcccccugcaaccucugccucccagguucaggugauucuccugccucagccucccgaguagcugggauuacaggcacaugccaccacaccuggauaauuuuuguauuuuuaguagagacaggguuucaccauguuggucaggcuggucucgaacuccuaaccucgugaucugcccaccuaaagugcugggauuacaggcgugagccacugggcccagccuaagucuuccuuuucuuuucuuuuucuuuuuugagauggagucuugcucagucauccaggcuggagugcaguggugcaaucuuggcucacugcaagcuccgccucccggguucacgcuauucuccugccucagccuccugaguagcugagacuacaggcgcccaccaccacgcccggcuaauuuuuuuuuguauuuuuaguagagacgggauuucaccguguuagccaggauggucuccaucuccugaccuugugauccacccgccucggccucccaaagugcuaggauuacaggcguaagccacugcgcccggccacgucuuccuuuucuuagcuuugcuuugagaaaucguuucuuaucuuggauuccauuacaaugguccuccugccaucuggcuucuccaguugguucgcuuauuuuuccuucuccuauccucauucauaaguauaccucaggacuaguuguggacuuuuucucugguauuuucuuagguaacuuacucucuguugccuuguguauccaguuaccuaaaggcucuggaggucccacuuuuaucucaaauccagcaugucuaaaacugaacauacuguauuucccccugcccucagauggcucauuucaagguccccaguuggguuaauggucuaguuaguucuuucccuaguuuucaaaccuuggugucuucuugagcacucuccugguguuuaguguucccaagucuguuaacucuucuuucucagggucuguugagacuuuccguuccuacccgcuaaccauuccccucguuuagcuuuuaguauuucaggccuagacgcuccuguccccagagcuuagaucaucuugagcccugaaauucagcagaucuugcucagugugcaagguucaagucaguucaccaacuuccaaucuuggcuccuacccagaggaauuuuuguccucugagugaauaucugguaaucuuuuaauucaugcugcuguguauuauauauaauuuaacuuuaaugucuguaugucuuggcuucucaguuacauuguaaauauguuguuaggaaaaaaauucuuucuugauacaugggucuuuuauauuucagcuuccuguguguugagaauaucacagucuguaucaugugagaauaauuuaagaaguaguauaacuaaagaacagugauuauuuuguuuucaacagauugucagaguccuuuuuuuuccauuuauuuguugaauaauuacuguguacaagaugugcuagguguuuuugagugguagcaaugacucaaaacauagauccaguaggaagacuagaugcaauguguaaguaacuaugauauacagugggaagaguuaagugucuuagagaaaaaugaaguucuguauuggccguugaaccaggcuuugaaaaugggagauugggccuggcacagugggucaugccuguaaucccagcacuuugggaggccaaggugggcagaucauuugaggucaggaguuagaaaccagcuuggccaacauggcaacacccugucacugcuaaaaauagaagagauuaagugagugugguggcaugcaucuguagucccagcuacuugugaggcugaggcaggagaauugcuugaacuuggggcaggggguuggagggguggagguugcgguuagccgagaucacgccacuguaguccagccugggcgacacagcaagacucccaucucaaaaaaaaaaaaaaaagaaaaaaaaggaugggagauuguucccuuacgauuucgcuaugaaaauuuucaagcauucagcaaaauuggaagaauuucuacuaccuuuucuacuaaugacauuucauuaugcuugcuugaucauauaucuguguaaaugcacaucuuucuguccauuaguucaucuuauuuucaagauauauuuuugggaugguggacuggcauucauaaaggccugaaaauaugggaagcaucaguuucucugagugcgaagucaggagauugagaccauccuggcuaacacggugaaaucccgucucuacuaaaaagacagaaaaaaauuagccaagugugguggcgggugccuguagucacagcuacucgggaggcugaggcgggagaauggugugaauccaggaggcggagcuuacagugagccuggaucgugccacugcacuccagccugggcgacagagagagacucggucucaaaaaaaaaaaaaaauuucucagagugauaggcaugugaaauacacaaacaguuugaaaaguauagguagaaaggacauauuaugaaaauaaugcuguguuauggaccaaauuuaucaaaugauaucuuuguuuuugccaaauaagaaauuaugaaaauaugauuacauuaaacaauuuuaaaaugcaacuacuuaggaacacacuuguguaaauauggagaccuauggaaugcaauuuauagccaguguacugcaguugauuuugaaacugacauacggaauuuggcaauacauagaacagauuauguaauugacuuaaugugaauaguuggcauuuacaauguauuuagcuuuuugcuugaucuguucuuuaaaauuaacuucagugaggcccaguguccugguagcagagugauucaaagaaagaaagauuacuauuaaauuaagucuugcuuuuuugaaaaaugagaaauucugaauugaagucagcaauuucaaaauauacuuaaggcaauuaugagggaagguuauauuggcuugaaaagauacuucaaaauguaaaugucaguucuaauauugccuuagcuaaauauuagauauccuugauggcuuucuuauugcaauaauuaucuucccacuaacccaaaugcaagaaugaagauuauaaugggauauuucaauagauccagaggagguuaaauuuggauaggccaaaugcaaaacugacaccauuacaguccaauaggacugaauguauuaacuguuaaguguacuuggagugagucugacuagcucauguugaaccaaaagguuuaugcaguaaaaauggcauuguggcacaucagaaggcacaguuguagauuaaauaacacucaucagccauuuagaaauggcaaguguugaggagagcuguccgggcgcgguggcucacaccuguaaucccagcacuuugggagguugagguggguagaucacuggaagccaggaguuggccuggccaauauagugaaaucccaucucuacuaaaaauacaaaaaauuagccaguggugauggugcaugccuguggucccugcuacuugggagacugaggcacgaaaaugccucagaccugugagguggaggcuguagugagcugagauuaugccacgacacuccggccugagccugggcgacagcaagacucugccaaaaaaaaaaaaaaaaaaaaagaaguguagaaaacuauuuuacuaauauauuuaucccuauagaagcagacauuuuauuuaaaagguacauugcugaugaggggugggggacaguuaaauaaaugaaaaagcccacuaccgugagguuuuauuaaaugucuaaguuaccuuccacguggagaaaauagcuuucagacgcaccaggaucucacacuugcaugauuguuaaugaugucaggcaaaacuagucaaaaccaacuaggaaacaauauggaacuggccagucuaauuuuuuuuuuuuuuuuuuuuugagauggggucuaacucugucaccaagcuggagugcgguggcccaaucuuggcucacugcaaccucugccucccagguucaagcgauucuccugccucacccucccaaauagcugggauuacaggcacaccuguaauaguagagaccaccacaccuagcuaauuuuuguauuuuuaguagggacgggguuucaccauguuggccagacuggucucgaaauccugaccucaacugauccacccaccuuggccucccaaagugcugggaucacuggcaugagcccccacgcccugccgaccacuauugauguuuguagauccagugaaguucagaauuacagcacaucuuuggucuuuuaauuuuuguaaguaaagauauuauauaaaacaucuucauccuucaacuucauucucaucuugguucuaauuuugaagggaggguucccugaggguucuuaucucccucagggaagggagguagaucauuucuuucaagauagccuaucucugcugaccuuaagucauaggaguucuuuaauucuuagagaccucugccuucucagaggccaguaccaccucuaaagugucguggccccuuggucuacacugcagcaccccucaucugggaagugcuguuaucuccaguaagccccacuguauucuuuauacaucucuggccagccacauauagaaauuuccaggcugucaacuuuuucagugugacuugguuccagcaucuuguauacagaucuucgagaccuaaaaagaaaaucuuuuuuuucugcguugauguauuuuucucccuagaugauguuugucuuuuucuuuuucuucuuuuuuuuuuuuuuugugacagagucucgcucugucgcccaggcuggagugcagugacaccaucucgguucacugcaaccuccgccuccagaguucaaguaguucuccgucucagccuccugaguagcugggauuacaggcggccaccaccacgccuggcuaauuuuuuuuuuuuuuuuuuuuuuuuuuuuuuaguauuuuuaguagagaugagguuucacugucuuggcuaggcuggucuugaacuccugaccuugugaccugcccaccucagccucccaaagugcugagauuacaggcaugagccaccgagccuggucagaugauguuugucuuaauaaagaugucauucauucuuugagcaguuccaguuacagagcugguccuaaugauauaccccaugagcuuaacagcccuggaaccccuaccugucuuaucugauaagggcaaaacugugaugagaaagaggguggaagagagggcuucccuuguaugcuuuuguucuuuuuuguuucauuaaagauauuucuuggauaaacaguuuuucucaauugcuguucuaacagucuggaaaauauaggucaugguuuugugacucucuacucuuacuauguuagagauaugauaaagcauccauguugagggaaaauauguguuucuguuuaaaaccgugguuuccccaucuugaagguguuauaguacugccuuuguaaguacuggugaguacuuacaaaguacuuacuggugaggggcuggguuuuugcucaguuaaaaaucugaaaguagccaagugaaccuggcaucaggaaagggagggaaccucugugguuguauuuuguaacugcaguaaaaaagccaaugcgcaugauuaauccuccuaagucuuauuugggccuaaugaggaaaggaggaagagggaaaccaguuugcauuaugugggaagauaaagauuucuucaaugguuugguauucugaagaguuagcugaggccgggaggcacugggcuuugucuccucaguguuucggcccucuccuuucauauugguuuuccuuuuuuaauuaaaaaauuagugcauuuccucugcggguaccaggcucagaagccugccaugcaaguggcugagcgaaaaccccucuuugagugaggaauccccagcacagaaugagagggucuucaucuugcagcaguggcaagggugagagugaaaaggcacccugcauucuguaccugaaaagaaaugcauuuagaggcugggcgugguggcucgugccuguaaugucagcaauuugggaggcugaagcggguggaucaugagguuaggaguucgagacaagccuggcaacauggugaaacccugccucuacuaaaaacacaaaaauuagccaggcgugguggugcgugucuguaaucccagcuacucgggaggcugaggcaggagaauggcuugaacccaggagguggagguuacagugagccgagauugugccacugcacuccagccugggcgacagagcaauacucuugucuugaagaaaaaaaaaaagagaaaugcacuuagauuucaaauuuaguuuggaaagagaaauuauaauugaaucaccuaauucccaggcuuguaaauguuguguccuucaaagcuugaaagcaaaauaaccacauaaauauuugggagugguucauacaaguaaacgucaaauacuugagacauuuugguugcuuggaagcaaggucaaaggaaaugguuugcauaugguuuagcuagaagcucuuauuuuggcagauucuugagguaguaacggucacaauguggauuuuauuguucuauuuugacaugaaaaagguuuuuucucuucucuaaccuucaggauagaguugcauaaguaacaucaagauaggcauguucagucaccauaauuuuguaucagagaugaugugccuucaugagcugugagguuuaauuugcagaaucaucaguuugggccggcacgguggcucacgccuguaaucccaguacuuugggaggccuaggcggguggauaaccugagguuaggaguucgauaccagccugggccacauggcgaaaccucguguuuacuaaaaaugcaaaaauuagccaggcguguuggcggacccuggggagccagagguugcagugagcggagaucuugccgcuacacuccagccugggcgacagagacuccaacucaaaaaaaaaaaaaaaaaagaaucaccaguuuguuacaccaguagguuucagccugccaucauucauacuauacugugauuugaauacaggagaaagugggcucucuugaauuacaguuaccucaucuguuugcagcagaacucucucucugcagggcuaccuccuaaacggggaguggggagggaggagaggggaacuugcaaaacuuguaaauaucgauugggguuguuuguguacuuggcaccaagcugguugcauuggaaacuuuucucucuggauggguagguauguaggccaucaugaaauuuacauguggugaaugggaaagcuuccuguggaucauccuacccugagaguucuucaaucuguaugacugaauuggucucuccccuucaaccuuuuaggauuuaauuuucucuucaguggcccauuaugacauuuacauacguugaauuugaaagauucccauacucccagucucuucuguuaccggugugccuggagcaguuuguugaauuugugaaauuuugagauagaaugaauuuuguaggaccugaauuuauuuauaaucuuauauuuauauuauaaauaugauguauauuuagauguauauuuauguuauaaauauaauguauauuuagauguauauuuguaugucauguauuuguauuaacaugaagucuuucugaugaugauaaaacacuauuuuuaaacauuuagcaguugaugacuacauuuuagaggucaucaaaauguuuuauuuuuuccucucuugaaguuauuugguauaauuaaaaaaauucauacuaaggaaauuuaucaggguuaaagauuccuguaauuaggcauguuuugauguuauugauauccucuuuucugguuuuggaguggauacuuucccugcugugaccucugugcucuguagugguucuccuagggaauuauauuccaguaauucuggguauuucuuuaaggugcuuuguauuucuugaagugccauuuugauacuuucaguguucugaacuguaccuagaacguacuuuuuauaaaaaggaagcagaguccauccaggcagagagaguacugugugccuguagucuugucuauucgcaaggcugaggccagaggaucccuugagcccaggaguucaaguccaggcugggcaacacacugggaccauguuucuuaaaaaaaaacaaaaacaaaaaacaaaaaacaaaaaaccaaaaaaacuaggcagugcgugguggcucacaccuguaaccccagcacuuugggaggcugagguuggcggaucacuugaagucagcagaucacuugagguuaggaguuugagaucagccuggcuaacguggugaaacccagucucuacuaaaaauacacaaauuagcugggcaugguggugcaugccuguagucccagcuacucgggaggcugaggcaggacaauugcuugaauccaggaggcagagguugcagugagccaagauugcgccacugcacuccagccuggguaacagagugagacuccaucucaaaaaacaacaacaauuaacaacaacaaaaaccaaagcuaaacaagagcagaauccagauuauuaaaauaacaauuuaaaaagcaugauugucacaggcuucaauaauuaccugccugcucuugaguguuuagguuggucuuggaaucggccugucccugugcuugaggaguggacccucagggugucacugcccuucuuugugaucucuuuuuagccuacuguccuuccuuuggugccuaacucagaaauaaacauucuuaaucuguucagcuuaauugagauucaaaccucuuaaaaaguaguuuugucaagaggcgugugaaccagagcaacuccauuuugaauaggagcuggguaaaaugaggcugagaccuacugggcugcauucccagacgguuaaggcauucuaacucacuggaugagauaguuggucagcacaagauacaggucauaaagaccuugcugguaaaacagguugcaguaaagaagccagcuaaaacccaccaaaacaaagauggccacgagagugaccucugguuguucucacugccacacucccacaagccccaugacaguuuacaagugcuguggcaaagucaggaaguuacucuauauauauagucuaaaaaggggaggcaugaauaauccaccccucguuuagcauaucaucaagaaauagccauaaaaaugggcaaucagcagcccuugggcugcuuugucuacggaguagccauucuuuuauuacuuuacuuuccuaauaaacuugcuuucacuuuacucuagggacucguccagaauucuuccuugugggagauccaagaacugucauuugaggucuggauugggaccccuuuccuguaauaguuugaauguuaaaguuugugccauugcauucuuuggugugauugcuuuauucugaacuagaggugaagaauguggggaauguggaauaaaaugaagggaauauaucaguacagauggagcucauaauuuauggugaauuucucauuccucacaauuggaggguauauguuugaagugagucaauuucugaauuuauuaccuaauuugauuguaugccuuauacauuauauuuuuaagaaaaaaauuaaaauaauuauugugcucugugaucucauugaacgauguaaaugaucuugggucauguaaaaugcugaacauauaggaggacccuacuuaauaauuuccuuugcgaugaaaauagggacacauuuuaaucaaagacaaacuguugaugguuauguuucuuagacuaaccaugacuuccgccuguguuuauggcaagaagggaaaaggaaaacacuuucauccacagaagucaucaauucugucaugauugacaacuugggggccuccaauuaagccucauuuauacuccccaccccccauuuuuuuagagaauugauuuuaaaggguauugggaggaagaaguaauuaagucagagagauaaaaugagaacuuaaaacacuucagauuguagaguaaugcaucagagggauucuuuucaagacagaauugucugugauccuuaacugugugaauacacuccuuggauuugaaaugaagacaaccccuuuccacuuagucaugugcccuaugaggcuuguuucuguguggcuugcugagacucacuuaaaaugacauugacuuuuauuaaaccuuaagguuugugaugggcuuuuugcacaaaagccuacuucuccaggggacgucccugcucucucagguugcuaucuuguuacucuggccugaaacaaguuagcagccacuuucccgcagaccugcacaaggcacaucacaucaacggcuguugauuagagcauaaugacuuguuagaucauguuuauugugcaaaugaaccugaauguuacuaggacagcauauccauguaggcuuagaaaacuuaauuuuuaaugccccuucuaucuuucaucaggcuaaagcuuuuggauuuaugguuauucauucuagcuauaaauauauuaauaguauuuugggcuggucagauauggggcaugaccuuugacauccugcuuggcuaugccugggaauuugacauccuucaauuuagguggaauucccuuguuuuguuuccugugauaguguggggaaauacacauuuuggcuccuucggcagaggaagacaggaaaaaaguaaaauuggaaugcacuaagaaaguauuaaugauuuuauuucugcuguguauaguugaaugcacaugcuuuuuauggaagccugagccuaugaaaauagugcacaauaauaagaaaaugcuaacaaucauauuuaguuuuugcauuuuuuaauuuggauuuauuuuuugacuaguuugacauuuuuggguuuuugaacuguuuugcaucuaaguauacaugguggaaagaacuuuuugugaugccuuuacuaguauuaucaguacagaguaucaacaguugggaagagcuacaaaagggaacucuuagccgguguguauuuugaccugaggaagggaguguucuguugcuaccaacuaaaaguuuaugagugugcuucuguuuccugaauguaaucagcaccuccaucaauaauuaucccuguaggggaacacaauauggcuuuccucuacuguagguucuuugacugagccaauaauuaaauugacauaaggcagacuaacaagauaaaaaaaaaauuguauuuucuuaugcacuggugacucgaagaagagucagaugauugaaacuuauagagcauccucagcuauaaguuaauggggauuauacagauaaaggggaaaagacaaagagacucuuaccacucuugcuuugaccagacucugcaggcauagaugugggagcccaaugugguaaaaagucuuagcuacagcuggcguuuugucagggucucaggauccugcagcuggaacaguccuggagcuaguaguguuccagccagugaaggaugcuccacauugggcaccagaagcuauauagcagggaaaaauggcuuccccccauccuucuagguucuuugggcugggccaugauuuaaauugacacuagauagcugggcgcgguggcucaugccugugauccuagcacucugggacgcugaggcugguggcucacuugagcucaggaguuggagugcagccugaccaacauggugaaacuccaucuccacuaaaaauacaaaaacuagccagaugugguggugcacggcuguaaucccagcuauuugggaggcuaaggcaugagaauugcuugaacccaggaaguggaggcugcagugagcugagaucacgccacugcacucccgccuaggugacagagcaagauuccaucucugggcaggggaggggaagaaauaaauaaauugacacaugguagacucuaacaggagaaaaugucauuuuauuuauacuuauguuugcacaagagucccacaaaauguaaugcagguugcaugauugaagcuuauauuguauacugagcuaagaaaagaauuaggguuugagguuuuugguggggugguggccacacaaguuaaaggaggaugaggggaagaauuauauggugaauaaagauugucuugcucuuggggauaaagucucucagguaauaaaaguugucuggagcaguccuaauccuaguacagauacuuuacuaauguagacuuccuuuauggaugcaaauuucuuuuacaaaaggacagcuuuucuugucuacucuggugucugcaguuucacagaauaaccagcucaaaauaugccaaggaaguauauuuugggguggcauauucugaucuccuacagucauauuuugggguaguguguccugggccccaacaucccuuuugaauuguuacgaaguucaggccgggcgcgguggcucacgccuguaaucccagcauuuugggaggcugaggcagguggaucacuugaggucaggagaucgagaccacccuggccgacauggugaaacccugucuuuacuaaaauacaaaaaauuagcugggcgugguggcacaugucuguaaucccggcuacuugggaggcugaagcaggggaaucucauuaacccgggaggcggugguuguagugagcugagauugcgccacugcacuccacccuggagacagagccagacuccgucucaaaacaaaacgaaacaaaacaaaaaugaauuguuaugaaguucaaauguccaaaauucgaugaagcggagggaaauugguuaagcuagaauuuuauaauauucaccuuuuagaagucacaguaguuggcugggcgcagcucacggcaccaacacuuguaaucccagcacuuugggaggcugaggugggcagaucacaaagucaggaguuugagaccagccuggccaauauggugaaaccccaucucuaguaaaaauacaaaaauuagcacuccagccuggaugacagagcgagacuccaucucaaaaaaaaaaaaaaaaaggucacagaagucaacuuuugcuuuaaaaaagaaaaccacaauuccuucacaccccucaaauaaucaauuaauaggcuugcuuuuuguucauuaauuuuuuuauuucccaucuaaggcugauauccaucauagacuaauuaaaauuguagauuguggggagucuaucuguucuguucucaauuauucacuaaauggagagugccaugacuuuuuuuuuuuuuuuugagacggaguuucccucuuguugcccaggcuagagugcaguggcgugaucuaggcucaucacaaccucugccucuuggguucaagcaauucuccugccucagccucaccggaguagcugggauuacagcaagcgccaccaugcccggcuaguuuuguauuuuuaguagagacaggauuucuccauguuugucaggcuggucucaaacuccagcugccuuggccucccaaagugcugggauuacaggugucagccacugcacccggccagugccaugacuuuugagggugcacaucuaaauggcugauauuaaaaaugaguacuuuuugaucacuuccuacuccccuucccuaguuuuucaucucuucuuugcuuuccuucucauuuucggcccccucauuuaaaauauuugacuugaauaaauuucucuaacuuuaauuagaugaaaaguuucuuuaaaggucauugcugguugcuggugugaguuuuaaguuugcuacaacaacccuguuuuacuuauuacugccuuuagaaauagucauuguuauuaauagaacugaucccauuuagaaauauuugcagguggugaugauacacuucacccugggcgugaacaugaugcaagucaccuuaaggccuguaaagaggaaauccacaaggagaaugacuuaggggagugagcuaaauggaaguuaccucuguguacuuucaccuuuuaaacugaaaauauguaaguauguguuugucuuaccauaguuuuacuaccuucauaguguucugguaaauaggaccuuuaaaaugagcagggaaggggagggaaacaguuuuucuggcagcugauagucuggauauauagauguaaauuuccacugaaacugcaccuacccaauccuuuuccuacugugacaugucauuaacucauauuugacuuuugggaggagagaacuacaaacucaugcagaaauaccaaggugugagguaagaagucauagccauuucaguauucuagaugugcaugucaccagcuguugucauugagcuaaaugccuuuguguuuucaguguugucucgacucugucgccagcaguagucugguuuagucugguuuagcaaauucugcagccuuccugccucaucuguguugaaugcuaagauuaguaacuuugagaugaguaguguuggcugccuucacauucugaaguucuuaauuuuaacuucuggcuuagagaauaugagaccauggacuggauggagaagucucuuaacauuaguaaaaggaguuaaauucucagggugguuucgcuuuugugcuugaaugaggaugggagagaauacugccauucucuguguuuugggugaauaaucccaaagacauuuuauauguugagaguuuagagguuugacccaaucaaaccgggaauuguauaacugggauguccaauaccaaggccucuaagcuccugaaaaacacuuuagaaguuccugagccaucauuguaugugugaccugguauaucccaccggacucacgugcaggucuuaacauugugauuuuuuuucucuggcucugguuagauuuggcuuuuacucuaucucuggcuucuaaucgguccuccuuucauucucccacccuacuuuucucuccuaguaaauuuuuccuuucuguuagaggcaguaaaguccucacucuccuugucaguccacauggaagcuuugccuacuuggcuccccuuggggugcggugaggugagaggaggagucuaguccugugcuaaucgcagauuguuggggacauguguuucaauuuccuuugucucaguuuucccaccuguaauuuuggagcaugauaaugggccauccagugcuagugucugcaaaacuugcuucgagaucacuggacaaaaggugcugguuagauauauuuacuggcaugcccugggaggaugucuuuagaucacuacaguauuccaaaacucacguuggggucacgucagaaugaucagaauucccucuagcauuugcucuuuauaaugcacucaugagccuaacuuagaucuguaauuuugcaguaaauauuaggaguuuuugguucuguuucugcauugguaaccagauaauuccuauuuagacaagucacaucacugcgguacuagcaucgucaucuguaaaauggggauaaugauacugcugggaaguacuuguaggacaaguugaggugcucaaaggaaggagcuguguaauuaugcuguauuauacagcaauagcauuagccaaaauacuuggacuuaaagcuuagcacaccugagauucugggguuuucuuuuucuuuuuuuuuuaaauuacggacauuaggauuauauggaauauuuuuacauaaaaacauaagaucagaaccaaagaaagaaucaaaaccuuuagaccuaucuuuccuagcauuccuaguaauuguguagcaaguuugauaagggugcucuggcagacuuauauuguuuuugugcuuuggaagaacuucugaugggauggggaaauaaccuggcagcaugagaaaguggaauauaaaauuguauaucaacugauuucaauuaugugaaguaucuuaggcucuacuguauagcuguacucgggaggaaauacacccagaguuugcaguggguuguauuuggaguguauaaauacggguaaguuauacauauguaucuucuuuucuuuuuuuuuuuuuuuucuuuuugagacggagucucacuuugucacccaggcuggaguacaguggagcgaucuugacucacugcaucaucugccucccggguucaagcaauucucccaccucaguguccugaguagcugggauuacaggugccugccaucacaccuggcuaauuuuuguauuuuuaguagagacgggguuucaccauguuggccaggcuggucucaaacuccugaccucaaaugauccaccugcuuuggccucccaaagugcuaggauuauaggcaugagccaccacgcccgguccuguauuacauuuuaaguaacaaacacuuuuaauagaaacauuaacaauuuugaaaugaaaaugcuguuugugguuuucaggcucuccuccuugagagaauuuuggauucaagcaagucaaacuugagauuauuuguauuuuuuauuuuugggagaggaucucacucugucucauccagguugaaguguaguggcacagucucggcuucaccuucuaggcucaagcaguccucccacuucagccucugaaguagcucggacacaggugcacgccaccaugguagacuacuuuuuuguauuuuugguagagacgguguuuugccauguugcccaggcugguuucgaacuccugagcucaggcaaucuaccugccuuggccuuccagaguccugggauuacaggcaugagccacccugcccagccuauuuaugcuguuaaagggaagaacagagggcuggaauuaaacuuuagagggucuuuuaugggauaggcagugagacaggacugagcugaucauguuaggauuccaaaggguaaguuugccaagcuuauaucugucaucugauagucuggauguauagauguaaauuuccacugaaacugaaauuuacauuuauauguggugacaggcaugagagauaccuuuuuggaguauaguugccggugcaaaagugaagacagacugauugagggaaguacacugguugagggaaugcccauuuuuugagaggacauucgcugacuguaugucuagauugggguuugguugcaucugcuacauauccuagcacuucuuaagaaugugaaaaaaaucuauagaauuagaccuguuuuucaaagcagugaaguuacacuagcuacaaaaaagaagcugauauuuauugugugcuuacuguggcaggcacugcuauaaaugccuuuuauuuuagucucauaaacauauaauguagauauucccacuauccccaauuuguauaugaggaaacugagacacgaaguugaguaauuucuugaauguuacacaguaaauggacucaagaugccaauguguauuuauuuauuuauuuauuuuuugagauggaguauugcugugucucccaggcuggagugcaauggugugaucuugguucacugcaaccucugccuccuagguucaagugguccucucaccucagccucccaaguagcugggauuacaaguaugcgccaccaugcccugcuaauuuuuacauuuuuaguggagauaggguuuuaccauguuggccaggcuggucuugaacuccugaccucaagugaucugccugcuucggccucccaaaguugcugggauuacaggugugagccaccgcacccagcugucaguggguuuuuaaccuaggucugugacucuuaaucacuucaguuugcuacagcaaagagaauaauuaucuuuggaauuuuggagaaaaaaacuaggacuuaaauuugaaacuggaaauacuaaaguaaaauaaaauuaacggcuaaauaaucaguuaauuaacagaaucuaaacaauuaaugcacauacugacaauccuaugguagaagucuuacuggcucauccagcuaguuaacuagacucuuaaagaugaaaaauauauaaugauauauauauauaugauauauauaaugagauauaaugagauuuaugucaaaguauuagugaauuguucucuaaggagaauaauucagguguguuuguggugaugauuaaugagcgguugggaggaguugaccaaguaacccugucguggcucaggguguggugaagaggaguugccugugguuuccucaccagauggauaggaaggcucuauuuaguuggcuucacuguuggcucugucacccccuacacauacugccuagaagacggaggaaaagaaccuccuuuuacggggaauggaaacuuguccuuguuguugcugugggguuggcacauagaaauaacaaacacuggccgggcacgauggcucacgccuguaauccuagcacuuuggagggccaaggcggguggaucacuugaggucaagaguuugagaccagccuggccaacauggugaaaucuugucucuacuaaaaauacaaaaaucagccggguaugguggcaggugccuguaaucgcagcuacuugggaggcugaggcaggagaauggcuugaacccaggaggcagagguugcaguaagccgagauugugccauugcacuccagccugggaaacagagcaaaaacucugucucaaacaacaacaacaacaacaacaacaacaacaacaacaacaaaagaaauaacaaacacugaccuguuuggacagaaaauacuuuguucuuggggugagcuuaagcuucaggaaggcuacugauacuuuaguuaagggacgaggacaaaaagaaauccuuaagcuuucauccacauuuuacuaagaacaggucaguccuucccauuagguacugucucuauugcaugcacaggaaacugaggugaagagaagcgaagugaccugcuccagacugagguccugagacucagggcuugggggaugcuaaagccgcccuucuaacuggaucaucagaugagcagaauagcgcccaggagcgcccucauugagaaagucuuuugguuuugcuuuggacgauacuuagagagagagaguguaguguaguucagaggcagugguaaccagggcuaccuucagagccagacauugcuuggcuuaggacucugcuuccaaauaauguucaucgucccucccuuucccuuuccuuauccuuuaaaagaaaucacagugaccuaaagcaauucuuuuaauucccuuuacauaugaugcuugcaugaaguguguggcccuuuagcuuuuucuugaguaauugguuccuaauagauggacaggauuugugcuauuuuaguguaggauuaucuagaguuuuuaauguuuguuuuauucaaggaguggaaucuauggcccugugggggcagagguucuguaguguuuagaaccuugaguauugucacaaauccguucaagcuuguuuaacuuaaccuuggacaaauuaacauuuaaggauagguuuucucacauguauaaugaggauagcacuugcuaagauugucgugaggauugagggauuggguuugccacauaaggcaaagguugcucucucccguucucagucguuuuauuuucgaagauuuuucagauagaagggagaaaggaaaaaacuucuaauuaggucuaaauucuuccucugcuaaagacugggcuagugguucucagcuggucccucugacauuuggcaauucaagaaacaucuuuuguugucacagcuuggguggggauguguugcuacuggcaucuagugauuagagaucaggggugcugcuaaacaccgugcaaagcacaggaccgaccucccauaacagagaauuaucugaccaguagugcuggccacuaugugugucaguagugcugaaguugugaaacccucccugcucuagacaaaauuaguuuauuuuuuuccugcaugaaaaugccuuuguugcuuagugagugauuuugaacuauuggaauaaaaaacugagagaauuccuaacuuaguuacuaguguuuuuauuuacugcaccuaaaacuagaagaaugacguguagggcucuggacuacugacaggcgacccugugguagggccaagcaggguuagacugucagagggucugaccuccuauuccaucagcccugaggcuugugaccucugaagagaugagucacucugcuggcucuugaaccuucuccauaucccugcuucccuuuucauugucuuaguaacuguuguuguuuuuuuuuuuaaagacagaguuucccucuuguugcccaggcuggagugcaguggcacuaucugaucucagcucacugcaacccccugcucccggguucaagcgauucuccugccucagccucccaaguagcugggauuacaggcacgcaccaccacaccuggcuaauuuuuguauuuuuaguagagacgggguuuuaccauguuggucaggcuggucucgaacuccugacgucaggugauccacccgcauuggccucccaaagugcuuggauuauaggcgugagccaccgugccuggccuuagugacuguucuggaguuacagagguggugcgcugcccugccccccuuccuuccauuucagaacuuccagugauggucugaaguuucuacugccuucagugccucaucacaguaugaauacagugcccauccuucugaugaccacuucucaccacugucgugagugggcauguauuuuccuaggaccauugccaccuucugaaaccuuaggcccccuccuccuccucccagacugccuauuuugcugccuuuuuugugaagcuuguugucuugauuuccuccccaauugaaugggauuucucuguuuccuuugauuccccccuuaacaggugugcucucucuuggaacuuuuugugaguuagucucucgcccccaaaucucauuggacuguaagcuuuuaagggcagaauucuauuuacuuuuccuuucuggucccaggaaacaucuuaauauuuaguuucucacacacaaugggaaugaaacagacauuuaaaaaugacaaauuuuagcuuuuuuuuuuguuggagaagcaaaaauguauucuuucauauaaugucuuccuuacaucacuucaacguuccucuauaaguuaucuccuuauggugaugauggugaugccagagguucucaucuggcuugacauguuuuucuagugcauccuuuuaaauuacuagguccuuaaauuaaaugaucugguucacugcugucauuguacuaaacugacccuaaaccaauccuugcuguuccuaaauuuagaaacagaaagaaccuucacagcauuccagccuuucugccacugaagucuacugacagaaaaaccaaauuucaagaauuuuuuaaaauacaaaaacuuuuaaguggguagacauaucacuguuaacucaguaguggacuguuggcaguaaaauguguacuacagcuugcaaaugacccuaaguguggugccuccaguaucuuagucucaucuguaauacagauaaacaugaacuuuuucugcaguucuguauaguauugcuuaucuaaauaaccaguuauucccauaaagugaguaguugcugaggaagucaguauaguagagugcguaagugcuucgguuugccggucacacugccuggguggaguucugccuucagugcuuaccaacuuuaucacuugggcaguugaccuccugugcugcucuuuacucgugugaagaauguaaauaguaacucuuauagguuguugugagaauugaacaaaacauaaaauguguucuagaguagcguuugcuguguaggaaguguuuuauaaaugguagcuauuauuaucauuacuuuggugaaguacagauuauauauagaaagcagaaaauagaaggcugacauuuuuugaguugguuaaaauuugauagcuaggaagacguaagguugagggugaaaucccagcaggaccuauuguaaccuuuuuuuuuuuuuuuuuuuuuuuuugugauggagucucacucuguugcccaggcuggagugcaguggcacgaucuuggcucacugcaaccuccgccucccggguucaagcuauucuccugccucagccuccugaguagcugggacuacaggcacgugucaccaugcccggcuaauuuuuuguauuuuuaguagagacgggguuucaccguguuagccaggauggccucaaucuccugaccuccugauccgccugccuuggcacucccaaagugcugagauuacagacgugagccaccgcgcucggccauaagcuuuuuacaugggaucaauugccacugccaccagaaaggcugucacaguguugaguugggguaucuuucugucaaguuugaauccaaccuuccuccacuugugaaugaaguucuuaaucuucaugccucaguuuccucauuuguaaguuggugcaauaaugaucaaggguuguuaugagagcuacauaaauuaauaauacaugguaaggugccuaaagaacaguaccuagcgcauaguauucaggaaaagucacuguuuauaauuacaguaguuuauucagccuagcacuuguacuccaccagguauugugcuaggcuucuuguuauuuccuucuuuuaaaacaauauuauuauuauuuuuuggccaggugugguggcucacgccuguaaucccagcacuuugggaguccaaggcgggugaaucaccugaggucaggaguuugagaccagcuacuaaaaauacaaaagucagcugggugugguggugcaugccuguaaucucagcuacuugggaggcugagacgggagaaucauuugaacccaggagguggagguugcagugagcugggauugugccacugcacuccagccugggcaacaaagagugaaacucugucucaaaaaaaaaaaaaaaaaaaaguuuuugaaaaauagaaaugggaucuugcuauaucgaccaggcugguauugaacuccuggccucaagcaguccucucauauuggccucccagagugcugagauuacaggcaugagccacugggcccagcccauuauuuuauucuuacaguagccuuucaugguguaaguaucaucaacauuuuacaggucaggaaauggagacccagagagguagaggacccuaccuuguuugagguuguacagcuuguguggcaaauguuuaacagaccccaccauuuuguuuuuuguuuuuuguuuuuuuuuugauggaaucucgcucuguggcccagguuggaguaggguggugagaucugaguucacugcaaccuccgccucccagguucaagcgauucuccugccuccgccucccaaguaguugggacuacagguguaccgcaccaugccacgccuggcuaauauuuguauuuuuaguacagacaggguuucaucauguuggccaggcuaguuucgaacucccgaccucaggugauccgccugccucagccucccaaagggcugggauuacagggugagccacagugcuggcucccacugguuuuuacagaugggcgccacugugggucugucacaugcaugcaucugguccccagggaggggcagcagguagaguacagcucauccugauggcugggaccucugucacguccccagaagugggcagggcaggcccucaguggaggggagaggacucacucuccucaguggugugccugaccauccagaggccuuuccugcacaaggcaucagccuuauugacuguagagggcagugauuagaggugagaaauuuagcuuaagggauugcccagacaugacaucucaauuuuccucuguaaaaauacucuuccagacucgugguaaugaaaauauuuucauuguagucuuagcagguuauuuguuugacaagcagauuauaaagcugaguaaaagcaaaacugaccaggaugaugauauuuugaaaacugacucagugauguaaacagugcuucuaccugguccccauggaugcaguauuaaacuggaaauuaaguccuuaaaaguccuuaaccuucguggguuaaaguguucuuuaucaggaacaguuuuuuuuuccccuaaauguuaagcuuguaaugauucugugaugcugcagaauuacagcauuacuuguagacuuaguagcauauagcaaaaaauuuaucuuaaauuuacuccuguguuucuucguaggaggaauaaacagugaaugggaaccaguauuuuucaaaaauuuuuuugguuaaugaagaacuagguauuacgauuucuuugucugauaucuaauacuuuguuucaggcaauaaagaacaaugccauaugccuuaccagguagauuuuuauauaaaugauugcuuaugaauuguaaaugauaugaguuggguuuagagguuuagauuuuaaugaaugaugcuaaauugauguugaaauuguagaggguuguuuguuuuguuuuuaaaaauuggggcuggacacgguggcucaugucuguaaucccagcacuuugggaggcugagguggguggauccaugaggucaggaguucgagaccagccuggccaacauggugaaacccuaucucuacuaaaaauacaaaaauuagcugggcgggguggugggcaccuguaaucccagcuacucggggcugaggaaggagaauugcuugagcccaggagguggagguugcaguaagcugagauugcgccacugcgcuccagccugggcgacagagcaagacuccgucuaaaaaaaaaaaaaaaguacuaaagccaccuuuguugcuuucuuuuuuuguuguugucgagacagggucuugcccugcugcccaggcuggaaugcaguggcaugaugauggcucacuacagccuuggccucccaggcugaagugauugcccugccuuaagccucccaggugcuuauuuuuaaauuuuuuuuguagaaauggggucuguguugcccuagcucacuuuucuuacuaauacacuuggagugacuuaaauuguguguauucugcagcuucuuagguuuguguuuaguuuauugaaugugggaguguucauuuguuaaugccuaagugagauuugauacugucuauacagcaagguguaauaauuacauuuucuuguaugcaguuguguggauaugaaccaguuaaauuguugaguucucuauugcagauuaguccaacacaaagcaaggcuuuuugguaucauugggaaaaacuaaagggaauuugucgugggcaguuuuauuagcaaagggaaacuucuuuacauuuuacuguaaaaucacacaguccugguacccugucauauaccugucaugugggcuaacaguuugauguugaagaacuguugucaguuacuagauuguaaagugccucauccagagaauagguaugaaacuucccauaauucaguuuccaacccugauagugagugcuuuacuagguacaguaauucauaaguuuauuuugaugaaccugggugcuuggcaaaauaggaauagcaugcauuucuacugaugugugccuuuggugaggaaaguugaguuucuauacuugagcauaaggagucuugggaauucuuuccuuggccauuuauaaaguuacugugacuauguaucuuuuaguaugaaauggauaaagaaaucuacauucuauuuuuaauaauagcuuuauugagaucuaauucacauaacaguuuacccacuuaaagaguacaauucaauaguuuuuaguguauuugcaagaguuugggcaacuaucaccacaauuuucauuuuuaucaucccuaaagaaaucuacuaccagucacuccccauucuucccauaucucccuaaccugcauuuacucucuguguuuauggauuugccuguugugaacauuuuguauaaaugguaucauuuuacaauaugugaucuccuuugacuggcuucuuugacuuagcauaacauuuucgagguuuauucccgugguagcauguaucaguaucauuccuuuuuauuaccaauuaauaugccauuguauggaaauaguauauuuuauccauuuaucaguugauuuuaaauaauuucaaaaccuccccacauuucaaaauuauugcuguuauuaauaauguuuugauuauucauguauaguuuuuuuaugugcauauauguauguuucauuucucuugguuuggguauauaccuaggaaugaaauggcuugggccauaagaacuguuuguucgaccuuuugaggaacugucaaacugcugaaaaguggcugcaccauuuuacauuccuaccaugaaagguaugaguauucucaucucucuacaaccuugaugacacuuguuauugucuuguuuauuuuagccguucuagugggugugaagugguaucacuguaauuuuguuuuccauuuuucugaugcuaaauaauguuaagcaucuuuuuauaugcuuauuggcuauuuguauaucuucuuuggagagauaucuacucagauccuucgcccuuuuuuuuucuuuuccuuuuuuuuuuuuuuugagauggaguuucacucuuuugcaauggcacaacuucagcucggauucaagugauucuccugccucagccucccaaguagcugggauuacaggcaugcaccacuaugcccagcuaauuuuuuuuuauuuuuaguagagacaggguuucaccauguuggccaggcuggucuugaacuccugacaucagguagucugccugccucagccucccaaagugcugggauuacaggcaugagccacugugcccggcucuuuuuuuuucuuuucuuuuuuugaaauggagucuugcucugucgcucaggcuguaguacaauggcacuaucucagcucacugcaaccuccgccucccgggcucaagagauauucgugccucagccucccaaguagcuaggauuacgggugcccaccaccaccccuggcuaauuuuuguguuuuuaguggagaugggguuuugccauguuguccaggcuggucucgaacuccggggcucaaguggucccuuugcccauuguuaaauuguguuauuuguccuuuuaguacugaguuuuaagaauucuucauauauucuagguacuaaucccuuauauauaugauuuacaaauaauugcucccauucugugggguuuuuguguuuuguuuuugagacggagucucgcugugucacccaggcuggagugcaguggcgugauacuggcucacugcuaccucugccucccagguucaagcuauucuccugucucagccuccugaguagcugggacuacaggcaugugccaccacaccuggcuaauuuuuuguauuuuuaguagagaugggguuucacuguguuagccaggauggucuccaucuccugaccucgugauccaccugccauggccucccaaagugcugggauuacagucaugagccaccaugcccugcuggguuuuuucauuuuuuuuggagguaguguccuauuuuuuuaaaauuugugguaaaauauacauaaaauacacuaucuuaaccguuuuaaaacguacuguuccgugacauuaaguacuuucauuuuguuaugccaacccauuguaaucaccauccaucuucagaacucuuuucaucuugcaaaacuguaacuuugugucuguuaaacaauaacuucgcauuuccuccuucuucaggcuuuugacagccaccauucuacuuucugucucuaugaauuugacuacuuuagguccuuuauaggaguggaauccuauuuugugacugguuuauuucacuuagcacaaugucuucaagguccauccauguuguaacuuguguccuacucuauucuauguauauaucacauuuuguuuauccauucaucccucaauggacaccuuuuggguguugugaauaguacugcugugaauauggauguacaaacggugguguccuuugaagcaaaaauguucuuaauuuugaugaaguccaaaguaucuauuuuuuuuucuuuuguagcuugugcuuuuggugucaugucuaagaaaccauugccuaauccaagaucggaaagauuuaucccuauguuuucuucuaagaguuuaauguauuaguucuuacauuuaggucuuugauucuuuugaguugauuuugguauaugccaugaggucacagucauaguuuauggaaugcggcccuaaacuuaagcucuaguuguuggucugcuuugguuaugcugaaaaguugcagcauaaauacuuuucgcagggaucccuccuccacaaugcugccacuccacccugcaggacucuaaguccagccucucuuggcccugaaugauugagaacucuggaacaaagaccuuggcaauaauguuuuuauauccauuucauuuuuccucauuggucauaacggcuuuauucuuucucacuuauccaccccacaacauaauuuauguuagguggaaaauugccccuaacuuuaguaagccucuuuggggugggaaaauccucaccuguauggaggcauugccccuugauucuugguuucugaaccacauuccugcagaguggugcccugcgggaaucuugguauuauacuuuaaggcaacuuccuucccauuuaagaaauuaaaaagauuuagacaaagaaaaaugacagagugguguugaggagugguguuggcaaagcuuguagucuucacaguaugggaagggaaaaauaguuuuaggcucuuucccuauuugccaggccagucauuaagugacaagcuuuuccugguuuuuccuuuuuuuuuuuugagaaguuuugcucccacgcccagucuggagugcaguggcgcgaucucggcccaccccaaccuccaccucuuggguucaagcaauuauccugccucagccuuccgaguagcugggauuacaggcgcgcgccacugcaccuggcuacauuuuuguauuuuuaguggacacgggguuucaccauguuggccaggcuggucuucaacuccugaccucagguaaucugccaccuuggccucccagcaugcuaggauuacaggcgugagcuacugcaccaggcugguuuuuccauguugacaaaugauuuuugcuuuucagugggaacaaaaagaagaacaaaagcaaacagccccagacuguuuagaaggauccccuuggcuugcccuguguguaaacgacaccgagauuuucuguauaaucagagauucucaagaguuucaguuccccuugcuguuuaaauuagcaggacuugaauuccuagaacaaauaugccuagcauuguggcaggacuggaguuccugguuuagcuacuuauauuuuaaaccuccuucccuuauuuuuuggacauagaaagguagaagauauaauacuaucaauuuuuuugaaguggugggcauuauuuuguaaauuaaaaauguuagauguaauguaguuaaagguucuuaucacuugacugcugagcacaagaaaagcccaaaccaggcuacuuguuguagguccucugguuucagaaugauuuaugcucacuuuacuagcacauauuuaguugccuugaaccuucucaacuguagcuuccucuuacagaacacagugccccacaaggagacuuugaaucugugaucuccucccagguuuuagccgaagcccacaacccacugagcaugugaagcaagggccauugguggaugggucuuauguccauaugcagguugaauauuccuaaucugaaaaucuaaaauccuaaaugcuccaaaaucugaaacuucuugaguggcaacaugaugcucaaaggaaaugcucaguggaggguuuuggauuuuuggauuagggaugcuuaacugguaaguuuaaugcaaauguuccaaaaucugaaaaaauccaaaguccaaaaugcuucugguuccaaucauuuuggauaagggauagucagucugcacuugauauaccucuagaggcugugaaaucuuaggcaguucaaaagucauguuguuuggcugggugcaguggcucacgccuguaaucccagcaccuugggaggccgaggcgggcagaucaccugagguugggaguucgagaccagccugaccaacauggagaaaccccaucucuacuaaaaauacaaaauuagcugggcgugguggcgcaugccuguaaucccagcuacucgggaggcugaggcaggagaauagcuugaacccgggaggcggagguugcagugggccgagauugcaccacugcacuccagccugggcaacaagagugaaacucugucugaaaaaaaaaaaaaaagucauguuguuuuaacuauucauugccauuuguugguugggccucuucaaccauugugauccaauccuaguucaaucccuuguugaauucaaguauugaggucuuaggaugaaugaacaaggcuuugggcuggcacauaaaggugggacacccacagguccugcucuuugggaguuuggguaaguguauuuuauucccgagaugcacuuguaaaaauauacaugguaggccauagguggucucacaguuugucuguaguaguacaguuacuguuugauucaggggagugagaggugagucuguuucagagcaggugccugggggacaaccuggagaggaagguugagccugcagggcuuuggaugugugaagguaaugauucccaguaguguuuuguauuauuucaaaguacuucuauaccauuguuaccucccaccaggucucaucugcuucugucaguagguuggccauguccccauuucacagaugaggaaacuuggcuuugagaguguggcuuggugcaacugagauuugggucuagaucguaugagucgauuccacuauacauuuucuaggaagugguaguagcgugaacaaaaaagcugaagaggacggacucagguagcauggugaguucuuugggacuggggaggggaagggugaaaagugcagaaagggaugaggggguuguacagugacaagguuuguccagacaaguugcgagagugcccgggaagacugaaacccucacgggguguguguguguguguguguguguguguguguguaaacagcucuuuugaggaauagcugauguauaaucugcacauauuuagaauguacaguuugguaaguuuugacauggguaugcuugugaaacaucaccacgcucgagaacgaacauuauucaucacccugaaaaguuuacuccugcccccaagaagggcuuuuuaaaaaaaauuuuuuauuuugaaauuuuuucaagugguaaguuugaagaauaaaaaaaaacuuuuauguacccguuacccagauucaccaguuuuugacauuuugauaauuugcuugcauccuuuauguauguauauauguauacauguguauaugucuguauuuguagguacauagauuugugcacacacacacgguuccccugccaacccagucaaggguagcuuuuaugagugaugcugcuguauuccuuaaugcuucaauguguauuuccagagaacaagaauagucuauuauggaucuguaguacagcauucacauucaggaaaguuacuguuguuuguuuguuuuuuuuuuuuuuuagccggaguaucacucuguugcccaggcuggagugcaauggcgcgaucuuggcucacugcaaccucugccucccggguucaagcgauucuccugucucagcuucccgaguagcugggauuacagacgccugccaccaugccuggcuaauuuugguguuuuuaguagagaugggguuucaccaugcuggccaggcuggucucgaacucccgaccucagaugaccugcccaccuuggcuucccaaagugcugggauuacaggcaugagccaccacgcuuggccaggaaaguuauuguuaauacaguauuuuuuauuucauguuccaguuuugucagucuccuaauaaucuccuuaguagcaaggacauuuuucuccucauacagaauccaguacaggguuauacagugcauuugagcauuaccuuucuugaguuaccuuugcuuugaacauuuccucagcauuucucagucuuucaugccauugacaccuuggaagaagccagaccaacuauuuuuaaaguguccaaggguuuugagguuuuagcaggugugugaaugugaucuaucuggguuugggaaaaaugaacaguugugagugagguggauacaggugguggggaggaaguuggaggcaguggacuuugugcucugauucccacaggcuuagguugguggaagccgugguugggggaauuguugguaaaauugcuuggauagggauggaccuggaaaagaagcaaaggugauugcaguguucuaaugcuuguguucuggaaaauuaaauaaagagcagggagguuuaaagauaaaacugggaaagggcuguuguauguccaggaauuguuaugcauacauuucuucuuucugcacacugugauagcccugaugguaacuacuuagaaaaagguugugaaauuuuaggaguuugggacccaguggccagacugaaauucagugcauguagggcaguugccaauaaagucacccuuggguacuuguucauagcuuuagauggaggaauguuuguucucuagcuuuaaggaauugagacugguaucaucggggcagugucugauggaccuaguuuagggaaguucaugggccagugucuuugcaagugaaacuaggcaucuuuccccaaugagagagcauauggagacguucacuuuaaggacggguuuugaaaggggagguauugguggaacuuaccaacuuuguuauguagccuaguuaucauuucuguagguguguaacaguuuaucaagugcaaggaguuaccucugaaucuucuauauaggaaagaaaauuuaggcauguuuaguaacaugcaguaaccucuggaaugcaaaaaugcaucuauacuuucuuuuaugaagucugacuagagaacauuucaguguggggcaugagcugucucaccagcaggacagcuuuagaggucauuaggcuuucaguguuguaaacuguuuaucacuuauuuuaaaacaucacaacugccugagaccagugccuuacuugguugcuuugucaggagacuugugaauauugaauccuuuuaagcuuuuacaauguuuugagaaguggaauuaguuaaaaauauauccucuuaucagaaugucugcuggcuaggauuuguuauucuguuguucuauuuaaauagaauaugucauauauuagauguuuucuuaaauagccuuagguuuuaaauaaaaaguaaggcugggcauggugguucacaccuguaaucccagcacuuugggaggcugaggugggagguuggcuugauccaggaguucaugaccagccugggcaacauagcaagaccuugacucaaaaaauaaauaaaauaagauaaaauaaaauguagugaagacaaagaugacuuuauccuggucccuggucagggaccugguucauaauuuaaaacucuuuuguuugaauuuaagaaucuauaaaguaggauugauaaacuauacugccuuggauugcuuuugaaaaugugugugccaaggccugcuuucacaugguaagaggaaagucauuaccuaucauaugccauguuuuccucugacuuauaccuaaaauauuuuagagugcuuauugccuuauguaaaauuacaagaucauauaaucacauucccacccuguggaaaauuaaacuuuuuuuuuuuuuuuaaagugaaagcaaguuuauuaaaauaaaggaauaaagaaugacuacuccaaaggcagagcagccuagacucucuuuguaauugagucuaagcuaauaacggauuauuguaaaaaaaaccucuguuuuauagcagaauuuucuaccgggccacauacgaauuuucugcucuugcugucuucaguguuaacagugggaaauuguggacacuuaaacugagcaguacuuagaauuugcuggauaugcugaaaaguaauccaucagcauuggagaccacaagcaguauaaaauuguugauacccauauuuauuuuuauuuucuuuagguggagaaagagacccuugaguuagaguuuuuggaugaugaauuuaguacucaaucauuaguauauuugugcaugucauauucuaggucacaauaaauuaucaacaugccacauuugugguaguuagauaaugcuuuuauuuccucuuuuuuccccacguugaauccagauuaacauaauauguuaauuuguguuuuucucaacugagugugguaauuccauugcauuaaaguguuagggacuuuugucuucacuaauaauccacuuaaucucucacaauaaaaaguacuuucauuucuacugacuuacauuuauccaaucaaaacuuuuuauauuacuagacuuuuuguuacuuuuaccuagcauccaaaaccauguuuuaugauugguuggcaaagagcuguagaaaacagauuuuaauauugcaauguauauuguuaaauuuucuaucugauggauuuccagaaauauucuguguuauauacauaaaaaacuauaugcauaauucccagugagacaguuauuuucauuacucgaaauacucuccuugaaaauuguaauuccauguuccauuacaugcuuaccaaaaaugauuccagguugggggagugguugauuccauauacucucaaaauuuccaaaaaaauaauuugaguggacuugauaaacuuuaaaaaguauuaaauuccuaugcagugucaucugucaccuccccccgccaaguugccuggcuagcuaccauuuaguuuaugaugagaugagugcucuggcccugggguucccaccccacccccuuuagucagagugcuguucuuaucaugugguaugaaucagaacugaucacuuacaacacauguuauaagugauuggaugagauaggcaagcacaauuuuuagauguuauaaagcaaagcauugcugcaauuucuggguaaguuuucaugaaacuccuguaguaacauauuucucuuugcucuuaggaauguccugagugaucuuuuuuuuuuuuuuuuuuuuuuaagcaguauuaguuuuuaagagcuuugaucacauuccuggccuguuuucuguuggugguacuaucaggcuaugagaugauaauaguccccaggugcaugaaaucuuagaauugggauuaggccacauaucuccuuuuggcuucuucugcagagggucgucuaggcuuuguuuaucuccagagauuaggagucuuuuauuucuuauuuuuauuuauugagacaaucucaugcugucacccaggcugaagagcagugguuugaucacagcucauuacagccucaaacuccugggcucaagccauccucccaccucagcuucccaaguagcugggacuacaggcgugcgccaccgugccuggcuaauuaaaaaaaaaaaaaauuuuuuuuuuuuuuuuuaagagauggugucucacuuuguugcccaggcuggucucaaacuccuccugccucagcuucccaaaguguugggauuacaggcgugagccaccaugccuggccuggggaacuucuugaccaugguccccagaacuggaccccuuucucauuaugggaugcgcucugauuuaucaauguccuucuuaaaguguguuaauaaagaacucaucuaguucuccagauauaguguggccaguuuugaguguagugagacuuuaauuuccugugaucuggaaauuguacauuuguuaaugcagccuaagacuaccacaccuuuuugucacuuacagugguucauaugacacagucagcaaacauuucugugccugccuccaaacacauuuccccauuaaaaagaaaaaaaacuguugaacuuccaauuuuauguugauuuucaaacccagcauucuaacuugucaguguaauuuaauucuguuguugauuuuauugcuuauuuuauuucuuguuguuggcaaguuuaccgaucugucuucuggguugucgugugauacacacagacguaaaugcagaggaaaaaaguugauuuucauaauagucagcaacaguaauaacuaaugccccacacggacccccgugucacuuuuggaaaaaaaaagccuguguucauagagcagccuuaccaagggauaaauguuuuauggccuggagcgaaaugcaucucaauauaauggcuguguuauuuuuuagaagccaguuuuguuuuucuuuccccuuuaacuguauuccuuuuuuuuuuuuaaacauucccauuggauaacuuagagaaaggugaauaaaugcaaaucaggugguuuuguuuugauuuaauaguaccuuugauaaaaggaauugauucugcugagaauuuggcuguauaaguguguugccauagcagacuugcagucaugaaaugauuggcaugggcuuaaaccuuugaaucacacccuggaagcagauaauaccuuaaggaaucucuugucuggaguuguuucuuacuuacagagcaggacacucuucuucuuccacgcuuacuuauagugauccuuagggaaugagcaaaauaggaguaaacuuggaaaauaauuuuuaggggauuggaaucugaggaauaaugauaaaaaauaguuuaacuuugaaaaaccauuuuaugccaggcauagagcuguguguuuucuguguacuaucucaucaugacaagccugaagcaagucauuauuggccccauuuugcacaggcucaggcaaugguggaauuaugucaagcaggcaggaggcuuggugauuuuuguuuggauuuucuuuggcuugggaaagacagauuugccuuuugcuagaaaagaaacuccuucagugagcuaucauuucaaaguugaugucucagaauguuguggagaugcagccaguucaccugaagguagugguggugguuaaauaaacaucucuguaagucuagcucuuccuacaguugugaaaucugagauuuuuugguuuguuuguuuuaauguuuauugguagaaauagaucaucaaugcauacuuuguauuuauauaaacugcauucucuuaaagguuuuuguuuucauuggaaauauuuagccuccaagugaacuuaaaguauuaucuaugcaaucgauucuuuauagacuuuuuuuagauuuuaacacuaaauuugagaaaccaugcauauuguauaccuuauuuaauaauccaaagaauuguuugcacuuucaaaaaaguuacagaaaggcugaacacaaguuaaauaaccuguauguccuaaauuuuccauuacugaauaaauacuuguucaguauuauauauugcuugcuuucuaauaagucagauugucagagauguuucaguaaauuaucucuauauuaaaauuauauccgaaucccuuuucucucugagaugaucuugccaguauuaaacauugugccauacgcaguauuagcccaaaagcuuaaauaagaaccaaacuuguacacugaauauuuuaaccuuagaauuauauaacuauacauauaugauaugcuguauauuaaauuuaacauuucaaauaacauguauagcacacauucagccacauacucucaugaaaagguauuauucguaaaaaguuaaugaaaagcuuauuuagauagaaaugucuagacauaaauacuaagccuaugaaacuugaaaguaaagucugcugugcuauuaaggaaaagaagauugguuuuuaaccuauugaauugugcagauacaaaagugcuuagcaugagaaaauuaccaaaauaaaaacauuuuagagguuauuugguucuagcaauguuaauuauuuuguguuucuggauaauuuaauguuuguauuuuaaauguuauauaaauuuccucuuuauaacaaguuuuaaaaagcacgcaaaaauaguucaaacuauauauaaucuguuauuuuucauccuaguuagcucaucacaaguaacucagcaaaacaaugcuugaacauucaguucuacuaaaauacaauauuugaguagaucccaucacuuuuacccauuguuugcuauguuggacccuaaaacaggcugcugacagaucggacaagugaaauucucugagagccaucggucaguacaaugaauaugaaauucaugccugcaagguaauugccugagcuuguuuccaguuauguggucacugauacaaacacuacagauuuuaccugguucacuaucaauacuguuaugcucuagcgcuggguggaaagauugucagucugcucuuugguuaaaucauguauucaggcgggcgugguggcucuugccuguaauccuagcacuuugggaggccgaggcaggcggaucaccugaggucaggaguugaagaccagccuggccaacauggugaaaccccaugucuacuaaaauacaaaaaucagccaggcaugauggcggguuccuguaaucccagcuacucgggaggcugagaugggagaauagcuugaacccgggagacggugauugcagugagccaagaucgcaccacugcacuccagccuggguggcugagugagacuccaucucaaaaaaaaaaaaaaaaagcaaggggaagaauaguaguuuuccaguuugacuaaaucauuugaauuuugcaacuacaugcuaccccuauugucacuguuucagguaugaggcuggguggucucauuuacaccaugcauuucagugcugucuccuugggccugccugucccguucccugugcuggcugcugucaguaacuguaccuaagguuacucaguucucaaugcaucucugguaaaugcugaccauuucucugaagcucugacuuggagaaccagagcuucucucuagugguugaacccucccuuagaguacuagauucuccagacccagucauaaucugccuuaagauugaccgaagagccacugaugauggcucaacaagcucguucucagaaauccuaggaagaauuaugguacuaacauagguuugaauacgugaccgcucuaaacgagaaaugauucggcagaagcccccacuauugcuuugaauagugacuguauguucuguuagcccuacucuggaugaguucuguuugcaauacuguccugaucucuauuuucuccgggauggauccuucucacuugaagguccagugugauuguuggaugucguaguacagcaguugaggaucugcuggauucuucuucuacuguuauucuugacauaagucuugaauuagagaaugggguauaugcaguaccucuguguucucuaucuugcucuaaaaagacuugaguuauaccucuccuccugacagaucuucuagugguuugcuguacuggucuacuuucccuuugugaauuaugacaaacagugccacugugucucugaauuggugaacagcuucggcuacuuauaguagaucuuauuggcccuaaucuuugguuuguauuucucacuguaacauuauaucuagccccauuuucccaaacaugugcugcuuuaaacuguugugccucccuuugccugaguuagcugccacccgacugguuugugugacuacugaaauuagugcgugaagcacuagcucugggaaugccagcugaucccccaguuccauuuuuuaaucuuccuacuguugagaaagauccuucagcugaauuuuucccccuugaagcaagccuaguccuuagaauguuggaacuaccaccauugaaauucacugagguuuggcuucuuguucgccuagccacaggacuagaugaccuuuguugccuauuuguaauaugaucucuguuacuaucugaaaguggaauguuuguauaaucuccaugaauuucagauccucuauuuucaugauuuauguggauuuccaaacuaaaccgaaacucuccacuguucgaguuuguucgacucacagcucuccaauuuugauucccauuuuguccacuuugaguugcauuuccugugccccgaaagguguucaacuaugcuagaagagaauauucauuugaacuuucucuggggacuucugagucucuguaauuuguuccauuucuuuauuucauuuuauuuuuuugagauggaguuucacucuugcugccuaggcuggagugcaauggcaugaucucggcucacugcaaacuccgccucccagauucaagcgauucuccugccucagccuccugaguagcugggauuagguauuacaggcaugugccaccacacccggcuaauuuuuuauaucuguuuaguagagaugggguuucaccauguuggccaggcuggucuugaacuccagaccucgugauccacccacucagccucccaaagugcugggauuacaggcaugagucacgguguccggccaguuuguuccauuucucgagucaggcugagaugcuaguuguuuguugaccccaucuaaccacuguugcaguucuucugauguuauuucucuaggggagccuaaaagauuaugguccucucauaagccgauaaucuucaucgaguucucaggccucuucucuguggagaugcucuugcugccaucuucucccauuuucacaaaugauuacggucuugagauaagguuucgucaccaccaccaucugaucuagaucuagacugauucauccugagauuccuggcuuucuuauuuuccuuucaauaugcuuuuaacauaugccaugguauccauccuucaauuguuugugccuuuuuggagagcuguccaucucuucccaacucaaauccaggccuguuggucuucaggguucuuaguuuuaacuacuguacuguucuugguuucauaacucugcuguucaguaaaauaacaauuauuguccucucugcccucaucacucggcuuagccaaaucauccaccagaauacaaucccguucuguggaacagcucuugggagcuuggaagaagaaagaugaguggguauuuuaguaugaauuggugguauucuacauguauauuuaaaguuuucagggccaggugucauggcucaugccuauaaucccagcucuuggaggggaguguagggugagauggguggaucucuugaguccaggaguuugaaaccauccugggcaacauggugaaaccccuucucuacaaaaauuagcaggguguguggcguaugccuguugucccagcuacucuggaugcugaggugggaggaucacuugagccugggaggcgggguugcagugagcugagauugcgccacugcacuccagccugggugacagagcugggaccgugucucaccaaaaaaaaauaaaaaguuuucaggucuugcaguacgcuggaagaaauaucuagaacggcagaugaugugauuuuggcaagcgugucacauguugauuucuguuuugccggugaaugcaucaggccugagguaugugugggaucuggacuucuccauuucuuguuucugaucaccugaggcuugcacucuggagcuuuuccuuccuugucuucagagaauuuccagugugauacaucucauuuguuguauuacaaacaauguacagaacacuuaaugcuuucauugguuaggaaucucugaaauuaaaaaggaaauaucauguuaguuuuugccuucuuauuuauuguucaacauuguuacuuacaucuuuuuuccuauuuucaggucauuuuuuuuccccccaacauguuugguauuccuucuguccaccuguuccuucacccaaauauaguuaggagaggagugcugaccuauuaaggcguguguacuguggcucugugucucuauuagaugagacugaguuccuuuucuggcuccuagaugcuggggacguauuaccuggucacaagaauguggguucugauaugauuucccacccuucucucuuuuaguaguaaacauucuuaguaaccuuucaccuuucuuuuuuuuuuuuuugagacggaguuuugcucuuguugcccaggcuggagugcaguggcgugaccacaaccuccgccuccuggguucaagugauucuccugccucagccucccagguagcugggauuacaggcaugugccaccacguccggcuaauuuuguauuuuuaguagaggcgagucuucuccauguuggucaggcuggucucgaacuccugaccucaggugaucuguccgccuuggccucccaaagugcugggauuacaggcgugagccacugugccuggccuuucaccuuuguuauuggucaaggauagauuguucccuaaacugucauuucucuucuguuaucccauuagaaauucaugcagaaauuaauacuuugguaucguauuuaaacauaucuguucaguuauuucuauuucgagugacuuggauccaguagggcgggugugggcagguuuuguauguauucacauguuagcauaaagauucuaaagcaugagggcuuuccauugaaaaaggagccccgagaagcucacuggaagugaguugcaauagaacguuguuuccugguuccuugcuccuuucuccaucugucccuuuugcucuggcuccggaucuagacugccauguagugucaguuuuucuuuucauuccuuggucuacuucaggucuuaauuuuauucugccuucuucccuccacaccccuugcaugcagccucacagaucaacucuguccuaagcagagaaacacaacuucgucucccucuuguauuucagucuuauucugcccuauaguagcuuccgauaccuccagcaauaaauaaaaucccucaugauggccuuuucaggccacucccgcugcugcuaccugugaguuuaccaaugggcuucucauucuucuccacaugcguuuggcccuccauggucccucuucuucugaaauccuuuuuccugucuuguucauuagaugagcaucgucucauccuucagacucauuuccuuuacagaacuuuucagaguaccuguuuuaguucuugucuuucaaauuuuuucucuguccuucauacaucuuuaaacauuagucccuuugcagcgcucucugacuuaauuuuuuguugugugccagggugugcaguguucuuuuuuugcguuuuaauuuuuuuuuucauuuaaaaagaaauccuccuuacuaucauucccagauauucuugucucagcuaaagauacuuguuuuucauuuugaguaaauauuccaaguaacuaaagcucuuucagauuuaggaagaaggcguuuuuccuuucccuuccuaucccacauccgguuuaucagcagugcugucaucuuuaucuucaaaauauauccagguuccuuuacuucuuaccccuuccacuuccgugucugguucaagccccuguaguuucucugcagguugguugcucugucuccuaacugcuuuucuuacuucuguccuuucuucucuugcagccuguacucagcaaggccagacggauccucugcuccaaacuugcccuggcugccuaccucccucagcaugaaagcugagguucucgcagcagacugcaaggcucuuuauuacagccgagcccuccugacgucauuuuccucucuuucaugucucucuggucacuuggccuccuuucacgccaugcauccuucugccucggggcuuuggcaccaucccuugccucucuuuggaacacucuuccccagaugucugucuggcuacuuccuucaccucaccucgcucacucagaugucaccuuuucaaagcagucuuccuugaccucauuguugauaaucacagccuccucacaugcccgguauaugccaugcaccaucccuucugcuguauguauguauguauguauguauguauguauguauguauguauguauuugagauggagucucacucugucacccagagugcaguggugcgaucuuggcucacugcaaccuccaccuccuggguucaagcaguucugccucagcuucccaaguagcugggauuauaggcgcgcacccccaugcccgguuaaauuguauuuuuaguagagaugggguuucaccauguuggccagucuggucuccaacuccugaccucaggugauccgccugccucggccucccagagugcuaggguuacaggcgugagccacugcgucuggcccccucugcuuuauuucucauagcacuuguugccaccuacccccaguguguauucuuguccaucucccccaccauagagcagaggcuccacaaggacaagcauccucuguuuuguucauuaucuugaacccacacggugguaggugcucagcgguuguuugcugcaugaaugugcauuuuaucuaccucugcauucacugugugcuuuucugccuuacuggagugaugggagugaucauugggaacuucggguuuuuugcauacccaccuaugccaugucuucuggagcuuggcaaagacuuccucuuacuguguacauugauuugccuccuagcuacuucagcaugguuuucaagauaggaagggaugagccuuucaggagaaacuuuauaacaaaguguguuaaguaacuggccuuauuuuauacacaguuuaaauccagcgggcccuggaugaggauuugagaggaucucugugcucuguaguucuguggauuagcacuuggcuuucauuguuuucuuuuagcccugacuuucugguucacauuuguuuaaauagucuaaguguuucagaggccgagggguuggaaggcuggccaccagauaaggggagcaucacuauccuugugcuuucuucucugcagggccaagagaucuuccacugugcacugugagaaaguugcuggcguuguucucaguaacaaaaucuucuacgugaagauuugcuguccccucaguuccuuaguuuuccucuuuacaaaaugaaacgucauugaccauguuuucaggcugcuugcaacuccagugaccuugaguccuguaggucccucuugcuaaguagaauguucagaugaauuaaauauggugccauuguguugcagaaucacacuuugaaaagagguccuauucccugcagugcucuugacuuucugaagaggacugagcucauggucagcauguuuccuggugguuaaacauaucuagcuuuaaaauuuccagcugcuagaggagacgaagacgaugagaagcaagcacacagcaaacuguuuggcuuuuagaugcauccuggccuggccggguggacuugcacagaacugcuggugccagguuaguucccugggacuuuuccaacauuugucucuguauugaguuuuguccuuauuccugaaauagaguagccacugaaaucaggaaccagaacuucuggaaaauaccuuuggaaaccacuguguugcaugguagaagaaaggcaacugccaguaguuaaaauaccggguugagugcuaguuuuuucacccuuuauuuuuucuuuuuaaggagaggucugauuuacuuucuucugucuguuaaagcucuucacagguucuuagaaaaacaagccauuuaaugguaccagccgugaggauccaacuucaguuccaugaaagcugccugguaguucuggucacaggguccugaugggagaccguguaacugcugcuaggcagucagcuggagggcucugguguggcucacgcuuguguuuguucaagugaccugaaugugcuuccucuuuggggaccuguuucaaaugcacaugcugacgccguaaucauccacuaaaccaagugagagucaggaaauucaaauucguagugccugugacuuggccacacucccuguacacauaaaacaaggucuuaaaucagagaaacuaccaucuagauuaacacucaaacugcagauggggaccggagcugcucuuggugugggaacugcaacuuugaaguuccagacuuugaugugauuaacauuucagacuuaaaguccuuucugugugguaacuuuuuuuuuuuuaaacaccaaacugaaaauaaaaauugauuagauuaggggugucggagaagcagauuguaaagggaggagcccucuugcaaaccacauguaacuaugucacauccuuaugugccucaggaagagagagaugacagacuagugaccuuucaccauaucucuuuuacuuauagcuguucuuacagagacccugcccuccaacacacacaccaccuccaaaaagaggacacuuuugacuuugcuaucucuuauugaccaagugauaauccugauggagagaugggguuuacaggcaugagguguucuuuuuuacccagauuucaagguucaaauacuggagaucaucuuacagccuucuucaaauuguggcugauuaaaguuuaauucuucaccucugucuugcuggugaaaggaauacgagggcagggaaaguggaguuugugggucauuccucuuuuaaaacguugccauuaaaauuguagauaaaccgauacacaguaguccuccuuuauaggagggagauaguuccaggacccacagugagugccugaaacuggauaguaucagacccuguguauacuacguuuuucccuauaccuacauaccuaugauaguuauacauuaggcagaguaagagauuaacaacaauaacuaauaauaaaacagaccaauaauaacaguauaauguaauaaaagauagaugaaugugguuucucucucucucaaaauaucuuacuguguuguacugcagguaacucaaaaagguggaaagugaaagcucagggaaggacuacuguacauggaauugacaucaagcaaacaagaaauguugugccugggaugauaaaauuucuuggccacugaaauuguugggccagccuucuuuuugaaagaaaucuccuuaggcaugcuugcgaacgcacguguguguauacguacauauguguaacacacacacaagucucuucuguuuucuuagguuaaaaaccugaggugucauccugauaauuucauggagacccuguaacauuuuugccaucauacauggcacuuuaucuucguagcugugucugugauauacugucugccugcugugcucuguccauuugagcuuucuagaacccuguaggagagguggggaagccuggauuuuguuggggagauccaaggucucuauggcaugacagcugauaaauggaagauggauaacuguaacccuugagucauuguguuuucugcuggcccuuucagucuacugaccuuguuuucaguaggccuguaaaaaggcagggcaaaaccuagcccucuaguagaguuuuuauuuuuauuuuuauuuguuuguuuauuuauuuauugagacagggucucacugugucucccacgcuggagugcaguggcgugaucuuggcucaacccccgccuccugggcucaaacaaaccucccaccucagccuccucaguggcugagacuaaaggcaugcaccaccacacauggcucauuuuuuguauuuucaguagagacgggguuuugccauguugcccaggguaguuuugaacuccugggcucaagugauccacucaacuuggccucccacugugcugggauuuacaggcgugagccacugugcccagccuagguuuuaggguuuuuacauuuuacuguugacaguacuguagcugugaugggaggagggaaauaacagggcucgugagagagugcugagcaccguccucucucccaaacacagcuuccguguguuuuagauguguucuuucccuaucaugccauccauguuuaggggcacaagaagagucaggugaggagggaaugggcauuuaaguccacgugaaccccucuagcaggguuccccucugcaucacuguuucaaggagaugggauagaauuauggcguaacuguuuuaauguacgaaaucagcagaagcgaugaauauuuuuaucuucaaauuuguauuacacacugaggaccuuauauaugauucuaaauuuauuggucauauccugaaauacacacuguguguaccuaguaaccuuguauugguuacaguggugcugucuuaaguuuguuuauuuguuuguuuguuuuaaauaaugucugaacccaccauagggguagcacucuagcacaguuuuggguaacaaauaagauugcauucugacauggugucauaaaucauaucuaaaagccgugaggucacauagaacuuguuuauguaacaggguagaacaaaacucauuguucugagaauauauugcucacucauuuuauccucagucacgaugaguuuuacagccuaugugcaguauugaugccacugaauaagcauuuauuuuugaugaagauacaacuuuucuccucacguucaguugagaguuugcaacaaguaagacuuugcauucuggaauuuauguagauguauguguauagauacaugugguuuuuaaggccuggcaaccuuaaugaauacugguagaagauuuuggcugucuuuuaacagcauuaccaugugguugaccauuuaaauaagcagcaguuuaucuugauguagugaaugcauuuaauugguuauccuggcaaagcaggguauucguugguuacaagcauaauuuucugaguuuauauuauuuuuccuucuagauauuugugagcuauuguuuuuauagccuauauugaaacaugcuuuuucuuuuuaaaauggauuguaguauagagcuuuguuaauaaaaaaauuuaaaauaaaaaugguaaggcagaaugacuuaguuauuuuuauauuuuccuguaaaaacagccucaguuaagugagccacaaugagccaugauguauuuccuccaucaggauggaaaauaagccauuuauuauuucaggucugacucacagugaaccugcugacacugggauguuuuaaaaucauaaucauaaggaacagguuagggcagaaacuuggacgcugggccuaggauuaccugcuuauuacaauguuuuacaacuuggaugcuuuagguuuucuggcacaauguccuaaaccucacacacuaaacacccccuuguuguacaauuauugcuugcugguuuuagauggugccaaauagacagaugccucaucauaauuaccauuuuuuaaaauuucacuguuauagacauauauaaauagguuguuaucuccucucccuucccucaguacaguaugcucaugcuuccacaaaaagcaccccggauguccuuaguuaauaaaaacgggcagcugaggagugaggguguggcagguggaugcagcguguccucagugucgcaggguacauaauauuaaauuacaugugauugcaaaggaaagcaguuacgucgaauacaguugugaaaauugucguaggguaauagaugugcuucuuuaucaauacauuaaauaauauuuaguggcgggucaccauaauuuugagguggagaugaauaaacaauauuuugaguuuuugacagcaacuguaaugugaaggcauccgauuucuauuggugucaaagucacagguacugccaauacugugauguguugccuacauucguaauuggaaaaaaugcugaauuuuaaugagcggcucauaaaaauguguuuuuuccuauccaaggucaugaaucccuugaguucuguccaugggcuccagguuaaaauccugggccuugaggaauuuuuuucccccccacccugaagaauuucuuuaggcgugaguuugaauauaugcaaauaaaguuuuccuugaagacagugcuauucuacuggccuugguucaaaaauaggaagacauguuuaacucuuguuuuuauagucaauccuaauuaucuacaguccagaauugaagaaauuagccuucauuuuccugagaaaaucacauacuccuuugacaucaaaagaaggaugcacugaaaccuguauuuucuaugguuuugaguaaacagacuuacauuuacaaauacucaugcauaauucuauacacauucuaggcauauuaauacaguguagacugauauaaaaaauuacauccuuuccaaaguaaguguaugccucuccuuuguaaaacagaaggaagaauaaagaaagcaaacaaauuaaccuugucauggcaagcagaagaaaaaagaagcaguaggcucccaguuugguauucuacccuccagaugacuuuauugcauaauauguuuugucauccaaacguaauuuuauuucaggucuacugagcuucaaaaauuacaaaugauaacgauaauuaauuaaauuugaguaguuuuaaugacauugagcugugugcuggaaugggaaaauggcacaauugaaggacauuuacauugaaugucauuguuuaaaguuacccugauuuggaggcccauuaaaaauaccaaaagucauuguauuuuaacauuuauuucagcugaagguuuuaaaacagcuuuuaaaaaucuuuaguaccugcagugaagauacacguacccccuucccaccuaucucuaggauccaucauaugagcugaaaauuaucuuuaauaaauuaaccaugaucaugacaaaucuuacuuuacugcuuugaaggaaaaaggaggcauuuugugacgugacacugaaaggauaacauuuguugccacccucuuauauaauaccuaccuuaagaaucaggaaaagccuuggagaugacacuucaauuuguagacaauguucuuuucugaagagaaucugaaaaaaagauagccuggagaaaucaauaaaauguaaaauagaaaaagaauaaggugauugcuacuuuaacaacaagcuaauacucugagggguuacauuagugacagacaaggagaaauaugcauuuuugacuugaaggauaacacauuguaucaguuagcuuuugcuccauaacaaauaaccccaaaagucucaguggcaugcaacuguauguauuuauuucuugcucacauguaugagauucccugcagcagccuacuccaugugucucacuuugaggccuuggcuggaaggugagcgacuaggguaaguucuucucaugguagugucaugugcaagagggcaagccugacuguaugaguauguuucaagucucugccagcaucagauucccuagcaucccauuagccauagcaucucuugaaucaagaaggagaaaaguguacuuuaccgacaagaggccauagaaauacaauuaccagggagugaagaauugggaccaauaauucuguccuaccacaaaugcuaaaaauguuagcagcugaggguagcuuuugguuaugagauuauaugguggugucuuauugccuuuggcuuuugucauuuccucugccccaagaaacacuaguucaguuuuucauauggauguuggaccgaauguaacacaccaugagagacauguuacuaacagcuggguaagggacaagaaagaggguacgugaauugagguaagacuuaagagaucuggguucaaaaucuguuucagcaguguaccaauugggggaaccccaggcaauucauguaaccuguuucugucaugggccccuuguucuguaaaaugaagauacugggcuagcccgucuccuuaguucuuucuaccacuagaauugagguuugauuucuuaucuguagauaacagguuucauuuauuggcaccuccauucucaccuuuguguugguguaggcucaaggcaacagaaugacuuuaguaggcaaaugggguuaaguaaaaacauugaguguauagagauguauuaccuauguguacaauacuaaauaguguggaguaaugacugucgaaugcuguguuugggguuauagaaucuccccuauaggcuuuaagcucccugauaacuuuauuucccucccucccucccacccaucuaguacagugccugacuuauaguaaagcacucuaggaacaaaugguugaaggaagaaaccccaagugggaaauuaguaggggaacaauucccuagccugaaaguguauccaagaagaaugauguuuuucuggugcuuauauuuauugccuaggauggacagcuuucugcuucagaggauugggaguguucauccaagcaagauugacauagacauuugaugcuguguccccagcauuuugcuaggcgcuccggguguagcacgaggaagcaugguugcaacgcccuccgguuuuugucuggaagacagauguguaaacagaauugcacugugccuucuguaccagaggcccaaccaaggcauagaagagccacgugggagacauagggagaucucacuuggaagaaaccugggucuggucuugauugaggaguggggagaaguugggcagaugugcgggcuuauagagagcuuucugggaagggugaaguggcacaauauuuuuugggggccuaacuacaaagucugaagggaaaggcaaagugagacaaagcuucagaggcagacaggguuagaucugagagcauugcaugauaugacuuuggucuuuaccugauagaaaaaggaaguuacugaggaauuuaaagcagggucagggaugugaugagauaggaauggcaaugaggaaguuggaugugggaguugcagggaccugcaggcugcacuaugacuuggggaggauggagggacagcagaggggcaugagaugggcugacaucuggcaaguagugucuaguauggacaaucacucuuacagcccuccucagucgcuuuuggcacccugccucucccccagccccaccauagaaaauaacaugcugugcugucacuuaaaacccccuuuucauggccgggcgcgguggcuuacaccuggaauccuggcauuuugggaggccgaggcgggcggaucacuugaggucaggaguuugaggccagccuggccaacauggugaaaccccaucucuacuaaaaauacaaaaauuagccagguguggugguggcacgugccuguaaucccagcuacucaggaggcugagacaggagaaucacuugaaucuaggaggcagagguugcagugagcuaagauugcgccacugcacuccagccugggugacagagugagacuccaucucuaaagaaaagaagaaagaaagaaaaagaaagaaagaaaccaaccaaccauguugcuggucccugaaguaguccguuuuaggcuauauagcucugggugaugagagagauaugguguagucuguguugaagagugauagaaacucaguuuggaaaacugucaacuugauagguuuaaaaccaccuuggucacuaaagugguggagguuauuuugagcuucaauuuuuacauuugcuuuaucuugcuagauaacauuuggaaaaauuguuauucuacaguauuuugguuaaguagaacaagccuuucaguaaauuccacuacauuauuguuauaauuuuuuuuuugucaucccagauuaguugauauuugcauuauuacuuggucgauguacguuuucuagauuauuaggcucauaccuacuacuuuucaauacuugucagcugauaagagguaucucuuagugguuagugucagcagcauuacugguauaauuuguggccuucuuucacacacuaguuuuccacaccuccaagcagguucagggcuuacguagcuacugauucauacguacugcuggcaacugacuagagagguggaaaagggaguaccuuggggguuuaggggcuagaaaaggucaccauuggguuggaaccaggaaaaaacagagugcacgccuaugaugagcacuguaguuuagguagaauuucaacaggcugaggcuguauuuuugggccagauugagaggagauucagggggaggagcagccuggacaaaggggaggaauugagaaguacagugugguuggauucgugugauuggaguuaaggcuggagaauugggagccauguccccaucauuucuuuuugagaguagggagcuaucgaguaggaaauguguguguguaaugcugacgguaauacuguuagguuaaaguuuuaagcaccaacugugagcgcuggggugcuuaguguuguaacagagcaucuccagguacucuggaauucucucaaaauauccuggaauuuuccuugaucaggaaaaaaaaugauauggucgagcagugaauuuuaagaauuuuauuuuucuauuuauuuacuucuauaaacauuuguuaguaacuguguuuuauuauagaguugcccacgcagugugugguuuuggugacuaaaaaugaggauuggaugaccauugacuaaaaauauauauuuauauguauuuuauauauaucaacauauacauauauaugauauauucagguuuuuaaaaguaaaugauaaagaacaucacuaauuuuauuuuauuuuuaguaaaucaguaaaucaaauauguaccaguuuuuaaauucuggaaacaaagauuccagguuucuauagcguuuaacaaauuauuauucauagcaaaaucugcauuccugaggcugggaacuagaggaaaggguuugugucuaauaggaaccaauugaauuuuagaaaggauguuaacauauagcuguuuuacugucuauaauguuaaaugaauacacuuuuggccucugucuagaaaaaaauaacaucuuaaucuagugugugauucuuauacauaagacuuuuuagggaugacaguaauauuuacaaauagguaaaaaaauauagaguugucugguuuagacuccuguugucauggcauguuuaaagaagaaagcuuccagccgagaaaggcuugugaugaaguagcaucaccuuucaguuaguucucuguaguauagauuauguguaugugucugccuggucauagaugcugguagcuagguguccuugccugaugccaauaugauucugggcugaaugcauaugaauccauucuaauauaaguguaaauagcacaugggaagauaaaccuaccaagagaaccacauacagaucauaugguuuauuccagaggcaagaaugauaaaaaaaaaaaaagaucugacaccagacuaauuaugagauaguugagugcacucagucauauguaugcuuuaaauaacauguagguacaugcacauacauauacaguaucacuaucuagauuuuucaaaagauugacuuguaagaacaagugacacacauuuaaaguguuaauagugcuucuagguggcaugucuugucuucuuuuuuuuuuuuccuuaguggaaauugcaaaauuuaggcuaauucugucacauucaauauaaaucacacaguuaaaaagccacucuguaguuuucccagucuuugccccauuuuggcacauaauuguucgggauaaauuucuguggcgacaccaucaucugcuccagcuuucucaccugaucuuugcuuccccagcacaccacaucaaccccaguucuuaauucccuugacaaaacacacuucaugauuguauauggcacucugacugcuaaagcuaagcucuaguacaguaguugaguuauaguuuucuugaaacucaguugugcuuuuucagauguguuugugcaguaguaauuguuuuccuaagaaaaaguuaguuauuaaauaugaaugugaaaauaauuaucuuuaggaaaaacuaaguugaaccccuugaaagacuuaagcugcugauaaauuaguugcagucagacccuguaagauuaggggaaaccaugaagaacucuguaguuggauugauaugaaagggguucaguuggauuccucuuacacuugaaagaaacccaaauuguaaaucuguggugacaauauacuguggguuuaggguuuauaagaaagaauggaagccuagccagaguaucuugguucaaagguuugcuguaccucaagcacaguuuccuguauauuuuuaaggcaaauguuuaaggaauacauauauauguacacacacacauguacagacacacacacauauauaagguauacauacuuuuuauuuauaauauauguauauauuuaaaauccugugcuuuaacucaaccuuuuuuuuuuuuuuuuuuuuuggauucaucugccaacuagggucuccaucugguuuggauuggauugagauuggauaacaccuuuccaccuaauagcagcauuaagagcauugacugccaaaagccauagcuaaccuacuuucuuuaggauacauauuguuucuccucauuacccuguaauaaaauaagauuuaucuuaagcauguccugagagaagccuaaaauggaaauacacgguacaggcaucguaagcugggagagaccugaaggaccauuggcagcccccugaauuguaacugaggaaauggcucugucagauugagaucugcauuaguggccuaguuguggagugacguagggagugaguguaugagcagagcaugugugguguucauucccauccauccaucacucauccuacaugaaguugccucuggauugggaccuugaacucuacuaauuuuaugguaguguaacuugcagaagacuuaccagguaggugagcuugguaguauguuuuguuuuguuuugcauuugggaccaucuucacaugugucaacuaagaaggauuugcugcuaaccuauaccuaaaucucugacacaaauccuggaaaagccuuaaaugauuggcagguaguguugaaaggugcuguaucaggguuuuguaaaucaugccaucuagauagaaugcauuguguuggaaugaaauuaaaacaaccauuuuaaaaaauguaaaugaccuuggguagaaaaacacgagcauuaagcuguauuagcaggugaagauaaaucucucccccuucauguuugaaauaaucuuuuacauuguuuaugugaauuucuuucuuuuuuucggguacauugauuauguaucuucccccacccuccacauuuaauccccuaagggaucgguauuaaugaguuuuaugcuuugaauuuuaaaauuuucuuguccucaaaagugagacuggggaaaaagagaaaagacuuuaaacauuuucuuugaaagcuuuuaguuaucucauauaccuauuccuuuugaaaauuucucuguggauagccggcuuaguuucuugcaaaugacuaauuuaaaugccauagaacauguuuagauucacugucacaugguuguucuugcuacauuucuuuugcucagauucaucuucagaaagugagggagggggaaagcauauuaagcauauuauuccugcaauuaaggcauagauuggcuacuuaauuuguaguuaguaaaaaacuacugugauggaacucaaaauauuaauaaauugagaaaaccagaaugcuugucuuuugcuuuagugaugggacuaagguuuacaugaaucuuucuaugucauguaguuucagcuagugccucuuggcucugaaagcuaugcauauguaauuucauuauuauugauaacauaguaccucucuagagaguucuaguuacuguauuuuuaaaaugcaaacauuugaaaauguagauacaauucuauuuuuuaaaauuaauaggucugaacugggaucuuuggugauauuuccauuucaaaguauuuaucaaaucaagacauuagugguaaaacaguacuaguacaaagaugcuuagguauugcucuauauuuuucaaaagaauaacaaagcaagaacaacaucuuuuagaaacgugucuaaaaaggugccaaugugaccaaaaaacccauuuaaucacugagaauuuuaacagaaauuuuuuaaaguauuauauugcaggaucaauauuuaguauauuggacaauucagaagauuuauucagguuugcuuggggauugagaacaaauacguguuuaaaucuguauguauaauuuaaaaauauuagagaaaauuugaaaaauagggaagagucagccauauuguuuuaauuaaacaaaaugacugcuucuguuuuagcagugcuuccacuuuguuuucuaugcguuaucuuuuugaagccacugguuaauguauguauaaagcuugccagcuuguuuuugauuaacaaaguucagucagugaauaauguaaaauacuauuaacagcauaacuggaaagugacuugagcacauaaaaaucaccuuuaaguccaaaguuaaauucuuguuuuuauguuauuuauuguuuuuauuuagagaagagauacgugccucaucuuaggaauucucauuuaauauccuucaaagacugggcuuuaaugaacaaauuugucauguggcagaaguuacuguagucugaugaaagggaagauggcugcaaagaagagaaaacgggugguggggggcauugagguauaauaaucuguggcugugggaugguuuucgacagaccagucauagcccagacucauguuuccaaacauacauuaacugcaaacccugaucucagguuuuauguuuuuccaucacuuuuuagcuuuaauuuguaguagauugcuugaggaaagaccccuguugauugguuguaaucaucuaagauuuaugaugauuaggaagucuaaauaaaagucuguuagauccaauuuggacauaaauuuugaaugcccaguuuauuggauugccuugaaauucuaauugguaauaugcaaaucgaguuagagucuugacuaucaaaaucaccuuaggacuaaauuagacaguuuggaagcuccauuaacucuuucagaguacugaacuacuauuuagucuacccaaacaguaauuuacuaaguuuagcauacccagacaguaauuugcaaaguaauacuuugaagaugcuggaaggaguuaaugaagcuucugaaauauuguguuuuuugggagaaucugacucagcauuugcaguaguuggaguugagaaagggcgucuuuaaauuuuggaugccuaauuggcaggaauuguugcuaaugcuacagucuuugauuuuuaucauacuccuacgcucuuccugucauguugcagacuccuuuuacuaaucuaugugagugccccccaagguaaagccccugugcacuuccguggugaugccuucugacugguucagccugucaccuugacacacacacagaugguuucuggaggccgauuuaauuccagcuaucuuguucuucaccucucguguccauuucucuccaucuuuucuccugagcuuuggucuaauuugucaacucaguggggaccaguuggcuggcuguugccuugaacuugucuuccucuuugaaauggguuucuccuccugaagucaucagguuuugaauagcacuuaccauaauuuuuuaggugaggauaguuuucagcgcugggucagugggaaaaacuccaguucaacucuguugccuccacaguagagcauggaguugaagcuucuuggaguuuuccucuuucucuuccccugguuggcuggaaccauuucaucauuucauacuugggucacuacacuggucuuuucaucggcuugcugccuccaguuuccuccuucacucugcugugggcaagaugacacaucacuuuaauuauaacauuucaccuccugaagcaucuucagacacucugcuacuuugaggauaaaaucuaaauccuuuugcugggcaucaagaccacucaccaucugaaaggcccaucuuuccagcuuccuuuccuacagauuccucuaccaccccuccgaggccggaggaggggcacucccucccuuugagguauuuuacacuuuucugugcuccuagcagggcaucccuuuuccguacccacccuaucuagaaccacucaaugaaaaaagccaggcucacaaagacacaugccacacgauuccauuuguauaaauuucaauaaacaaaacgaacauaagugcuaguaagugacaguaccugugaguggugguuucacaggguccacguacaaaacuucguccagcuguacacagcccauuugagccuuuggcuguguguaaauuagaccucaguaaaacagugccaaucguguaaggcuguggugaggcuuaaauuauauaguguaguauauaaaaugcugagggcaaggccuggcaugugggggaaaucccaucucuuuuagacagaagcagucgcucucauucugaauuguauaguagauaaauucuucccugacaagacuaacucugcaaacagaccuuggaagcuuuuuuuuuuuuucagcguguuuuucacuugacuuuuauugccauguuuuguucaguugguaucuuugguuuaauguggauauacuuguuuuuuuuuuuucuuguuuauaguguaaauuuuugaucaauagaaauaauggcaguaggguguguuguagaaagcucuuaauggaauaagcaauucucccuucccccaaaacauuguacauaucaaaaagaacuuuaucuuaaaaguguuucauacaacaaacaagauuuauuuucccaagucaucuaguuaccagagaagcauccauaaaugguacuuaguaggaagacauaugacuaaggaagacuuucuuaauugagcugugaaaaugaaauaauaaaccauuuugcgagauggcaaacuucaguguauauauuaaucaccuggggaucuugucaguucugauuuaguaggucugggcugaagcccaagguccugcauuuguaaccagcuccuagugaugccagugcugcuggccucagaaccacacugggaguagagcagagcuggggguguauucagguucagagaugggacauuaggaagggcaaaacaagaacuuagcucauaaaaaccaccccacaaauuuggguggguagugaccuugugaaccacauauauguaaauauuccugaaagaaucuauucaagaaaguaucaacuuguguuuuaaaguuuugauguugugugauuuuuuuuuugugcuaguggaaaagacugguugauuucauuaguuuguuuuuguucauucguuuguuuuuguucccucuugcaaauaauauaucagaaauggucaugaauucaaucagaauuuuagggaaagaaauuuauuugugugaaugccccuucuuuaaagaaacaguaacaacaucaacagaaaagccccaaaaacugaacuaaaaacuaccauccugcccauuuguuacuguauuuaaugcaucauacuugacaaaguugcuacccugugccauauuccaccugaagagccaguuucgccgguguucugucugcucacuuaaccaugaguagauuuccauuucccuccucugaacuggggccucuuucauucgcuuguuccguuuugccuaucacagucuugacuugguagaggauuuuauucccugucagucuucaaccucuguuagccuaugauuugaaacugagaaaaguccaaguuggaaauugaaaacgagagcccgauucucugaggcugggaaagccucugaggacuuggcccgagcaccgcccgccaccauaacagguuaacaggaagaauguggcucugccugccggcuccugggcacauuccuuucuguuuggggacugaaguacuggacacacacauuauuaaauuacuuaaugaagauuuugaagcacaccucuaaucccuuugaaaaggcccuuugagcuggagaagggugugugggcagugagagagaggcgccuucacccuggugaacagggccccuuagaagcucccagggugcgagucagcagcguuccaaggcugaccauuacuuucugcccugaauuggcagaagagacuuaggggaaaguucuuucuagggcaggacccuucaccgggggaagauguaggguuuaggcuccaaccuugacucagcauugccauuuaccauuuuggcacaggaccuuguugaagccaugacuaagggccuccagguggugggcuguccuuuacagguccugaucacaguuagggaugcagcucggacugauaaaaaagggccuugggcucugucagaaauguguguaguugaauuacauaggugauucugauaauaaagauguuuuuguguucccacuacccucuuauugggaagaugucugccuuagaaaauaagagaacaggcuccaaggcugggugaccaggaacucaucucuggcaacaaacuccaauagccuuugucuuuaucugugguaauaauaauuauaauaguccuaauacauucugggguuaugguggugauugauugagaauguauaaggaaagacuagauauuaaagcauuaaucacguguaacugucuguaaacagcgguuuuguaguuuuuugcuuuuaguaaauaggcucccccgugugaucaauacuaaacugacagcaaaagagcaguccauucuuauuagaccaugcuuggggagauaaguugcugcuggcucaugaaggacacauucuucuugauguagggagguggaaugaggauuuaggcgcugucuuccuccccuuugggguaggguaccuugcugucuuuugacagaaugaggaugagaggaggugguaggaaggcgggggaggaucagugaugagauggcacuggggacaguggagagaaugguugugcauaugauuuacggucuuucuuuucaguauacuacagugcuuagauguguaugcagaaaucaagaguuaucagugauguuugaaaauuagauguugcuggcauggaacuuccguuuucauugagaacagagcgugcuuagugacguguauauuuaguacaguaagacaguugcagaaggauggcccugauggugacagugauaauccuaacccuagaugcucacuggcugggcacaaguacaggaucucacuggaaccucacuagguaucuguuguccuccuuuuauaguugagaaagagaaagcuuaaguaauuugcccaagaucauguaacuaauaacuggcagggauuugagucaggaucuccaaagcuacaucucuuccuaaagcuaguuuuaaaauuucauuucucauauauggaguagcccacaaaggcuguaugcaagguagucuucagaaagcuuacaucuucaccaaggcacaugaaacugcagaaagaagcaauguuaggcguuccugauaauaauuaucugccuggaugacagcaguccugcuuuauggucacagaccccagcuuucugccagaacauggcucaggacuccugaaaaucaucccauucgggagcaaguggguuuaauuuccuuuucaugaaaggaaagauuagcuuucaugcaaacacuugguccauuuggccauuuaauaagaagacugaagucucauguuccauaacuuuaucagccuaaaagucccuuuguuguaucauaaacacauaggcugaaaccccuguccuuccaacucagagcaaauucuguuguauuaaauaaccaugccauguacugaauguuuuuacacuuauuuauuggacuugacuccuaccuccuucccgcaaaaaaaaaaaaaaaaaaaauuagcugacauuucuacagggccuacgacuaaccagagggaaagagacucacaugucacuguuuguagccagcaguccaaauugugaaauaaacauacuuugaaauguggucauaaaauaccuccuguauuuuauggcccacagagaaaugacaaauguuugaggugauaugcucagaagagcauagaagugaucagggugggucauuuuguuaaccguucaaggauggagauucuguguucaaggaaucagaggaaauugugaauuuauuugaauuucuguuacuguucacuugauaauuuuauaguugucuuaguggcccuucuaacagaauaugccccuuuaugaaauauuaccaccccugccccguuuuacccugauuugaucauuauacacuguauacauguaucauaguguuacucaguacuccauaauuauguuuaauuaucaugugucaguuuagauaaaauuguagcauggaccauugacaucaguaucaccaggaaaucucaggcccacccccagacaauacugaacgaggaucugcguuuugacaggauagauagaucccugaugaucccuuguauguucaaguaugagaagcacugauuuuuaugguacucagucccccuccaacuuacugguuaggcuuauagaauggaggcuuuauucuuuacaaagugugucaagcucuuuuaaagcuaggcuuuagagaacaaaaguccaaguguaccuguuuagcaucagggcuguuuugcauuucuagcaaagucugacuuauuaaaccuccuaaucgcuccaucucaguuuuuucuguuuacguuguauuucauuugcaaugugaagcuauuaggauguuccuuuugugagggaaaaggagggauagauuccaucuuaguucucauaaaaguauaaaaaucaaaaccaaauaagcauauauaaagucuacuguaugcuggugcgguggcucauaccuauaaucucagcacuuugggaggucaaaguaggagggucgcuugagcccagaaguuugagacuagucugggcaacauagugagaccuugucucuagaaaaaauaaaagaaauuagcuggcuugguggcuugcaccuguaguccuagcuacuugggaggcugaggcaagaggauagcuugagccuaggaguuggaagcugcaagugagccaugauuguaccacugcauuccagccugggugucagagcaagacccugucucuaaaacagaaucuccuguagauggcauggaggagagaagcccguguguauuauccagaacccucgcucccugacgccuucuccccugccuucaucuugugcucuuuauuggagaaaagugugaggugaacgcacagaaaggugcuccccacuguggcagguugaacguuuguuuuuguuaauuaauguccaugcauucugcucuuucaguaacuagauuuagguaaccugggccuguuucccaucacuuccuggccuugugacugggcaaauaacuuugucucccugggccucaguuuccuuaacccugaaaugaagggguuagauuccagcgcuuugcauucucuggccagcucuugagcaccugcgacuccuuccugcucuucaguucuuccuccauccuggcugacuuuugcuuggcucccgcugcccccauuggcccccuuaaacuccagaagagcauagaagugaucaggugggucuuuuuguucacuauccauuaacuuuucaaggagggagaugcuguguucaaggagucagaggugaaauugugaguuuaucugauuuucuguucacuugauaauuauauaguugacuuggaaguguuucaaacugaagauauuccuuaaugaaauaugaccuccccacugccccaucuuuagggaauggcauucaccaaauccuuucaaauucagagaaauuagaaaaccuuggaucauuuuaguauuaaauuuagucuuaaaauugugggugguugucaaaucagaccucgucuaaggggaccucauuaggcaguucucuauaauggugacaggguggcuuaaaaugucuuaacuaaaugcaaauuaucucagagccaaaaguugagcacuugaaagccaaugaaauaucuauuuaaggagcacagaaggaugucagagaaggauccaaaguccugauuuuuuuguuacauuauauugggguagauuuacugcaagccagaggauucuuuacguaauuaacucccauuugaaaaaauagcaaacaauaaaacuauuuuuuuucccuuuaccuuugguauaaauagaacuaagccauagguugguauguuuaguaaguaauagguauuaaguaaguaauauguauuacuuacauuuuaccauaguugaagugugaacuugaaauauuuuuaaagcacagucuacagugguaagaacuuuucuuugcugcaguuuuagauuaccuaggaagaagacagugacauccuggaaugauuguaaauuggugcuugaaacccuggaagugaacuguuuuccaguggcaggaugaugugagguucaauacuucuccccuuugagucuuagauuuuaaauagucuaauuccaaaauauuuccuuaggcuggacacgguggcucaugccuguaauucuagcacuuugugaggccauugugggcggaucacuugaucccaggaguucgagaccagccugggcaacauagggagacccugucucuauaaaaaaaaccaacaaaaauuagccaggcguggugacaugugccuauggucccagcuauucgggaggcugagguggggccaucaccugagccugggaguuugaggcugcaguaagcaaugaucacgccacugcacuccaaugugggugacagagugagacccugucucagaaacaaaacaaaacaaaaaagcccccaaaacaaaaugcuucccuuuauucuugaggcauaguugauguuuuaaugguguuauaaacauaauuauuaucuuauauaggcugugaagugauugcuuauugguuugguacuagaaaccauauaccuuuaauuauguuugaucaugugagacccagaaaugccuccuguacacgccuuuaccauuucuugggaagacaauaggggccugccaucacugugaagcaauaaaguguaaaggauuggaaaauagggauugggauuauugaaacuggaaaaagugagggaguaauuuaaauucuguuuuaguuauuaaaagucugguuuccugacugugcuaaguauugcagaaagacaaagugugagacaaaauauuuagaucuucaggagcuuacauucaagacaagguuaaccugaugcuguaguucugguuguguuccuccaagaggcaggagaggagaauuggagauauucagaacauguuugggaggaauguaguaaucagggcacccuucugguuuaaguugucuuuucugcuucgcugcuauucagaaagugaaaagcuuuguucuggaacuuugagauauagaugggucuuuugcuuuuaauaauuuaagguaacuccuucaaagauauugcaggucuaguucacaaaacaaauuguacagugagcugagagcaacuuucucuguccugaguuuugaugaaguuguuuuuuuuaaaucaugaucaggauacagguccucaauuaguuugucuggaauuuaguaagcggagugcuggagauuggagaucagaguagcaugaagauugaauaagauggggauugcacauucugguuuacccaguuuggaagaguaaugcauagguaauauacagguuguguugaugggugaggauacagaugucacaguuugugagaauucaaguguagugauuuauuucauuuaaucuacuggcagagcucuaauuuacuuauggagcuguagaaacaaaaaauuucuaauagggcugagugcgguggcucacgucuguaaucucagcacuuugggaggucaaggcggguggaucacuugaggcccggaacucgagaccagccugaccaacaucaugagacccugucucuacuaagaaugcaaaaauuagccuggcgugguggcacacagcuguaaaaauaucucagcuacucaggaggcugagguaugagaauugcuuggaccugggagguggagguugcagugagccaagaucgagccaccucacucuagccugggcgauagagugagacucugucucaaaaaauauauauauuuuuaguaguuuuugcuauaguuuuaugaaaguaacaagacuaguaaaauuauaaaacaauuggccuuuauggucuaaagcguucuuauuuauagccacccagaauguaucaucugcuagucuccacucugcugucuguccuuuccaucaucccucuugggcgcccuaccuggcuggccugcccaguaaguauggcaccagguuuccuguucugggccucuggcugcuuuguacuucuccauuccuggaggucucuggaccuucagcugcucaaaauucaauugcaccaacuuugacugaagugcacugcugaugauccuucucuuugugagccuugccucuucccuaugagcuacuuucugccuagaccuccucauggugccguguccagaacgugggagccacccggcuaggaaacucaacacugcugcccuccuagcaguagcagcaagcuacagcuugcccccuuucaagguguuugacccuguuggauuucucauugcuccccuucuugcuuuguauuuuuuuuggcaggaagagucucuuuuauuucugagcugauuugcagaucagaaacgauggaccucuguugaacucugaagcaguccucccucuccacuugggacugcuaguccucuugccuuugguauaaagggguccuccaucuguccccaggccccauccuccgagaggccuuccagaaccugagcauuguguuuuucuuuuucaauacuuuaguaccuuagaaaccagaaagugauaaaugaggagaguagguaugaaguagaagaggauuuugauggccagcucguaaaguguagcguuaagugaaacauugugaugugaacaauuugguauuuuugaaaguccuaaugcuacuuguaccaggugaaauguuuaaaucucucucaagccccuagcauuuugauauucuuaaaaaagaaaaaaaaagccacacagaaggcauuaguccagcgugguauguuauugaaacuggaacgauauugcagcauaucuccacaucucccguugacggcaaagcugagccagugaaacaggugugagccuuugagacugcugggauaacccaugcuguggagauggaaaacuaaacuuuugagugaguuuucugguuuauugggauucauccuugguauaucagcaguugugguuucaagguuccauauuuuaguucuuguuccacuugauggaacacuugacaucuauccucuucuguaacuccgcaagaggggcauuugguuaauggucauuuuggaaagaaagcuauuuuggggacaguaauugccuggagucuuuauguaagaagagaccgaagagucuuagcaaggagaagguuucuguuugcggcauuuggcccauaguauaguacacauuccuguuguguuguuuuguuugcaucauugggcuuagauguuauuagauauuacuagucuaauccaauuccuuguucuuggagaauagguuucuuguuuaucugaauggcuuuucuuugcgucacuaugccagaauagucauucuuggacagaaaugaugguuuuaaaaucucucuuacauuuuaagaccugcucuagggguuguaaaauaguacugcuguuauugggaggaguuggguaggggccacagcagcagggagagagaggcucccaucguacaaacuugcagacuuuuauuaaaacguauuuauugauugcaaauuaugucaacagagugaggcuuugguaacucuucaaguuacuaguguuuccuucuuugcauaguuguuucccaucacccuuuaaacaucugcugcuucuggucuuguccagucaugcuugagugaucagccccagaagucugacagcucuuccugucuugacucaggacaguccaggacagcugagcucccugcacugaaacaaugggacuccugaaaacugcucugcuguugacaugagaagcacauuuccucuuucuuaacuuccagaaaguuacugugguggcuuugaaauuuguucugaaacaauaagcucaaaggauucuguuaaucuauucugauuaauuuaggaggcagcagcauucauuauuugacuuauguuagugguuaauuaaccaaaguagaacauguucacuuuuuauaaauuaaaugcugauagaguaacaaagacgaaauauuuuacaacacagauccuugaauuugacucugaaauauucuguuauuuugcagcaguuuccgguuuuagugacacuuacauacuguuucuauuauuagcaaguuuugaauuuaaguaacuugaaauggauaugaaaguuguuucuauaaauaauacagacuguacucaugugagaguuuuuuuucuuuaauuucauuguuggccuugauuggggagaagauuuauauuuuaugccagucuuuucuuguuuagaauuggcaagaauuggauugaguuguauuaaacuguuuaugugaauagauaguuacuuuugagaugucuuugaauguagaauauucuugcagccauuucuugauggucugccuugacugucuuauggacaguuggcaucagugacacuuucauuuauuuacuuauuuauuuuuuuuuagacagagucucgcucugucgcccaggcuggaaugcagucguucgaucucaggcucacugcaaccucugccugcuggauucaagugauucuugugccucagccuccaaaguagccgggauuacaggcaugcaccacuaugccuggcuaauuuuugcauuuuuaauagagaugggguuuuaccauguuggccaggcuggucuugaacuccugacuuccagcaaucugcccaccucggccucccaaagugcugggauuacaggagugagucaucacuccuggucaaucagugacacuuuuaaaucacuuguguccuugacucuuuuuauguugucuuuaugagggacaggcccuuuauucuaccaaggagaccuccauaguugcucauucugaauucuuucaggaagauuugguugaggguuguucauuaggcuggggccucugccgggguggguugagauuagauggauaacaggaaaauaaucauagugcuucccagccccuguaagugaggggucuucuuaggauaacuuuuuggcuuggaguaaaugucccccccaaaaucuuaaacucaguuuaagggugaaaacuuaaauauaauuuguuccuggacuuugggauucugugaacauuuguuugcuucuguuagugaugguuauggaggguuuaaccgcccacauuuucacuaccuuuuuagcccaauaaauggaaaaagaaaagguaggcagggaauuuuguuccacuuaaaacaucaguuggccuguucggauucaggugacucaagguuugguaaugaagcuagagaagucuugugcagauacacucaaacuuccugacugugcaguucagggaauuguaaguagagccugagcaaggaacaccuugauuguuggagaggaaagguggaagaugagcacucccuaauccuccucuacucaguuucuuuaggguuaaaugggcauuuauuuaaauguaggauucugcuugccugaacucccaagguucuguuaauugaauugaauccuuucuauccugggcuuccucccgcaccauagcagaugugaggauauggagcauaaugcaguagugcucuguacucuguguuaugcaauuugaaaagugccguucuagcccgaaaauguuagugcauugacucucuuucacaugaaaggccuuaaaguuuaccccuggaagucaaccuaggguggcacagaggcagagacccauuaccaccaucaacccucuggcccuuuuaaaagguggggagaggcuacugugaacacugaagacagcacuuuaguuggauggacuucauaauuaaugucucauuaagugaagacuuccguuucauuuggcuuuccagaccauucgguagaaaugcagaggaauggagggagaacagugcaucucaguuggcaggcaggaagagcagauguggaagaagcaacaaagauuuucuccaagcacuugagccgugcuuuagguauagauggacugucuuuggggccauccuaguaaucaacaugguuaauggcagcuucucucucuguccuugagucuuuuagcaaaaauaaguuuuuauuugacuccucaagcaaggguacccagccuuggagaggagaugaaauuaagauaaaucuuuauuuuuucuuauuuguauuugaaggggaaguuuaaaacuagucauguaaauagcuguuuggcuuaucuggacuuuccagucauuuuuguuuuccuuccuuucacggauaaucaaucuuucacuaucuguucguauuugcuucuuauuguggucuccugcuccgcccugcccacucccacuuuuuuuuuuuuuuuuuuuacuuuguucugagcccuucucaggcagaggaggucaggcagguacacgugccuuugggaagaaggugguggaaaaauauggaauaaugagcccuucugacuuuggauucagcaauuuaacauuggugcaguagguggaguuauucuuggagucccaguuugaagauugcugugcagaaacccaucugugcugcugguugccaacauuucugguacaaauauugucauuugcucuugaggcaaucugcuauuucaguccuagaugcaguuuuguaauaugcuggguaaaauagcagacaaaaaauaucuuaaguggugguauaaucuucaguuuaaaaacacuuuagcaauguuuccaguagaggauuguucaacgugucuccuuuccuuggcuguaaacauaaucuaaauucauuuuuccucguuugccugagccacgguucccuugugcugacuuugcaugucaguaacuuccguacccaucagagaggaaagacagaggggcagucuugugcagguaaaagguuuaaguaguaacauuuccuuaagauugcacccuguagagguuuagcauuccaugaucauucuguugauaagcaaaugagaaaugaguaacuugcucaaaaguuacuugguuacaaaaauugucaaaacugauacuacacacuauuucccauuugguaccuuuuaucccuacacacuauuucccauuuggugccuuuuauuccagacugcaagagucauaucuucugugcaggcugcugaacagcuucacaagggggugccucuguugccugugaggaguagguguucuugaugggauuggggucucccuggaaacccggggaugggacugugccaccauuuuauugggcuuuuguuauuaagcccuucuuagagagagaaagcauauccuguaggaaguaguauguuuccuucuguuucuguggcuuucucaguuucuucccaucuugaugcauagugagaaauccauuuuacaguaugacucagugcacauaugcacacaaugauagaagaguuuuacaaaauaguacugugcuuagccauuuauguaagacuguuuuguuauuauuuacagaaaugcuagccacaauccucucaauugguuucacuauuuuauggauugugauccagaguuuuagccugagggcuuucccacauucuuucaagaccuuugugucauggcagcagccuugaaguuaggggaaacagguagaugaauccauauauggagaauuggccauauaugggaaaugaggagggaguucacaggucagucacuugaacacacaaugauuugggcugagccaguuuuuaaguagccccucucuggauuggucucaaacauggaacuaguuaaacuuacguacuaaaucaaacagacccaaaagacaccguuuguuuuuuaagucuugcuggcacagacuagcuaggauaggguuuuucauccaucuggacaucuugucguuuagcuuuuguauacaacccuugaaaaugggcagcugcuggguccacuuuccuggaugagguuucuugcuucuuucuuuugagauuaaccugaguagggcucaccugaaucaauuauuuccgcagaagcuuucaucucaugaaagcgcauuccacuuuucaugucuucagggcaaauacgaauugcacuuccacccugaagucagaacuguaaaggaauuuuagguguuaucaauguuugauaagaagugauuacccuuucucugcagagcuggaacagcugaagcuggugugaucuggcugggagaaggcugugcucuggaauaguguccuuuccacugagucccugacuugccuguuggcauauggagcaguaaucuuuucaaaacuccauugugaaguuggcugugugugugugugugugugugugugugugcgcgcgcgcagaggaaauacuuacauacuaaaggggaaagcgggggaggaaaauuccaggaaauugcaaggugagguugacauuccuuauucucuuaacucuugcuucuguuuuucuuucugaaaaacaaugaugacuuaaaauuugaucccagaaccaacuggcuuuuuauccguaagauuacaguuguguuuuuuagacauccuuucauaaauaucuaaugaauugccuuuuauuauuugguguuaaugaccaaaaguaccacuaacauaguguuucucauacuugccugucauauaagauacuuguuaagaauauucugggacuucaucuuccucuuguuaaaucagaaucuaccuggaauaacauaguuaccuuauuuucuuagaauaguagaacugaaaagaaucuuacacaugaaaguaguucagguguucccaaaccuggcuccaguaccaugacugcuuuaauagauugccaagcugcgcuucauaccuagugaaucauaacauccgaagcuuccuagaagagucggaccauuagacuggagggauaacuacucgcuuauucgguugccuucaggaaaggggaauuuaugugcuugguuauugggcugauuaauagcaggacaagaaaucuuauugucucuguagauucauccaaauaauauccaaauauauauauaauguuuguuugagauggggucucacuuugccccccuggcuggagugcaguggcacaaucacagcucacugcagccucaaccuacccgggcucaggugauccuccuaccucagccuccugaauagcuaggacuauagacacgugccacugcaucuggcuuuuuuuuuuuuuuuuuuuuuuuuuuuuuuuugcauuuuuuguggagauagaauuucuccauguugcccaggcuggucuugaacuccugggcucaagccauaugccuaccuugaccucccaaagugcuaggauuacaggugugagccaccaugcccagccccaaauaauauuuacauuucagguacugacuagguaggugagugggggcaguuuugagaugggugagcaaggucucucugccuuggagguauauguggauuguuauucagccuuucucaagggaugaguuuuagagaguggaauuagacucacuugaggagcuuuuuauuaaaaaaaauucuaauacccauauaagacugcaaacuuaacugauaaauguuuguucucacugcuccaccaaccugccauuccccaucugucucccccucuucaggguucccuaucccugagacaaaacaauauugagauuaggccauuaaaacccccacaauggcuucuacauguucaaauaaaaggaagagucacaccaucugaucucacucacuguaaaucaaaggcuagaaaugauucagcuuagugaggaaggcauguauaaagcccagauuguccaaaagcuaggccucuuaugccagucagccaaguugugaaugcaaagggaaaguucuugaaggaaauuaaaaaugccauuccagugaacacaaauuauaagaaagcaaaacagccuuauugcugaucuggagaaaguuuuagugguuuguauagaagaucaaaacagucacaacauuccuuuaagccaaagccauguucagagcaaggccguaacucuuaaauucugugaagguugagggaggugaggaagcugcagaagaaaaguuugaaacuagcagagguuguugguucaugagguguaaggaaagaagccaucuccauaacaugaaaguacaaagugaaggagcagcaaguuauccagaagauguagauaagaccauugaugaagguggccacacuaaacaacagauuuucaauguagaugaaguggcauucuauuggaagaagaugccaucuaggacuuucauagcuagagaggagaaguuaaugccaagcuucaaagaacagguugugauucucuuauuagggggguaaugcagcugguggcuugaaguugaagccaaugcucauggaccauucagaaaauucuagugcccuuaagaaguaugcuaaaucaacucuaucugugcucuguaaauggaacaacaaagccugagcgacagcacaucuguuuacagcauggcuuacugaauauuuuaagcccacaguugagaccuacugcucaggaugaaagauucaaaauauuaaacugcucaaugauaauguaccuccucacacaagagcuuugauggagauguacaagcagauuagugguguuuucuugucugcuaacacaacaucuguucugcagcccaugggucaagaaauaauuuugacuuucaagucuuauuauuuaagaaauauauuuuauuaaggcccaaguugccauagugauuccucugauggaucugggcaaaguaaaauuaaaaaucuucaagaaaggauuuagcauuguagaugccauuaagaaauuugugguucaugggaggaggucauaauagcaauauuaauagaaauuuggaagaagcugauuccagucuucauggaugaccugggagggguucaagauuucagaagaggaaguagaugcagauguggugaaaacaucaaaagaacuagaauuagaaguggagccugaagaugugauugaauugcagcaaucucaugauaaaacuugaacucaugaggacuugcuucuuacggaugagcaaagagagugguuucuugagauggaaucuacuucuggugaagaugcugugaaugaacaugguugaaaugacaguaaaggcuuuagaauauuacauaaagcgguggcaggguuugagaggauugacucuaauuuugaaagaaguucugcugugaguaaaaugcuaucaaacagcaucacaugcuacagagaaauuuuucgugaaagaaagagucaaucaaucaggcaaauuuaauuguguuguuuuaagaaauuaccaaagcgaucccagcuuuuagcuaccaccacccugaucagacugcaguaauuaacauugaggcaaaggcccuccagcaaccgaucacaacucguugaaggcucagaugauuauuagcauauuuuaacaauaaaaguuuuuaauuaagauguguacauuauuuuuuuaaaauauggcuauugcacacuuaauaggcuacaauauaaugcauaccuuuuaugcacagggaaacaaaaauuuguuuuuacuuuauugugauauuugcuuuauugugguauucuggaagugaacuugagguaucucuaagguaggccuguauuucauacaugaagaaaggcauagagaccaauauaauuaguacccauauucuaccucucuguuuuagcuauaaauauaauucuuccccuccuugucccagagguagccacuaauuccagaguuuguguguugaagggcaccuuuccugccagaagcccguacccuggcugugcugauagaugggguccacaaauucuuuguaggauccccuuuuuaaaaaaagcuuuacauaaauguuaucauuuaagguaaacaccauucuguaacuugauuuucuuuaauaaaagucagcaugauauuuuugagauguauuguucuuacaugaccagauauggccccauacuuaauaguuaaaucaggaaauugaagccagacagcuugaaaaccuucuuaauggaaaaaaaugcaagaagugggugggauagaguuucuguugaauuuuuguauagaacauugucauuugugggaaacuaguugauuugaauucuguguuauuuugaauagccuaauaacagcuuaaugaggauuaauugcauguuguauggaaaguuaauuguuuuaauuuacuauggguguaguuacugcaguuugguucaaacaggugaaaguuaagauuuguagcauaaaacaggaagcagaugggggcuaauuaaaguucuguugaugauaaaaggaugacugaucaaggagcgagcagcugguuucucaauuuaaacacaauuuguacuauuguaugaagacagcccucugcaaguucucaugaguaucuuucaaaggugaaggcauguguuccagcaacaagugugaaggcuguuguggcccuguuugugcucgcuccccuuuuuugccuucaagcagugucacuucagguuuuuccaaaaaaggggguuaagggaucacaaaaccuggccagauuuucagugaugcucucuggacaccuguugugucccagaaaagucuaaagcucuuucugucuccaagaaaagugcccaagcauuucauuuccuuuuguaguuuuucuuacuuaucucaacuccgucucuuggcaggcuuuccaauguuguugcccugaccauaacccaagaaggcccacaucuagcuagcggaagcgccggguauuuaaguguguaggcgaaggcuaagcagugcuguagauacuuuccuggagccucaccuuguucuucagggucuuugagcuucuggccaugagauguuagggacuugaacuuauuuugcuugauuguguccuggaugacuuucaccuucaaaugacagcaucuuuuguugcuacugcuaauagugauugcguaaacauugaggacaaguguccucuauguguuuugcuuaaggaacaugccagcacuggguuuucuuugaaugugugcagggaggugacaugaggucagaugaggugugccuugcuuggagccaggggcuagacauuugcuugagauuuugugcccauaauaucuaauauuuauaagugcuuuguaggauuaucucauuuuaguccuuacaaaaaugcuuuggaauggaaguuguuuauccccauuuuguagaugaggagauugaagccuggagagguaaagugacucagccaaggucucacauuugcuaagugccaguacuggauguagauuccagguuugugugacagcaagcccacgcuccucagccacuaguuuuguguaaaauuguuguucucuuuccccgucuccugcuuaaggaaagauauauuguuuccuggaaaaacaaaaauguuagcauauaguuugcaaacuacaacuuauuauuugguuaugcagguguguguguguuguauaaacauuauauauauuucacuuggauauauuccacuugauaggaacugcuuuguuuuugaaugaauauaugagaaaggaaaaugccuggguuuuuguuuguuaccccaauguagcaacauuaugaaagguaaaaugcucuuucuuuaacagcagcagcaaaaaagacaacaugcaaagguaaucuacaaaguaaaaagccccauuauauucaccaccuggaagcaacauuauuguauucaucaaaauugucuuguaaaagaaguaauugaccauacagagcucguauaauugguaauaaagagcacccuguauuuuaguugcaaauagugugcaauagguuucaggggugucaugauugauguucacugucagguguuguaaauaaacuuuccaaucccagaugguguuuuugccuaguuagguucuacacugaucccaccacauauuacacuaauggggaaaccuuguguacagguuccucaucuuccaagcucuauuguggugacccuagaaacugccuaugugcucacaucauggcuccuaacagcaugaggaggagugucacagccaaggcuagaguguuuuccuggccugggagaagucuuaggauuguaccgcccccgcccccuuuuuuuuucauucugcugccuucucagcagucaacuucagaaucacucuucuccugucuucuuucccccuucuuugcuuguuccuuccuauaccuugcuugucuuuuuacagaagcauuuaaggagauggaaaagauuuggcccauucuucuccugucauaacucugccuguguauuucugaagaugauguugacuguuggggaaugggauguaggagaaagaggucuacugugggucuugcuucgcacggaguaauccgaccuggcguggauugucuggucuccuccuucauccaucaaagaguaaggcaugguucaauuacuucuagcagcaagucccacagaacaccugggcuuucugagcuaccuagggcagguguguuauuugguaggaaguuugggcagcacuggggcuuucagugagagccccuccuucuaccuuggcauaaucauaaaaucucaccaauacguagcccuuuaugcuuuuugaagcacuuauacccauuacaauucuguggggcauuuaggacagacauuguuuuccuacuuuauagacaagaaagcuuagacauaaaggauguaaaaauguguccagucagaaagauagagccagacuuagauuuucuuccucauuaccaccgucuugccauuagaucagcauuuuccaaaaugugugcugcugaacaucaguuucaugguauagucugucaagaagcgcgggcaaagaaauguguaugugcguggaggggugugcaugugcaugcaugugaucccaccaacaaaacaaaacaaagucuaagggaacaguuuugcucuuguuuguuuuguguuguuuuguguacucaaggcucuaaaaaacuguacaguuaggaauccuguuuaauucuguguggccagagugucccaaagguauuuuuucagugaauucaaaucacccuaaaaggaaccauuauuuuguagagcacaugccgaagaaugcuuuaguaggccauagugugcugcuuuguccugaagcuacuuuggaggugcuacaggagaccucaaugguuagaggaaaaucugaucuucagggaacuugcagggaagaguccagaggaugcugauacacagucaguggcuggggaugcuuugggaauaaagacugucccgaagguggagugggaugggaggcuggcugcagggaaucuuugucauaaugucacuauaagcaccaugccuccaggauuucauaccgaguaggaauuuaaccagaaugcacaaaaguucucaaucuacaggaucagcauucuaggaccaguugucagcuuuguuagguaaagcuccaugaacuguagccugagugacagcugcagaguuuauuggcuuagggauggacuuaagaaauuuggacccaguacagccagcaugcugcugcaucuuggccugaaguuugacaaggcacauucccugagugaggccaucugcaucaacccccgcuccacugcccuuucuuuaguacuuaauguucaacuuugcgugcaauuuugcuuuuacuagauggcaauugagggaaggguggaagagaaguuggugguaaaggugccagucagugggcacauucugcauccauguucuuaaucagcucuucugucuuuuagcagaaauagaacuugauaaaacucuuuuauuuugaaguaaguuuguuccagccaagcagaaaggauaaauuauuuugcauugauaucugaaacuaaggaagcaagucuaaccuccuaagaacuggucauggauaucacccuugaucuaucuuuucuccucuucuguucauucuguuucauucuguuauguucugcuuggcucuguucuguucuaggcauugaguauagaucaaaaaguucauguauaauauuuuuaaaucccgacgacaaaaacuuuagauuaauggaggugauuaguuuacuuaguuugggcuggugaggagaauaaaaugauccuaguaggaggaguggcuggaagaagugcuaugaaauaggaaaaguuaauaaccuaaggugugguguuccugucugcagguaucuguuagcuauccuccauaaagugguuuuauguucuucuaaaguggacagaguauuagacucugugacccauucuacaaaauauuugaacugucugcuaagguuucuuuguuugcuaguaacugugaguuuuagacccugucuuaaguugcauggcacacacuugguuuguaacaggaaggaaaggaagcaguuagaggucagggcaucuggcugguggaagaagaaaggaggaugggaucuguugaggguaagguuaacaucacauaaaauguuuauaaucgaauucuguuguggggagugcucaucaaccuuuuaaaaguuuucaagaauuggaccacuugucuucuaguaugcaugugggcgggggguaaucaugccuuucacauugaggaggagggguggguggguggggggagucugaugccacugcagcuuauccucaugccccugcaguaccccacagccuuggcccugaaucuccugugcauccaccaggguacugacuaaugcaugaguauuuuguugcagcuuuauccauguuuguguggaacaauccaugguuacauuguaggccauuauuuccuuuaauuuccuuuuagcuguucaaaacaaccugaaagauguuauaguugagccuagacaaugacaucaaggaacaaaaauaaaccuucaaaauguaagaaccaaauuuuuaugccaaaucuugugaaugauggauaaaauguaugaaagcagucagcuucauggagggagacuuuuaaaaucuguuuucaaaacaaaugguccuggccccagcauccugcccuccuuuggcuaugaaaauaucagauuaugccguaaguuugaaaacaaucaaguauccuucaagucaugagacagaagccaaagcuugaaucgaaaacccugucauuuucagcgagggagacagggaggagggccugaagguaacuuguuucuggaggcccuucucucagcacuagcugcagcagcuuccuguuaggugggagaagcaccacagccaaggacagcagcuccuggagaugcuuuuacuuaucaagagcaauguagauguaugcaaaaauacagacacccacucacaguuacauuuguggauaaucagaaauaucuuucugcuuucccagcagagcccaaacucuccuccuaucauccaggugggaagacagguuuggcgcuuugcucuagguucugcauuauaacuuuacucuguuguccucugaucuuccacuggcuguccugugaguugcauguaggguaaaaaacaugcugcuguguuaaggccccacccaccguaccuccucucucucucuccucccuuucugugucuaaacucauacauggccauacugaccucuucucuuuucuccagacauaccuuacuaguguuuuuaaaaaaguuuccucacaaacacuaauagcucauauuuaucggacauucugcacaguggucaguaaguacuguuaguauuuccuucuugcagacaagggaaccaagcccaaagaucgcaagccauuuauccaagagcacucaggccguaacuggguuugaacugggccagucugguucuagcacacauguucugcaccaccacauaguuugucugucaacauugguucaugcucugcccuaccucaagaauucccaucccguuuuaucuagcaauccaagucguccuuugcuucacgucccaauuccagcguagggccuuuccuuucuuguuuugcgugugcugcaccuuaacguuucuguguugucagccuuccguacauauguguaagaccaugggaggcagggagagccuugagccuuaaugccuacuuguuauuuccacaguauacaguaggggcuuaguaaauaauuguucauugaaaauuacauugaucgguauugauuugaccaaaucaaaagauccuaauuuauguuauugaaaugugaauggaaauaaauuaacuucugaaauugucaguugauugaaauacuuuacauuagguaggcccacagauuuuccagugacaaaaaugaagauaaaaauugaucuuugguuuguauucccaauaaaaauaacugacacaggguccuuugagacccuuccuccuuggugcccuucacuccaccuacccccaccccuggcaagugcucuaacacugacuugggcaggaugaacuggacauguucaguuccaguccugauucucugaauggucccuuauuuauuuauuuuugucacccaggcuagagugcauuguugugaacuuggcucauuccaggcucaacuuccugggcucaagcuauccuccugccucugccuucuguguugcugggacuacaaaugugcaacaccacaccuaacuuuuugauuuuuuuuuuuuuaauguagagacaggauggucucauuguguugcccaggcuggucuuaaacuccugugcucaagcaauccucccuccuuugccuccgaaagugcugggauuaccggugugagccaacaugccuggcccaaaugguccuuuuaaagucuaucauauauuucugucagagacuucaugaagauagaccucaauauauuggauaaccauuuuagucuucaaaguagcuauaaauuaagcuaggaauagcaagcaauuuucgaacaaaauauuucuuuaaaagaguuuucuagguuuggcuauuuauuaugugugauagauuuuuuaaaugauuaaaaugugaaacuuuucuuuuugggggugguaggguaccacugaagaaugauuguuuuacacuuuguucagucaacagcaguucuaagucauccauugcaaucuuaacuaggcugucagaauuuagcuaaauuaguuuucucaguaaucaaaaugaaaauaaauugaaauaccagagacuacauguugguucagagaaaagugaucuuugagaguugaaaugcugaaguaaucuguuagacugaccuuacugcucaucucuuuguuauauaaguaucugugacaguagagccaauaauuucuaauaaaaaccuugcauuuuguucuagaauaucaugaguuuauagaauaauucucgaauaugcuugaaauugguagcauucuucacauguauaaucuguuuuauguuuuccaaacauguucucauuuaaucuucacaaugcaccauucaguuauuugguacggagacaccagggcaucauacagcucagauucacacgcgcaguaaugaucuaacuuggacacagacauacacgcccugacuucuaguacucuuccuacuggaccauauuggcaacuucguaguuuuaagagaaguagagaaaaggcaucuccaaaugugcuaauacauacauugugguggaaaacuaacagcaggucagaguauccuuuuuaaaaauuuuuuauuuuacuuuaaguccugggauacaugugcagaguauccuugaauaguagcuuggaagagauaaaaaaacguuuguacuugugugcaagauucuagccacaauaguugauauucaguucccuuuuggaggaaauugaaagugaaaacgcugaaacaaugaggacuaaaauuccaaagaggaguuuaagguguaccaucgcaaauuauuggcuugugugggagauucuaauuuucuguugguuugagucauccuaaaaaaugguucauuuaaucauucauuccuucugccuuugcuaguuugcccgaaguuauuaagauuaucuuuguguuuucauccucaaacacaaauguguauugcgcauagccaguguguuuuaaaagaucaagacuuuucuuaaaaugaugucgauaacuuccaaaggcaacugugagguuuuuuuguuuuguuuguuuguuugucguuuucuuuuguuuuggucuuuggagguuuauaaagauagucuugucuuaacguaugacaacaauaucauccauguuuccaaaaaagacaugauucgaacugcagcauuagaauaaaacauuuaauauuuaauacaaggaacacuguccauaugguaagguuugcuuagucauucaaguggggacccucaggugguucagggaucccuuuuuuccuaccugacauucucccuucucucuggagcccaaagaauuccuagugggauguccucaagucaucuaaaugugguuccagggcagacucaacuuggagccuuccagaauuccuuuagcccaggagugaucuuggggaagcacauucuuccugggcuggcuugcuuugaccugagacugcauuuaagcugaaaguccuggugggcaccucugacacagaugugcccacaucugguggagugccagugacugcgcaguggugaaagcugcucugcaggcuucuuuucugcucagugggugcugaguuuucaaacagacaugaacaugcagcucucagcacaggugcuuccacugggguggaaauuuggccuuacaaauaagcaaaauguaggcuucauucauguuaggugugugcugauggggauguguggcuuuagugugggcacauugaggagggccaggaggagucauggaggcuuuuuagguauguuaaugaaagcagcauuacugaaacauuuaugugagcugcuuuuggaguccccaaacacgccugggcuucuggugaugcugagggagcagcaguuugugagggggaccaugucuuuuguauuacuuagaaggaagguguggacagcagggcuguugcgcagcagaccuacugugucuuagaguguaauugugcucugccuccucagguggaucccugaugucugugggaagcugggccacagcccugacuugggcucaaucucugugauggugggaguuucucuuuagcauaaaccugggcccaaauaguuuugcuauuauugggucaacccauuugggaagcuauuugauuugagacaaccuuugaauaauauuugggugguauauaaacaaacauauauauucggcagucucgagucguuguugcauuaggcuuccuagacagaguaaugggcaagcuggugucaagauucuacguaaacccuacaggaaaacccaacauugcagguaguguaauucagaguguuacacuuuauugcaguuugcuguuguuuuuguaaucuggauuaucauaucuaggucccaaaauagaaaaaacacauaaaucuagacuugguacucuguuuacuaagaauucuuaguaaacagacuaugcgaaaaaacacauaaaucuagacuuuguacucuguuuacuaagaauucuuaguaaacagacuauguauccaauagauaaauucuucccuagauuuuccagauagcaaacauauuuaggauaaaaacaguucuacguaguacaugcuaugggugggauauuguccuagggauuuuaaucugucaaaguuucaguguucuugcuucugaauuuauauccauaaaguuuuucacuggcuucuguaaacaauucgggaacauaccuugaauauacauuuaccuagcaugaacaggauuaacaggcucaucaauguaaugcugacaaaauacuuuaaaauucacuuuaguccuuuaaaauuuuagaaagcuuuaaaauggaucaaaguauugguauggcuaugcuuuauuuuaugccuaauuuaaauucuucaucagaagagaguagauccuaaugcguucuuuguuuuugguuuuaacuuuguugugccuuagucuucugguagccaaauagauaagguaguuaauugcguuauaaugcugugcguuuauaggaccacugcagauuagaaaaauuguauggccuauaaaacagacaaagauuuucauuaggaacagcagaauuacuucagcgucaaaugaguuuccucuuaauauucuccugugguggggccuuuugcaucugagacagccauuaggcggaagcagcaaaaagcauggguauuccaguaguuaauucagucgaaguuucaggaaggccccuuuaggucacugaugggcaagaugggggaguuguggcugucugcuguggauuuggcaguaccuggccucugugccucccuggggaggagcuggugaguggguuaaaggguccccagggguaacugcaggcugcaucaaaacuaaaucaauccuaggggaaacaagcuccacuuugaaauccuugguagccuacagaucucuuuuuuuauuuacuuuuuuuauaguacuuuaaguucuaggguacaugugcacaaugugcaggcuuguuacauagguauacaugugccauguuagugugcugcacccauuuacucgucauuuacauuagguauaucuccuaaugcuaucccucccccuuccccccaccccaugacaggccccggugugugauguuccccuuccgccuacagaucucuucaaacaaggcauuuagaagaauuuuagcuagaugaaauuuagucucuggauauccaccacagggaccuuauuagcuaggguugaugacauucauuugagagcuggccuuguuuggguugugugguaucauuaaacccaagcguaugacagugugagauaguuucuguuuuccaggcuuugcuuaaauagggguccacauuagcaccugauacagagggguuauagaaggaaagugauuaagaugaaugccuugugaucuggagcuggugucuaaggggauugcucguuucugccucaccuggauuguuuugggauuugucuuuuugggguaguuuguuucugauagugcauagagcccauaguauugaaugguacaggagacuuccauuucacuuccugaaaauuaaagggcuuugcccuuccuuucacaaaacuguagauuccuuuaauacaggguucucaugugggacacagugaaauuuuguagugcugcuuuuuaauuacuaccuucugaaaugcaaaagcuuugguaugguguaauaucauuaaguacauuuucuguucugucccugaagggguuuucuucaauccuaaauguaugagguuauuggcugaaauguuacucugaaauauuuagaccuuuggcuaauaaagaucagacaaaccagagaacauccuccguuguaaagcuuucugcccccggucuugugggcuagugguggcccccuucuuccuucuuuguuccucaauaccguagucccauuuacuuguaacgcaccucuuuuguccuguaguacguucuuacacuccuugaccuccucaccucuuaggggucuuuuuuuuauuuuauuuuauuuuuuuuuuuggagacagagucuugcucuguugccgggcuggagugcaguggcgcgaucuuggcuuacugcaaccuccgccucccgaguucaagcaauuuucuugccucagccucccaaguagcugggauuacaggcacgugccaccacacccggccaauuuuuguauuuuuaguagaggggguuucaccauguuggccaggauggucuccaucucuucacccucgugaucugccugccucggccucccaaagugcugugauuacaggcaugagccacugcgccuggccuaggggcucuuuuagaguuuguuuuccauaaaguaaauagucaugggugacuaguguuugugaagagaugagaaagaacaucauucuaauaaucaccauccuggauauaauuugucaucaguccaggugcaguggugcaggccuguaaucccagcacuuugggaggcugaggugggaggaucaguugaggccaggaguuggagaccagcaugggcagcauagcaaaacccaaucuauuuaaaaaauuguuuaaauguaaaaauuaaucuauuaucagacaacugcuguaucucccuuaacuugaacaacauccuggacacacguguucugacauaggucaccucaaaaaccgacagaauaugcuaguuaaaugcucaaauucuuucauuuaaaauuuucuuaacagggagaaaacacaauuuuucuguaaaugacggauugcagcucgguugugaggacauuggaaauaagccugaggaaggcuggcugccuuuaaacaggaaguuugugaugagugacuuuuaaucaaguuacaaccauucauaauggcuuaaaaaauuguuguuuauguauucuuucacuuccuaaaacaaaauagccaguguuuauugucauugugucaggugaugcaccaggcaacuucauguauaucauguauaucaugccauccguacauguaacuguuuuacagaugugaaaacaggcuuagugaugagauccaggaccuacucagaagggcccagcaguaacucugccuccagagccggcaccuccgguucugccucacaguguacuucccaaguccaugaagcuucuccugacaccuaugaguucuuccauuugucuuuuuaguacuauuugacaugcaagcauaaucuccuacauuccuuuugcaguggauagucauauuuucccuuccuuuggaaugacugacuagaguuagagauaaagcuguguaacuaaauuugugucuauagcgguuugagaccauagguaaggauuggcuuggcuaggggaggaauauugcauguucuugguacuuguuuuacauuucuuccaguacuaaagcuccaugugguucuauuuuuuguaaaugaacacccauaaguuucccaucugcguuguaaucucucugaacuuuguuucccuaacauaaaacaagagcguuagaccagaugaccuucgaaguaccuuccgguuuuaccaggccgccagucucuguccacagcccugggaucaguggagaugcuuuaagaccucugcacaguggggguagcagugggggguauaguggucuuugaggauauucgggcaagaaggaaacgauucugggaaaugaaccagccuuauggaaggaucuaggguguaagcauguagauuagcuauucucagcagaucuuguguuaaacacuuucuaacauugauuuacauacugucuauugcuaacgugugucuacugacaacucuuguaaaaaaaggguuggcaaaaggucauguuuuccuucuguuugcaaacaaaauggauuauuuuuaaaaguuguuguuuuauuaguaacucuuaaugggaacucuguugaauagauuuuccuaguucaguuuguuuucacuuguggaagugcaggaagagcugguguaaaagagaggaaggaggagggagggaauaaaggccaugccgggagccugcauaacaaucgcacacauugagaaaguucacagaaauuagauuaaaugcuuugggaaaauguaguuugucuagcauuuugaaagaauuucuagaauuucugggacaaugaguucauuuaaucauauguuccaguuucugagugugaaguucuuuuuguuggauuugguggcuguugcucacaccuucacgcaggguggugggcaguucuagguagcugggggucucuggggaccuuuccgcuuucccugugaguccccacagguuuucccuaggaugaugcucacaucugaaaugcacgcuucagcugcuauggauuccugccauaaagaagaacccacuagaauaagagcaaaucacauuguguaaauuuuuuuuuuuuaagacggagucuugcucuguugcccagucuagagugcaguggugcgaucucggcucacugcaaccucugccucccagguucaagugauucuccugccucagucucccgaguaccugggacuacaggugcccaccaccaugcccagcuaauuuuuguaucuuuaguagagaugggguuucaccauauugcccaggcuggucucgaacuccugaucuugugaucugcccuccucagccucccaaagugccaggauuacaggugugagccaccacgcccgcccacauuguguaaauuuaucaccuguuaaggcagaaaaugagcuuuguaaacuaguaagcagaauuauuucugcucccucaaggugcacacaaguaaccucagccuuaaguauguuccuuugauucuucuuaacaguggugaaggcaaggggauaguuuuuucagccagcagugggguugcagguagaaucacagagcuuugcuuugaacccuaacuggacagaucauuuucugagucuuaauuuuuccuuuuccauuucuaaagugaagccaguaauaccugccuuauagggcuguugcaaggauggaaugagauguauugacagcaguaaacuauaaaauacauaguuuauauaauaaacuaugaaauaaauacaaaaauauaaaacacgggguaugaaggccaucuaaggguuucaugagcaagguguauucagccuuaaguugagguuuugcauuauuuuugguuaaauauaaagaccaggguaaucauagaacugccaagcagaaagaaauguagaauguagcagugguguggagacccguggcugacaggugguggucuucauauaggcugagggacaggcuagaugcaugucaaguggcagcucagguuggaagacaggaguuggggaugugagaguccaggccagggugaagagaaguggcugggaaggcagccaggcucagcucuuaggaggcagagagcugcaagcagagggugggaccaggucucuuuuuucaacccagucuugagggaugggggcaaagucaaccuagacuugauuuagagcuaguucuguucacuugaucaucuuuauugggccuucaggcuccuagaagacuaccgugauagacugacuaguggucuguaaaugguuuuuauuaaaaaaaucacauacccuuuuugauaaaacauguauuuguuuauacacuuuaaauauauuguguaauuauauaauacauucacaaauaagaauuuuaaaagaaugagauaaaaaauuuaaaguaggccaggcgcaguggcucacgccuguaaucccagcgcuuuguggagacugaggcaggcagaucacgaggucaggaguucgagaccagccuggccaacauggugaaaccccgccuguacuaaaaauacaaauaauuagccaggcguggugacaggugacuguaaucccagcuacucaggaggcugaggcaggagaaucgcuugaaccugggaggcagagguugcagugagccaagaucaagccacugcacuccagccugggcaacagagugagacucugucuuuaaaaaaaaaaaaaaaaugaaagucaaugaaaguuguaaagauuucauccugcacuucaguggcugaugauugccuuagacagugggucugggagcauccuggggagggcauguguccucaggggucucuggggaccagccucagcaccucacuucuuccagccacagagacagaacaucagaaccauccuucauggagcuucccaacuggccuguugaggucccugcucugccaaccccugcugcugcucugcacaugcuggcuguguccagagcucggaggccccuggccccagcaaugugugaugccugcacauguggcuuggcugcagcaccuugagaagacuuaaauauucuagugacauuggcugaccagggcacugacagccucaccuuaguauuugaaucaguucugaggcaauaucuagugucaagagaaaaaugaacuguuuuucccaaaccagucaaucuuuccaguaauuaacauauaaaaaagccucauguuaagugagagcagugcagugugugguuauaaagaaauaagacuaauguuuaugacauacauaggucuguaaaacacagacauauguuauuuuauggaugcuauuaugccaguagugauaacaguaacauuagcuaauagagauuaagguaagccuuuccacgcauacuaucucauuuaaucuuugcaccaacuuuguaaauguaggaaauacuaaucuguucaacagauacuugagugccccuaugguguuggugcugugaggauacaguguacaagaagacagacaaaggucccugugcucacuugagcagcucacaguguagugggaagucaggcaugcccccccaccgccccagggaucagacauaguggaaucauaaagaggggugaguaaguaaggucccauguuagagcugcaggaugggaugaggucaucaagaaaugcuucuggaggggccaguugggcugagacagaagcuggggcauggagggcaggguggcagccuuuggagagaaaagguccguguuccuggacagucuauggguugugucauccuauuaaguggcucuuuacguguacuuauuuucuccccagguagaucaaaagcuucuggagggcauguucugugucucauuccuucaugucuuucgcuacuccuuccacaaaauaguuuccaguaaauguuaguugacaugaauugguacucaaauggaugguuaaaagauguguauuguguaagacaccauaucuuccuuguaauuuuuuugggggucaagcaacaaacaguuauugaggcuaugauauuagaaauuaaagacaagcuuuagcccauuugcucuuuaaggaacucagaaucugaacauagaacagccagcagagcagguugaacaagcaaguacaccaugucgggguuccccgacuacaccaugucgggguuccccgacucccccaucuguggagcucauugggucaggcuucccaggaagcacaugcugcacugcuugggguggccaggcaugcagauggcagauggggugugugcagaggcuugugaguggggcugcagagaaacaagcuaguggagaggagauuggcuggcuuguguuucucuagugccgucauguagaaacgcuggauuugggcaagugauugacagggcaugaaccucuguccugacauccugccucuguccucagguaauauuuguugagaguucaagggcauaauauuucagagcccagcagucucacgcggcucugcugcgaaguccuucuggugaacugcucuuccauccagccucuccuguggccaguaggggagugcagacacaacgucguuaauagcaacacauuuuuacaaaauuuaccuuuucaaaccccacccccuagaaaccguagcuucuuuaaugucccgcuggcugugugaaaaacaggaauuuauguaacaaguccugcacagcaaaccuuuuccuguucggaaaaaauuuuaauuguuggcaaaguuaggaaacagcucuguuacucaaagagcgaccugaaauguccucuuagaaaaauauguaauaugauguuuugauaaguaggagacugcuguggcuuuuuuuuuuuuaaagucuaaauuaguauaugucccaccugaguuagugaacgcuucuugaauguuuuaaagauuuccuuauuaugucuccugcagucuuuuuaaaaaugacccccagcugggcuugccagugaucugacaggcuuaucaugaauguuagagagcuucacccccucuccccaagucaaugcaacaaccaggaagcuucuaucugggaagaucuuucuucccccuuuaucauuaacuaaaugugacagggacaggagucaagcuuccucuccuccagagauuucaucggagcuuaucugugugucuauuguguucaaagaacaaaacugucaugauggaauauugugcaaaugccuggacuuccaguguauagaaaaugucagggucagacugcagggcugcauuccagugcuaccccaagugcgggccugcugaucuuaaggaggaauuaagaacucgguucggcugggguugguggguacagcagacaaggcuguggcucugugagcauacauguguguguguggcgccuucccauaggaauuuggggaucuuaggggaaugcaauaggaugggagggaaauguacucccuggccucuuuuagggauucuuguaccuacucuaagccccuggcccuccucacagcgugucucgaggugaggguagaucuuggguguggaggaagguggggauucuugggaacaggagacagucacugccaucaccacacaccugcuccguuccagccgggaaucuggggcuccgguggugucuuccccgcucucacacuucacuguaugcucuggcaggagggcuugucacguagcugcuguguugaaaucuuuaggcggaaugcaguacagagagucagagggcguuuugaaauguggauuucucagcccugacugcugggccuuacccugacuuuugcaucucccuuuagaaagugagaccccuccauuuucucucuucuaccaccuuuuaaugagagaagacuucucucccaguuuguguuggagccaggccucauccugcugugcagaggcucugcucaggcgcagugguuggcacucgggcccgggcgucccaugucaauggcaugaggaugugggcgcuguggcugcaccccugggugaccacaaauccagccagagccuuuuugugguugagaagaggggccgcagagaugcagggggcauggucagcugagccuugcauccaguuggcagaggaggccaagaaagcugggagacugugcacauuccagggucuuagggcacccagaaucccacuccuugggagcagaccucugaggaaagaggcugcugaaugaacaagguguaguggcugugugcccuguacugugcugggggccagaagcuauaagacaaggcccuuccuucuggggagcucacagcguuucccucgucuccuuuuccacgugucccacggacuccccugaacaccaucuuacucuguguuguagaggaggugaaucaaaccauggcuuucucaucugcagccuggcucugguguuucugcugaaacuuggagagaccaccucuggccccuuucaccauauauuugcaguuguggguuuguaucuguacuacuucuaagcuccuauacauaccacacugaauaggaauagagaagcaggacuuuggggcgcaggauaccacuauucuaaguuggggucuaauauucccuucauggugacugcuuacaugccaggcaccgcugagcauuuuuauguaucucauuuaguacauguaacaacccugauaaggcucuguaauuuagcccugcuuuacaggugaggaaacuuaagacacauuaggggcuaggcagcuucccaaggucaccuagguaaguaaguagcagagccacccaggaaguacucaaaagaaagauuguugguuuuucuucccuaguuggccuagggaugauaaacauggcaugauuaguuaugaagcugcgguagcuugagaguuagagcucuuugcguucucugucauuucuucccaucccagguugucuguuuggacaguguagccccuggcuacguggaggugugucauggaguuaguuggugcauccugcucauacuacuggucauugguagaacuggaggguaggggcacuacuugaauuaaaaaaaaauuucuuuuggcaggucagcuuucucaaauacaaaagcaaugacucuguuuuccuuacauucacuuguauuugcuuaaugggcuuuaaaggugugaaugaauccaagucuuauuaauuugggggccuuuaauucuugaucagcucuauauuucuauauucuuuuuuuuuuuuuuuuuuuggcgacagaguguuuaacucuuguugcccaggcuggagugaucucagcucaccgcagucuccuucuccugccucagccugccaaguagcugggauuacuggcgccugccaccacacccgacuaauuuuuguauuuuuaguagagaugggguuucaccauguuggcuaggcuggucuugaacuccugaccucaggugaucugccugccuuggccuccuacagugcugggauuauaggugugaaccaccaugccuggccuauauucuauauucuauauauucuauauucuuuugucuuuuuuguuucuguaaguaugugggcccaguaauauaaaacuucuuuauguaaauggcacagguucaaacugaagagaauuggcaguaguuuuaaggauaguagaauggaagggguuuuugauagcacuuugauacagaguacuauuguagcuaagcaaaauuuaagcgguuauuaaaaccaauuccuuugauuuuuccauaaaauguagcuguauaaaagaagguauuuacaauacucuuuauuaaauuuugucccuucauuaaauuaagauauagaauuuuuuuuuuuuuuuuuuugagaucgagucucacucugucucccaggcuggagugcaguggcacgaucucgccucacugcaagcuccgccucccagguucacgccauucuccugccccagccucccgaguagcugggacuacagguuugcaccaccaugccuggcuaauuuuuuguauuuuuaguagagaugggguuucacuguguuagccaggaugcucuugaucuccugaucucaugauccgcuugccugggccucgcaaagugcuaggauuacaggcgugagccaccgcacccagccacagauauuguuuuuaagauaagauacuauuuauuccugugcuauuugagaucuuuuguaguggcuucagagccauuaggacuguucagauggaaaucuguagcacacacucuuaagauuuuuuacuuguuuuccauguaauacauguagaauaggaaguuuugcaagcagagaaguauuguacuucuaauaagauguuuugccuuacagaauucaauucgucauaaucugucccuacacagcaaguucauucgugugcagaaugaaggaacuggaaaaaguucuugguggaugcucaauccagaggguggcaagagcgggaaaucuccuaggagaagagcugcauccauggacaacaacaguaaauuugcuaagagccgaagccgagcugccaagaagaaagcaucucuccagucuggccaggagggugcuggggacagcccuggaucacaguuuuccaaauggccugcaagcccuggcucucacagcaaugaugacuuugauaacuggaguacauuucgcccucgaacuagcucaaaugcuaguacuauuagugggagacucucacccauuaugaccgaacaggaugaucuuggagaaggggaugugcauucuaugguguacccgccaucugccgcaaagauggccucuacuuuacccagucugucugagauaagcaaucccgaaaacauggaaaaucuuuuggauaaucucaaccuucucucaucaccaacaucauuaacuguuucgacccaguccucaccuggcaccaugaugcagcagacgccgugcuacucguuugcgccaccaaacaccaguuugaauucacccagcccaaacuaccaaaaauauacauauggccaauccagcaugagcccuuugccccagaugccuauacaaacacuucaggacaauaagucgaguuauggagguaugagucaguauaacugugcgccuggacucuugaaggaguugcugacuucugacucuccuccccauaaugacauuaugacaccaguugauccugggguagcccagcccaacagccggguucugggccagaacgucaugaugggcccuaauucggucaugucaaccuauggcagccaggcaucucauaacaaaaugaugaaucccagcucccauacccacccuggacaugcucagcagacaucugcaguuaacgggcguccccugccccacacgguaagcaccaugccccacaccucggguaugaaccgccugacccaagugaagacaccuguacaagugccucugccccaccccaugcagaugagugcccuggggggcuacuccuccgugagcagcugcaauggcuauggcagaaugggccuucuccaccaggagaagcucccaagugacuuggauggcauguucauugagcgcuuagacugugacauggaauccaucauucggaaugaccucauggauggagauacauuggauuuuaacuuugacaauguguugcccaaccaaagcuucccacacagugucaagacaacgacacauagcugggugucaggcugaggguuagugagcagguaaguucaccccaauaucaaaagaccuuuugaaaaauagaacuuaaaagcgaggaacacaguaacuugccaugguuagcacaucuuugaugucaacugacugucccuugcagagagggaucuuuuaucauucauucucuguccuuuuugcagcuuacaguuuuccuucugagcuuacacagaaggaagcuuccuuuaacugcuuuaaagauuucuuuuugacaguucgauggcugcaucuuuuuaguagcucuucaauaaaugaauacauuugauauaaaucaaaugcugaaggguuuuuuguaaaguagaauuuuccccauugaaugauuuuagagcuguuugagaaagcucuagcuuuuugccccuaaguaugucugucacucuuaacauguuaaguugaauugauuuuaauuuggcuauauuuucauuguguguguaugugugugugcguauguauguguuuuuuccuagguuacacuuaaaaguacuucagauugucugacagcaggaacugagagaagcaguccaaagaugucuuucaccaacucccuuuuaguuuucuugguuaaaaaaaaaaacaaaaaaaaaaacccuccuuuuuuccuuucgucagacuuggcagcaaagacauuuuuccuguacaggauguuugcccaaugugugcagguuaugugcugcuguagauaaggacugugccauuggaaauuucauuacaaugaagugccaaacucacuacaccauauaauugcagaaaagauuuucagauccuggugugcuuucaaguuuuguauauaagcaguagauacagauuguauuuguguguguuuuugguuuuucuaaauauccaauugguccaaggaaaguuuauacucuuuuuguaauacugugaugggccucaugucuugauaaguuaaacuuuuguuuguacuaccuguuuucugcggaacugacggaucacaaagaacugaaucuccauucugcaucuccauugaacagccuuggaccuguucacguugccacagaauucacaugagaaccaaguagccuguuaucaaucugcuaaauuaauggacuuguuaaacuuuuggaaaaaaaaagauuaaaugccagcuuuguacaggucuuuucuauuuuuuuuuguuuauuuuguuauuugcaaauuuguacaaacauuuaaaugguucuaauuuccagauaaaugauuuuugauguuauuguugggacuuaagaacauuuuuggaauagauauugaacuguaauaauguuuucuuaaaacuagagucuacuuuguuacauagucagcuuguaaauuuuguggaaccacagguauuuggggcagcauucauaauuuucauuuuguauucuaacuggauuaguacuaauuuuauacaugcuuaacugguuuguacacuuugggaugcuacuuagugauguuucugacuaaucuuaaaucauuguaauuaguacuugcauauucaacguuucaggcccugguugggcaggaaagugauguauaguuauggacacuuugcguuucuuauuuaggauaacuuaauauguuuuuauguauguauuuuaaagaaauuucaucugcuucuacugaacuaugcguacugcauagcaucaagucuucucuagagaccucuguaguccugggaggccucauaauguuuguagaucagaaaagggagaucugcaucuaaagcaaugguccuuugucaaacgagggauuuugauccacuucaccauuuugaguugagcuuuagcaaaaguuuccccucauaauucuuugcucuuguuucaguccagguggagguugguuuuguaguucugccuugaggaauuaugucaacacucauacuucaucucauucucccuucugcccugcagauuagauuacuuagcacacuguggaaguuuaaguggaaggagggaauuuaaaaaugggacuugagugguuuguagaauuuguguucauaaguucagauggguagcaaauggaauagaacuuacuuaaaaauuggggagauuuauuugaaaaccagcuguaaguugugcauugagauuauguuaaaagccuuggcuuaagaauuugaaaauuucuuuagccuguagcaaccuaaacuguaauuccuaucauuauguuuuauuacuuuccaauuaccuguaacugacagaccaaauuaauuggcuuuguguccuauuuaguccaucaguauuuucaagucauguggaaagcccaaagucaucacaaugaagagaacaggugcacagcacuguuccucuuguguucuugagaaggaucuaauuuuucuguauauagcccacaucacacuugcuuugucuuguauguuaauugcaucuucauuggcuugguauuuccuaaauguuuaacaagaacacaaguguuccugauaagauuuccuacaguaagccagcucuauuguaagcuucccacugugaugaucauuuuuuugaagauucauugaacagccaccacucuaucauccucauuuuggggcaguccaagacauagcugguuuuagaaacccaaguuccucuaagcacagccucccggguauguaacugaacuuggugccaaaguacuuguguacuaauuucuauuacuacguacugucacuuuccucccgugccauuacugcaucauaauacaaggaaccucagagcccccauuuguucauuaaagaggcaacuacagccaaaaucacuguuaaaaucuuacuacuucauggaguagcucuuaggaaaauauaucuuccuccugagucuggguaauuauaccucucccaagcccccauuguguguugaaauccugucaugaauccuugguagcucucugagaacagugaaguccagggaaaggcaucuggucugucuggaaagcaaacauuauguggccucugguaguuuuuuuccuguaagaauacugacuuucuggaguaaugaguauauaucaguuauuguacaugauugcuuugugaaaugugcaaaugauaucaccuaugcagccuuguuugauuuauuuucucugguuuguacuguuauuaaaagcauauuguauuauagagcuauucagauauuuuaaauauaaagauguauuguuuccgu

SEQ ID NO: 21368 - RNA, 110275 nt, Homo sapiens
acggaaacaauacaucuuuauauuuaaaauaucugaauagcucuauaauacaauaugcuuuuaauaacaguacaaaccagagaaaauaaaucaaacaaggcugcauaggugauaucauuugcacauuucacaaagcaaucauguacaauaacugauauauacucauuacuccagaaagucaguauucuuacaggaaaaaaacuaccagaggccacauaauguuugcuuuccagacagaccagaugccuuucccuggacuucacuguucucagagagcuaccaaggauucaugacaggauuucaacacacaaugggggcuugggagagguauaauuacccagacucaggaggaagauauauuuuccuaagagcuacuccaugaaguaguaagauuuuaacagugauuuuggcuguaguugccucuuuaaugaacaaaugggggcucugagguuccuuguauuaugaugcaguaauggcacgggaggaaagugacaguacguaguaauagaaauuaguacacaaguacuuuggcaccaaguucaguuacauacccgggaggcugugcuuagaggaacuuggguuucuaaaaccagcuaugucuuggacugccccaaaaugaggaugauagagugguggcuguucaaugaaucuucaaaaaaaugaucaucacagugggaagcuuacaauagagcuggcuuacuguaggaaaucuuaucaggaacacuuguguucuuguuaaacauuuaggaaauaccaagccaaugaagaugcaauuaacauacaagacaaagcaagugugaugugggcuauauacagaaaaauuagauccuucucaagaacacaagaggaacagugcugugcaccuguucucuucauugugaugacuuugggcuuuccacaugacuugaaaauacugauggacuaaauaggacacaaagccaauuaauuuggucugucaguuacagguaauuggaaaguaauaaaacauaaugauaggaauuacaguuuagguugcuacaggcuaaagaaauuuucaaauucuuaagccaaggcuuuuaacauaaucucaaugcacaacuuacagcugguuuucaaauaaaucuccccaauuuuuaaguaaguucuauuccauuugcuacccaucugaacuuaugaacacaaauucuacaaaccacucaagucccauuuuuaaauucccuccuuccacuuaaacuuccacagugugcuaaguaaucuaaucugcagggcagaagggagaaugagaugaaguaugaguguugacauaauuccucaaggcagaacuacaaaaccaaccuccaccuggacugaaacaagagcaaagaauuaugaggggaaacuuuugcuaaagcucaacucaaaauggugaaguggaucaaaaucccucguuugacaaaggaccauugcuuuagaugcagaucucccuuuucugaucuacaaacauuaugaggccucccaggacuacagaggucucuagagaagacuugaugcuaugcaguacgcauaguucaguagaagcagaugaaauuucuuuaaaauacauacauaaaaacauauuaaguuauccuaaauaagaaacgcaaaguguccauaacuauacaucacuuuccugcccaaccagggccugaaacguugaauaugcaaguacuaauuacaaugauuuaagauuagucagaaacaucacuaaguagcaucccaaaguguacaaaccaguuaagcauguauaaaauuaguacuaauccaguuagaauacaaaaugaaaauuaugaaugcugccccaaauaccugugguuccacaaaauuuacaagcugacuauguaacaaaguagacucuaguuuuaagaaaacauuauuacaguucaauaucuauuccaaaaauguucuuaagucccaacaauaacaucaaaaaucauuuaucuggaaauuagaaccauuuaaauguuuguacaaauuugcaaauaacaaaauaaacaaaaaaaaauagaaaagaccuguacaaagcuggcauuuaaucuuuuuuuuuccaaaaguuuaacaaguccauuaauuuagcagauugauaacaggcuacuugguucucaugugaauucuguggcaacgugaacagguccaaggcuguucaauggagaugcagaauggagauucaguucuuugugauccgucaguuccgcagaaaacagguaguacaaacaaaaguuuaacuuaucaagacaugaggcccaucacaguauuacaaaaagaguauaaacuuuccuuggaccaauuggauauuuagaaaaaccaaaaacacacacaaauacaaucuguaucuacugcuuauauacaaaacuugaaagcacaccaggaucugaaaaucuuuucugcaauuauaugguguagugaguuuggcacuucauuguaaugaaauuuccaauggcacaguccuuaucuacagcagcacauaaccugcacacauugggcaaacauccuguacaggaaaaaugucuuugcugccaagucugacgaaaggaaaaaaggaggguuuuuuuuuuuguuuuuuuuuuuaaccaagaaaacuaaaagggaguuggugaaagacaucuuuggacugcuucucucaguuccugcugucagacaaucugaaguacuuuuaaguguaaccuaggaaaaaacacauacauacgcacacacacauacacacacaaugaaaauauagccaaauuaaaaucaauucaacuuaacauguuaagagugacagacauacuuaggggcaaaaagcuagagcuuucucaaacagcucuaaaaucauucaauggggaaaauucuacuuuacaaaaaacccuucagcauuugauuuauaucaaauguauucauuuauugaagagcuacuaaaaagaugcagccaucgaacugucaaaaagaaaucuuuaaagcaguuaaaggaagcuuccuucuguguaagcucagaaggaaaacuguaagcugcaaaaaggacagagaaugaaugauaaaagaucccucucugcaagggacagucaguugacaucaaagaugugcuaaccauggcaaguuacuguguuccucgcuuuuaaguucuauuuuucaaaaggucuuuugauauuggggugaacuuaccugcucacuaacccucagccugacacccagcuaugugucguugucuugacacugugugggaagcuuugguugggcaacacauugucaaaguuaaaauccaauguaucuccauccaugaggucauuccgaaugauggauuccaugucacagucuaagcgcucaaugaacaugccauccaagucacuugggagcuucuccugguggagaaggcccauucugccauagccauugcagcugcucacggaggaguagccccccagggcacucaucugcaugggguggggcagaggcacuuguacaggugucuucacuugggucaggcgguucauacccgagguguggggcauggugcuuaccguguggggcaggggacgcccguuaacugcagaugucugcugagcauguccaggguggguaugggagcugggauucaucauuuuguuaugagaugccuggcugccauagguugacaugaccgaauuagggcccaucaugacguucuggcccagaacccggcuguugggcugggcuaccccaggaucaacuggugucauaaugucauuauggggaggagagucagaagucagcaacuccuucaagaguccaggcgcacaguuauacugacucauaccuccauaacucgacuuauuguccugaaguguuuguauaggcaucuggggcaaagggcucaugcuggauuggccauauguauauuuuugguaguuugggcugggugaauucaaacugguguuugguggcgcaaacgaguagcacggcgucugcugcaucauggugccaggugaggacugggucgaaacaguuaaugauguuggugaugagagaagguugagauuauccaaaagauuuuccauguuuucgggauugcuuaucucagacagacuggguaaaguagaggccaucuuugcggcagauggcggguacaccauagaaugcacauccccuucuccaagaucauccuguucggucauaaugggugagagucucccacuaauaguacuagcauuugagcuaguucgagggcgaaauguacuccaguuaucaaagucaucauugcugugagagccagggcuugcaggccauuuggaaaacugugauccagggcuguccccagcacccuccuggccagacuggagagaugcuuucuucuuggcagcucggcuucggcucuuagcaaauuuacuguuguuguccauggaugcagcucuucuccuaggagauuucccgcucuugccacccucuggauugagcauccaccaagaacuuuuuccaguuccuucauucugcacacgaaugaacuugcuguguagggacagauuaugacgaauugaauucuguaaggcaaaacaucuuauuagaaguacaauacuucucugcuugcaaaacuuccuauucuacauguauuacauggaaaacaaguaaaaaaucuuaagagugugugcuacagauuuccaucugaacaguccuaauggcucugaagccacuacaaaagaucucaaauagcacaggaauaaauaguaucuuaucuuaaaaacaauaucuguggcugggugcgguggcucacgccuguaauccuagcacuuugcgaggcccaggcaagcggaucaugagaucaggagaucaagagcauccuggcuaacacagugaaaccccaucucuacuaaaaauacaaaaaauuagccaggcaugguggugcaaaccuguagucccagcuacucgggaggcuggggcaggagaauggcgugaaccugggaggcggagcuugcagugaggcgagaucgugccacugcacuccagccugggagacagagugagacucgaucucaaaaaaaaaaaaaaaaaaauucuauaucuuaauuuaaugaagggacaaaauuuaauaaagaguauuguaaauaccuucuuuuauacagcuacauuuuauggaaaaaucaaaggaauugguuuuaauaaccgcuuaaauuuugcuuagcuacaauaguacucuguaucaaagugcuaucaaaaaccccuuccauucuacuauccuuaaaacuacugccaauucucuucaguuugaaccugugccauuuacauaaagaaguuuuauauuacugggcccacauacuuacagaaacaaaaaagacaaaagaauauagaauauauagaauauagaauauaggccaggcauggugguucacaccuauaaucccagcacuguaggaggccaaggcaggcagaucaccugaggucaggaguucaagaccagccuagccaacauggugaaaccccaucucuacuaaaaauacaaaaauuagucgggugugguggcaggcgccaguaaucccagcuacuuggcaggcugaggcaggagaaggagacugcggugagcugagaucacuccagccugggcaacaagaguuaaacacucugucgccaaaaaaaaaaaaaaaaaaagaauauagaaauauagagcugaucaagaauuaaaggcccccaaauuaauaagacuuggauucauucacaccuuuaaagcccauuaagcaaauacaagugaauguaaggaaaacagagucauugcuuuuguauuugagaaagcugaccugccaaaagaaauuuuuuuuuaauucaaguagugccccuacccuccaguucuaccaaugaccaguaguaugagcaggaugcaccaacuaacuccaugacacaccuccacguagccaggggcuacacuguccaaacagacaaccugggaugggaagaaaugacagagaacgcaaagagcucuaacucucaagcuaccgcagcuucauaacuaaucaugccauguuuaucaucccuaggccaacuagggaagaaaaaccaacaaucuuucuuuugaguacuuccuggguggcucugcuacuuacuuaccuaggugaccuugggaagcugccuagccccuaaugugucuuaaguuuccucaccuguaaagcagggcuaaauuacagagccuuaucaggguuguuacauguacuaaaugagauacauaaaaaugcucagcggugccuggcauguaagcagucaccaugaagggaauauuagaccccaacuuagaauagugguauccugcgccccaaaguccugcuucucuauuccuauucagugugguauguauaggagcuuagaaguaguacagauacaaacccacaacugcaaauauauggugaaaggggccagagguggucucuccaaguuucagcagaaacaccagagccaggcugcagaugagaaagccaugguuugauucaccuccucuacaacacagaguaagaugguguucaggggaguccgugggacacguggaaaaggagacgagggaaacgcugugagcuccccagaaggaagggccuugucuuauagcuucuggcccccagcacaguacagggcacacagccacuacaccuuguucauucagcagccucuuuccucagaggucugcucccaaggagugggauucugggugcccuaagacccuggaaugugcacagucucccagcuuucuuggccuccucugccaacuggaugcaaggcucagcugaccaugcccccugcaucucugcggccccucuucucaaccacaaaaaggcucuggcuggauuuguggucacccaggggugcagccacagcgcccacauccucaugccauugacaugggacgcccgggcccgagugccaaccacugcgccugagcagagccucugcacagcaggaugaggccuggcuccaacacaaacugggagagaagucuucucucauuaaaaggugguagaagagagaaaauggaggggucucacuuucuaaagggagaugcaaaagucaggguaaggcccagcagucagggcugagaaauccacauuucaaaacgcccucugacucucuguacugcauuccgccuaaagauuucaacacagcagcuacgugacaagcccuccugccagagcauacagugaagugugagagcggggaagacaccaccggagccccagauucccggcuggaacggagcagguguguggugauggcagugacugucuccuguucccaagaauccccaccuuccuccacacccaagaucuacccucaccucgagacacgcugugaggagggccaggggcuuagaguagguacaagaaucccuaaaagaggccagggaguacauuucccucccauccuauugcauuccccuaagauccccaaauuccuaugggaaggcgccacacacacacauguaugcucacagagccacagccuugucugcuguacccaccaaccccagccgaaccgaguucuuaauuccuccuuaagaucagcaggcccgcacuugggguagcacuggaaugcagcccugcagucugacccugacauuuucuauacacuggaaguccaggcauuugcacaauauuccaucaugacaguuuuguucuuugaacacaauagacacacagauaagcuccgaugaaaucucuggaggagaggaagcuugacuccugucccugucacauuuaguuaaugauaaagggggaagaaagaucuucccagauagaagcuuccugguuguugcauugacuuggggagagggggugaagcucucuaacauucaugauaagccugucagaucacuggcaagcccagcugggggucauuuuuaaaaagacugcaggagacauaauaaggaaaucuuuaaaacauucaagaagcguucacuaacucaggugggacauauacuaauuuagacuuuaaaaaaaaaaaagccacagcagucuccuacuuaucaaaacaucauauuacauauuuuucuaagaggacauuucaggucgcucuuugaguaacagagcuguuuccuaacuuugccaacaauuaaaauuuuuuccgaacaggaaaagguuugcugugcaggacuuguuacauaaauuccuguuuuucacacagccagcgggacauuaaagaagcuacgguuucuagggggugggguuugaaaagguaaauuuuguaaaaauguguugcuauuaacgacguugugucugcacuccccuacuggccacaggagaggcuggauggaagagcaguucaccagaaggacuucgcagcagagccgcgugagacugcugggcucugaaauauuaugcccuugaacucucaacaaauauuaccugaggacagaggcaggaugucaggacagagguucaugcccugucaaucacuugcccaaauccagcguuucuacaugacggcacuagagaaacacaagccagccaaucuccucuccacuagcuuguuucucugcagccccacucacaagccucugcacacaccccaucugccaucugcaugccuggccaccccaagcagugcagcaugugcuuccugggaagccugacccaaugagcuccacagaugggggagucggggaaccccgacaugguguagucggggaaccccgacaugguguacuugcuuguucaaccugcucugcuggcuguucuauguucagauucugaguuccuuaaagagcaaaugggcuaaagcuugucuuuaauuucuaauaucauagccucaauaacuguuuguugcuugacccccaaaaaaauuacaaggaagauauggugucuuacacaauacacaucuuuuaaccauccauuugaguaccaauucaugucaacuaacauuuacuggaaacuauuuuguggaaggaguagcgaaagacaugaaggaaugagacacagaacaugcccuccagaagcuuuugaucuaccuggggagaaaauaaguacacguaaagagccacuuaauaggaugacacaacccauagacuguccaggaacacggaccuuuucucuccaaaggcugccacccugcccuccaugccccagcuucugucucagcccaacuggccccuccagaagcauuucuugaugaccucaucccauccugcagcucuaacaugggaccuuacuuacucaccccucuuuaugauuccacuaugucugaucccuggggcggugggggggcaugccugacuucccacuacacugugagcugcucaagugagcacagggaccuuugucugucuucuuguacacuguauccucacagcaccaacaccauaggggcacucaaguaucuguugaacagauuaguauuuccuacauuuacaaaguuggugcaaagauuaaaugagauaguaugcguggaaaggcuuaccuuaaucucuauuagcuaauguuacuguuaucacuacuggcauaauagcauccauaaaauaacauaugucuguguuuuacagaccuauguaugucauaaacauuagucuuauuucuuuauaaccacacacugcacugcucucacuuaacaugaggcuuuuuuauauguuaauuacuggaaagauugacugguuugggaaaaacaguucauuuuucucuugacacuagauauugccucagaacugauucaaauacuaaggugaggcugucagugcccuggucagccaaugucacuagaauauuuaagucuucucaaggugcugcagccaagccacaugugcaggcaucacacauugcuggggccaggggccuccgagcucuggacacagccagcaugugcagagcagcagcagggguuggcagagcagggaccucaacaggccaguugggaagcuccaugaaggaugguucugauguucugucucuguggcuggaagaagugaggugcugaggcugguccccagagaccccugaggacacaugcccuccccaggaugcucccagacccacugucuaaggcaaucaucagccacugaagugcaggaugaaaucuuuacaacuuucauugacuuucauuuuuuuuuuuuuuuuaaagacagagucucacucuguugcccaggcuggagugcaguggcuugaucuuggcucacugcaaccucugccucccagguucaagcgauucuccugccucagccuccugaguagcugggauuacagucaccugucaccacgccuggcuaauuauuuguauuuuuaguacaggcgggguuucaccauguuggccaggcuggucucgaacuccugaccucgugaucugccugccucagucuccacaaagcgcugggauuacaggcgugagccacugcgccuggccuacuuuaaauuuuuuaucucauucuuuuaaaauucuuauuugugaauguauuauauaauuacacaauauauuuaaaguguauaaacaaauacauguuuuaucaaaaaggguaugugauuuuuuuaauaaaaaccauuuacagaccacuagucagucuaucacgguagucuucuaggagccugaaggcccaauaaagaugaucaagugaacagaacuagcucuaaaucaagucuagguugacuuugcccccaucccucaagacuggguugaaaaaagagaccuggucccacccucugcuugcagcucucugccuccuaagagcugagccuggcugccuucccagccacuucucuucacccuggccuggacucucacauccccaacuccugucuuccaaccugagcugccacuugacaugcaucuagccugucccucagccuauaugaagaccaccaccugucagccacgggucuccacaccacugcuacauucuacauuucuuucugcuuggcaguucuaugauuacccuggucuuuauauuuaaccaaaaauaaugcaaaaccucaacuuaaggcugaauacaccuugcucaugaaacccuuagauggccuucauaccccguguuuuauauuuuuguauuuauuucauaguuuauuauauaaacuauguauuuuauaguuuacugcugucaauacaucucauuccauccuugcaacagcccuauaaggcagguauuacuggcuucacuuuagaaauggaaaaggaaaaauuaagacucagaaaaugaucuguccaguuaggguucaaagcaaagcucugugauucuaccugcaaccccacugcuggcugaaaaaacuauccccuugccuucaccacuguuaagaagaaucaaaggaacauacuuaaggcugagguuacuugugugcaccuugagggagcagaaauaauucugcuuacuaguuuacaaagcucauuuucugccuuaacaggugauaaauuuacacaaugugggcgggcgugguggcucacaccuguaauccuggcacuuugggaggcugaggagggcagaucacaagaucaggaguucgagaccagccugggcaauauggugaaaccccaucucuacuaaagauacaaaaauuagcugggcaugguggugggcaccuguagucccagguacucgggagacugaggcaggagaaucacuugaaccugggaggcagagguugcagugagccgagaucgcaccacugcacucuagacugggcaacagagcaagacuccgucuuaaaaaaaaaaaauuuacacaaugugauuugcucuuauucuaguggguucuucuuuauggcaggaauccauagcagcugaagcgugcauuucagaugugagcaucauccuagggaaaaccuguggggacucacagggaaagcggaaagguccccagagacccccagcuaccuagaacugcccaccacccugcgugaaggugugagcaacagccaccaaauccaacaaaaagaacuucacacucagaaacuggaacauaugauuaaaugaacucauugucccagaaauucuagaaauucuuucaaaaugcuagacaaacuacauuuucccaaagcauuuaaucuaauuucugugaacuuucucaaugugugcgauuguuaugcaggcucccggcauggccuuuauucccucccuccuccuuccucucuuuuacaccagcucuuccugcacuuccacaagugaaaacaaacugaacuaggaaaaucuauucaacagaguucccauuaagaguuacuaauaaaacaacaacuuuuaaaaauaauccauuuuguuugcaaacagaaggaaaacaugaccuuuugccaacccuuuuuuuacaagaguugucaguagacacacguuagcaauagacaguauguaaaucaauguuagaaaguguuuaacacaagaucugcugagaauagcuaaucuacaugcuuacacccuagauccuuccauaaggcugguucauuucccagaaucguuuccuucuugcccgaauauccucaaagaccacuauaccccccacugcuacccccacugugcagaggucuuaaagcaucuccacugaucccagggcuguggacagagacuggcggccugguaaaaccggaagguacuucgaaggucaucuggucuaacgcucuuguuuuauguuagggaaacaaaguucagagagauuacaacgcagaugggaaacuuauggguguucauuuacaaaaaauagaaccacauggagcuuuaguacuggaagaaauguaaaacaaguaccaagaacaugcaauauuccuccccuagccaagccaauccuuaccuauggucucaaaccgcuauagacacaaauuuaguuacacagcuuuaucucuaacucuagucagucauuccaaaggaagggaaaauaugacuauccacugcaaaaggaauguaggagauuaugcuugcaugucaaauaguacuaaaaagacaaauggaagaacucauaggugucaggagaagcuucauggacuugggaaguacacugugaggcagaaccggaggugccggcucuggaggcagaguuacugcugggcccuucugaguagguccuggaucucaucacuaagccuguuuucacaucuguaaaacaguuacauguacggauggcaugauauacaugauauacaugaaguugccuggugcaucaccugacacaaugacaauaaacacuggcuauuuuguuuuaggaagugaaagaauacauaaacaacaauuuuuuaagccauuaugaaugguuguaacuugauuaaaagucacucaucacaaacuuccuguuuaaaggcagccagccuuccucaggcuuauuuccaauguccucacaaccgagcugcaauccgucauuuacagaaaaauuguguuuucucccuguuaagaaaauuuuaaaugaaagaauuugagcauuuaacuagcauauucugucgguuuuugaggugaccuaugucagaacacguguguccaggauguuguucaaguuaagggagauacagcaguugucugauaauagauuaauuuuuacauuuaaacaauuuuuuaaauagauuggguuuugcuaugcugcccaugcuggucuccaacuccuggccucaacugauccucccaccucagccucccaaagugcugggauuacaggccugcaccacugcaccuggacugaugacaaauuauauccaggauggugauuauuagaaugauguucuuucucaucucuucacaaacacuagucacccaugacuauuuacuuuauggaaaacaaacucuaaaagagccccuaggccaggcgcaguggcucaugccuguaaucacagcacuuugggaggccgaggcaggcagaucacgagggugaagagauggagaccauccuggccaacauggugaaacccccucuacuaaaaauacaaaaauuggccgggugugguggcacgugccuguaaucccagcuacuugggaggcugaggcaagaaaauugcuugaacucgggaggcggagguugcaguaagccaagaucgcgccacugcacuccagcccggcaacagagcaagacucugucuccaaaaaaaaaaauaaaauaaaauaaaaaaaagaccccuaagaggugaggaggucaaggaguguaagaacguacuacaggacaaaagaggugcguuacaaguaaaugggacuacgguauugaggaacaaagaaggaagaagggggccaccacuagcccacaagaccgggggcagaaagcuuuacaacggaggauguucucugguuugucugaucuuuauuagccaaaggucuaaauauuucagaguaacauuucagccaauaaccucauacauuuaggauugaagaaaaccccuucagggacagaacagaaaauguacuuaaugauauuacaccauaccaaagcuuuugcauuucagaagguaguaauuaaaaagcagcacuacaaaauuucacugugucccacaugagaacccuguauuaaaggaaucuacaguuuugugaaaggaagggcaaagcccuuuaauuuucaggaagugaaauggaagucuccuguaccauucaauacuaugggcucuaugcacuaucagaaacaaacuaccccaaaaagacaaaucccaaaacaauccaggugaggcagaaacgagcaauccccuuagacaccagcuccagaucacaaggcauucaucuuaaucacuuuccuucuauaaccccucuguaucaggugcuaauguggaccccuauuuaagcaaagccuggaaaacagaaacuaucucacacugucauacgcuuggguuuaaugauaccacacaacccaaacaaggccagcucucaaaugaaugucaucaacccuagcuaauaaggucccugugguggauauccagagacuaaauuucaucuagcuaaaauucuucuaaaugccuuguuugaagagaucuguaggcggaaggggaacaucacacaccggggccugucaugggguggggggaagggggagggauagcauuaggagauauaccuaauguaaaugacgaguaaaugggugcagcacacuaacauggcacauguauaccuauguaacaagccugcacauugugcacauguacccuagaacuuaaaguacuauaaaaaaaguaaauaaaaaaagagaucuguaggcuaccaaggauuucaaaguggagcuuguuuccccuaggauugauuuaguuuugaugcagccugcaguuaccccuggggacccuuuaacccacucaccagcuccuccccagggaggcacagaggccagguacugccaaauccacagcagacagccacaacucccccaucuugcccaucagugaccuaaaggggccuuccugaaacuucgacugaauuaacuacuggaauacccaugcuuuuugcugcuuccgccuaauggcugucucagaugcaaaaggccccaccacaggagaauauuaagaggaaacucauuugacgcugaaguaauucugcuguuccuaaugaaaaucuuugucuguuuuauaggccauacaauuuuucuaaucugcagugguccuauaaacgcacagcauuauaacgcaauuaacuaccuuaucuauuuggcuaccagaagacuaaggcacaacaaaguuaaaaccaaaaacaaagaacgcauuaggaucuacucucuucugaugaagaauuuaaauuaggcauaaaauaaagcauagccauaccaauacuuugauccauuuuaaagcuuucuaaaauuuuaaaggacuaaagugaauuuuaaaguauuuugucagcauuacauugaugagccuguuaauccuguucaugcuagguaaauguauauucaagguauguucccgaauuguuuacagaagccagugaaaaacuuuauggauauaaauucagaagcaagaacacugaaacuuugacagauuaaaaucccuaggacaauaucccacccauagcauguacuacguagaacuguuuuuauccuaaauauguuugcuaucuggaaaaucuagggaagaauuuaucuauuggauacauagucuguuuacuaagaauucuuaguaaacagaguacaaagucuagauuuauguguuuuuucgcauagucuguuuacuaagaauucuuaguaaacagaguaccaagucuagauuuauguguuuuuucuauuuugggaccuagauaugauaauccagauuacaaaaacaacagcaaacugcaauaaaguguaacacucugaauuacacuaccugcaauguuggguuuuccuguaggguuuacguagaaucuugacaccagcuugcccauuacucugucuaggaagccuaaugcaacaacgacucgagacugccgaauauauauguuuguuuauauaccacccaaauauuauucaaagguugucucaaaucaaauagcuucccaaauggguugacccaauaauagcaaaacuauuugggcccagguuuaugcuaaagagaaacucccaccaucacagagauugagcccaagucagggcuguggcccagcuucccacagacaucagggauccaccugaggaggcagagcacaauuacacucuaagacacaguaggucugcugcgcaacagcccugcuguccacaccuuccuucuaaguaauacaaaagacauggucccccucacaaacugcugcucccucagcaucaccagaagcccaggcguguuuggggacuccaaaagcagcucacauaaauguuucaguaaugcugcuuucauuaacauaccuaaaaagccuccaugacuccuccuggcccuccucaaugugcccacacuaaagccacacauccccaucagcacacaccuaacaugaaugaagccuacauuuugcuuauuuguaaggccaaauuuccaccccaguggaagcaccugugcugagagcugcauguucaugucuguuugaaaacucagcacccacugagcagaaaagaagccugcagagcagcuuucaccacugcgcagucacuggcacuccaccagaugugggcacaucugugucagaggugcccaccaggacuuucagcuuaaaugcagucucaggucaaagcaagccagcccaggaagaaugugcuuccccaagaucacuccugggcuaaaggaauucuggaaggcuccaaguugagucugcccuggaaccacauuuagaugacuugaggacaucccacuaggaauucuuugggcuccagagagaagggagaaugucagguaggaaaaaagggaucccugaaccaccugaggguccccacuugaaugacuaagcaaaccuuaccauauggacaguguuccuuguauuaaauauuaaauguuuuauucuaaugcugcaguucgaaucaugucuuuuuuggaaacauggaugauauuguugucauacguuaagacaagacuaucuuuauaaaccuccaaagaccaaaacaaaagaaaacgacaaacaaacaaacaaaacaaaaaaaccucacaguugccuuuggaaguuaucgacaucauuuuaagaaaagucuugaucuuuuaaaacacacuggcuaugcgcaauacacauuuguguuugaggaugaaaacacaaagauaaucuuaauaacuucgggcaaacuagcaaaggcagaaggaaugaaugauuaaaugaaccauuuuuuaggaugacucaaaccaacagaaaauuagaaucucccacacaagccaauaauuugcgaugguacaccuuaaacuccucuuuggaauuuuaguccucauuguuucagcguuuucacuuucaauuuccuccaaaagggaacugaauaucaacuauuguggcuagaaucuugcacacaaguacaaacguuuuuuuaucucuuccaagcuacuauucaaggauacucugcacauguaucccaggacuuaaaguaaaauaaaaaauuuuuaaaaaggauacucugaccugcuguuaguuuuccaccacaauguauguauuagcacauuuggagaugccuuuucucuacuucucuuaaaacuacgaaguugccaauaugguccaguaggaagaguacuagaagucagggcguguaugucuguguccaaguuagaucauuacugcgcgugugaaucugagcuguaugaugcccuggugucuccguaccaaauaacugaauggugcauugugaagauuaaaugagaacauguuuggaaaacauaaaacagauuauacaugugaagaaugcuaccaauuucaagcauauucgagaauuauucuauaaacucaugauauucuagaacaaaaugcaagguuuuuauuagaaauuauuggcucuacugucacagauacuuauauaacaaagagaugagcaguaaggucagucuaacagauuacuucagcauuucaacucucaaagaucacuuuucucugaaccaacauguagucucugguauuucaauuuauuuucauuuugauuacugagaaaacuaauuuagcuaaauucugacagccuaguuaagauugcaauggaugacuuagaacugcuguugacugaacaaaguguaaaacaaucauucuucagugguacccuaccacccccaaaaagaaaaguuucacauuuuaaucauuuaaaaaaucuaucacacauaauaaauagccaaaccuagaaaacucuuuuaaagaaauauuuuguucgaaaauugcuugcuauuccuagcuuaauuuauagcuacuuugaagacuaaaaugguuauccaauauauugaggucuaucuucaugaagucucugacagaaauauaugauagacuuuaaaaggaccauuugggccaggcauguuggcucacaccgguaaucccagcacuuucggaggcaaaggagggaggauugcuugagcacaggaguuuaagaccagccugggcaacacaaugagaccauccugucucuacauuaaaaaaaaaaaaaucaaaaaguuaggugugguguugcacauuuguagucccagcaacacagaaggcagaggcaggaggauagcuugagcccaggaaguugagccuggaaugagccaaguucacaacaaugcacucuagccugggugacaaaaauaaauaaauaagggaccauucagagaaucaggacuggaacugaacauguccaguucauccugcccaagucaguguuagagcacuugccagggguggggguagguggagugaagggcaccaaggaggaagggucucaaaggacccugugucaguuauuuuuauugggaauacaaaccaaagaucaauuuuuaucuucauuuuugucacuggaaaaucugugggccuaccuaauguaaaguauuucaaucaacugacaauuucagaaguuaauuuauuuccauucacauuucaauaacauaaauuaggaucuuuugauuuggucaaaucaauaccgaucaauguaauuuucaaugaacaauuauuuacuaagccccuacuguauacuguggaaauaacaaguaggcauuaaggcucaaggcucucccugccucccauggucuuacacauauguacggaaggcugacaacacagaaacguuaaggugcagcacacgcaaaacaagaaaggaaaggcccuacgcuggaauugggacgugaagcaaaggacgacuuggauugcuagauaaaacgggaugggaauucuugagguagggcagagcaugaaccaauguugacagacaaacuaugugguggugcagaacaugugugcuagaaccagacuggcccaguucaaacccaguuacggccugagugcucuuggauaaauggcuugcgaucuuugggcuugguucccuugucugcaagaaggaaauacuaacaguacuuacugaccacugugcagaauguccgauaaauaugagcuauuaguguuugugaggaaacuuuuuuaaaaacacuaguaagguaugucuggagaaaagagaagaggucaguauggccauguaugaguuuagacacagaaagggaggagagagagagaggagguacgguggguggggccuuaacacagcagcauguuuuuuacccuacaugcaacucacaggacagccaguggaagaucagaggacaacagaguaaaguuauaaugcagaaccuagagcaaagcgccaaaccugucuucccaccuggaugauaggaggagaguuugggcucugcugggaaagcagaaagauauuucugauuauccacaaauguaacugugagugggugucuguauuuuugcauacaucuacauugcucuugauaaguaaaagcaucuccaggagcugcuguccuuggcuguggugcuucucccaccuaacaggaagcugcugcagcuagugcugagagaagggccuccagaaacaaguuaccuucaggcccuccucccugucucccucgcugaaaaugacaggguuuucgauucaagcuuuggcuucugucucaugacuugaaggauacuugauuguuuucaaacuuacggcauaaucugauauuuucauagccaaaggagggcaggaugcuggggccaggaccauuuguuuugaaaacagauuuuaaaagucucccuccaugaagcugacugcuuucauacauuuuauccaucauucacaagauuuggcauaaaaauuugguucuuacauuuugaagguuuauuuuuguuccuugaugucauugucuaggcucaacuauaacaucuuucagguuguuuugaacagcuaaaaggaaauuaaaggaaauaauggccuacaauguaaccauggauuguuccacacaaacauggauaaagcugcaacaaaauacucaugcauuagucaguacccugguggaugcacaggagauucagggccaaggcugugggguacugcaggggcaugaggauaagcugcaguggcaucagacuccccccacccacccaccccuccuccucaaugugaaaggcaugauuaccccccgcccacaugcauacuagaagacaagugguccaauucuugaaaacuuuuaaaagguugaugagcacuccccacaacagaauucgauuauaaacauuuuaugugauguuaaccuuacccucaacagaucccauccuccuuucuucuuccaccagccagaugcccugaccucuaacugcuuccuuuccuuccuguuacaaaccaagugugugccaugcaacuuaagacagggucuaaaacucacaguuacuagcaaacaaagaaaccuuagcagacaguucaaauauuuuguagaaugggucacagagucuaauacucuguccacuuuagaagaacauaaaaccacuuuauggaggauagcuaacagauaccugcagacaggaacaccacaccuuagguuauuaacuuuuccuauuucauagcacuucuuccagccacuccuccuacuaggaucauuuuauucuccucaccagcccaaacuaaguaaacuaaucaccuccauuaaucuaaaguuuuugucgucgggauuuaaaaauauuauacaugaacuuuuugaucuauacucaaugccuagaacagaacagagccaagcagaacauaacagaaugaaacagaaugaacagaagaggagaaaagauagaucaagggugauauccaugaccaguucuuaggagguuagacuugcuuccuuaguuucagauaucaaugcaaaauaauuuauccuuucugcuuggcuggaacaaacuuacuucaaaauaaaagaguuuuaucaaguucuauuucugcuaaaagacagaagagcugauuaagaacauggaugcagaaugugcccacugacuggcaccuuuaccaccaacuucucuuccacccuucccucaauugccaucuaguaaaagcaaaauugcacgcaaaguugaacauuaaguacuaaagaaagggcaguggagcggggguugaugcagauggccucacucagggaaugugccuugucaaacuucaggccaagaugcagcagcaugcuggcuguacuggguccaaauuucuuaaguccaucccuaagccaauaaacucugcagcugucacucaggcuacaguucauggagcuuuaccuaacaaagcugacaacugguccuagaaugcugauccuguagauugagaacuuuugugcauucugguuaaauuccuacucgguaugaaauccuggaggcauggugcuuauagugacauuaugacaaagauucccugcagccagccucccaucccacuccaccuucgggacagucuuuauucccaaagcauccccagccacugacuguguaucagcauccucuggacucuucccugcaaguucccugaagaucagauuuuccucuaaccauugaggucuccuguagcaccuccaaaguagcuucaggacaaagcagcacacuauggccuacuaaagcauucuucggcaugugcucuacaaaauaaugguuccuuuuagggugauuugaauucacugaaaaaauaccuuugggacacucuggccacacagaauuaaacaggauuccuaacuguacaguuuuuuagagccuugaguacacaaaacaacacaaaacaaacaagagcaaaacuguucccuuagacuuuguuuuguuuuguuggugggaucacaugcaugcacaugcacaccccuccacgcacauacacauuucuuugcccgcgcuucuugacagacuauaccaugaaacugauguucagcagcacacauuuuggaaaaugcugaucuaauggcaagacggugguaaugaggaagaaaaucuaagucuggcucuaucuuucugacuggacacauuuuuacauccuuuaugucuaagcuuucuugucuauaaaguaggaaaacaaugucuguccuaaaugccccacagaauuguaauggguauaagugcuucaaaaagcauaaagggcuacguauuggugagauuuuaugauuaugccaagguagaaggaggggcucucacugaaagccccagugcugcccaaacuuccuaccaaauaacacaccugcccuagguagcucagaaagcccagguguucugugggacuugcugcuagaaguaauugaaccaugccuuacucuuugauggaugaaggaggagaccagacaauccacgccaggucggauuacuccgugcgaagcaagacccacaguagaccucuuucuccuacaucccauuccccaacagucaacaucaucuucagaaauacacaggcagaguuaugacaggagaagaaugggccaaaucuuuuccaucuccuuaaaugcuucuguaaaaagacaagcaagguauaggaaggaacaagcaaagaagggggaaagaagacaggagaagagugauucugaaguugacugcugagaaggcagcagaaugaaaaaaaaagggggcgggggcgguacaauccuaagacuucucccaggccaggaaaacacucuagccuuggcugugacacuccuccucaugcuguuaggagccaugaugugagcacauaggcaguuucuagggucaccacaauagagcuuggaagaugaggaaccuguacacaagguuuccccauuaguguaauauguggugggaucaguguagaaccuaacuaggcaaaaacaccaucugggauuggaaaguuuauuuacaacaccugacagugaacaucaaucaugacaccccugaaaccuauugcacacuauuugcaacuaaaauacagggugcucuuuauuaccaauuauacgagcucuguauggucaauuacuucuuuuacaagacaauuuugaugaauacaauaauguugcuuccagguggugaauauaauggggcuuuuuacuuuguagauuaccuuugcauguugucuuuuuugcugcugcuguuaaagaaagagcauuuuaccuuucauaauguugcuacauugggguaacaaacaaaaacccaggcauuuuccuuucucauauauucauucaaaaacaaagcaguuccuaucaaguggaauauauccaagugaaauauauauaauguuuauacaacacacacacaccugcauaaccaaauaauaaguuguaguuugcaaacuauaugcuaacauuuuuguuuuuccaggaaacaauauaucuuuccuuaagcaggagacggggaaagagaacaacaauuuuacacaaaacuaguggcugaggagcgugggcuugcugucacacaaaccuggaaucuacauccaguacuggcacuuagcaaaugugagaccuuggcugagucacuuuaccucuccaggcuucaaucuccucaucuacaaaauggggauaaacaacuuccauuccaaagcauuuuuguaaggacuaaaaugagauaauccuacaaagcacuuauaaauauuagauauuaugggcacaaaaucucaagcaaaugucuagccccuggcuccaagcaaggcacaccucaucugaccucaugucaccucccugcacacauucaaagaaaacccagugcuggcauguuccuuaagcaaaacacauagaggacacuuguccucaauguuuacgcaaucacuauuagcaguagcaacaaaagaugcugucauuugaaggugaaagucauccaggacacaaucaagcaaaauaaguucaagucccuaacaucucauggccagaagcucaaagacccugaagaacaaggugaggcuccaggaaaguaucuacagcacugcuuagccuucgccuacacacuuaaauacccggcgcuuccgcuagcuagaugugggccuucuuggguuauggucagggcaacaacauuggaaagccugccaagagacggaguugagauaaguaagaaaaacuacaaaaggaaaugaaaugcuugggcacuuuucuuggagacagaaagagcuuuagacuuuucugggacacaacagguguccagagagcaucacugaaaaucuggccagguuuugugaucccuuaacccccuuuuuuggaaaaaccugaagugacacugcuugaaggcaaaaaaggggagcgagcacaaacagggccacaacagccuucacacuuguugcuggaacacaugccuucaccuuugaaagauacucaugagaacuugcagagggcugucuucauacaauaguacaaauuguguuuaaauugagaaaccagcugcucgcuccuugaucagucauccuuuuaucaucaacagaacuuuaauuagcccccaucugcuuccuguuuuaugcuacaaaucuuaacuuucaccuguuugaaccaaacugcaguaacuacacccauaguaaauuaaaacaauuaacuuuccauacaacaugcaauuaauccucauuaagcuguuauuaggcuauucaaaauaacacagaauucaaaucaacuaguuucccacaaaugacaauguucuauacaaaaauucaacagaaacucuaucccacccacuucuugcauuuuuuuccauuaagaagguuuucaagcugucuggcuucaauuuccugauuuaacuauuaaguauggggccauaucuggucauguaagaacaauacaucucaaaaauaucaugcugacuuuuauuaaagaaaaucaaguuacagaaugguguuuaccuuaaaugauaacauuuauguaaagcuuuuuuuaaaaaggggauccuacaaagaauuuguggaccccaucuaucagcacagccaggguacgggcuucuggcaggaaaggugcccuucaacacacaaacucuggaauuaguggcuaccucugggacaaggaggggaagaauuauauuuauagcuaaaacagagagguagaauauggguacuaauuauauuggucucuaugccuuucuucauguaugaaauacaggccuaccuuagagauaccucaaguucacuuccagaauaccacaauaaagcaaauaucacaauaaaguaaaaacaaauuuuuguuucccugugcauaaaagguaugcauuauauuguagccuauuaagugugcaauagccauauuuuaaaaaaauaauguacacaucuuaauuaaaaacuuuuauuguuaaaauaugcuaauaaucaucugagccuucaacgaguugugaucgguugcuggagggccuuugccucaauguuaauuacugcagucugaucaggguggugguagcuaaaagcugggaucgcuuugguaauuucuuaaaacaacacaauuaaauuugccugauugauugacucuuucuuucacgaaaaauuucucuguagcaugugaugcuguuugauagcauuuuacucacagcagaacuucuuucaaaauuagagucaauccucucaaacccugccaccgcuuuauguaauauucuaaagccuuuacugucauuucaaccauguucauucacagcaucuucaccagaaguagauuccaucucaagaaaccacucucuuugcucauccguaagaagcaaguccucaugaguucaaguuuuaucaugagauugcugcaauucaaucacaucuucaggcuccacuucuaauucuaguucuuuugauguuuucaccacaucugcaucuacuuccucuucugaaaucuugaaccccucccaggucauccaugaagacuggaaucagcuucuuccaaauuucuauuaauauugcuauuaugaccuccucccaugaaccacaaauuucuuaauggcaucuacaaugcuaaauccuuucuugaagauuuuuaauuuuacuuugcccagauccaucagaggaaucacuauggcaacuugggccuuaauaaaauauauuucuuaaauaauaagacuugaaagucaaaauuauuucuugacccaugggcugcagaacagauguuguguuagcagacaagaaaacaccacuaaucugcuuguacaucuccaucaaagcucuugugugaggagguacauuaucauugagcaguuuaauauuuugaaucuuucauccugagcaguaggucucaacugugggcuuaaaauauucaguaagccaugcuguaaacagaugugcugucgcucaggcuuuguuguuccauuuacagagcacagauagaguugauuuagcauacuucuuaagggcacuagaauuuucugaaugguccaugagcauuggcuucaacuucaagccaccagcugcauuaccccccuaauaagagaaucacaaccuguucuuugaagcuuggcauuaacuucuccucucuagcuaugaaaguccuagauggcaucuucuuccaauagaaugccacuucaucuacauugaaaaucuguuguuuaguguggccaccuucaucaauggucuuaucuacaucuucuggauaacuugcugcuccuucacuuuguacuuucauguuauggagauggcuucuuuccuuacaccucaugaaccaacaaccucugcuaguuucaaacuuuucuucugcagcuuccucaccucccucaaccuucacagaauuuaagaguuacggccuugcucugaacauggcuuuggcuuaaaggaauguugugacuguuuugaucuucuauacaaaccacuaaaacuuucuccagaucagcaauaaggcuguuuugcuuucuuauaauuuguguucacuggaauggcauuuuuaauuuccuucaagaacuuucccuuugcauucacaacuuggcugacuggcauaagaggccuagcuuuuggacaaucugggcuuuauacaugccuuccucacuaagcugaaucauuucuagccuuugauuuacagugagugagaucagauggugugacucuuccuuuuauuugaacauguagaagccauuguggggguuuuaauggccuaaucucaauauuguuuugucucagggauagggaacccugaagagggggagacagauggggaauggcagguugguggagcagugagaacaaacauuuaucaguuaaguuugcagucuuauauggguauuagaauuuuuuuuaauaaaaagcuccucaagugagucuaauuccacucucuaaaacucaucccuugagaaaggcugaauaacaauccacauauaccuccaaggcagagagaccuugcucacccaucucaaaacugcccccacucaccuaccuagucaguaccugaaauguaaauauuauuuggggcugggcaugguggcucacaccuguaauccuagcacuuugggaggucaagguaggcauauggcuugagcccaggaguucaagaccagccugggcaacauggagaaauucuaucuccacaaaaaaugcaaaaaaaaaaaaaaaaaaaaaaaaaaaaaaaagccagaugcaguggcacgugucuauaguccuagcuauucaggaggcugagguaggaggaucaccugagcccggguagguugaggcugcagugagcugugauugugccacugcacuccagccaggggggcaaagugagaccccaucucaaacaaacauuauauauauauuuggauauuauuuggaugaaucuacagagacaauaagauuucuuguccugcuauuaaucagcccaauaaccaagcacauaaauuccccuuuccugaaggcaaccgaauaagcgaguaguuaucccuccagucuaaugguccgacucuucuaggaagcuucggauguuaugauucacuagguaugaagcgcagcuuggcaaucuauuaaagcagucaugguacuggagccagguuugggaacaccugaacuacuuucauguguaagauucuuuucaguucuacuauucuaagaaaauaagguaacuauguuauuccagguagauucugauuuaacaagaggaagaugaagucccagaauauucuuaacaaguaucuuauaugacaggcaaguaugagaaacacuauguuagugguacuuuuggucauuaacaccaaauaauaaaaggcaauucauuagauauuuaugaaaggaugucuaaaaaacacaacuguaaucuuacggauaaaaagccaguugguucugggaucaaauuuuaagucaucauuguuuuucagaaagaaaaacagaagcaagaguuaagagaauaaggaaugucaaccucaccuugcaauuuccuggaauuuuccucccccgcuuuccccuuuaguauguaaguauuuccucugcgcgcgcgcacacacacacacacacacacacacacacagccaacuucacaauggaguuuugaaaagauuacugcuccauaugccaacaggcaagucagggacucaguggaaaggacacuauuccagagcacagccuucucccagccagaucacaccagcuucagcuguuccagcucugcagagaaaggguaaucacuucuuaucaaacauugauaacaccuaaaauuccuuuacaguucugacuucaggguggaagugcaauucguauuugcccugaagacaugaaaaguggaaugcgcuuucaugagaugaaagcuucugcggaaauaauugauucaggugagcccuacucagguuaaucucaaaagaaagaagcaagaaaccucauccaggaaaguggacccagcagcugcccauuuucaaggguuguauacaaaagcuaaacgacaagauguccagauggaugaaaaacccuauccuagcuagucugugccagcaagacuuaaaaaacaaacggugucuuuugggucuguuugauuuaguacguaaguuuaacuaguuccauguuugagaccaauccagagaggggcuacuuaaaaacuggcucagcccaaaucauuguguguucaagugacugaccugugaacucccuccucauuucccauauauggccaauucuccauauauggauucaucuaccuguuuccccuaacuucaaggcugcugccaugacacaaaggucuugaaagaaugugggaaagcccucaggcuaaaacucuggaucacaauccauaaaauagugaaaccaauugagaggauuguggcuagcauuucuguaaauaauaacaaaacagucuuacauaaauggcuaagcacaguacuauuuuguaaaacucuucuaucauugugugcauaugugcacugagucauacuguaaaauggauuucucacuaugcaucaagaugggaagaaacugagaaagccacagaaacagaaggaaacauacuacuuccuacaggauaugcuuucucucucuaagaagggcuuaauaacaaaagcccaauaaaaugguggcacagucccauccccggguuuccagggagaccccaaucccaucaagaacaccuacuccucacaggcaacagaggcacccccuugugaagcuguucagcagccugcacagaagauaugacucuugcagucuggaauaaaaggcaccaaaugggaaauaguguguagggauaaaagguaccaaaugggaaauaguguguaguaucaguuuugacaauuuuuguaaccaaguaacuuuugagcaaguuacucauuucucauuugcuuaucaacagaaugaucauggaaugcuaaaccucuacagggugcaaucuuaaggaaauguuacuacuuaaaccuuuuaccugcacaagacugccccucugucuuuccucucugauggguacggaaguuacugacaugcaaagucagcacaagggaaccguggcucaggcaaacgaggaaaaaugaauuuagauuauguuuacagccaaggaaaggagacacguugaacaauccucuacuggaaacauugcuaaaguguuuuuaaacugaagauuauaccaccacuuaagauauuuuuugucugcuauuuuacccagcauauuacaaaacugcaucuaggacugaaauagcagauugccucaagagcaaaugacaauauuuguaccagaaauguuggcaaccagcagcacagauggguuucugcacagcaaucuucaaacugggacuccaagaauaacuccaccuacugcaccaauguuaaauugcugaauccaaagucagaagggcucauuauuccauauuuuuccaccaccuucuucccaaaggcacguguaccugccugaccuccucugccugagaagggcucagaacaaaguaaaaaaaaaaaaaaaaaaagugggagugggcagggcggagcaggagaccacaauaagaagcaaauacgaacagauagugaaagauugauuauccgugaaaggaaggaaaacaaaaaugacuggaaaguccagauaagccaaacagcuauuuacaugacuaguuuuaaacuuccccuucaaauacaaauaagaaaaaauaaagauuuaucuuaauuucaucuccucuccaaggcuggguacccuugcuugaggagucaaauaaaaacuuauuuuugcuaaaagacucaaggacagagagagaagcugccauuaaccauguugauuacuaggauggccccaaagacaguccaucuauaccuaaagcacggcucaagugcuuggagaaaaucuuuguugcuucuuccacaucugcucuuccugccugccaacugagaugcacuguucucccuccauuccucugcauuucuaccgaauggucuggaaagccaaaugaaacggaagucuucacuuaaugagacauuaauuaugaaguccauccaacuaaagugcugucuucaguguucacaguagccucuccccaccuuuuaaaagggccagaggguugauggugguaaugggucucugccucugugccacccuagguugacuuccagggguaaacuuuaaggccuuucaugugaaagagagucaaugcacuaacauuuucgggcuagaacggcacuuuucaaauugcauaacacagaguacagagcacuacugcauuaugcuccauauccucacaucugcuauggugcgggaggaagcccaggauagaaaggauucaauucaauuaacagaaccuugggaguucaggcaagcagaauccuacauuuaaauaaaugcccauuuaacccuaaagaaacugaguagaggaggauuagggagugcucaucuuccaccuuuccucuccaacaaucaagguguuccuugcucaggcucuacuuacaauucccugaacugcacagucaggaaguuugaguguaucugcacaagacuucucuagcuucauuaccaaaccuugagucaccugaauccgaacaggccaacugauguuuuaaguggaacaaaauucccugccuaccuuuucuuuuuccauuuauugggcuaaaaagguagugaaaaugugggcgguuaaacccuccauaaccaucacuaacagaagcaaacaaauguucacagaaucccaaaguccaggaacaaauuauauuuaaguuuucacccuuaaacugaguuuaagauuuugggggggacauuuacuccaagccaaaaaguuauccuaagaagaccccucacuuacaggggcugggaagcacuaugauuauuuuccuguuauccaucuaaucucaacccaccccggcagaggccccagccuaaugaacaacccucaaccaaaucuuccugaaagaauucagaaugagcaacuauggaggucuccuugguagaauaaagggccugucccucauaaagacaacauaaaaagagucaaggacacaagugauuuaaaagugucacugauugaccaggagugaugacucacuccuguaaucccagcacuuugggaggccgaggugggcagauugcuggaagucaggaguucaagaccagccuggccaacaugguaaaaccccaucucuauuaaaaaugcaaaaauuagccaggcauaguggugcaugccuguaaucccggcuacuuuggaggcugaggcacaagaaucacuugaauccagcaggcagagguugcagugagccugagaucgaacgacugcauuccagccugggcgacagagcgagacucugucuaaaaaaaaauaaauaaguaaauaaaugaaagugucacugaugccaacuguccauaagacagucaaggcagaccaucaagaaauggcugcaagaauauucuacauucaaagacaucucaaaaguaacuaucuauucacauaaacaguuuaauacaacucaauccaauucuugccaauucuaaacaagaaaagacuggcauaaaauauaaaucuucuccccaaucaaggccaacaaugaaauuaaagaaaaaaaacucucacaugaguacagucuguauuauuuauagaaacaacuuucauauccauuucaaguuacuuaaauucaaaacuugcuaauaauagaaacaguauguaagugucacuaaaaccggaaacugcugcaaaauaacagaauauuucagagucaaauucaaggaucuguguuguaaaauauuucgucuuuguuacucuaucagcauuuaauuuauaaaaagugaacauguucuacuuugguuaauuaaccacuaacauaagucaaauaaugaaugcugcugccuccuaaauuaaucagaauagauuaacagaauccuuugagcuuauuguuucagaacaaauuucaaagccaccacaguaacuuucuggaaguuaagaaagaggaaaugugcuucucaugucaacagcagagcaguuuucaggagucccauuguuucagugcagggagcucagcuguccuggacuguccugagucaagacaggaagagcugucagacuucuggggcugaucacucaagcaugacuggacaagaccagaagcagcagauguuuaaagggugaugggaaacaacuaugcaaagaaggaaacacuaguaacuugaagaguuaccaaagccucacucuguugacauaauuugcaaucaauaaauacguuuuaauaaaagucugcaaguuuguacgaugggagccucucucucccugcugcuguggccccuacccaacuccucccaauaacagcaguacuauuuuacaaccccuagagcaggucuuaaaauguaagagagauuuuaaaaccaucauuucuguccaagaaugacuauucuggcauagugacgcaaagaaaagccauucagauaaacaagaaaccuauucuccaagaacaaggaauuggauuagacuaguaauaucuaauaacaucuaagcccaaugaugcaaacaaaacaacacaacaggaauguguacuauacuaugggccaaaugccgcaaacagaaaccuucuccuugcuaagacucuucggucucuucuuacauaaagacuccaggcaauuacuguccccaaaauagcuuucuuuccaaaaugaccauuaaccaaaugccccucuugcggaguuacagaagaggauagaugucaaguguuccaucaaguggaacaagaacuaaaauauggaaccuugaaaccacaacugcugauauaccaaggaugaaucccaauaaaccagaaaacucacucaaaaguuuaguuuuccaucuccacagcauggguuaucccagcagucucaaaggcucacaccuguuucacuggcucagcuuugccgucaacgggagauguggagauaugcugcaauaucguuccaguuucaauaacauaccacgcuggacuaaugccuucuguguggcuuuuuuuuucuuuuuuaagaauaucaaaaugcuaggggcuugagagagauuuaaacauuucaccugguacaaguagcauuaggacuuucaaaaauaccaaauuguucacaucacaauguuucacuuaacgcuacacuuuacgagcuggccaucaaaauccucuucuacuucauaccuacucuccucauuuaucacuuucugguuucuaagguacuaaaguauugaaaaagaaaaacacaaugcucagguucuggaaggccucucggaggauggggccuggggacagauggaggaccccuuuauaccaaaggcaagaggacuagcagucccaaguggagagggaggacugcuucagaguucaacagagguccaucguuucugaucugcaaaucagcucagaaauaaaagagacucuuccugccaaaaaaaauacaaagcaagaaggggagcaaugagaaauccaacagggucaaacaccuugaaagggggcaagcuguagcuugcugcuacugcuaggagggcagcaguguugaguuuccuagccggguggcucccacguucuggacacggcaccaugaggaggucuaggcagaaaguagcucauagggaagaggcaaggcucacaaagagaaggaucaucagcagugcacuucagucaaaguuggugcaauugaauuuugagcagcugaagguccagagaccuccaggaauggagaaguacaaagcagccagaggcccagaacaggaaaccuggugccauacuuacugggcaggccagccagguagggcgcccaagagggaugauggaaaggacagacagcagaguggagacuagcagaugauacauucuggguggcuauaaauaagaacgcuuuagaccauaaaggccaauuguuuuauaauuuuacuagucuuguuacuuucauaaaacuauagcaaaaacuacuaaaaauauauauauuuuuugagacagagucucacucuaucgcccaggcuagagugagguggcucgaucuuggcucacugcaaccuccaccucccagguccaagcaauucucauaccucagccuccugaguagcugagauauuuuuacagcugugugccaccacgccaggcuaauuuuugcauucuuaguagagacagggucucaugauguuggucaggcuggucucgaguuccgggccucaagugauccacccgccuugaccucccaaagugcugagauuacagacgugagccaccgcacucagcccuauuagaaauuuuuuguuucuacagcuccauaaguaaauuagagcucugccaguagauuaaaugaaauaaaucacuacacuugaauucucacaaacugugacaucuguauccucacccaucaacacaaccuguauauuaccuaugcauuacucuuccaaacuggguaaaccagaaugugcaauccccaucuuauucaaucuucaugcuacucugaucuccaaucuccagcacuccgcuuacuaaauuccagacaaacuaauugaggaccuguauccugaucaugauuuaaaaaaaacaacuucaucaaaacucaggacagagaaaguugcucucagcucacuguacaauuuguuuugugaacuagaccugcaauaucuuugaaggaguuaccuuaaauuauuaaaagcaaaagacccaucuauaucucaaaguuccagaacaaagcuuuucacuuucugaauagcagcgaagcagaaaagacaacuuaaaccagaagggugcccugauuacuacauuccucccaaacauguucugaauaucuccaauucuccucuccugccucuuggaggaacacaaccagaacuacagcaucagguuaaccuugucuugaauguaagcuccugaagaucuaaauauuuugucucacacuuugucuuucugcaauacuuagcacagucaggaaaccagacuuuuaauaacuaaaacagaauuuaaauuacucccucacuuuuuccaguuucaauaaucccaaucccuauuuuccaauccuuuacacuuuauugcuucacagugauggcaggccccuauugucuucccaagaaaugguaaaggcguguacaggaggcauuucugggucucacaugaucaaacauaauuaaagguauaugguuucuaguaccaaaccaauaagcaaucacuucacagccuauauaagauaauaauuauguuuauaacaccauuaaaacaucaacuaugccucaagaauaaagggaagcauuuuguuuugggggcuuuuuuguuuuguuuuguuucugagacagggucucacucugucacccacauuggagugcaguggcgugaucauugcuuacugcagccucaaacucccaggcucaggugauggccccaccucagccucccgaauagcugggaccauaggcacaugucaccacgccuggcuaauuuuuguugguuuuuuuuauagagacagggucucccuauguugcccaggcuggucucgaacuccugggaucaagugauccgcccacaauggccucacaaagugcuagaauuacaggcaugagccaccguguccagccuaaggaaauauuuuggaauuagacuauuuaaaaucuaagacucaaaggggagaaguauugaaccucacaucauccugccacuggaaaacaguucacuuccaggguuucaagcaccaauuuacaaucauuccaggaugucacugucuucuuccuagguaaucuaaaacugcagcaaagaaaaguucuuaccacuguagacugugcuuuaaaaauauuucaaguucacacuucaacuaugguaaaauguaaguaauacauauuacuuacuuaauaccuauuacuuacuaaacauaccaaccuauggcuuaguucuauuuauaccaaagguaaagggaaaaaaaauaguuuuauuguuugcuauuuuuucaaaugggaguuaauuacguaaagaauccucuggcuugcaguaaaucuaccccaauauaauguaacaaaaaaaucaggacuuuggauccuucucugacauccuucugugcuccuuaaauagauauuucauuggcuuucaagugcucaacuuuuggcucugagauaauuugcauuuaguuaagacauuuuaagccacccugucaccauuauagagaacugccuaaugagguccccuuagacgaggucugauuugacaaccacccacaauuuuaagacuaaauuuaauacuaaaaugauccaagguuuucuaauuucucugaauuugaaaggauuuggugaaugccauucccuaaagauggggcaguggggaggucauauuucauuaaggaauaucuucaguuugaaacacuuccaagucaacuauauaauuaucaagugaacagaaaaucagauaaacucacaauuucaccucugacuccuugaacacagcaucucccuccuugaaaaguuaauggauagugaacaaaaagacccaccugaucacuucuaugcucuucuggaguuuaagggggccaaugggggcagcgggagccaagcaaaagucagccaggauggaggaagaacugaagagcaggaaggagucgcaggugcucaagagcuggccagagaaugcaaagcgcuggaaucuaaccccuucauuucaggguuaaggaaacugaggcccagggagacaaaguuauuugcccagucacaaggccaggaagugaugggaaacaggcccagguuaccuaaaucuaguuacugaaagagcagaaugcauggacauuaauuaacaaaaacaaacguucaaccugccacaguggggagcaccuuucugugcguucaccucacacuuuucuccaauaaagagcacaagaugaaggcaggggagaaggcgucagggagcgaggguucuggauaauacacacgggcuucucuccuccaugccaucuacaggagauucuguuuuagagacagggucuugcucugacacccaggcuggaaugcagugguacaaucauggcucacuugcagcuuccaacuccuaggcucaagcuauccucuugccucagccucccaaguagcuaggacuacaggugcaagccaccaagccagcuaauuucuuuuauuuuuucuagagacaaggucucacuauguugcccagacuagucucaaacuucugggcucaagcgacccuccuacuuugaccucccaaagugcugagauuauagguaugagccaccgcaccagcauacaguagacuuuauauaugcuuauuugguuuugauuuuuauacuuuuaugagaacuaagauggaaucuaucccuccuuuucccucacaaaaggaacauccuaauagcuucacauugcaaaugaaauacaacguaaacagaaaaaacugagauggagcgauuaggagguuuaauaagucagacuuugcuagaaaugcaaaacagcccugaugcuaaacagguacacuuggacuuuuguucucuaaagccuagcuuuaaaagagcuugacacacuuuguaaagaauaaagccuccauucuauaagccuaaccaguaaguuggagggggacugaguaccauaaaaaucagugcuucucauacuugaacauacaagggaucaucagggaucuaucuauccugucaaaacgcagauccucguucaguauugucugggggugggccugagauuuccuggugauacugaugucaaugguccaugcuacaauuuuaucuaaacugacacaugauaauuaaacauaauuauggaguacugaguaacacuaugauacauguauacaguguauaaugaucaaaucaggguaaaacggggcaggggugguaauauuucauaaaggggcauauucuguuagaagggccacuaagacaacuauaaaauuaucaagugaacaguaacagaaauucaaauaaauucacaauuuccucugauuccuugaacacagaaucuccauccuugaacgguuaacaaaaugacccacccugaucacuucuaugcucuucugagcauaucaccucaaacauuugucauuucucugugggccauaaaauacaggagguauuuuaugaccacauuucaaaguauguuuauuucacaauuuggacugcuggcuacaaacagugacaugugagucucuuucccucugguuagucguaggcccuguagaaaugucagcuaauuuuuuuuuuuuuuuuuuuugcgggaaggagguaggagucaaguccaauaaauaaguguaaaaacauucaguacauggcaugguuauuuaauacaacagaauuugcucugaguuggaaggacagggguuucagccuauguguuuaugauacaacaaagggacuuuuaggcugauaaaguuauggaacaugagacuucagucuucuuauuaaauggccaaauggaccaaguguuugcaugaaagcuaaucuuuccuuucaugaaaaggaaauuaaacccacuugcucccgaaugggaugauuuucaggaguccugagccauguucuggcagaaagcuggggucugugaccauaaagcaggacugcugucauccaggcagauaauuauuaucaggaacgccuaacauugcuucuuucugcaguuucaugugccuuggugaagauguaagcuuucugaagacuaccuugcauacagccuuugugggcuacuccauauaugagaaaugaaauuuuaaaacuagcuuuaggaagagauguagcuuuggagauccugacucaaaucccugccaguuauuaguuacaugaucuugggcaaauuacuuaagcuuucucuuucucaacuauaaaaggaggacaacagauaccuagugagguuccagugagauccuguacuugugcccagccagugagcaucuaggguuaggauuaucacugucaccaucagggccauccuucugcaacugucuuacuguacuaaauauacacgucacuaagcacgcucuguucucaaugaaaacggaaguuccaugccagcaacaucuaauuuucaaacaucacugauaacucuugauuucugcauacacaucuaagcacuguaguauacugaaaagaaagaccguaaaucauaugcacaaccauucucuccacuguccccagugccaucucaucacugauccucccccgccuuccuaccaccuccucucauccucauucugucaaaagacagcaagguacccuaccccaaaggggaggaagacagcgccuaaauccucauuccaccucccuacaucaagaagaauguguccuucaugagccagcagcaacuuaucuccccaagcauggucuaauaagaauggacugcucuuuugcugucaguuuaguauugaucacacgggggagccuauuuacuaaaagcaaaaaacuacaaaaccgcuguuuacagacaguuacacgugauuaaugcuuuaauaucuagucuuuccuuauacauucucaaucaaucaccaccauaaccccagaauguauuaggacuauuauaauuauuauuaccacagauaaagacaaaggcuauuggaguuuguugccagagaugaguuccuggucacccagccuuggagccuguucucuuauuuucuaaggcagacaucuucccaauaagaggguagugggaacacaaaaacaucuuuauuaucagaaucaccuauguaauucaacuacacacauuucugacagagcccaaggcccuuuuuuaucaguccgagcugcaucccuaacugugaucaggaccuguaaaggacagcccaccaccuggaggcccuuagucauggcuucaacaagguccugugccaaaaugguaaauggcaaugcugagucaagguuggagccuaaacccuacaucuucccccggugaaggguccugcccuagaaagaacuuuccccuaagucucuucugccaauucagggcagaaaguaauggucagccuuggaacgcugcugacucgcacccugggagcuucuaaggggcccuguucaccagggugaaggcgccucucucucacugcccacacacccuucuccagcucaaagggccuuuucaaagggauuagaggugugcuucaaaaucuucauuaaguaauuuaauaauguguguguccaguacuucaguccccaaacagaaaggaaugugcccaggagccggcaggcagagccacauucuuccuguuaaccuguuaugguggcgggcggugcucgggccaaguccucagaggcuuucccagccucagagaaucgggcucucguuuucaauuuccaacuuggacuuuucucaguuucaaaucauaggcuaacagagguugaagacugacagggaauaaaauccucuaccaagucaagacugugauaggcaaaacggaacaagcgaaugaaagaggccccaguucagaggagggaaauggaaaucuacucaugguuaagugagcagacagaacaccggcgaaacuggcucuucagguggaauauggcacaggguagcaacuuugucaaguaugaugcauuaaauacaguaacaaaugggcaggaugguaguuuuuaguucaguuuuuggggcuuuucuguugauguuguuacuguuucuuuaaagaaggggcauucacacaaauaaauuucuuucccuaaaauucugauugaauucaugaccauuucugauauauuauuugcaagagggaacaaaaacaaacgaaugaacaaaaacaaacuaaugaaaucaaccagucuuuuccacuagcacaaaaaaaaaaucacacaacaucaaaacuuuaaaacacaaguugauacuuucuugaauagauucuuucaggaauauuuacauauaugugguucacaaggucacuacccacccaaauuuguggggugguuuuuaugagcuaaguucuuguuuugcccuuccuaaugucccaucucugaaccugaauacacccccagcucugcucuacucccagugugguucugaggccagcagcacuggcaucacuaggagcugguuacaaaugcaggaccuugggcuucagcccagaccuacuaaaucagaacugacaagauccccaggugauuaauauauacacugaaguuugccaucucgcaaaaugguuuauuauuucauuuucacagcucaauuaagaaagucuuccuuagucauaugucuuccuacuaaguaccauuuauggaugcuucucugguaacuagaugacuugggaaaauaaaucuuguuuguuguaugaaacacuuuuaagauaaaguucuuuuugauauguacaauguuuugggggaagggagaauugcuuauuccauuaagagcuuucuacaacacacccuacugccauuauuucuauugaucaaaaauuuacacuauaaacaagaaaaaaaaaaaacaaguauauccacauuaaaccaaagauaccaacugaacaaaacauggcaauaaaagucaagugaaaaacacgcugaaaaaaaaaaaaagcuuccaaggucuguuugcagaguuagucuugucagggaagaauuuaucuacuauacaauucagaaugagagcgacugcuucugucuaaaagagaugggauuucccccacaugccaggccuugcccucagcauuuuauauacuacacuauauaauuuaagccucaccacagccuuacacgauuggcacuguuuuacugaggucuaauuuacacacagccaaaggcucaaaugggcuguguacagcuggacgaaguuuuguacguggacccugugaaaccaccacucacagguacugucacuuacuagcacuuauguucguuuuguuuauugaaauuuauacaaauggaaucguguggcaugugucuuugugagccuggcuuuuuucauugagugguucuagauaggguggguacggaaaagggaugcccugcuaggagcacagaaaaguguaaaauaccucaaagggagggagugccccuccuccggccucggaggggugguagaggaaucuguaggaaaggaagcuggaaagaugggccuuucagauggugaguggucuugaugcccagcaaaaggauuuagauuuuauccucaaaguagcagagugucugaagaugcuucaggaggugaaauguuauaauuaaagugaugugucaucuugcccacagcagagugaaggaggaaacuggaggcagcaagccgaugaaaagaccaguguagugacccaaguaugaaaugaugaaaugguuccagccaaccaggggaagagaaagaggaaaacuccaagaagcuucaacuccaugcucuacuguggaggcaacagaguugaacuggaguuuuucccacugacccagcgcugaaaacuauccucaccuaaaaaauuaugguaagugcuauucaaaaccugaugacuucaggaggagaaacccauuucaaagaggaagacaaguucaaggcaacagccagccaacugguccccacugaguugacaaauuagaccaaagcucaggagaaaagauggagagaaauggacacgagaggugaagaacaagauagcuggaauuaaaucggccuccagaaaccaucugugugugugucaaggugacaggcugaaccagucagaaggcaucaccacggaagugcacaggggcuuuaccuuggggggcacucacauagauuaguaaaaggagucugcaacaugacaggaagagcguaggaguaugauaaaaaucaaagacuguagcauuagcaacaauuccugccaauuaggcauccaaaauuuaaagacgcccuuucucaacuccaacuacugcaaaugcugagucagauucucccaaaaaacacaauauuucagaagcuucauuaacuccuuccagcaucuucaaaguauuacuuugcaaauuacugucuggguaugcuaaacuuaguaaauuacuguuuggguagacuaaauaguaguucaguacucugaaagaguuaauggagcuuccaaacugucuaauuuaguccuaaggugauuuugauagucaagacucuaacucgauuugcauauuaccaauuagaauuucaaggcaauccaauaaacugggcauucaaaauuuauguccaaauuggaucuaacagacuuuuauuuagacuuccuaaucaucauaaaucuuagaugauuacaaccaaucaacaggggucuuuccucaagcaaucuacuacaaauuaaagcuaaaaagugauggaaaaacauaaaaccugagaucaggguuugcaguuaauguauguuuggaaacaugagucugggcuaugacuggucugucgaaaaccaucccacagccacagauuauuauaccucaaugccccccaccacccguuuucucuucuuugcagccaucuucccuuucaucagacuacaguaacuucugccacaugacaaauuuguucauuaaagcccagucuuugaaggauauuaaaugagaauuccuaagaugaggcacguaucucuucucuaaauaaaaacaauaaauaacauaaaaacaagaauuuaacuuuggacuuaaaggugauuuuuaugugcucaagucacuuuccaguuaugcuguuaauaguauuuuacauuauucacugacugaacuuuguuaaucaaaaacaagcuggcaagcuuuauacauacauuaaccaguggcuucaaaaagauaacgcauagaaaacaaaguggaagcacugcuaaaacagaagcagucauuuuguuuaauuaaaacaauauggcugacucuucccuauuuuucaaauuuucucuaauauuuuuaaauuauacauacagauuuaaacacguauuuguucucaauccccaagcaaaccugaauaaaucuucugaauuguccaauauacuaaauauugauccugcaauauaauacuuuaaaaaauuucuguuaaaauucucagugauuaaauggguuuuuuggucacauuggcaccuuuuuagacacguuucuaaaagauguuguucuugcuuuguuauucuuuugaaaaauauagagcaauaccuaagcaucuuuguacuaguacuguuuuaccacuaaugucuugauuugauaaauacuuugaaauggaaauaucaccaaagaucccaguucagaccuauuaauuuuaaaaaauagaauuguaucuacauuuucaaauguuugcauuuuaaaaauacaguaacuagaacucucuagagagguacuauguuaucaauaauaaugaaauuacauaugcauagcuuucagagccaagaggcacuagcugaaacuacaugacauagaaagauucauguaaaccuuagucccaucacuaaagcaaaagacaagcauucugguuuucucaauuuauuaauauuuugaguuccaucacaguaguuuuuuacuaacuacaaauuaaguagccaaucuaugccuuaauugcaggaauaauaugcuuaauaugcuuucccccucccucacuuucugaagaugaaucugagcaaaagaaauguagcaagaacaaccaugugacagugaaucuaaacauguucuauggcauuuaaauuagucauuugcaagaaacuaagccggcuauccacagagaaauuuucaaaaggaauagguauaugagauaacuaaaagcuuucaaagaaaauguuuaaagucuuuucucuuuuuccccagucucacuuuugaggacaagaaaauuuuaaaauucaaagcauaaaacucauuaauaccgaucccuuaggggauuaaauguggagggugggggaagauacauaaucaauguacccgaaaaaaagaaagaaauucacauaaacaauguaaaagauuauuucaaacaugaagggggagagauuuaucuucaccugcuaauacagcuuaaugcucguguuuuucuacccaaggucauuuacauuuuuuaaaaugguuguuuuaauuucauuccaacacaaugcauucuaucuagauggcaugauuuacaaaacccugauacagcaccuuucaacacuaccugccaaucauuuaaggcuuuuccaggauuugugucagagauuuagguauagguuagcagcaaauccuucuuaguugacacaugugaagauggucccaaaugcaaaacaaaacaaaacauacuaccaagcucaccuaccugguaagucuucugcaaguuacacuaccauaaaauuaguagaguucaaggucccaauccagaggcaacuucauguaggaugagugauggauggaugggaaugaacaccacacaugcucugcucauacacucacucccuacgucacuccacaacuaggccacuaaugcagaucucaaucugacagagccauuuccucaguuacaauucagggggcugccaaugguccuucaggucucucccagcuuacgaugccuguaccguguauuuccauuuuaggcuucucucaggacaugcuuaagauaaaucuuauuuuauuacaggguaaugaggagaaacaauauguauccuaaagaaaguagguuagcuauggcuuuuggcagucaaugcucuuaaugcugcuauuagguggaaagguguuauccaaucucaauccaauccaaaccagauggagacccuaguuggcagaugaauccaaaaaaaaaaaaaaaaaaaaagguugaguuaaagcacaggauuuuaaauauauacauauauuauaaauaaaaaguauguauaccuuauauaugugugugugucuguacauguguguguguacauauauauguauuccuuaaacauuugccuuaaaaauauacaggaaacugugcuugagguacagcaaaccuuugaaccaagauacucuggcuaggcuuccauucuuucuuauaaacccuaaacccacaguauauugucaccacagauuuacaauuuggguuucuuucaaguguaagaggaauccaacugaaccccuuucauaucaauccaacuacagaguucuucaugguuuccccuaaucuuacagggucugacugcaacuaauuuaucagcagcuuaagucuuucaagggguucaacuuaguuuuuccuaaagauaauuauuuucacauucauauuuaauaacuaacuuuuucuuaggaaaacaauuacuacugcacaaacacaucugaaaaagcacaacugaguuucaagaaaacuauaacucaacuacuguacuagagcuuagcuuuagcagucagagugccauauacaaucaugaaguguguuuugucaagggaauuaagaacugggguugauguggugugcuggggaagcaaagaucaggugagaaagcuggagcagaugauggugucgccacagaaauuuaucccgaacaauuaugugccaaaauggggcaaagacugggaaaacuacagaguggcuuuuuaacugugugauuuauauugaaugugacagaauuagccuaaauuuugcaauuuccacuaaggaaaaaaaaaaaagaagacaagacaugccaccuagaagcacuauuaacacuuuaaaugugugucacuuguucuuacaagucaaucuuuugaaaaaucuagauagugauacuguauauguaugugcauguaccuacauguuauuuaaagcauacauaugacugagugcacucaacuaucucauaauuagucuggugucagaucuuuuuuuuuuuuuaucauucuugccucuggaauaaaccauaugaucuguaugugguucucuugguagguuuaucuucccaugugcuauuuacacuuauauuagaauggauucauaugcauucagcccagaaucauauuggcaucaggcaaggacaccuagcuaccagcaucuaugaccaggcagacacauacacauaaucuauacuacagagaacuaacugaaaggugaugcuacuucaucacaagccuuucucggcuggaagcuuucuucuuuaaacaugccaugacaacaggagucuaaaccagacaacucuauauuuuuuuaccuauuuguaaauauuacugucaucccuaaaaagucuuauguauaagaaucacacacuagauuaagauguuauuuuuuucuagacagaggccaaaaguguauucauuuaacauuauagacaguaaaacagcuauauguuaacauccuuucuaaaauucaauugguuccuauuagacacaaacccuuuccucuaguucccagccucaggaaugcagauuuugcuaugaauaauaauuuguuaaacgcuauagaaaccuggaaucuuuguuuccagaauuuaaaaacugguacauauuugauuuacugauuuacuaaaaauaaaauaaaauuagugauguucuuuaucauuuacuuuuaaaaaccugaauauaucauauauauguauauguugauauauauaaaauacauauaaauauauauuuuuagucaauggucauccaauccucauuuuuagucaccaaaaccacacacugcgugggcaacucuauaauaaaacacaguuacuaacaaauguuuauagaaguaaauaaauagaaaaauaaaauucuuaaaauucacugcucgaccauaucauuuuuuuuccugaucaaggaaaauuccaggauauuuugagagaauuccagaguaccuggagaugcucuguuacaacacuaagcaccccagcgcucacaguuggugcuuaaaacuuuaaccuaacaguauuaccgucagcauuacacacacacauuuccuacucgauagcucccuacucucaaaaagaaaugauggggacauggcucccaauucuccagccuuaacuccaaucacacgaauccaaccacacuguacuucucaauuccuccccuuuguccaggcugcuccucccccugaaucuccucucaaucuggcccaaaaauacagccucagccuguugaaauucuaccuaaacuacagugcucaucauaggcgugcacucuguuuuuuccugguuccaacccaauggugaccuuuucuagccccuaaacccccaagguacucccuuuuccaccucucuagucaguugccagcaguacguaugaaucaguagcuacguaagcccugaaccugcuuggagguguggaaaacuagugugugaaagaaggccacaaauuauaccaguaaugcugcugacacuaaccacuaagagauaccucuuaucagcugacaaguauugaaaaguaguagguaugagccuaauaaucuagaaaacguacaucgaccaaguaauaaugcaaauaucaacuaaucugggaugacaaaaaaaaaauuauaacaauaauguaguggaauuuacugaaaggcuuguucuacuuaaccaaaauacuguagaauaacaauuuuuccaaauguuaucuagcaagauaaagcaaauguaaaaauugaagcucaaaauaaccuccaccacuuuagugaccaaggugguuuuaaaccuaucaaguugacaguuuuccaaacugaguuucuaucacucuucaacacagacuacaccauaucucucucaucacccagagcuauauagccuaaaacggacuacuucagggaccagcaacaugguugguugguuucuuucuuucuuuuucuuucuuucuucuuuucuuuagagauggagucucacucugucacccaggcuggagugcaguggcgcaaucuuagcucacugcaaccucugccuccuagauucaagugauucuccugucucagccuccugaguagcugggauuacaggcacgugccaccaccacaccuggcuaauuuuuguauuuuuaguagagaugggguuucaccauguuggccaggcuggccucaaacuccugaccucaagugauccgcccgccucggccucccaaaaugccaggauuccagguguaagccaccgcgcccggccaugaaaaggggguuuuaagugacagcacagcauguuauuuucuaugguggggcugggggagaggcagggugccaaaagcgacugaggagggcuguaagagugauuguccauacuagacacuacuugccagaugucagcccaucucaugccccucugcugucccuccauccuccccaagucauagugcagccugcaggucccugcaacucccacauccaacuuccucauugccauuccuaucucaucacaucccugacccugcuuuaaauuccucaguaacuuccuuuuucuaucagguaaagaccaaagucauaucaugcaaugcucucagaucuaacccugucugccucugaagcuuugucucacuuugccuuucccuucagacuuuguaguuaggcccccaaaaaauauugugccacuucacccuucccagaaagcucucuauaagcccgcacaucugcccaacuucuccccacuccucaaucaagaccagacccagguuucuuccaagugagaucucccuaugucucccacguggcucuucuaugccuugguugggccucugguacagaaggcacagugcaauucuguuuacacaucugucuuccagacaaaaaccggagggcguugcaaccaugcuuccucgugcuacacccggagcgccuagcaaaaugcuggggacacagcaucaaaugucuaugucaaucuugcuuggaugaacacucccaauccucugaagcagaaagcuguccauccuaggcaauaaauauaagcaccagaaaaacaucauucuucuuggauacacuuucaggcuagggaauuguuccccuacuaauuucccacuugggguuucuuccuucaaccauuuguuccuagagugcuuuacuauaagucaggcacuguacuagaugggugggagggagggagggaaauaaaguuaucagggagcuuaaagccuauaggggagauucuauaaccccaaacacagcauucgacagucauuacuccacacuauuuaguauuguacacauagguaauacaucucuauacacucaauguuuuuacuuaaccccauuugccuacuaaagucauucuguugccuugagccuacaccaacacaaaggugagaauggaggugccaauaaaugaaaccuguuaucuacagauaagaaaucaaaccucaauucuagugguagaaagaacuaaggagacgggcuagcccaguaucuucauuuuacagaacaaggggcccaugacagaaacagguuacaugaauugccugggguucccccaauugguacacugcugaaacagauuuugaacccagaucucuuaagucuuaccucaauucacguacccucuuucuugucccuuacccagcuguuaguaacaugucucucaugguguguuacauucgguccaacauccauaugaaaaacugaacuaguguuucuuggggcagaggaaaugacaaaagccaaaggcaauaagacaccaccauauaaucucauaaccaaaagcuacccucagcugcuaacauuuuuagcauuugugguaggacagaauuauuggucccaauucuucacucccugguaauuguauuucuauggccucuugucgguaaaguacacuuuucuccuucuugauucaagagaugcuauggcuaaugggaugcuagggaaucugaugcuggcagagacuugaaacauacucauacagucaggcuugcccucuugcacaugacacuaccaugagaagaacuuacccuagucgcucaccuuccagccaaggccucaaagugagacacauggaguaggcugcugcagggaaucucauacaugugagcaagaaauaaauacauacaguugcaugccacugagacuuuugggguuauuuguuauggagcaaaagcuaacugauacaauguguuauccuucaagucaaaaaugcauauuucuccuugucugucacuaauguaaccccucagaguauuagcuuguuguuaaaguagcaaucaccuuauucuuuuucuauuuuacauuuuauugauuucuccaggcuaucuuuuuuucagauucucuucagaaaagaacauugucuacaaauugaagugucaucuccaaggcuuuuccugauucuuaagguagguauuauauaagaggguggcaacaaauguuauccuuucagugucacgucacaaaaugccuccuuuuuccuucaaagcaguaaaguaagauuugucaugaucaugguuaauuuauuaaagauaauuuucagcucauaugauggauccuagagauaggugggaaggggguacguguaucuucacugcagguacuaaagauuuuuaaaagcuguuuuaaaaccuucagcugaaauaaauguuaaaauacaaugacuuuugguauuuuuaaugggccuccaaaucaggguaacuuuaaacaaugacauucaauguaaauguccuucaauugugccauuuucccauuccagcacacagcucaaugucauuaaaacuacucaaauuuaauuaauuaucguuaucauuuguaauuuuugaagcucaguagaccugaaauaaaauuacguuuggaugacaaaacauauuaugcaauaaagucaucuggaggguagaauaccaaacugggagccuacugcuucuuuuuucuucugcuugccaugacaagguuaauuuguuugcuuucuuuauucuuccuucuguuuuacaaaggagaggcauacacuuacuuuggaaaggauguaauuuuuuauaucagucuacacuguauuaauaugccuagaauguguauagaauuaugcaugaguauuuguaaauguaagucuguuuacucaaaaccauagaaaauacagguuucagugcauccuucuuuugaugucaaaggaguaugugauuuucucaggaaaaugaaggcuaauuucuucaauucuggacuguagauaauuaggauugacuauaaaaacaagaguuaaacaugucuuccuauuuuugaaccaaggccaguagaauagcacugucuucaaggaaaacuuuauuugcauauauucaaacucacgccuaaagaaauucuucagggugggggggaaaaaaauuccucaaggcccaggauuuuaaccuggagcccauggacagaacucaagggauucaugaccuuggauaggaaaaaacacauuuuuaugagccgcucauuaaaauucagcauuuuuuccaauuacgaauguaggcaacacaucacaguauuggcaguaccugugacuuugacaccaauagaaaucggaugccuucacauuacaguugcugucaaaaacucaaaauauuguuuauucaucuccaccucaaaauuauggugacccgccacuaaauauuauuuaauguauugauaaagaagcacaucuauuacccuacgacaauuuucacaacuguauucgacguaacugcuuuccuuugcaaucacauguaauuuaauauuauguacccugcgacacugaggacacgcugcauccaccugccacacccucacuccucagcugcccguuuuuauuaacuaaggacauccggggugcuuuuuguggaagcaugagcauacuguacugagggaagggagaggagauaacaaccuauuuauauaugucuauaacagugaaauuuuaaaaaaugguaauuaugaugaggcaucugucuauuuggcaccaucuaaaaccagcaagcaauaauuguacaacaaggggguguuuagugugugagguuuaggacauugugccagaaaaccuaaagcauccaaguuguaaaacauuguaauaagcagguaauccuaggcccagcguccaaguuucugcccuaaccuguuccuuaugauuaugauuuuaaaacaucccagugucagcagguucacugugagucagaccugaaauaauaaauggcuuauuuuccauccugauggaggaaauacaucauggcucauuguggcucacuuaacugaggcuguuuuuacaggaaaauauaaaaauaacuaagucauucugccuuaccauuuuuauuuuaaauuuuuuuauuaacaaagcucuauacuacaauccauuuuaaaaagaaaaagcauguuucaauauaggcuauaaaaacaauagcucacaaauaucuagaaggaaaaauaauauaaacucagaaaauuaugcuuguaaccaacgaauacccugcuuugccaggauaaccaauuaaaugcauucacuacaucaagauaaacugcugcuuauuuaaauggucaaccacaugguaaugcuguuaaaagacagccaaaaucuucuaccaguauucauuaagguugccaggccuuaaaaaccacauguaucuauacacauacaucuacauaaauuccagaaugcaaagucuuacuuguugcaaacucucaacugaacgugaggagaaaaguuguaucuucaucaaaaauaaaugcuuauucaguggcaucaauacugcacauaggcuguaaaacucaucgugacugaggauaaaaugagugagcaauauauucucagaacaaugaguuuuguucuacccuguuacauaaacaaguucuaugugaccucacggcuuuuagauaugauuuaugacaccaugucagaaugcaaucuuauuuguuacccaaaacugugcuagagugcuaccccuaugguggguucagacauuauuuaaaacaaacaaacaaauaaacaaacuuaagacagcaccacuguaaccaauacaagguuacuagguacacacaguguguauuucaggauaugaccaauaaauuuagaaucauauauaagguccucaguguguaauacaaauuugaagauaaaaauauucaucgcuucugcugauuucguacauuaaaacaguuacgccauaauucuaucccaucuccuugaaacagugaugcagaggggaacccugcuagagggguucacguggacuuaaaugcccauucccuccucaccugacucuucuugugccccuaaacauggauggcaugauagggaaagaacacaucuaaaacacacggaagcuguguuugggagagaggacggugcucagcacucucucacgagcccuguuauuucccuccucccaucacagcuacaguacugucaacaguaaaauguaaaaacccuaaaaccuaggcugggcacaguggcucacgccuguaaaucccagcacagugggaggccaaguugaguggaucacuugagcccaggaguucaaaacuacccugggcaacauggcaaaaccccgucucuacugaaaauacaaaaaaugagccaugugugguggugcaugccuuuagucucagccacugaggaggcugaggugggagguuuguuugagcccaggaggcggggguugagccaagaucacgccacugcacuccagcgugggagacacagugagacccugucucaauaaauaaauaaacaaacaaauaaaaauaaaaauaaaaacucuacuagagggcuagguuuugcccugccuuuuuacaggccuacugaaaacaaggucaguagacugaaagggccagcagaaaacacaaugacucaaggguuacaguuauccaucuuccauuuaucagcugucaugccauagagaccuuggaucuccccaacaaaauccaggcuuccccaccucuccuacaggguucuagaaagcucaaauggacagagcacagcaggcagacaguauaucacagacacagcuacgaagauaaagugccauguaugauggcaaaaauguuacagggucuccaugaaauuaucaggaugacaccucagguuuuuaaccuaagaaaacagaagagacuuguguguguguuacacauauguacguauacacacacgugcguucgcaagcaugccuaaggagauuucuuucaaaaagaaggcuggcccaacaauuucaguggccaagaaauuuuaucaucccaggcacaacauuucuuguuugcuugaugucaauuccauguacaguaguccuucccugagcuuucacuuuccaccuuuuugaguuaccugcaguacaacacaguaagauauuuugagagagagagaaaccacauucaucuaucuuuuauuacauuauacuguuauuauuggucuguuuuauuauuaguuauuguuguuaaucucuuacucugccuaauguauaacuaucauagguauguagguauagggaaaaacguaguauacacagggucugauacuauccaguuucaggcacucacuguggguccuggaacuaucucccuccuauaaaggaggacuacuguguaucgguuuaucuacaauuuuaauggcaacguuuuaaaagaggaaugacccacaaacuccacuuucccugcccucguauuccuuucaccagcaagacagaggugaagaauuaaacuuuaaucagccacaauuugaagaaggcuguaagaugaucuccaguauuugaaccuugaaaucuggguaaaaaagaacaccucaugccuguaaaccccaucucuccaucaggauuaucacuuggucaauaagagauagcaaagucaaaaguguccucuuuuuggaggugguguguguguuggagggcagggucucuguaagaacagcuauaaguaaaagagauauggugaaaggucacuagucugucaucucucucuuccugaggcacauaaggaugugacauaguuacaugugguuugcaagagggcuccucccuuuacaaucugcuucuccgacaccccuaaucuaaucaauuuuuauuuucaguuugguguuuaaaaaaaaaaaaguuaccacacagaaaggacuuuaagucugaaauguuaaucacaucaaagucuggaacuucaaaguugcaguucccacaccaagagcagcuccgguccccaucugcaguuugaguguuaaucuagaugguaguuucucugauuuaagaccuuguuuuauguguacagggaguguggccaagucacaggcacuacgaauuugaauuuccugacucucacuugguuuaguggaugauuacggcgucagcaugugcauuugaaacagguccccaaagaggaagcacauucaggucacuugaacaaacacaagcgugagccacaccagagcccuccagcugacugccuagcagcaguuacacggucucccaucaggacccugugaccagaacuaccaggcagcuuucauggaacugaaguuggauccucacggcugguaccauuaaauggcuuguuuuucuaagaaccugugaagagcuuuaacagacagaagaaaguaaaucagaccucuccuuaaaaagaaaaaauaaagggugaaaaaacuagcacucaacccgguauuuuaacuacuggcaguugccuuucuucuaccaugcaacacagugguuuccaaagguauuuuccagaaguucugguuccugauuucaguggcuacucuauuucaggaauaaggacaaaacucaauacagagacaaauguuggaaaagucccagggaacuaaccuggcaccagcaguucugugcaaguccacccggccaggccaggaugcaucuaaaagccaaacaguuugcugugugcuugcuucucaucgucuucgucuccucuagcagcuggaaauuuuaaagcuagauauguuuaaccaccaggaaacaugcugaccaugagcucaguccucuucagaaagucaagagcacugcagggaauaggaccucuuuucaaagugugauucugcaacacaauggcaccauauuuaauucaucugaacauucuacuuagcaagagggaccuacaggacucaaggucacuggaguugcaagcagccugaaaacauggucaaugacguuucauuuuguaaagaggaaaacuaaggaacugaggggacagcaaaucuucacguagaagauuuuguuacugagaacaacgccagcaacuuucucacagugcacaguggaagaucucuuggcccugcagagaagaaagcacaaggauagugaugcuccccuuaucugguggccagccuuccaaccccucggccucugaaacacuuagacuauuuaaacaaaugugaaccagaaagucagggcuaaaagaaaacaaugaaagccaagugcuaauccacagaacuacagagcacagagauccucucaaauccucauccagggcccgcuggauuuaaacuguguauaaaauaaggccaguuacuuaacacacuuuguuauaaaguuucuccugaaaggcucaucccuuccuaucuugaaaaccaugcugaaguagcuaggaggcaaaucaauguacacaguaagaggaagucuuugccaagcuccagaagacauggcauagguggguaugcaaaaaacccgaaguucccaaugaucacucccaucacuccaguaaggcagaaaagcacacagugaaugcagagguagauaaaaugcacauucaugcagcaaacaaccgcugagcaccuaccaccguguggguucaagauaaugaacaaaacagaggaugcuuguccuuguggagccucugcucuauggugggggagauggacaagaauacacacuggggguagguggcaacaagugcuaugagaaauaaagcagagggggccagacgcaguggcucacgccuguaacccuagcacucugggaggccgaggcaggcggaucaccugaggucaggaguuggagaccagacuggccaacauggugaaaccccaucucuacuaaaaauacaauuuaaccgggcaugggggugcgcgccuauaaucccagcuacuugggaagcugaggcagaacugcuugaacccaggagguggagguugcagugagccaagaucgcaccacugcacucugggugacagagugagacuccaucucaaauacauacauacauacauacauacauacauacauacauacauacauacagcagaagggauggugcauggcauauaccgggcaugugaggaggcugugauuaucaacaaugaggucaaggaagacugcuuugaaaaggugacaucugagugagcgaggugaggugaaggaaguagccagacagacaucuggggaagaguguuccaaagagaggcaagggauggugccaaagccccgaggcagaaggaugcauggcgugaaaggaggccaagugaccagagagacaugaaagagaggaaaaugacgucaggagggcucggcuguaauaaagagccuugcagucugcugcgagaaccucagcuuucaugcugagggagguaggcagccagggcaaguuuggagcagaggauccgucuggccuugcugaguacaggcugcaagagaagaaaggacagaaguaagaaaagcaguuaggagacagagcaaccaaccugcagagaaacuacaggggcuugaaccagacacggaaguggaagggguaagaaguaaaggaaccuggauauauuuugaagauaaagaugacagcacugcugauaaaccggaugugggauaggaagggaaaggaaaaacgccuucuuccuaaaucugaaagagcuuuaguuacuuggaauauuuacucaaaaugaaaaacaaguaucuuuagcugagacaagaauaucugggaaugauaguaaggaggauuucuuuuuaaaugaaaaaaaaaauuaaaacgcaaaaaaagaacacugcacacccuggcacacaacaaaaaauuaagucagagagcgcugcaaagggacuaauguuuaaagauguaugaaggacagagaaaaaauuugaaagacaagaacuaaaacagguacucugaaaaguucuguaaaggaaaugagucugaaggaugagacgaugcucaucuaaugaacaagacaggaaaaaggauuucagaagaagagggaccauggagggccaaacgcauguggagaagaaugagaagcccauugguaaacucacagguagcagcagcgggaguggccugaaaaggccaucaugagggauuuuauuuauugcuggagguaucggaagcuacuauagggcagaauaagacugaaauacaagagggagacgaaguuguguuucucugcuuaggacagaguugaucugugaggcugcaugcaagggguguggagggaagaaggcagaauaaaauuaagaccugaaguagaccaaggaaugaaaagaaaaacugacacuacauggcagucuagauccggagccagagcaaaagggacagauggagaaaggagcaaggaaccaggaaacaacguucuauugcaacucacuuccagugagcuucucggggcuccuuuuucaauggaaagcccucaugcuuuagaaucuuuaugcuaacaugugaauacauacaaaaccugcccacacccgcccuacuggauccaagucacucgaaauagaaauaacugaacagauauguuuaaauacgauaccaaaguauuaauuucugcaugaauuucuaaugggauaacagaagagaaaugacaguuuagggaacaaucuauccuugaccaauaacaaaggugaaaggccaggcacaguggcucacgccuguaaucccagcacuuugggaggccaaggcggacagaucaccugaggucaggaguucgagaccagccugaccaacauggagaagacucgccucuacuaaaaauacaaaauuagccggacgugguggcacaugccuguaaucccagcuaccugggaggcugaggcaggagaaucacuugaacccaggaggcggagguuguggucacgccacugcacuccagccugggcaacaagagcaaaacuccgucucaaaaaaaaaaaaaagaaaggugaaagguuacuaagaauguuuacuacuaaaagagagaagggugggaaaucauaucagaacccacauucuugugaccagguaauacguccccagcaucuaggagccagaaaaggaacucagucucaucuaauagagacacagagccacaguacacacgccuuaauaggucagcacuccucuccuaacuauauuugggugaaggaacagguggacagaaggaauaccaaacauguuggggggaaaaaaaaugaccugaaaauaggaaaaaagauguaaguaacaauguugaacaauaaauaagaaggcaaaaacuaacaugauauuuccuuuuuaauuucagagauuccuaaccaaugaaagcauuaaguguucuguacauuguuuguaauacaacaaaugagauguaucacacuggaaauucucugaagacaaggaaggaaaagcuccagagugcaagccucaggugaucagaaacaagaaauggagaaguccagaucccacacauaccucaggccugaugcauucaccggcaaaacagaaaucaacaugugacacgcuugccaaaaucacaucaucugccguucuagauauuucuuccagcguacugcaagaccugaaaacuuuuuauuuuuuuuuggugagacacggucccagcucugucacccaggcuggagugcaguggcgcaaucucagcucacugcaaccccgccucccaggcucaagugauccucccaccucagcauccagaguagcugggacaacaggcauacgccacacacccugcuaauuuuuguagagaagggguuucaccauguugcccaggaugguuucaaacuccuggacucaagagauccacccaucucacccuacacuccccuccaagagcugggauuauaggcaugagccaugacaccuggcccugaaaacuuuaaauauacauguagaauaccaccaauucauacuaaaauacccacucaucuuucuucuuccaagcucccaagagcuguuccacagaacgggauuguauucugguggaugauuuggcuaagccgagugaugagggcagagaggacaauaauuguuauuuuacugaacagcagaguuaugaaaccaagaacaguacaguaguuaaaacuaagaacccugaagaccaacaggccuggauuugaguugggaagagauggacagcucuccaaaaaggcacaaacaauugaaggauggauaccauggcauauguuaaaagcauauugaaaggaaaauaagaaagccaggaaucucaggaugaaucagucuagaucuagaucagauggugguggugacgaaaccuuaucucaagaccguaaucauuugugaaaaugggagaagauggcagcaagagcaucuccacagagaagaggccugagaacucgaugaagauuaucggcuuaugagaggaccauaaucuuuuaggcuccccuagagaaauaacaucagaagaacugcaacagugguuagauggggucaacaaacaacuagcaucucagccugacucgagaaauggaacaaacuggccggacaccgugacucaugccuguaaucccagcacuuugggaggcugaguggguggaucacgaggucuggaguucaagaccagccuggccaacauggugaaaccccaucucuacuaaacagauauaaaaaauuagccgggugugguggcacaugccuguaauaccuaaucccagcuacucaggaggcugaggcaggagaaucgcuugaaucugggaggcggaguuugcagugagccgagaucaugccauugcacuccagccuaggcagcaagagugaaacuccaucucaaaaaaauaaaaugaaauaaagaaauggaacaaauuacagagacucagaaguccccagagaaaguucaaaugaauauucucuucuagcauaguugaacaccuuucggggcacaggaaaugcaacucaaaguggacaaaaugggaaucaaaauuggagagcugugagucgaacaaacucgaacaguggagaguuucgguuuaguuuggaaauccacauaaaucaugaaaauagaggaucugaaauucauggagauuauacaaacauuccacuuucagauaguaacagagaucauauuacaaauaggcaacaaaggucaucuaguccuguggcuaggcgaacaagaagccaaaccucagugaauuucaauggugguaguuccaacauucuaaggacuaggcuugcuucaagggggaaaaauucagcugaaggaucuuucucaacaguaggaagauuaaaaaauggaacugggggaucagcuggcauucccagagcuagugcuucacgcacuaauuucaguagucacacaaaccagucggguggcagcuaacucaggcaaagggaggcacaacaguuuaaagcagcacauguuugggaaaauggggcuagauauaauguuacagugagaaauacaaaccaaagauuagggccaauaagaucuacuauaaguagccgaagcuguucaccaauucagagacacaguggcacuguuugucauaauucacaaagggaaaguagaccaguacagcaaaccacuagaagaucugucaggaggagagguauaacucaagucuuuuuagagcaagauagagaacacagagguacugcauauaccccauucucuaauucaagacuuaugucaagaauaacaguagaagaagaauccagcagauccucaacugcuguacuacgacauccaacaaucacacuggaccuucaagugagaaggauccaucccggagaaaauagagaucaggacaguauugcaaacagaacucauccagaguagggcuaacagaacauacagucacuauucaaagcaauagugggggcuucugccgaaucauuucucguuuagagcggucacguauucaaaccuauguuaguaccauaauucuuccuaggauuucugagaacgagcuuguugagccaucaucaguggcucuucggucaaucuuaaggcagauuaugacugggucuggagaaucuaguacucuaagggaggguucaaccacuagagagaagcucugguucuccaagucagagcuucagagaaauggucagcauuuaccagagaugcauugagaacugaguaaccuuagguacaguuacugacagcagccagcacagggaacgggacaggcaggcccaaggagacagcacugaaaugcaugguguaaaugagaccacccagccucauaccugaaacagugacaauagggguagcauguaguugcaaaauucaaaugauuuagucaaacuggaaaacuacuauucuuccccuugcuuuuuuuuuuuuuuuuugagauggagucucacucagccacccaggcuggagugcaguggugcgaucuuggcucacugcaaucaccgucucccggguucaagcuauucucccaucucagccucccgaguagcugggauuacaggaacccgccaucaugccuggcugauuuuuguauuuuaguagacaugggguuucaccauguuggccaggcuggucuucaacuccugaccucaggugauccgccugccucggccucccaaagugcuaggauuacaggcaagagccaccacgcccgccugaauacaugauuuaaccaaagagcagacugacaaucuuuccacccagcgcuagagcauaacaguauugauagugaaccagguaaaaucuguaguguuuguaucagugaccacauaacuggaaacaagcucaggcaauuaccuugcaggcaugaauuucauauucauuguacugaccgauggcucucagagaauuucacuuguccgaucugucagcagccuguuuuaggguccaacauagcaaacaauggguaaaagugaugggaucuacucaaauauuguauuuuaguagaacugaauguucaagcauuguuuugcugaguuacuugugaugagcuaacuaggaugaaaaauaacagauuauauauaguuugaacuauuuuugcgugcuuuuuaaaacuuguuauaaagaggaaauuuauauaacauuuaaaauacaaacauuaaauuauccagaaacacaaaauaauuaacauugcuagaaccaaauaaccucuaaaauguuuuuauuuugguaauuuucucaugcuaagcacuuuuguaucugcacaauucaauagguuaaaaaccaaucuucuuuuccuuaauagcacagcagacuuuacuuucaaguuucauaggcuuaguauuuaugucuagacauuucuaucuaaauaagcuuuucauuaacuuuuuacgaauaauaccuuuucaugagaguauguggcugaaugugugcuauacauguuauuugaaauguuaaauuuaauauacagcauaucauauauguauaguuauauaauucuaagguuaaaauauucaguguacaaguuugguucuuauuuaagcuuuugggcuaauacugcguauggcacaauguuuaauacuggcaagaucaucucagagagaaaagggauucggauauaauuuuaauauagagauaauuuacugaaacaucucugacaaucugacuuauuagaaagcaagcaauauauaauacugaacaaguauuuauucaguaauggaaaauuuaggacauacagguuauuuaacuuguguucagccuuucuguaacuuuuuugaaagugcaaacaauucuuuggauuauuaaauaagguauacaauaugcaugguuucucaaauuuaguguuaaaaucuaaaaaaagucuauaaagaaucgauugcauagauaauacuuuaaguucacuuggaggcuaaauauuuccaaugaaaacaaaaaccuuuaagagaaugcaguuuauauaaauacaaaguaugcauugaugaucuauuucuaccaauaaacauuaaaacaaacaaaccaaaaaaucucagauuucacaacuguaggaagagcuagacuuacagagauguuuauuuaaccaccaccacuaccuucaggugaacuggcugcaucuccacaacauucugagacaucaacuuugaaaugauagcucacugaaggaguuucuuuucuagcaaaaggcaaaucugucuuucccaagccaaagaaaauccaaacaaaaaucaccaagccuccugccugcuugacauaauuccaccauugccugagccugugcaaaauggggccaauaaugacuugcuucaggcuugucaugaugagauaguacacagaaaacacacagcucuaugccuggcauaaaaugguuuuucaaaguuaaacuauuuuuuaucauuauuccucagauuccaauccccuaaaaauuauuuuccaaguuuacuccuauuuugcucauucccuaaggaucacuauaaguaagcguggaagaagaagaguguccugcucuguaaguaagaaacaacuccagacaagagauuccuuaagguauuaucugcuuccagggugugauucaaagguuuaagcccaugccaaucauuucaugacugcaagucugcuauggcaacacacuuauacagccaaauucucagcagaaucaauuccuuuuaucaaagguacuauuaaaucaaaacaaaaccaccugauuugcauuuauucaccuuucucuaaguuauccaaugggaauguuuaaaaaaaaaaaaggaauacaguuaaaggggaaagaaaaacaaaacuggcuucuaaaaaauaacacagccauuauauugagaugcauuucgcuccaggccauaaaacauuuaucccuugguaaggcugcucuaugaacacaggcuuuuuuuuuccaaaagugacacggggguccguguggggcauuaguuauuacuguugcugacuauuaugaaaaucaacuuuuuuccucugcauuuacgucuguguguaucacacgacaacccagaagacagaucgguaaacuugccaacaacaagaaauaaaauaagcaauaaaaucaacaacagaauuaaauuacacugacaaguuagaaugcuggguuugaaaaucaacauaaaauuggaaguucaacaguuuuuuuucuuuuuaauggggaaauguguuuggaggcaggcacagaaauguuugcugacugugucauaugaaccacuguaagugacaaaaaggugugguagucuuaggcugcauuaacaaauguacaauuuccagaucacaggaaauuaaagucucacuacacucaaaacuggccacacuauaucuggagaacuagaugaguucuuuauuaacacacuuuaagaaggacauugauaaaucagagcgcaucccauaaugagaaagggguccaguucuggggaccauggucaagaaguuccccaggccaggcaugguggcucacgccuguaaucccaacacuuugggaagcugaggcaggaggaguuugagaccagccugggcaacaaagugagacaccaucucuuaaaaaaaaaaaaaaaaauuuuuuuuuuuuuuaauuagccaggcacgguggcgcacgccuguagucccagcuacuugggaagcugaggugggaggauggcuugagcccaggaguuugaggcuguaaugagcugugaucaaaccacugcucuucagccugggugacagcaugagauugucucaauaaauaaaaauaagaaauaaaagacuccuaaucucuggagauaaacaaagccuagacgacccucugcagaagaagccaaaaggagauauguggccuaaucccaauucuaagauuucaugcaccuggggacuauuaucaucucauagccugauaguaccaccaacagaaaacaggccaggaaugugaucaaagcucuuaaaaacuaauacugcuuaaaaaaaaaaaaaaaaaaaaaagaucacucaggacauuccuaagagcaaagagaaauauguuacuacaggaguuucaugaaaacuuacccagaaauugcagcaaugcuuugcuuuauaacaucuaaaaauugugcuugccuaucucauccaaucacuuauaacauguguuguaagugaucaguucugauucauaccacaugauaagaacagcacucugacuaaaggggguggggugggaaccccagggccagagcacucaucucaucauaaacuaaaugguagcuagccaggcaacuuggcggggggaggugacagaugacacugcauaggaauuuaauacuuuuuaaaguuuaucaaguccacucaaauuauuuuuuuggaaauuuugagaguauauggaaucaaccacucccccaaccuggaaucauuuuugguaagcauguaauggaacauggaauuacaauuuucaaggagaguauuucgaguaaugaaaauaacugucucacugggaauuaugcauauaguuuuuuauguauauaacacagaauauuucuggaaauccaucagauagaaaauuuaacaauauacauugcaauauuaaaaucuguuuucuacagcucuuugccaaccaaucauaaaacaugguuuuggaugcuagguaaaaguaacaaaaagucuaguaauauaaaaaguuuugauuggauaaauguaagucaguagaaaugaaaguacuuuuuauugugagagauuaaguggauuauuagugaagacaaaagucccuaacacuuuaaugcaauggaauuaccacacucaguugagaaaaacacaaauuaacauauuauguuaaucuggauucaacguggggaaaaaagaggaaauaaaagcauuaucuaacuaccacaaauguggcauguugauaauuuauugugaccuagaauaugacaugcacaaauauacuaaugauugaguacuaaauucaucauccaaaaacucuaacucaagggucucuuucuccaccuaaagaaaauaaaaauaaauauggguaucaacaauuuuauacugcuuguggucuccaaugcugauggauuacuuuucagcauauccagcaaauucuaaguacugcucaguuuaaguguccacaauuucccacuguuaacacugaagacagcaagagcagaaaauucguauguggcccgguagaaaauucugcuauaaaacagagguuuuuuuuacaauaauccguuauuagcuuagacucaauuacaaagagagucuaggcugcucugccuuuggaguagucauucuuuauuccuuuauuuuaauaaacuugcuuucacuuuaaaaaaaaaaaaaaaguuuaauuuuccacagggugggaaugugauuauaugaucuuguaauuuuacauaaggcaauaagcacucuaaaauauuuuagguauaagucagaggaaaacauggcauaugauagguaaugacuuuccucuuaccaugugaaagcaggccuuggcacacacauuuucaaaagcaauccaaggcaguauaguuuaucaauccuacuuuauagauucuuaaauucaaacaaaagaguuuuaaauuaugaaccaggucccugaccagggaccaggauaaagucaucuuugucuucacuacauuuuauuuuaucuuauuuuauuuauuuuuugagucaaggucuugcuauguugcccaggcuggucaugaacuccuggaucaagccaaccucccaccucagccucccaaagugcugggauuacaggugugaaccaccaugcccagccuuacuuuuuauuuaaaaccuaaggcuauuuaagaaaacaucuaauauaugacauauucuauuuaaauagaacaacagaauaacaaauccuagccagcagacauucugauaagaggauauauuuuuaacuaauuccacuucucaaaacauuguaaaagcuuaaaaggauucaauauucacaagucuccugacaaagcaaccaaguaaggcacuggucucaggcaguugugauguuuuaaaauaagugauaaacaguuuacaacacugaaagccuaaugaccucuaaagcuguccugcuggugagacagcucaugccccacacugaaauguucucuagucagacuucauaaaagaaaguauagaugcauuuuugcauuccagagguuacugcauguuacuaaacaugccuaaauuuucuuuccuauauagaagauucagagguaacuccuugcacuugauaaacuguuacacaccuacagaaaugauaacuaggcuacauaacaaaguugguaaguuccaccaauaccuccccuuucaaaacccguccuuaaagugaacgucuccauaugcucucucauuggggaaagaugccuaguuucacuugcaaagacacuggcccaugaacuucccuaaacuagguccaucagacacugccccgaugauaccagucucaauuccuuaaagcuagagaacaaacauuccuccaucuaaagcuaugaacaaguacccaagggugacuuuauuggcaacugcccuacaugcacugaauuucagucuggccacugggucccaaacuccuaaaauuucacaaccuuuuucuaaguaguuaccaucagggcuaucacagugugcagaaagaagaaauguaugcauaacaauuccuggacauacaacagcccuuucccaguuuuaucuuuaaaccucccugcucuuuauuuaauuuuccagaacacaagcauuagaacacugcaaucaccuuugcuucuuuuccagguccaucccuauccaagcaauuuuaccaacaauucccccaaccacggcuuccaccaaccuaagccugugggaaucagagcacaaaguccacugccuccaacuuccuccccaccaccuguauccaccucacucacaacuguucauuuuucccaaacccagauagaucacauucacacaccugcuaaaaccucaaaacccuuggacacuuuaaaaauaguuggucuggcuucuuccaaggugucaauggcaugaaagacugagaaaugcugaggaaauguucaaagcaaagguaacucaagaaagguaaugcucaaaugcacuguauaacccuguacuggauucuguaugaggagaaaaauguccuugcuacuaaggagauuauuaggagacugacaaaacuggaacaugaaauaaaaaauacuguauuaacaauaacuuuccuggccaagcgugguggcucaugccuguaaucccagcacuuugggaagccaaggugggcaggucaucugaggucgggaguucgagaccagccuggccagcauggugaaaccccaucucuacuaaaaacaccaaaauuagccaggcaugguggcaggcgucuguaaucccagcuacucgggaagcugagacaggagaaucgcuugaacccgggaggcagagguugcagugagccaagaucgcgccauugcacuccagccugggcaacagagugauacuccggcuaaaaaaaaaaaaaaacaaacaaacaacaguaacuuuccugaaugugaaugcuguacuacagauccauaauagacuauucuuguucucuggaaauacacauugaagcauuaaggaauacagcagcaucacucauaaaagcuacccuugacuggguuggcaggggaaccgugugugugugcacaaaucuauguaccuacaaauacagacauauacacauguauacauauauacauacauaaaggaugcaagcaaauuaucaaaaugucaaaaacuggugaaucuggguaacggguacauaaaaguuuuuuuuuauucuucaaacuuaccacuugaaaaaauuucaaaauaaaaaauuuuuuuuaaaaagcccuucuugggggcaggaguaaacuuuucagggugaugaauaauguucguucucgagcguggugauguuucacaagcauacccaugucaaaacuuaccaaacuguacauucuaaauaugugcagauuauacaucagcuauuccucaaaagagcuguuuacacacacacacacacacacacacacacacacaccccgugaggguuucagucuucccgggcacucucgcaacuugucuggacaaaccuugucacuguacaacccccucaucccuuucugcacuuuucacccuuccccuccccagucccaaagaacucaccaugcuaccugaguccguccucuucagcuuuuuuguucacgcuacuaccacuuccuagaaaauguauaguggaaucgacucauacgaucuagacccaaaucucaguugcaccaagccacacucucaaagccaaguuuccucaucugugaaauggggacauggccaaccuacugacagaagcagaugagaccuggugggagguaacaaugguauagaaguacuuugaaauaauacaaaacacuacugggaaucauuaccuucacacauccaaagcccugcaggcucaaccuuccucuccagguugucccccaggcaccugcucugaaacagacucaccucucacuccccugaaucaaacaguaacuguacuacuacagacaaacugugagaccaccuauggccuaccauguauauuuuuacaagugcaucucgggaauaaaauacacuuacccaaacucccaaagagcaggaccugugggugucccaccuuuaugugccagcccaaagccuuguucauucauccuaagaccucaauacuugaauucaacaagggauugaacuaggauuggaucacaaugguugaagaggcccaaccaacaaauggcaaugaauaguuaaaacaacaugacuuuuuuuuuuuuuuucagacagaguuucacucuuguugcccaggcuggagugcaguggugcaaucucggcccacugcaaccuccgccucccggguucaagcuauucuccugccucagccucccgaguagcugggauuacaggcaugcgccaccacgcccagcuaauuuuguauuuuuaguagagaugggguuucuccauguuggucaggcuggucucgaacucccaaccucaggugaucugcccgccucggccucccaaggugcugggauuacaggcgugagccacugcacccagccaaacaacaugacuuuugaacugccuaagauuucacagccucuagagguauaucaagugcagacugacuaucccuuauccaaaaugauuggaaccagaagcauuuuggacuuuggauuuuuucagauuuuggaacauuugcauuaaacuuaccaguuaagcaucccuaauccaaaaauccaaaacccuccacugagcauuuccuuugagcaucauguugccacucaagaaguuucagauuuuggagcauuuaggauuuuagauuuucagauuaggaauauucaaccugcauauggacauaagacccauccaccaauggcccuugcuucacaugcucaguggguugugggcuucggcuaaaaccugggaggagaucacagauucaaagucuccuuguggggcacuguguucuguaagaggaagcuacaguugagaagguucaaggcaacuaaauaugugcuaguaaagugagcauaaaucauucugaaaccagaggaccuacaacaaguagccugguuugggcuuuucuugugcucagcagucaagugauaagaaccuuuaacuacauuacaucuaacauuuuuaauuuacaaaauaaugcccaccacuucaaaaaaauugauaguauuauaucuucuaccuuucuauguccaaaaaauaagggaaggagguuuaaaauauaaguagcuaaaccaggaacuccaguccugccacaaugcuaggcauauuuguucuaggaauucaaguccugcuaauuuaaacagcaaggggaacugaaacucuugagaaucucugauuauacagaaaaucucggugucguuuacacacagggcaagccaaggggauccuucuaaacagucuggggcuguuugcuuuuguucuucuuuuuguucccacugaaaagcaaaaaucauuugucaacauggaaaaaccagccuggugcaguagcucacgccuguaauccuagcaugcugggaggccaagguggcagauuaccugaggucaggaguugaagaccagccuggccaacauggugaaaccccguguccacuaaaaauacaaaaauguagccaggugcaguggcgcgcgccuguaaucccagcuacucggaaggcugaggcaggauaauugcuugaacccaagagguggagguuggggugggccgagaucgcgccacugcacuccagacugggcgugggagcaaaacuucucaaaaaaaaaaaaggaaaaaccaggaaaagcuugucacuuaaugacuggccuggcaaauagggaaagagccuaaaacuauuuuucccuucccauacugugaagacuacaagcuuugccaacaccacuccucaacaccacucugucauuuuucuuugucuaaaucuuuuuaauuucuuaaaugggaaggaaguugccuuaaaguauaauaccaagauucccgcagggcaccacucugcaggaaugugguucagaaaccaagaaucaaggggcaaugccuccauacaggugaggauuuucccaccccaaagaggcuuacuaaaguuaggggcaauuuuccaccuaacauaaauuauguugugggguggauaagugagaaagaauaaagccguuaugaccaaugaggaaaaaugaaauggauauaaaaacauuauugccaaggucuuuguuccagaguucucaaucauucagggccaagagaggcuggacuuagaguccugcaggguggaguggcagcauuguggaggagggaucccugcgaaaaguauuuaugcugcaacuuuucagcauaaccaaagcagaccaacaacuagagcuuaaguuuagggccgcauuccauaaacuaugacugugaccucauggcauauaccaaaaucaacucaaaagaaucaaagaccuaaauguaagaacuaauacauuaaacucuuagaagaaaacauagggauaaaucuuuccgaucuuggauuaggcaaugguuucuuagacaugacaccaaaagcacaagcuacaaaagaaaaaaaaauagauacuuuggacuucaucaaaauuaagaacauuuuugcuucaaaggacaccaccguuuguacauccauauucacagcaguacuauucacaacacccaaaagguguccauugagggaugaauggauaaacaaaaugugauauauacauagaauagaguaggacacaaguuacaacauggauggaccuugaagacauugugcuaagugaaauaaaccagucacaaaauaggauuccacuccuauaaaggaccuaaaguagucaaauucauagagacagaaaguagaaugguggcugucaaaagccugaagaaggaggaaaugcgaaguuauuguuuaacagacacaaaguuacaguuuugcaagaugaaaagaguucugaagauggauggugauuacaauggguuggcauaacaaaaugaaaguacuuaaugucacggaacaguacguuuuaaaacgguuaagauaguguauuuuauguauauuuuaccacaaauuuuaaaaaaauaggacacuaccuccaaaaaaaaugaaaaaacccagcagggcaugguggcucaugacuguaaucccagcacuuugggaggccauggcagguggaucacgaggucaggagauggagaccauccuggcuaacacagugaaaccccaucucuacuaaaaauacaaaaaauuagccaggugugguggcacaugccuguagucccagcuacucaggaggcugagacaggagaauagcuugaaccugggaggcagagguagcagugagccaguaucacgccacugcacuccagccugggugacacagcgagacuccgucucaaaaacaaaacacaaaaaccccacagaaugggagcaauuauuuguaaaucauauauauaagggauuaguaccuagaauauaugaagaauucuuaaaacucaguacuaaaaggacaaauaacacaauuuaacaaugggcaaagggaccacuugagccccggaguucgagaccagccuggacaacauggcaaaaccccaucuccacuaaaaacacaaaaauuagccaggggugguggugggcacccguaauccuagcuacuugggaggcugaggcacgaauaucucuugagcccgggaggcggagguugcagugagcugagauagugccauuguacuacagccugagcgacagagcaagacuccauuucaaaaaaagaaaagaaaaaaaaagagccgggcacaguggcucaugccuguaaucccagcacuuugggaggcugaggcaggcagacuaccugaugucaggaguucaagaccagccuggccaacauggugaaacccugucucuacuaaaaauaaaaaaaaauuagcugggcauaguggugcaugccuguaaucccagcuacuugggaggcugaggcaggagaaucacuugaauccgagcugaaguugugccauugcaaaagagugaaacuccaucucaaaaaaaaaaaaaaaggaaaagaaaaaaaaagggcgaaggaucugaguagauaucucuccaaagaagauauacaaauagccaauaagcauauaaaaagaugcuuaacauuauuuagcaucagaaaaauggaaaacaaaauuacagugauaccacuucacacccacuagaacggcuaaaauaaacaagacaauaacaagugucaucaagguuguagagagaugagaauacucauaccuuucaugguaggaauguaaaauggugcagccacuuuucagcaguuugacaguuccucaaaaggucgaacaaacaguucuuauggcccaagccauuucauuccuagguauauacccaaaccaagagaaaugaaacauacauauaugcacauaaaaaaacuauacaugaauaaucaaaacauuauuaauaacagcaauaauuuugaaauguggggagguuuugaaauuauuuaaaaucaacugauaaauggauaaaauauacuauuuccauacaauggcauauuaauugguaauaaaaaggaaugauacugauacaugcuaccacgggaauaaaccucgaaaauguuaugcuaagucaaagaagccagucaaaggagaucacauauuguaaaaugauaccauuuauacaaaauguucacaacaggcaaauccauaaacacagagaguaaaugcagguuagggagauaugggaagaauggggagugacugguaguagauuucuuuagggaugauaaaaaugaaaauuguggugauaguugcccaaacucuugcaaauacacuaaaaacuauugaauuguacucuuuaaguggguaaacuguuaugugaauuagaucucaauaaagcuauuauuaaaaauagaauguagauuucuuuauccauuucauacuaaaagauacauagucacaguaacuuuauaaauggccaaggaaagaauucccaagacuccuuaugcucaaguauagaaacucaacuuuccucaccaaaggcacacaucaguagaaaugcaugcuauuccuauuuugccaagcacccagguucaucaaaauaaacuuaugaauuacuguaccuaguaaagcacucacuaucaggguuggaaacugaauuaugggaaguuucauaccuauucucuggaugaggcacuuuacaaucuaguaacugacaacaguucuucaacaucaaacuguuagcccacaugacagguauaugacaggguaccaggacugugugauuuuacaguaaaauguaaagaaguuucccuuugcuaauaaaacugcccacgacaaauucccuuuaguuuuucccaaugauaccaaaaagccuugcuuuguguuggacuaaucugcaauagagaacucaacaauuuaacugguucauauccacacaacugcauacaagaaaauguaauuauuacaccuugcuguauagacaguaucaaaucucacuuaggcauuaacaaaugaacacucccacauucaauaaacuaaacacaaaccuaagaagcugcagaauacacacaauuuaagucacuccaaguguauuaguaagaaaagugagcuagggcaacacagaccccauuucuacaaaaaaaauuuaaaaauaagcaccugggaggcuuaaggcagggcaaucacuucagccugggaggccaaggcuguagugagccaucaucaugccacugcauuccagccugggcagcagggcaagacccugucucgacaacaacaaaaaaagaaagcaacaaagguggcuuuaguacuuuuuuuuuuuuuuuagacggagucuugcucugucgcccaggcuggagcgcaguggcgcaaucucagcuuacugcaaccuccaccuccugggcucaagcaauucuccuuccucagccccgaguagcugggauuacaggugcccaccaccccgcccagcuaauuuuuguauuuuuaguagagauaggguuucaccauguuggccaggcuggucucgaacuccugaccucauggauccacccaccucagccucccaaagugcugggauuacagacaugagccaccguguccagccccaauuuuuaaaaacaaaacaaacaacccucuacaauuucaacaucaauuuagcaucauucauuaaaaucuaaaccucuaaacccaacucauaucauuuacaauucauaagcaaucauuuauauaaaaaucuaccugguaaggcauauggcauuguucuuuauugccugaaacaaaguauuagauaucagacaaagaaaucguaauaccuaguucuucauuaaccaaaaaaauuuuugaaaaauacugguucccauucacuguuuauuccuccuacgaagaaacacaggaguaaauuuaagauaaauuuuuugcuauaugcuacuaagucuacaaguaaugcuguaauucugcagcaucacagaaucauuacaagcuuaacauuuaggggaaaaaaaaacuguuccugauaaagaacacuuuaacccacgaagguuaaggacuuuuaaggacuuaauuuccaguuuaauacugcauccauggggaccagguagaagcacuguuuacaucacugagucaguuuucaaaauaucaucauccuggucaguuuugcuuuuacucagcuuuauaaucugcuugucaaacaaauaaccugcuaagacuacaaugaaaauauuuucauuaccacgagucuggaagaguauuuuuacagaggaaaauugagaugucaugucugggcaaucccuuaagcuaaauuucucaccucuaaucacugcccucuacagucaauaaggcugaugccuugugcaggaaaggccucuggauggucaggcacaccacugaggagagugaguccucuccccuccacugagggccugcccugcccacuucuggggacgugacagaggucccagccaucaggaugagcuguacucuaccugcugccccucccuggggaccagaugcaugcaugugacagacccacaguggcgcccaucuguaaaaaccagugggagccagcacuguggcucacccuguaaucccagcccuuugggaggcugaggcaggcggaucaccugaggucgggaguucgaaacuagccuggccaacaugaugaaacccugucuguacuaaaaauacaaauauuagccaggcguggcauggugcgguacaccuguagucccaacuacuugggaggcggaggcaggagaaucgcuugaaccugggaggcggagguugcagugaacucagaucucaccacccuacuccaaccugggccacagagcgagauuccaucaaaaaaaaaacaaaaaacaaaaaacaaaaugguggggucuguuaaacauuugccacacaagcuguacaaccucaaacaagguaggguccucuaccucucugggucuccauuuccugaccuguaaaauguugaugauacuuacaccaugaaaggcuacuguaagaauaaaauaaugggcugggcccaguggcucaugccuguaaucucagcacucugggaggccaauaugagaggacugcuugaggccaggaguucaauaccagccuggucgauauagcaagaucccauuucuauuuuucaaaaacuuuuuuuuuuuuuuuuuuuugagacagaguuucacucuuuguugcccaggcuggagugcaguggcacaaucccagcucacugcaaccuccaccuccuggguucaaaugauucucccgucucagccucccaaguagcugagauuacaggcaugcaccaccacacccagcugacuuuuguauuuuuaguagcuggucucaaacuccugaccucaggugauucacccgccuuggacucccaaagugcugggauuacaggcgugagccaccacaccuggccaaaaaauaauaauaauauuguuuuaaaagaaggaaauaacaagaagccuagcacaauaccugguggaguacaagugcuaggcugaauaaacuacuguaauuauaaacagugacuuuuccugaauacuaugcgcuagguacuguucuuuaggcaccuuaccauguauuauuaauuuauguagcucucauaacaacccuugaucauuauugcaccaacuuacaaaugaggaaacugaggcaugaagauuaagaacuucauucacaaguggaggaagguuggauucaaacuugacagaaagauaccccaacucaacacugugacagccuuucugguggcaguggcaauugaucccauguaaaaagcuuauggccgagcgcgguggcucacgucuguaaucucagcacuuugggagugccaaggcaggcggaucaggaggucaggagauugaggccauccuggcuaacacggugaaaccccgucucuacuaaaaauacaaaaaauuagccgggcauggugacacgugccuguagucccagcuacucaggaggcugaggcaggagaauagcuugaacccgggaggcggagguugcagugagccaagaucgugccacugcacuccagccugggcaacagagugagacuccaucacaaaaaaaaaaaaaaaaaaaaaaaaagguuacaauagguccugcugggauuucacccucaaccuuacgucuuccuagcuaucaaauuuuaaccaacucaaaaaaugucagccuucuauuuucugcuuucuauauauaaucuguacuucaccaaaguaaugauaauaauagcuaccauuuauaaaacacuuccuacacagcaaacgcuacucuagaacacauuuuauguuuuguucaauucucacaacaaccuauaagaguuacuauuuacauucuucacacgaguaaagagcagcacaggaggucaacugcccaagugauaaaguugguaagcacugaaggcagaacuccacccaggcagugugaccggcaaaccgaagcacuuacgcacucuacuauacugacuuccucagcaacuacucacuuuaugggaauaacugguuauuuagauaagcaauacuauacagaacugcagaaaaaguucauguuuaucuguauuacagaugagacuaagauacuggaggcaccacacuuagggucauuugcaagcuguaguacacauuuuacugccaacaguccacuacugaguuaacagugauaugucuacccacuuaaaaguuuuuguauuuuaaaaaauucuugaaauuugguuuuucugucaguagacuucaguggcagaaaggcuggaaugcugugaagguucuuucuguuucuaaauuuaggaacagcaaggauugguuuagggucaguuuaguacaaugacagcagugaaccagaucauuuaauuuaaggaccuaguaauuuaaaaggaugcacuagaaaaacaugucaagccagaugagaaccucuggcaucaccaucaucaccauaaggagauaacuuauagaggaacguugaagugauguaaggaagacauuauaugaaagaauacauuuuugcuucuccaacaaaaaaaaaagcuaaaauuugucauuuuuaaaugucuguuucauucccauugugugugagaaacuaaauauuaagauguuuccugggaccagaaaggaaaaguaaauagaauucugcccuuaaaagcuuacaguccaaugagauuugggggcgagagacuaacucacaaaaaguuccaagagagagcacaccuguuaaggggggaaucaaaggaaacagagaaaucccauucaauuggggaggaaaucaagacaacaagcuucacaaaaaaggcagcaaaauaggcagucugggaggaggaggagggggccuaagguuucagaagguggcaaugguccuaggaaaauacaugcccacucacgacaguggugagaaguggucaucagaaggaugggcacuguauucauacugugaugaggcacugaaggcaguagaaacuucagaccaucacuggaaguucugaaauggaaggaaggggggcagggcagcgcaccaccucuguaacuccagaacagucacuaaggccaggcacgguggcucacgccuauaauccaagcacuuugggaggccaaugcggguggaucaccugacgucaggaguucgagaccagccugaccaacaugguaaaaccccgucucuacuaaaaauacaaaaauuagccaggugugguggugcgugccuguaaucccagcuacuugggaggcugaggcaggagaaucgcuugaacccgggagcaggggguugcagugagcugagaucagauagugccacugcacuccagccugggcaacaagagggaaacucugucuuuaaaaaaaaaaacaacaacaguuacuaagacaaugaaaagggaagcagggauauggagaagguucaagagccagcagagugacucaucucuucagaggucacaagccucagggcugauggaauaggaggucagacccucugacagucuaacccugcuuggcccuaccacagggucgccugucaguaguccagagcccuacacgucauucuucuaguuuuaggugcaguaaauaaaaacacuaguaacuaaguuaggaauucucucaguuuuuuauuccaauaguucaaaaucacucacuaagcaacaaaggcauuuucaugcaggaaaaaaauaaacuaauuuugucuagagcagggaggguuucacaacuucagcacuacugacacacauaguggccagcacuacuggucagauaauucucuguuaugggaggucgguccugugcuuugcacgguguuuagcagcaccccugaucucuaaucacuagaugccaguagcaacacauccccacccaagcugugacaacaaaagauguuucuugaauugccaaaugucagagggaccagcugagaaccacuagcccagucuuuagcagaggaagaauuuagaccuaauuagaaguuuuuuccuuucucccuucuaucugaaaaaucuucgaaaauaaaacgacugagaacgggagagagcaaccuuugccuuauguggcaaacccaaucccucaauccucacgacaaucuuagcaagugcuauccucauuauacaugugagaaaaccuauccuuaaauguuaauuuguccaagguuaaguuaaacaagcuugaacggauuugugacaauacucaagguucuaaacacuacagaaccucugcccccacagggccauagauuccacuccuugaauaaaacaaacauuaaaaacucuagauaauccuacacuaaaauagcacaaauccuguccaucuauuaggaaccaauuacucaagaaaaagcuaaagggccacacacuucaugcaagcaucauauguaaagggaauuaaaagaauugcuuuaggucacugugauuucuuuuaaaggauaaggaaagggaaagggagggacgaugaacauuauuuggaagcagaguccuaagccaagcaaugucuggcucugaagguagcccugguuaccacugccucugaacuacacuacacucucucucucuaaguaucguccaaagcaaaaccaaaagacuuucucaaugagggcgcuccugggcgcuauucugcucaucugaugauccaguuagaagggcggcuuuagcaucccccaagcccugagucucaggaccucagucuggagcaggucacuucgcuucucuucaccucaguuuccugugcaugcaauagagacaguaccuaaugggaaggacugaccuguucuuaguaaaauguggaugaaagcuuaaggauuucuuuuuguccucgucccuuaacuaaaguaucaguagccuuccugaagcuuaagcucaccccaagaacaaaguauuuucuguccaaacaggucaguguuuguuauuucuuuuguuguuguuguuguuguuguuguuguuguuguuguuguuugagacagaguuuuugcucuguuucccaggcuggagugcaauggcacaaucucggcuuacugcaaccucugccuccuggguucaagccauucuccugccucagccucccaaguagcugcgauuacaggcaccugccaccauacccggcugauuuuuguauuuuuaguagagacaagauuucaccauguuggccaggcuggucucaaacucuugaccucaagugauccacccgccuuggcccuccaaagugcuaggauuacaggcgugagccaucgugcccggccaguguuuguuauuucuaugugccaaccccacagcaacaacaaggacaaguuuccauuccccguaaaaggagguucuuuuccuccgucuucuaggcaguauguguagggggugacagagccaacagugaagccaacuaaauagagccuuccuauccaucuggugaggaaaccacaggcaacuccucuucaccacacccugagccacgacaggguuacuuggucaacuccucccaaccgcucauuaaucaucaccacaaacacaccugaauuauucuccuuagagaacaauucacuaauacuuugacauaaaucucauuauaucucauuauauauaucauauauauauauaucauuauauauuuuucaucuuuaagagucuaguuaacuagcuggaugagccaguaagacuucuaccauaggauugucaguaugugcauuaauuguuuagauucuguuaauuaacugauuauuuagccguuaauuuuauuuuacuuuaguauuuccaguuucaaauuuaaguccuaguuuuuuucuccaaaauuccaaagauaauuauucucuuugcuguagcaaacugaagugauuaagagucacagaccuagguuaaaaacccacugacagcugggugcgguggcucacaccuguaaucccagcaacuuugggaggccgaagcaggcagaucacuugaggucaggaguucaagaccagccuggccaacaugguaaaacccuaucuccacuaaaaauguaaaaauuagcagggcaugguggcgcauacuuguaaucccagcuacuugggaggcugaggugagaggaccacuugaaccuaggaggcagagguugcagugaaccaagaucacaccauugcacuccagccugggagacacagcaauacuccaucucaaaaaauaaauaaauaaauaaauacacauuggcaucuugaguccauuuacuguguaacauucaagaaauuacucaacuucgugucucaguuuccucauauacaaauuggggauagugggaauaucuacauuauauguuuaugagacuaaaauaaaaggcauuuauagcagugccugccacaguaagcacacaauaaauaucagcuucuuuuuuguagcuaguguaacuucacugcuuugaaaaacaggucuaauucuauagauuuuuuucacauucuuaagaagugcuaggauauguagcagaugcaaccaaaccccaaucuagacauacagucagcgaauguccucucaaaaaaugggcauucccucaaccaguguacuucccucaaucagucugucuucacuuuugcaccggcaacuauacuccaaaaagguaucucucaugccugucaccacauauaaauguaaauuucaguuucaguggaaauuuacaucuauacauccagacuaucagaugacagauauaagcuuggcaaacuuacccuuuggaauccuaacaugaucagcucaguccugucucacugccuaucccauaaaagacccucuaaaguuuaauuccagcccucuguucuucccuuuaacagcauaaauaggcugggcaggguggcucaugccuguaaucccaggacucuggaaggccaaggcagguagauugccugagcucaggaguucgaaaccagccugggcaacauggcaaaacaccgucucuaccaaaaauacaaaaaaguagucuaccaugguggcgugcaccuguguccgagcuacuucagaggcugaagugggaggacugcuugagccuagaaggugaagccgagacugugccacuacacuucaaccuggaugagacagagugagauccucucccaaaaauaaaaaauacaaauaaucucaaguuugacuugcuugaauccaaaauucucucaaggaggagagccugaaaaccacaaacagcauuuucauuucaaaauuguuaauguuucuauuaaaaguguuuguuacuuaaaauguaauacaggaccgggcgugguggcucaugccuauaauccuagcacuuugggaggccaaagcagguggaucauuugaggucaggaguuugagaccagccuggccaacauggugaaaccccgucucuacuaaaaauacaaaaauuagccaggugugauggcaggcaccuguaaucccagcuacucaggacacugaggugggagaauugcuugaacccgggaggcagaugaugcagugagucaagaucgcuccacuguacuccagccugggugacaaagugagacuccgucucaaaaagaaaaaaaaaaaaaaaagaaaagaagauacauauguauaacuuacccguauuuauacacuccaaauacaacccacugcaaacucuggguguauuuccucccgaguacagcuauacaguagagccuaagauacuucacauaauugaaaucaguugauauacaauuuuauauuccacuuucucaugcugccagguuauuuccccaucccaucagaaguucuuccaaagcacaaaaacaauauaagucugccagagcacccuuaucaaacuugcuacacaauuacuaggaaugcuaggaaagauaggucuaaagguuuugauucuuucuuugguucugaucuuauguuuuuauguaaaaauauuccauauaauccuaauguccguaauuuaaaaaaaaaagaaaaagaaaaccccagaaucucaggugugcuaagcuuuaaguccaaguauuuuggcuaaugcuauugcuguauaauacagcauaauuacacagcuccuuccuuugagcaccucaacuuguccuacaaguacuucccagcaguaucauuauccccauuuuacagaugacgaugcuaguaccgcagugaugugacuugucuaaauaggaauuaucugguuaccaaugcagaaacagaaccaaaaacuccuaauauuuacugcaaaauuacagaucuaaguuaggcucaugagugcauuauaaagagcaaaugcuagagggaauucugaucauucugacgugaccccaacgugaguuuuggaauacuguagugaucuaaagacauccucccagggcaugccaguaaauauaucuaaccagcaccuuuuguccagugaucucgaagcaaguuuugcagacacuagcacuggauggcccauuaucaugcuccaaaauuacaggugggaaaacugagacaaaggaaauugaaacacauguccccaacaaucugcgauuagcacaggacuagacuccuccucucaccucaccgcaccccaaggggagccaaguaggcaaagcuuccauguggacugacaaggagagugaggacuuuacugccucuaacagaaaggaaaaauuuacuaggagagaaaaguagggugggagaaugaaaggaggaccgauuagaagccagagauagaguaaaagccaaaucuaaccagagccagagaaaaaaaaucacaauguuaagaccugcacgugaguccggugggauauaccaggucacacauacaaugauggcucaggaacuucuaaaguguuuuucaggagcuuagaggccuugguauuggacaucccaguuauacaauucccgguuugauugggucaaaccucuaaacucucaacauauaaaaugucuuugggauuauucacccaaaacacagagaauggcaguauucucucccauccucauucaagcacaaaagcgaaaccacccugagaauuuaacuccuuuuacuaauguuaagagacuucuccauccaguccauggucucauauucucuaagccagaaguuaaaauuaagaacuucagaaugugaaggcagccaacacuacucaucucaaaguuacuaaucuuagcauucaacacagaugaggcaggaaggcugcagaauuugcuaaaccagacuaaaccagacuacugcuggcgacagagucgagacaacacugaaaacacaaaggcauuuagcucaaugacaacagcuggugacaugcacaucuagaauacugaaauggcuaugacuucuuaccucacaccuugguauuucugcaugaguuuguaguucucuccucccaaaagucaaauaugaguuaaugacaugucacaguaggaaaaggauuggguaggugcaguuucaguggaaauuuacaucuauauauccagacuaucagcugccagaaaaacuguuucccuccccuucccugcucauuuuaaagguccuauuuaccagaacacuaugaagguaguaaaacuaugguaagacaaacacauacuuacauauuuucaguuuaaaaggugaaaguacacagagguaacuuccauuuagcucacuccccuaagucauucuccuuguggauuuccucuuuacaggccuuaaggugacuugcaucauguucacgcccagggugaaguguaucaucaccaccugcaaauauuucuaaaugggaucaguucuauuaauaacaaugacuauuucuaaaggcaguaauaaguaaaacaggguuguuguagcaaacuuaaaacucacaccagcaaccagcaaugaccuuuaaagaaacuuuucaucuaauuaaaguuagagaaauuuauucaagucaaauauuuuaaaugagggggccgaaaaugagaaggaaagcaaagaagagaugaaaaacuagggaaggggaguaggaagugaucaaaaaguacucauuuuuaauaucagccauuuagaugugcacccucaaaagucauggcacuggccgggugcaguggcugacaccuguaaucccagcacuuugggaggccaaggcagcuggaguuugagaccagccugacaaacauggagaaauccugucucuacuaaaaauacaaaacuagccgggcaugguggcgcuugcuguaaucccagcuacuccggugaggcugaggcaggagaauugcuugaacccaagaggcagagguugugaugagccuagaucacgccacugcacucuagccugggcaacaagagggaaacuccgucucaaaaaaaaaaaaaaaagucauggcacucuccauuuagugaauaauugagaacagaacagauagacuccccacaaucuacaauuuuaauuagucuaugauggauaucagccuuagaugggaaauaaaaaaauuaaugaacaaaaagcaagccuauuaauugauuauuugaggggugugaaggaauugugguuuucuuuuuuaaagcaaaaguugacuucugugaccuuuuuuuuuuuuuuuuugagauggagucucgcucugucauccaggcuggagugcuaauuuuuguauuuuuacuagagaugggguuucaccauauuggccaggcuggucucaaacuccugacuuugugaucugcccaccucagccucccaaagugcugggauuacaaguguuggugccgugagcugcgcccagccaacuacugugacuucuaaaaggugaauauuauaaaauucuagcuuaaccaauuucccuccgcuucaucgaauuuuggacauuugaacuucauaacaauucauuuuuguuuuguuucguuuuguuuugagacggagucuggcucugucuccaggguggagugcaguggcgcaaucucagcucacuacaaccaccgccucccggguuaaugagauuccccugcuucagccucccaaguagccgggauuacagacaugugccaccacgcccagcuaauuuuuuguauuuuaguaaagacaggguuucaccaugucggccaggguggucucgaucuccugaccucaagugauccaccugccucagccucccaaaaugcugggauuacaggcgugagccaccgcgcccggccugaacuucguaacaauucaaaagggauguuggggcccaggacacacuaccccaaaauaugacuguaggagaucagaauaugccaccccaaaauauacuuccuuggcauauuuugagcugguuauucugugaaacugcagacaccagaguagacaagaaaagcuguccuuuuguaaaagaaauuugcauccauaaaggaagucuacauuaguaaaguaucuguacuaggauuaggacugcuccagacaacuuuuauuaccugagagacuuuauccccaagagcaagacaaucuuuauucaccauauaauucuuccccucauccuccuuuaacuuguguggccaccaccccaccaaaaaccucaaacccuaauucuuuucuuagcucaguauacaauauaagcuucaaucaugcaaccugcauuacauuuugugggacucuugugcaaacauaaguauaaauaaaaugacauuuucuccuguuagagucuaccaugugucaauuuauuuauuucuuccccuccccugcccagagauggaaucuugcucugucaccuaggcgggagugcaguggcgugaucucagcucacugcagccuccacuuccuggguucaagcaauucucaugccuuagccucccaaauagcugggauuacagccgugcaccaccacaucuggcuaguuuuuguauuuuuaguggagauggaguuucaccauguuggucaggcugcacuccaacuccugagcucaagugagccaccagccucagcgucccagagugcuaggaucacaggcaugagccaccgcgcccagcuaucuagugucaauuuaaaucauggcccagcccaaagaaccuagaaggauggggggaagccauuuuucccugcuauauagcuucuggugcccaauguggagcauccuucacuggcuggaacacuacuagcuccaggacuguuccagcugcaggauccugagacccugacaaaacgccagcuguagcuaagacuuuuuaccacauugggcucccacaucuaugccugcagagucuggucaaagcaagagugguaagagucucuuugucuuuuccccuuuaucuguauaauccccauuaacuuauagcugaggaugcucuauaaguuucaaucaucugacucuucuucgagucaccagugcauaagaaaauacaauuuuuuuuuuaucuuguuagucugccuuaugucaauuuaauuauuggcucagucaaagaaccuacaguagaggaaagccauauuguguuccccuacagggauaauuauugauggaggugcugauuacauucaggaaacagaagcacacucauaaacuuuuaguugguagcaacagaacacucccuuccucaggucaaaauacacaccggcuaagaguucccuuuuguagcucuucccaacuguugauacucuguacugauaauacuaguaaaggcaucacaaaaaguucuuuccaccauguauacuuagaugcaaaacaguucaaaaacccaaaaaugucaaacuagucaaaaaauaaauccaaauuaaaaaaugcaaaaacuaaauaugauuguuagcauuuucuuauuauugugcacuauuuucauaggcucaggcuuccauaaaaagcaugugcauucaacuauacacagcagaaauaaaaucauuaauacuuucuuagugcauuccaauuuuacuuuuuuccugucuuccucugccgaaggagccaaaauguguauuuccccacacuaucacaggaaacaaaacaagggaauuccaccuaaauugaaggaugucaaauucccaggcauagccaagcaggaugucaaaggucaugccccauaucugaccagcccaaaauacuauuaauauauuuauagcuagaaugaauaaccauaaauccaaaagcuuuagccugaugaaagauagaaggggcauuaaaaauuaaguuuucuaagccuacauggauaugcuguccuaguaacauucagguucauuugcacaauaaacaugaucuaacaagucauuaugcucuaaucaacagccguugaugugaugugccuugugcaggucugcgggaaaguggcugcuaacuuguuucaggccagaguaacaagauagcaaccugagagagcagggacguccccuggagaaguaggcuuuugugcaaaaagcccaucacaaaccuuaagguuuaauaaaagucaaugucauuuuaagugagucucagcaagccacacagaaacaagccucauagggcacaugacuaaguggaaagggguugucuucauuucaaauccaaggaguguauucacacaguuaaggaucacagacaauucugucuugaaaagaaucccucugaugcauuacucuacaaucugaaguguuuuaaguucucauuuuaucucucugacuuaauuacuucuuccucccaauacccuuuaaaaucaauucucuaaaaaaaugggggguggggaguauaaaugaggcuuaauuggaggcccccaaguugucaaucaugacagaauugaugacuucuguggaugaaaguguuuuccuuuucccuucuugccauaaacacaggcggaagucaugguuagucuaagaaacauaaccaucaacaguuugucuuugauuaaaaugugucccuauuuucaucgcaaaggaaauuauuaaguaggguccuccuauauguucagcauuuuacaugacccaagaucauuuacaucguucaaugagaucacagagcacaauaauuauuuuaauuuuuuucuuaaaaauauaauguauaaggcauacaaucaaauuagguaauaaauucagaaauugacucacuucaaacauauacccuccaauugugaggaaugagaaauucaccauaaauuaugagcuccaucuguacugauauauucccuucauuuuauuccacauuccccacauucuucaccucuaguucagaauaaagcaaucacaccaaagaaugcaauggcacaaacuuuaacauucaaacuauuacaggaaaggggucccaauccagaccucaaaugacaguucuuggaucucccacaaggaagaauucuggacgagucccuagaguaaagugaaagcaaguuuauuaggaaaguaaaguaauaaaagaauggcuacuccguagacaaagcagcccaagggcugcugauugcccauuuuuauggcuauuucuugaugauaugcuaaacgagggguggauuauucaugccuccccuuuuuagacuauauauauagaguaacuuccugacuuugccacagcacuuguaaacugucauggggcuugugggaguguggcagugagaacaaccagaggucacucucguggccaucuuuguuuugguggguuuuagcuggcuucuuuacugcaaccuguuuuaccagcaaggucuuuaugaccuguaucuugugcugaccaacuaucucauccagugaguuagaaugccuuaaccgucugggaaugcagcccaguaggucucagccucauuuuacccagcuccuauucaaaauggaguugcucugguucacacgccucuugacaaaacuacuuuuuaagagguuugaaucucaauuaagcugaacagauuaagaauguuuauuucugaguuaggcaccaaaggaaggacaguaggcuaaaaagagaucacaaagaagggcagugacacccugaggguccacuccucaagcacagggacaggccgauuccaagaccaaccuaaacacucaagagcaggcagguaauuauugaagccugugacaaucaugcuuuuuaaauuguuauuuuaauaaucuggauucugcucuuguuuagcuuugguuuuuguuguuguuaauuguuguuguuuuuugagauggagucucacucuguuacccaggcuggagugcaguggcgcaaucuuggcucacugcaaccucugccuccuggauucaagcaauuguccugccucagccucccgaguagcugggacuacaggcaugcaccaccaugcccagcuaauuuguguauuuuuaguagagacuggguuucaccacguuagccaggcugaucucaaacuccuaaccucaagugaucugcugacuucaagugauccgccaaccucagccucccaaagugcugggguuacaggugugagccaccacgcacugccuaguuuuuuugguuuuuuguuuuuuguuuuuuguuuuuguuuuuuuuuaagaaacauggucccaguguguugcccagccuggacuugaacuccugggcucaagggauccucuggccucagccuugcgaauagacaagacuacaggcacacaguacucucucugccuggauggacucugcuuccuuuuuauaaaaaguacguucuagguacaguucagaacacugaaaguaucaaaauggcacuucaagaaauacaaagcaccuuaaagaaauacccagaauuacuggaauauaauucccuaggagaaccacuacagagcacagaggucacagcagggaaaguauccacuccaaaaccagaaaagaggauaucaauaacaucaaaacaugccuaauuacaggaaucuuuaacccugauaaauuuccuuaguaugaauuuuuuuaauuauaccaaauaacuucaagagaggaaaaaauaaaacauuuugaugaccucuaaaauguagucaucaacugcuaaauguuuaaaaauaguguuuuaucaucaucagaaagacuucauguuaauacaaauacaugacauacaaauauacaucuaaauauacauuauauuuauaacauaaauauacaucuaaauauacaucauauuuauaauauaaauauaagauuauaaauaaauucagguccuacaaaauucauucuaucucaaaauuucacaaauucaacaaacugcuccaggcacaccgguaacagaagagacugggaguaugggaaucuuucaaauucaacguauguaaaugucauaaugggccacugaagagaaaauuaaauccuaaaagguugaaggggagagaccaauucagucauacagauugaagaacucucaggguaggaugauccacaggaagcuuucccauucaccacauguaaauuucaugauggccuacauaccuacccauccagagagaaaaguuuccaaugcaaccagcuuggugccaaguacacaaacaaccccaaucgauauuuacaaguuuugcaaguuccccucuccucccuccccacuccccguuuaggagguagcccugcagagagagaguucugcugcaaacagaugagguaacuguaauucaagagagcccacuuucuccuguauucaaaucacaguauaguaugaaugauggcaggcugaaaccuacugguguaacaaacuggugauucuuuuuuuuuuuuuuuuuugaguuggagucucugucgcccaggcuggaguguagcggcaagaucuccgcucacugcaaccucuggcuccccaggguccgccaacacgccuggcuaauuuuugcauuuuuaguaaacacgagguuucgccauguggcccaggcugguaucgaacuccuaaccucagguuauccacccgccuaggccucccaaaguacugggauuacaggcgugagccaccgugccggcccaaacugaugauucugcaaauuaaaccucacagcucaugaaggcacaucaucucugauacaaaauuauggugacugaacaugccuaucuugauguuacuuaugcaacucuauccugaagguuagagaagagaaaaaaccuuuuucaugucaaaauagaacaauaaaauccacauugugaccguuacuaccucaagaaucugccaaaauaagagcuucuagcuaaaccauaugcaaaccauuuccuuugaccuugcuuccaagcaaccaaaaugucucaaguauuugacguuuacuuguaugaaccacucccaaauauuuaugugguuauuuugcuuucaagcuuugaaggacacaacauuuacaagccugggaauuaggugauucaauuauaauuucucuuuccaaacuaaauuugaaaucuaagugcauuucucuuuuuuuuuuucuucaagacaagaguauugcucugucgcccaggcuggagugcaguggcacaaucucggcucacuguaaccuccaccuccuggguucaagccauucuccugccucagccucccgaguagcugggauuacagacacgcaccaccacgccuggcuaauuuuuguguuuuuaguagaggcaggguuucaccauguugccaggcuugucucgaacuccuaaccucaugauccacccgcuucagccucccaaauugcugacauuacaggcacgagccaccacgcccagccucuaaaugcauuucuuuucagguacagaaugcagggugccuuuucacucucacccuugccacugcugcaagaugaagacccucucauucugugcuggggauuccucacucaaagagggguuuucgcucagccacuugcauggcaggcuucugagccugguacccgcagaggaaaugcacuaauuuuuuaauuaaaaaaggaaaaccaauaugaaaggagagggccgaaacacugaggagacaaagcccagugccucccggccucagcuaacucuucagaauaccaaaccauugaagaaaucuuuaucuucccacauaaugcaaacugguuucccucuuccuccuuuccucauuaggcccaaauaagacuuaggaggauuaaucaugcgcauuggcuuuuuuacugcaguuacaaaauacaaccacagagguucccucccuuuccugaugccagguucacuuggcuacuuucagauuuuuaacugagcaaaaacccagccccucaccaguaaguacuuuguaaguacucaccaguacuuacaaaggcaguacuauaacaccuucaagauggggaaaccacgguuuuaaacagaaacacauauuuucccucaacauggaugcuuuaucauaucucuaacauaguaagaguagagagucacaaaaccaugaccuauauuuuccagacuguuagaacagcaauugagaaaaacuguuuauccaagaaauaucuuuaaugaaacaaaaaagaacaaaagcauacaagggaagcccucucuuccacccucuuucucaucacaguuuugcccuuaucagauaagacagguagggguuccagggcuguuaagcucaugggguauaucauuaggaccagcucuguaacuggaacugcucaaagaaugaaugacaucuuuauuaagacaaacaucaucugaccaggcucgguggcucaugccuguaaucucagcacuuugggaggcugaggugggcaggucacaaggucaggaguucaagaccagccuagccaagacagugaaaccucaucucuacuaaaaauacuaaaaaaaaaaaaaaaaaaaaaaaaaaaaaauuagccaggcguggugguggccgccuguaaucccagcuacucaggaggcugagacggagaacuacuugaacucuggaggcggagguugcagugaaccgagauggugucacugcacuccagccugggcgacagagcgagacucugucacaaaaaaaaaaaaaaagaagaaaaagaaaaagacaaacaucaucuagggagaaaaauacaucaacgcagaaaaaaaagauuuucuuuuuaggucucgaagaucuguauacaagaugcuggaaccaagucacacugaaaaaguugacagccuggaaauuucuauauguggcuggccagagauguauaaagaauacaguggggcuuacuggagauaacagcacuucccagaugaggggugcugcaguguagaccaaggggccacgacacuuuagaggugguacuggccucugagaaggcagaggucucuaagaauuaaagaacuccuaugacuuaaggucagcagagauaggcuaucuugaaagaaaugaucuaccucccuucccugagggagauaagaacccucagggaacccucccuucaaaauuagaaccaagaugagaaugaaguugaaggaugaagauguuuuauauaauaucuuuacuuacaaaaauuaaaagaccaaagaugugcuguaauucugaacuucacuggaucuacaaacaucaauaguggucggcagggcgugggggcucaugccagugaucccagcacuuugggaggccaagguggguggaucaguugaggucaggauuucgagaccagucuggccaacauggugaaaccccgucccuacuaaaaauacaaaaauuagcuaggugugguggucucuacuauuacaggugugccuguaaucccagcuauuugggagggugaggcaggagaaucgcuugaaccugggaggcagagguugcagugagccaagauugggccaccgcacuccagcuuggugacagaguuagaccccaucucaaaaaaaaaaaaaaaaaaaaauuagacuggccaguuccauauuguuuccuaguugguuuugacuaguuuugccugacaucauuaacaaucaugcaagugugagauccuggugcgucugaaagcuauuuucuccacguggaagguaacuuagacauuuaauaaaaccucacgguagugggcuuuuucauuuauuuaacugucccccaccccucaucagcaauguaccuuuuaaauaaaaugucugcuucuauagggauaaauauauuaguaaaauaguuuucuacacuucuuuuuuuuuuuuuuuuuuuuuggcagagucuugcugucgcccaggcucaggccggagugucguggcauaaucucagcucacuacagccuccaccucacaggucugaggcauuuucgugccucagucucccaaguagcagggaccacaggcaugcaccaucaccacuggcuaauuuuuuguauuuuuaguagagaugggauuucacuauauuggccaggccaacuccuggcuuccagugaucuacccaccucaaccucccaaagugcugggauuacaggugugagccaccgcgcccggacagcucuccucaacacuugccauuucuaaauggcugaugaguguuauuuaaucuacaacugugccuucugaugugccacaaugccauuuuuacugcauaaaccuuuugguucaacaugagcuagucagacucacuccaaguacacuuaacaguuaauacauucaguccuauuggacuguaauggugucaguuuugcauuuggccuauccaaauuuaaccuccucuggaucuauugaaauaucccauuauaaucuucauucuugcauuuggguuagugggaagauaauuauugcaauaagaaagccaucaaggauaucuaauauuuagcuaaggcaauauuagaacugacauuuacauuuugaaguaucuuuucaagccaauauaaccuucccucauaauugccuuaaguauauuuugaaauugcugacuucaauucagaauuucucauuuuucaaaaaagcaagacuuaauuuaauaguaaucuuucuuucuuugaaucacucugcuaccaggacacugggccucacugaaguuaauuuuaaagaacagaucaagcaaaaagcuaaauacauuguaaaugccaacuauucacauuaagucaauuacauaaucuguucuauguauugccaaauuccguaugucaguuucaaaaucaacugcaguacacuggcuauaaauugcauuccauaggucuccauauuuacacaaguguguuccuaaguaguugcauuuuaaaauuguuuaauguaaucauauuuucauaauuucuuauuuggcaaaaacaaagauaucauuugauaaauuugguccauaacacagcauuauuuucauaauauguccuuucuaccuauacuuuucaaacuguuuguguauuucacaugccuaucacucugagaaauuuuuuuuuuuuuuugagaccgagucucucucugucgcccaggcuggagugcaguggcacgauccaggcucacuguaagcuccgccuccuggauucacaccauucucccgccucagccucccgaguagcugugacuacaggcacccgccaccacacuuggcuaauuuuuuucugucuuuuuaguagagacgggauuucaccguguuagccaggauggucucaaucuccugacuucgcacucagagaaacugaugcuucccauauuuucaggccuuuaugaaugccaguccaccaucccaaaaauauaucuugaaaauaagaugaacuaauggacagaaagaugugcauuuacacagauauaugaucaagcaagcauaaugaaaugucauuaguagaaaagguaguagaaauucuuccaauuuugcugaaugcuugaaaauuuucauagcgaaaucguaagggaacaaucucccauccuuuuuuuucuuuuuuuuuuuuuuuugagaugggagucuugcugugucgcccaggcuggacuacaguggcgugaucucggcuaaccgcaaccuccaccccuccaacccccugccccaaguucaagcaauucuccugccucagccucacaaguagcugggacuacagaugcaugccaccacacucacuuaaucucuucuauuuuuagcagugacaggguguugccauguuggccaagcugguuucuaacuccugaccucaaaugaucugcccaccuuggccucccaaagugcugggauuacaggcaugacccacugugccaggcccaaucucccauuuucaaagccugguucaacggccaauacagaacuucauuuuucucuaagacacuuaacucuucccacuguauaucauaguuacuuacacauugcaucuagucuuccuacuggaucuauguuuugagucauugcuaccacucaaaaacaccuagcacaucuuguacacaguaauuauucaacaaauaaauggaaaaaaaaggacucugacaaucuguugaaaacaaaauaaucacuguucuuuaguuauacuacuucuuaaauuauucucacaugauacagacugugauauucucaacacacaggaagcugaaauauaaaagacccauguaucaagaaagaauuuuuuuccuaacaacauauuuacaauguaacugagaagccaagacauacagacauuaaaguuaaauuauauauaauacacagcagcaugaauuaaaagauuaccagauauucacucagaggacaaaaauuccucuggguaggagccaagauuggaaguuggugaacugacuugaaccuugcacacugagcaagaucugcugaauuucagggcucaagaugaucuaagcucuggggacaggagcgucuaggccugaaauacuaaaagcuaaacgaggggaaugguuagcggguaggaacggaaagucucaacagacccugagaaagaagaguuaacagacuugggaacacuaaacaccaggagagugcucaagaagacaccaagguuugaaaacuagggaaagaacuaacuagaccauuaacccaacuggggaccuugaaaugagccaucugagggcagggggaaauacaguauguucaguuuuagacaugcuggauuugagauaaaagugggaccuccagagccuuuagguaacuggauacacaaggcaacagagaguaaguuaccuaagaaaauaccagagaaaaaguccacaacuaguccugagguauacuuaugaaugaggauaggagaaggaaaaauaagcgaaccaacuggagaagccagauggcaggaggaccauuguaauggaauccaagauaagaaacgauuucucaaagcaaagcuaagaaaaggaagacguggccgggcgcaguggcuuacgccuguaauccuagcacuuugggaggccgaggcggguggaucacaaggucaggagauggagaccauccuggcuaacacggugaaaucccgucucuacuaaaaauacaaaaaaaaauuagccgggcgugguggugggcgccuguagucucagcuacucaggaggcugaggcaggagaauagcgugaacccgggaggcggagcuugcagugagccaagauugcaccacugcacuccagccuggaugacugagcaagacuccaucucaaaaaagaaaaagaaaagaaaaggaagacuuaggcugggcccaguggcucacgccuguaaucccagcacuuuaggugggcagaucacgagguuaggaguucgagaccagccugaccaacauggugaaacccugucucuacuaaaaauacaaaaauuauccaggugugguggcaugugccuguaaucccagcuacucgggaggcugaggcaggagaaucaccugaaccugggaggcagagguugcagggggcugagaucacgccacugcacuccagccugggugacagagcaagacuccgucucaaaaaaaaaaaaaaaaagaaaagaaaagaaaaggaagacuuagacacacacacgcccaacucucauaaagaguguagcuucagggaucaucagaacaaaaaccagaauugggggcuacacaggcuaauucccuaaacagcucucccuugauuuuuuuuuuuuccuguaaugaauauggcuugaaauaaaggacacauuuugaacuuauguccuuauuaaaguaauaagugaagguaaaaauucacuaaauuguaugaugaggagcugcagauuuaccuuuuuaguaguauuugacuuaauaucaaaacuaacuugcuuuuuuguuuuccuuuuuaguuuuuaucaaaacuauacaaaaauggaugaaagaaaaaaaaaguagcccaaaugccugccaaguagcaagaauaagucaacccuagauucaacuauuggcggugcuuaaccuacaaguugauaaaccacagggagaagacggaauagaguaaacugggaugcuaaugaauaaagcaaguuuuuaaaaaggcugaaccauauaaaauagccaacguacaaaaauguguuuuucauguuuccuauguuccuuagaagacuacaaauaacaaguaguaauaccuacaaaagaauuucugugccacugacuugauuuuuguucauccucaucagcaacuggcaaagaggaagaugucuuccacacucuaaguauuuguacacagcauaucccuuaggcaucaaaauacauacuuuuucaaguacauguggucuucuguuucacagcugaggaacaccaccagaagcaucagaauucuuuauguaccaagaaaaggugcuugguuauaugaccccagggagauccugggggggcugggcaagucucugcaaguuguugcuacaaaggcaaaggcaaaucuugaacugcagggaagcagaccaacucccacacaauugaaaauucugccuuccccaaucacuaugugguauuuacacugccuuuccaagaggauccccaaaaagccccaaagcuacagcacauauaggccaaaaaaauggcuggguaaauucccaugaugccagggaacuggguaguuuccaagggcagaguguuccagaaaaaugcaaaucauucaggcuuccccagagaaauuccagccaaauacagcugcuaucuuagaaagccuaacacaaaacugcaguuuagaugcuuggaugaaggggcuagaagcacaaggacaggcaacauguuuacagucugcaaggcauucuaacuugccacugaauauucuucccccucaucccauuucguaucgccucggagaagauuccuugugugugcggagcaugaaaucuaugugucugcugcuaaugugauaccuuuucagcaauuuugggaucuugaagaccuuuaacuuuuuucaaguuuacaugagaauuaaaaugccuuauuuucaauagucaaguguuugucacuuaaaaaaaacuaguccaugagcaguggcucgugccgauaaucccaacuauucgggaggcugaggugggaggaucacuugagccaggggcaggcagagguugcagugagcugagaucaagccacuacacuccagccugggcaacagagugagacccuggcucagaaaaacaacaacaacaacaacaacaacaacaacaacaacaacaaaaaugagaaucauucaaaaagaggccacucuucucgccauccccucaaccaaggacaugccacaaaaccaugcguaaaaaguaaagcucuugggagucugaaaugaaguauuccaauuuggcaucuauuuuggaauuucugaacaaaauguuuuagcucucaaauagauucagguaacuuucagcccuuaauaagaugcuacauuuagcugcauaacccccucauccauuuuaaauuauuucuucauuaucgcuuccccaaguacauauacaggauuaucaaggcuuucuucuuuuuuuuuuuggagacagggucucccucuguugcccagguuggaggucagugacgugaucucggcucacugcaaccuccgccuucuagguucaagcgauucuccugccucagccucccgaguaguugggauuauuggcacgauagcugggacuacaggcaccugccaccacacccggcuaauuuuuuguauuuuaguagagaugagguuucaccauguugcccaggguggucuugaacuccugagcucaggcaauccgcccaccuuagccucccaaagugcugggauuacaggugugcgccaccacgcccagccuaucaaggcuuucuuuaagguaauuucagugacaauccagaaguaggaaagaugucucagauccucuaaccacucggucucaccaggauucucuaagucaaaugugaccaugcaacaaaaaagcagccaucuuucuaacgggaucucuguggcugguucaauuacucaccuauagauuauacccaaauuacagaauauuuauuucaaaacauaaggaaauccacugucaguucauaggccaaauaagaaacaucacucccaauuaaagauuuaucuuaaaaauaaaaagcuuuggggccaggcacgguggcuuacgcauguaaucucugcacuuuaggagaucaaggcaggcagaucacgaggucaggaguucgaggccagccaagccaauaugugaaacccccucucuacuaaaaauacaaaaauuagccaagcaugguggcacgugccaguagucccagcuacucgggaggcugaggcagaagaauugcuugaaccugggaggcggagguugcagcaagccgagauugcgccacugcacuccagccugggcaacagagugagacucugacucaaaaaaaaaaaaaaaaaaaaaaaaaagauauuuaucuuuaaaucaaagaggauaccucuaauaaaacaaucuaaaaauuuauuuaacaagaguuaagugguauagucaaagucauucuuuuaaccuaaaguguuccuaauaauaucaaaagagucaacucaaaacugccauuuauuaaaaaaaaucagaguucaaacuaccacuucccaagcuuuagaaggcuuucuaugugaaaaaacaggucauggaaaugaaguuucauuauuuauaaauacugcacuagauuuagaagaucccggguuuuccaaaagucuuagguuccacuuugugugugaccuuauagcaauucuagccaauauuacaacaaguguaagacauuuaacauaccauccccacaaacacaaaaugcauauccuucaaauauaaccagcacuuaacuaucuaaagaaugacauuaaaaguuuuugaauucauuaacaguuuuccaacuaguuuguccuaugcaaaugacucaaacuuucaggcaggccccaggaagcagcacacaagaaacuauuuaauuaaagauucagccuaauucccaguaguaaaucacaggaaauauuuugugccaaagcaaccucuccucgguccuaaaacaguuaaguuuugguugcuuugcauuuaaaaacuggauuuaaguuaaaauucauaguaaaauuucucuuuuaugacucuuagaacaggagucuuucagaucugagagugaaacuugguuuuaacaaguaacucauuuuuaugaaacuaaccaaaagacuaguuaugaguuagaacagcucagguuguuucuuuucuucuuaaaauacccuuuuacucaaacugaaaauguacuugcugcaaucagacuuaaaccaacugacauuacaccugaaacacuuacucauuugagaaaggcagccuacuccaaagcaaagccccauuaggcucccacugggagcugcccaagggccuccaauuccagacagauaacuuaacaggucuccuagcucuggcaaauaaauuuaaaaaaaaacuaaauuauucuugcauuuuuaaaaaaaucagaacaagaaccugauaaaaaugguuguaaagaugauuuaacaucagaaucuauuuuuuaaaaaccuaaaucuuaaaaaguguaagcauauuccuaguuuaagacuaacacucugacaaugccauuugagacgcaaaacuaaaaauaucccaaaacacuuccuuuaucuuuaaagaaaggcacuccagcaaguugaaguagguuguauccauuuccaaggacuaaagaaugguguaaguacacacuguacuuugaaugcaaaaaaaggggggaggauuuuuuuuuuaaauggcuaauacucuguaacagcugaaguggaauugauagaugagcaaguaagucaaguacuuaaauucaaauguuaaguaaaacaagauuuggcagacaauuucgauuuugugacuuaauagaauauaugcugaacuuaacgguaagaaggcacuuuacuuuuuugaaacacuugguaaaauugcauguaaugccugguaaugaagcgauaagugauaccuuuacucuaaaacacacuuuggaaaaaauaaaaugaaucuugaauuccuucuaaaggaacuucaauaaggugugaguaacuuaacccuuuugacacgcauuaaccacagggaugacacuguguguaaaauaaccuugguguuaacaacugcgcagcaaagaccaaucuuuauuaugccguggaguccaauaugagaggcgaagaaagguauguuuuaaaaagguguuuagcucggccgggaacgguggcucacgccuguaaucccagcacuuugggaggccgaggcgggccgaucacgaggucaggagauccagaacauccuggccaacauggugaaacccggucucuacuaaaaacacaaaaauuagcucgacgugguggcucgugccuguaaucccagcuacucgggaggcugagacaggagaaucgcuugaaccagagagucggagguugcagugagccgagaucgcgccacgguacuccagccuggcgacagagcgagacuccgucucggaggaggggagggagguguuuagcucaacuagacagccuuuacagcaauuccgccaccggugacagugagaaacugucagcuuggggaggccgcgccacgacuggaccccgcccccgggaagccuccccggagccgagggcccccgggccuucuccucggagucgggaagugccugcccccacgcuaagucucuccuggccacgcucugaaaggcaaaaauggcaaaaauccuccuucaaggcaccgcucccucgacgcgcaccgccacuccgacucccucaaaacauuggucgcaaagcccccccgccugguccuccaugcucaagaauaggguggcaaggcaggaaaagacucacacaucccagcccccggccccucagggcagccucuguguuucuaacuaaaagccuccuaccaggggcaagaccaaguucgggcgcuuccccgcauggagaaacgcuggccccacggcgcccggccccgacgcgcuggcccuuuaaaggcgcgggcuuccugcgcccggggccccucccacgccaccgccaccgccaccgccaccgcccgcgcccgcccccgccgagggucacacuugaacuuuagcucgccccgcgcggccaggcgccggcgcuccgcaggcgguggccgccccuucgcacgugucggaggcaccaccucgggcucgggacgccgggcccccggcacucgaggccacuccggagaaaaccaaaacaaagcaaaaugcgcaccgccuccagaaacugcccggcaggcccugcaccguccccggccggucgcgcccugccuguccccuccaccugcagcccggucccggggcagcgaggcuccggggccccucgccgcgcccucccccgccgcgcccggcggaaacagcuccgcggcgcggccggagagaacccgcccuccccccgcggagguccgggagggaaggggcagccgaagcagucggcgcgggccggggguugccgcucccagcgaaccccuuucuccuuucacuggcaaacuuuucggccucgcucugacguccacuucuuggcgcacuuucuuuacuuaguuccccaacgagccccuuaccgcgucccacgcgaacuccugacuggcgcgcacgcacaccuacugccguccccgaccggacccgggcgaggccaccgcgaccaccgcuucucgcccgcccuccugggaacgcgcugcccuccugcuccgcaccuucaggccgagcaaaccugcacagcugcgcccucgccugacccaccgcgcccccaagguccggccgcgcgccgaguccacucaccuuccagcccgccgagcuguugcugucacccuuauccuugaaguagggcacgcucuugaccauccacucguagaucugcgacagcgugagccgcuucuccgccgagcucucgauggccuuggugaugaggucggcguaggacagguugccccacgcguugcggcgggacgagcugcucuugcgcggcugccccgcgagcggcccagcggcggcggggggcaccggcgggugcugcgacagcggcccgggcggcgggggcugcgguggcgcugggugcaggcagcccgccuccgggcccuggaaguccccgcacagccccccgguggcggccgcggcggccgccgccgccaccgccgccgccacggagccgggcgccugcgggaaguccucgcucuccuccagcaagcucagguugcucaugaagucggcgcugacagcggcagccgaggccgagggcaggcccgccgcggcgucgggguuggcagccgcgcugcccgacggcgccgggcuggagguggccgaguuggacuggcuaaacuccggccugggcagcggccaggugcacgagcgcggccggggcagcggcucgaaguccgggucgaucuccaccaccugaggcgccucggccauggugacccccgccccucccccagccgcaggagagccaagagggggagaacgcagcacugggggcggacggggagggggcgcgaagggacgguccgagauuugggggaacgaagccggugcggcgagcggacggaaacugggaggaaggcgcggcggaguggaagcgcgagcccagaacuuaacuucgcggggccauccacaucgaggcuccucgggguccgccgcacggacuggacggccggccagagccgccgggccggggcagagccugcgccgcgcuccagcugacagggccgcggacggaaggacggacggacgccgcgggccgcuugcucuccccagcggcgcgcccgcugcgcugcugccuguugaauguggcggcugcggcagcggcugcugcgacuaccaggccgcccgacuuacgggaucugccgccgcc

SEQ ID NO: 21369 - RNA, 315946 nt, Homo sapiens
gggagaggcaggcagagcccagccggccgccugcggcucaguaccgaccgugccgcgucgccgggcucugcguaccccugucucugcccaggcucccgcaaaacuuuuauucucuggggcccccggggugugugaaggaauuggaaccuuccgccaucuccgcgcuccccuucggcggcgaccgaggggaccugcgucccucguccgccgggcucuggagcccugcgccucaccugcugaucgcucuccggagucucgagggggcacccccggagggaccgcgcgggcgccggcgccccugaacucucccgcucaccgcggcagacccgcccagcgcaacuuuaacuugauucuucuugcccaaccggggcaccagcggcugcugcugcggcggcugcugcuaccgccgccgccgcggucucacaaaggggcucagggaagggaggcggcgcgggcggcagggacgggccuccgggccgccgaggcggggagacaaaagggaagcugccucugcucgcgcugccugcucggagccgcuugcucggcugccucuggcugggcuccgcgauccucucccccacccucgggcacugcuccgccucccucccggcgggcuguccccgcagugcucccggacccggcgagccuucggggcgcgcgucgcugguggugguugaggcucuagcgauaauaaaugauagaggauacaaugacuuugcugucucugcugggucgcaucaugcgcuacuucuugcugagacccgagacgcuuuuccugcugugcaucagcuuggcucuauggaguuacuucuuccacaccgacgaggugaagaccaucgugaaguccagccgggacgccgugaagauggugaagggcaagguagccgagaucaugcagaacgaucgacucggggggcuugaugugcucgaggccgaguuuuccaagaccugggaguucaagaaccacaacguggcgguguacuccauccagggccggagagaccacauggaggaccgcuucgaaguucucacggaucuggccaacaagacgcacccguccaucuucgggaucuucgacgggcacgggggagagguaggagcuaccccggggcuuuguauuuguguccguguaugucucguguguguguguguguguguguguguguguguguguguauaaacaacaggacagcgugugcgcagcgggagaggaucugggugcgaggggcguggugaugacaccacggugccuggcuggacaaaugcggcucaaguugccaaaagcacugcuggauccagacuucuuggugcugaggguccacuuuagggaaaggagagucauccacagcauauuuguugcuacuuaaugugagguucccaaggccggaacccagaaaacacugugcuaguuuagcaaggagaauuaaugguaucuccagugaacuuuggucccagaccccagugcccuuguucuaggguuugagcugaacuaggcacagagaaggaagacaauaucuuaugcuucauuaggcaaacaggcuauaucugcagagcgagcucauugagggugaaggaagcugugacuccuucccaucgccuucacucuagggaggaauccgaggggcagcucugcgcuucuuuccaacucuaucaacuuuacaagugcaaucgggccaauugacaggagcgccucgcuggccgcuuguuuucacuaggaucucagagcgggaccuagaugucccuggccuuugcagagguggcuaugcccgcaaaggaggcggugcuuugaccucacccuugcgcccuggcgggcuuaggggugcagacgucguccugcuucuagauuccuuuguuugugguucaucuggaagcaggagauagcuagaggccaguucaguucccucucccacauuucuguggcacccggguugugcgcugaggcccagguuuccuggagguuaggcaaagcuuggcucugguccuugcgcauuggcccaggcaaagugagaggcaaauguggcucuagcgccaugcuccaaagaacacugggccaaucaccccaucucucaaauuggcgguuuguaacggguucauugcugcauacucuuuguuuucccuuuuggcagcauacuuuucuuauucuuaaccccuuccuguuuuugauuacaccccucccccgaacucccauacaaguuuucccccaacuuucuucucugcccucugaucucuggguaggcuguagggaacugcagggacugccauucuuuuucaagcauuugcuuguucuuuggccuuuguuuuggguaaacauugagaaagcuuucaacuggauaucuuauccgcauuccuuacccaucacucugcuaaucuuuucaugcuacugugccuaccuaccuuguagaaccaacuuugccaagaaugacaaacuuaguagaaaaacucauuugguagaacugaaaucaguuuuugccauuuuccauccacucuagcuuuuuuuauauuguuuuuucagaaugcagguuucucacugguuguaaauuuguaaccucuuggguagugucgggguccccuccccuuggucacagaguaagugaaagauauaaaauuaauugagggaaaaaaggcuguguacaugggcaaaaacauaucuuaaugacaaaguugccaguauaauggcugauuugucuucuuggcuugaagcagacuaucuguauuuucauuuuuuugugccuaaauucaaugagggugaaggaagcugugauuccuuccuuuguaaaucauuuaacaagcuuauauuuauuauauauuuuuauauuaaaauugguggcuggugauaaucugcuucuggucuuagaaagcacaguuuuaauuuuauuaaagauuugguuguaauaguaauguggugaaauuuuggguugugguugucugggugugaugcauuggcauaguuucagccuugggcuaaaaagguguaagugauugggugauuuaauuuuuuuuucuuuuaaguugauacuguaaaaccugaaaguugcagaccaaaacacuuuucagguugaaaaauuucuaguaguaucuugugguaaauguaccauccagaaaagggacacgauaaaugcuuuuauuuuacuaaaaguauuuuacacguacauggcuugucauuaaauuuuuuaacugcaaaugaaaagaugauaaucuuuagccaaaccaugaaauacuuuucuuugugccuuacauuaaaaagcaugcuguuugcaaaauaauugauauuaucaguacucugaaaaauagaguauuuguucuguucauaaucccuuaucguauguagccaguuaguucauuuuggcuuuguuuuagggcaaaauaaggaaagugcuacaaaaggaguuacuuaauugcuauugggaguauaacagugacaaauaauauuagauaauuucucuugcuuuuucuuuauauaucauucaaaauccuaccaucuaauucuuguguguuguuuagcuccuuuaacauucaccagaggagggugccacuguuugauuuuaguauagaugauguuagcuccugucacagaagaggaagcuuuuucugaacuuucuauuauuuauguauauucuagcucuagaauggugcagacgauaaaugaggaguuuaauuuuauuucuaauaacucacacuaguaagauagaccaucaaaaacuagggcccgucuguaauuguaguacucuuuagaugcagaggagacauuaccuuguauauccuuguacauccauuucaucuguguauaucaauuucaucccucacccuuuuuuuuucuuuuaagcugagaugcugauagcuggagaaguugugaccuuccuaaggcuauguggcuaguucaaggccuucaguuuguugaucucuauaugaaaccacuggacaaauuggcuugaauauuuaccuagauagauggugcccuggggauacaagggugaaugaaauauaaccccuauccucaaaaaguuucagucuagugagagagauagaccucuacaccaaaaauuauagucauggugcgcuuagaguguuacggugacacagaggagggacauuuaaaucagacugguagguaggaaggcccaggaaaaaacgccuugaagguauuguuuacuucaagauuagcagcauagguuuugacuugagaucuggcuuugaaucugugcucugcuuuauucuagcugcgacauuggacaaguugcugaaacagcuuuaucugggaguuuauuaucuaaaaaauagggauaauaaugccuguaaggugcaccuucaucaguuguauuauacccugucuagagaaguaccuaaaggagagaaggauauggaagaggaaaggccaagaagaccaagaagucugcagugcuggggcagcacuauucaagggagagagacucuuccugugugagccacaacuuuuaucucuaugaagauguauguagugcagggauaauuuauuagcuaucccccaaacucucuauaucucaagguucuaacuuucaguggacuccugauuacuaauucaggauuucaguuauccagauauuugagaaaagugugucauggcuuuagguguaaauuuucuuacuagucaaaaggaauauucucuaugauuaauuaagaaauugguauucugauuuguacuucagccucuuaugauuuggguuaccaugaguuaguucucuugagcauauuuaacugugaauucuucggcaaagauaugucucuggacuuuuuaugcugaggaccagacucucuagggcuguggcuucuucuagauggaugagauuuuaaagagccuuaucucagugguccuacaggccagcuuccucccuugauucuaaccaugauacuguguguggaugguucacaguguguguaugugucuaaagguauggcagugauugucuucuuauauaacaagauuaaaacaacaaaaagguaaaaaggagcucguuauauaaauugauguagaaagauuauuuuaagauaaaaaugauuuuugucuaggaaaaucauuguuuuugugcuuacuuguaauuuuuaucuacaggcaaaaggugguuuuuuuuuuguuuuuuuuuuuuaauaccaucuagaagaaauaucaccaaauccuuuggcaccucuaucaauguucauggcugaagccuagcuagaagaauagauuguuaugugcuccauauguucaugagcacuacucuauuaaaggucuuauguaucuugauaauugacacacagcuuggccagugguuaaagcccagaguuccacauuuugcaugagggagaagccauacuucaagcgcuugccagggacugcagucuugaggcucagcacuucucagaagcucagaaaauaaacuccuuauggaggguugccugaagaauauauauauagucuuauucuuuagaucagugguucuuaacuuuucuugagucaugcugcucuuugagaauguuaugaaacuacagacauauuccccagaaaaaaggacaugcauaucaaauuuucuuuguaguuucagagacaaguggaugcaugaagccucugaauuucagauuagucuagauagaauaaaaucuguuuuugaugcaucuagcucugcaaggaacuguguaucugaaccccuugcuuggcccuccugcuuuccucuccaucauuugcuuuuauugaauuguuugcugucauuugccugugaggguuguuuggaggaauagucuccuuagcucugagaaauaacugcaagaauguuguugaggaaaucauuuauuauauuauauagugucauuuuaaugaggaccaagggagaaauaguacucuauuaccuauuuaucuuaaggaugcugaauuauguaacugauugggccauccuggguuuguuggcugcuacaaguauuaagagccaaacgccugaccuaccucuagcaaaugugcagacuuuuauggaauacauucaucugguacaugaaccucacuccuaggacaguuuaucuuuccuacacucaauuuuccuuuaucccauuuguauuagcccguuuucaugcugcugauaaagacauacccaaggcugggaaauuuacaaaagaaagagguuuaauggacuuauaguuccacguggcuggggaagccucacagucauggcugaaggugaaaggugcaucucacaugguggcagaccggagaagaagagagcuuguggagggaaacuuccccuuauauaauuaucagaucuugugagacuuauucacuaucaugagaacaguaugagaaugaccugccccaauguuucaaauuaccucucacugggucccucccacaauauuugugaauucaagaugagauuuggguggggacacagccaaaccauaucaccauuuuucucuucucuuagauaugucauuuuagcuuguauuauauguauuuauguaaguuucauugacuccuucugaaauaagauacacuucugaauaaauaaauuaugacuggcacagugaaugaucugcuuuucagacauuauagcuacuguuaguaaauguucggcuuucacauuaugauguauaagaggccuagggauuuaguauggacaaaugccuuaugguuuaagagaagauucugauuauuuugguuuaaaauggcacauuaaaguuucugcaaaaaauuuuuuuuucaaugaaacccuccuuccuaugccugugcuuaaagaccuuuuuguaugggaauguaggaaccugacugcugaccuugcugcgucuucugaacagguuguuaagaaauucaguucaauuaagccaacauuuucuguauaguuuggcaccugugaaaagcaguguuauguucuaugugaugucuaaagaugauuuggugcauucuguguccucagggagcauucugucuacuuggagagaugagcuuuuuuuaaaaaaaauagcagaguuacaagaugccugccaccuacaagugugugauggcuugacugaaggagcuugggaaauuuuggauaauuuugaagaggaacugacauuuaauuguauccuagcauuucuguagacagcgauuggguggagaaaggaggggaagaugauauuagagauugaagaaaaaauauggaaaugguacagaggaaauaaaaugcaggcaccguuggaagaaggcagguagucuuauuugucaggaguaggcuuuccccaacgguaaucauucuagaagcucauucauuauuuuuuuccauauucaaguacccucuguguuuugauauacuaaacuuauuuuuaaauuaacuguuuuuuuaauguuaaguauauuuauuugaaaaagaaacuucauaucagcaccgggaguggaaaaauccaugaaaugaaauucuuggccuuuaaccugcugagaugcugucuccaucuugauggagcagaaugauucuaaaaagauuuaucuccuagucucugguugucucuagaguuccucuauccuccuccccuugcuuuuuuaugaggagaaaagguggcuuuuaaaauuuaauugccagccauaauuugaagcaaggcagccugcuugcucccuuugcagguggagagcacuuccagugaugccacuuugugaggagcucagguuuggaguaucccuuuccgcugugacucauguggcagagaagauuuuauuuguaucaugccuccaugggaaacacagaguuaugggcaguguuucagcauagauuccauccucauuuuuaaugcagguaaaugggaagagauuauaggaauaaaacugauauuuuucuagcuaguuuaaaaaaauaaauaauucacaacuaagguacuugaaccauuauggauaacacauugcuugugacauaacuuacaaugacaaaaauauaccagcaugcuaggucccccuguugagccauggccugggguuugggauacacacaggugaggagagugggagaugcugcuggaacuauuagcacuauuauugaagcugugcugaggagccugggccauguucuguauauauuggagaacuacuguauaggaauggcauaaauuccaugcuuuaguaauccuguuccuccaaacuauguggaggauugauuugaacuaacaagauagaaguauggggggagagggucaauugggaagcuugagacagagcagugaagaugaaacucaggagcgugggccauuguugaaagagagggagaggaugugaugggaguggauaacucuugaggugguaagacugaugucaggguuugcauaacuuuuguuaccauuuuaguaauucuacuuaaugaaugucaaaauaaaucuacagcaaagccaaauauauuuuaaaguaaacuaauuuuaauauuauaaaaauaauaugacuccaugauagauauuacagaaaagaagaaacauuccuccaaaucucauuacccugucacaucuacuguuacauuuuugguguauugcuugcuggucauuuuguuuguuuguuuguuucuuuuuuaggggguggggugggcaggaucuggcuuuguugcugaggcuggauugcaauagcaccaucauagcuuacuacagccacaaacuccugggcucagaugaucuuccugccucagccucaugaauagcugggacuauaggcaugugccacugugcccagcuucaccuuuuuuaaaacaauaugcauuuuaaauauaauuuuacauaauuauaaaaauauacauauguagauuuaaaucuuguuuuucuuuguauaauucuauaaacauacugucauuuugcucuauaaugcuuuauauuugauuuguuauuuauuuuaauucucccucucucucucucucuuuuuuuuuuuaagacggugucuuguucugucccaggcuggagugcaauggcacgaucuaggcucgcugcaaacucugucuccuggguucaagcaauucuccugucucagccuccugaguagcugggauuacaggcacccgccacuaugcccagcuaauuuucauauuuuuuaauagagaugggguuucaccauguuggccaggcuggucaugaacuccugaccucaggcaaucugccccccucggccucccaaagugcugggauuacaggcaugugccaccacgccuggccuauuuuaauucuuuauauuuauauuuugaguguauuuuuuagugauagagcaauauuuuauugaguagauauuugagaaauuacucaacugcuuccuuauuuguauacacuuaggcuccucuaacuucuuaccauuguaaauaccauuguaauaaauauuuuuguguuucuacuguacuuuggauuauuucucuaggguggguuuccagaagugggauuucuggaucaaaggaauaaaggagaagccaccauuauugaugguaauaacaauugcuaacauuuauugaguauguauaauaugccaggcaguauuuauaaaguacuuuacauauguuaucuaauuuuaauucugauaagaguuuaugagguagguacuauauuaucccccauuuuguagguguagaaauuaaggcacugagagguuaaguaauuugcccauggucucucacagcuuguggguggugaaacuaggguaugaaacugccauucagacuuagagcucccugucuccaaagccuguuccaucaguuuuugguugaagcccuacagaucuccuaauuuggucaaugaagugcugauaacauuguuauguggacacugccuagucuucucgauuugcuuagugggacuuugguuuucucauaugacugugacaguugugucucugugacagguggugguguuuuugaaaacccuaugcugcuaaccuugguagguugaucuuguaauuaccuagaaaaguccuguaguuaaaaaagauugggguuagaagucagagcaggugaugcuucacauucaaacaucuguucuaaucuacccugcuucuuugcuggcagaaucucuaucccacuacagaaaaucugcaauauuuuugccuguuggcucaugaaaggcuuucauagaaauuauagugguauuagcauaaccagucacaauaaacaaaaaugacuuauauuuuauuuuacuucagaguaccaaaggcuugacuuuaggauaaauauguaggaguguggauguguuugcauaacuuuucuuuauauucaagcuucgacuuuuuuuuucuuuuucaggaucaaaacaguuuccuauugcauauauuguuaauuuuaagcagcaaauaucauuuucucauuuguuuauaauacugaguugguauguuuaguuugaguggaugcuaauccugcguuuucauucuagaaggcuacuuaauacauuauuuucuuagccaaacuuaagucaagccaagcuuugguuauggcuaguuauaaucuguuuuuaauaggaauccucaaagucaaaguuuaaacaaacaaaagaagccauccuuuucaaaauaguuauuguaaugauaaucccuuuuauagcuuuguuuuauaguuuuaggcccuccucugaaaaguacagagcauuuuuauuaauauuuauauaggcaaaaaucaugcauauugauaaacuaauauauuuucaauaaaguugaagucuaugcuaugaaaagcugcuuaaaaagugaagauauaugauauggucugggucuggguccccaccgaaaucucaucuuguauuguaauuuccauguguugagggaaggaccucguggaaggugauuagaucauggggggacuagaucauuagaucuggggauuagaucauuagaucauuagaccuucuugcuguucucaugauacugagugaguucucaugagaucugaugguuuuauaaggggcuuuuccccucuuuccacuucucauucucucuccugccacucugugaagagaugauuuccacuaugauuguaaguuuccugaggccuccccagccauguggaacugugagucaauuaagucucuuuucuuuguaaauuacccaaucucagguauuucuucauagcagcguuaaaauggacuaauacaauauaauauuguacuucugaaaaaaaaaagaagcuacaagucuugaucacuugaucucucuggagguuuuuuuuuuuuucccuucucuuucucuguuucuugauaauagggcccaauugaauggaaccuuagcugcuuccaacuuuucuggaauuaaggagggccuugauacucgagucuguuaagauugagacuuaaccuacuuucuuccauuccuagaagacaagagaguuccugucugccacugggcgugaggcuccugaaggcaaguuuggggccauugcauaccauagugcaagauguacaccguacaguguuacuagguggagagacauuauuuucuaaugugugcagagcugucugcuccccaagcuaggcaucuaugggucuacaauaacuuggaaacuuuucuaguuuguacagaagcuaaaggcgccguagcaguaggcuguauuucugagacucacagacuuuuuaccauaccauccaccauuagugcccuccauguccugcucuuguaugagcagcugacagaugaugaucuuugugucuuaguuucuuuuuuuuuuuuuugauauaggauauuacucugccauccaggcuggagugcaguggcaccaucucgguucacugcaaacuccaccucccaggcucaagugauccucccaccucagccucccaaguagcugggacuacaggcgugugccaccaugccuggcuaauuuuuuguauuuuugguagagaugggguuuugccauguuacccaggcugaucuugaacuccugagcucagaugauccacccgccucggccucccaaagcgcugcaauuacaggugugagccacugcacccagccugugugucuuaguuucuaaaucaaagaccaguugucuauugcaugucaauaaaccuugugacuucucuggaguaguaaacacuuauuugcauuugcuuuucaacauuauuguugcaaauuuuggucauuauaaaugugaguggugauuuaaugcccuguagcaguaaaucuuaaauauuucaaauuguauuuuuaagaagagggucuauauucagcacuacucuuggacagcaaaguuuuuaaucuaaaauaugguauaaaauuuauucucuuaguuaugagauugcaauagggcagaaacuguuuuauucugauaaguguauaccauuucuuuuuaaucuaguaagugcuuucauuuaucguuuuaauuaaaugaauuaauuuucaguuaaauuagucacuggauauuuucuggccaaauaagucucuuaaugacaccgucaggauuuuacagaaauugagacauggugggaucuuugaucguaguguuuaucuuuuugcuccauagauaaugaagugaauuuucuauaacagcugguuuacauaguuauaugauagauauguuccagaguuugagauuaagaaguuuuuacuucugguuuauuugagcacuuagauguuuuucuaaauuugucuuucugaguuuucucucuagauaggucuggcagggauuuuugaauugucauguaauccaaauauagugccuaaggcuucacagcuacaugaaauaucuauuuuuaaggacuuucaucaaggagauuccacauuuucccuggagaauuuuuuucacuauaauccuuucucucaagaaauucaucucuguaugugaacuaggucccucugguuuaagacuauuucuucuagucuggcuucaucagagagagauaaagauuagauuguuaccauuuuaaaacugguaaaacuaugauauuaauaauuuuuucucuucccccaaaauuaaauauuaacauuaaauuuaugugagaaguacucaucucaagaagggaaauucaauguaauuucuacuaaagacagaauaguuucuagauaaucaguaguggcuccuguuuguaaagagcuagucuggcaauaaggaaauguccucuuacagaucgguugguuuugucuguuauaagucucuguugucagagacuuaugcuacagguggaguggguucuagcuggccaccuagaugguacauuauugggaaguuuuugguugcaagugacagaaaacucaaguggaagcggauuaaacacuggagacaguuauuaucucacauaacaaaaggcccaaaagaggcuuuugaucuaacagcucaauaacuucaaggcucugguucagugucucagaaauucucuucaguuuucccucaugguuccaagaugugauacucugaacugcugcagccaucuuuguauaacuacauccagagacaugagcaggaaauuauaucugucccguucuuuuuuaagcuucaggaaaccucucuagaaaguacucuucacaucuuauaguccauagcuguaucacaugcucaugccuaaaccaauaacuuggucaugggaaugugaucagcaugauuagccuugacucaucauaauucauucugggucugaggaggagcccagccucuggaggacaugacaacuuagaaaggugaacaaaacuagaauuguauuagcuaggaagaaggagaaguggaaaugguuguugagugagccacauaguugggaaggggguuuagagaauguugcuuguucugcacguuaguaaccucauuggagaauguugcuguaaaguguauaacacugauaugggggaaaauagacuuuagaggacuucagaaaagaguaaaccuucuuauuuuuggauugucuuagggaugguuuuauuugggagcugagacauaaauuugguauuuuagggccccaucaagucuuaagaaacuacuaguagguguuagguuggugcaaaaguaauugcaguuuuugccauuaguuuucuaacucagguuuuuuucuccgcugugugaacuagugaucaggaggggucugaguguuuggagaacaacaagguggguuuuuuuuuucucuaauauauaucuguauucacuauaguuaaugcugcugaugaauguggaaauauuauaguaguucuucuguuggcuauccauuuuuacuuuacuaucuccuguuuuagaugaugaauuuguuggucaaauucaguaggauuuuuguucuuuaauuauuagauauuguaaguguuauuuuguuuuaaaauauucgaaucuacuccaggccaaagaggggauuacugggaggguaggaauuuuuguacccauuucggagggggacaaccucgcaauggucuaggcuacagugagaagagaguguaaaagacuuuucgguaggucaaaugaguguacuuggaguaaauucuguguaugaggaugaaguacuuauccuucugcugcuacuauaaacugauuacaaugagaccaucuuuucauuauguuuucucaucugauuauugucaauuuauaaaaaugcuuacugacucaacuuccuauuuagcuuuaguagcauuucuggugauucauucucucucuacuuucuuuucuuuucuuuuuuaaaaagauaugccauuauauugacuacagauaauguaauuuugucuccuacuuucuagauaguuguauuuuuuguuuuuguuuucugccucauuucauuaacuagaacuaacagaacaauauuuuuuaauacugaugauaguggauguuaucauguuccuguguuugagauuauuuaaaaaguuugagauaaagggaauguaaaaaugccuucaguuuauggauaauggaguaaauuuucuuuacugauauagugaaagaugaaaaccuguagaaaguaagagccaaagaagaaaggauauuuaaaguauaguaauauagagaauugauaaucacagaauagacuagaacuuauauagauguaaugguaaaaaccagcaugcaucgauuacauaacaggaagaacaaauacuguaguuuuuucuuuggagaaaaguaucaucacuagauccaucugaaggaaaugaccuagaaagcauuagucuaaacaauaggcagaauaucugacugcacaggauaacgauucugcacguugaaagaccuaaccagauaugcucaggaauccugcccucugguuucagaaaagugggagcucuggagccauuuugcccuggcacuucugcugguuuuggugaaggucauccuuauuuuuucuaggauuuccugugcauaagauccuugcccuaguuucuacuaucuguccuguaaagaaauaguggcugcuugcggaggagucucauacugagugagguuagguccugaguugguauaagagacaaagucaugucuagucaaaaucucucuugaaagaucccucaaauugcccauaaagagcaguguacaugauuuugcacaucuuacuguguagaguaauauguaauuauaaauguguaauauccaaaguuaaaauuuauuccaaagaauaaaguauauguauguaaaauauauuuuuauaguguuuuaaaugauauagaagaguauuuugaauuuguauaaauuuguaaaugguaccauuucacuacaccuucuauaaaguaauagaauaaguaauuaaauaauauuuugagauuuucaggcaacuuuccggaacuuuucuuuucuuuuuuuuugagacaggucucacucugccacccaggcuggagugcaguggugagaucucggcucacugcaaucucugccuccugggcucaggugauccucccaccacagccuccugacacacaaccacaccaggcuaauuuuuuauuuuauuuuuuuguagaaaugggguuucaccauguugccuaggcuggucuugaacuucugagcucaagcaaucugcccuccuuggccucucaaaguguggggauuauagucacgagccaccaaggcuggcucuuuuuuuuuuuuuuuuuuuuuuuuuuuaaaaagagcauauuaaauauuucugugugugaucaguuggaggaaauuuagucucuuaaaguuuuaaagauacgaagcagaauaaacaugugacuuuggaguugggaguaagauuaauucauuccgauuauauuuuuguagucaguuuuaggaagauaauuguaaugccauauugaaagcuuuauguuuaaucuaagugccagccauagcuuugacaccagaugggaauauagagaugggcacucagccuguuaauuuauauucuaaauacauggaaaaaguuuauauuugcuguuuguuuuuuuuuucuuaucuauggcuugaaaccuuggaggauuuuauucucuaaugauuucagaagagagaccaacuggggauucugaccuuuucccuacuuuucuggaacucuucugagcaucugauaugguaccuucaggccugaccuguuuuuauaaaugccugggccuggauuugucuaggagugagacucacaaagcagcaaauaauuuuuggaaaggaagcucauauuuuuaacauguagggggaccugagugucugcugcugaagaagucaugggguaaagaacugggaucccgacaguggucagagaagcucucuauaccuucauauuagagccacaggcccugaucugauucaugaaacuacacagagacagaaauuguuuauccccaaaggauuauguaaugcaaacagauuuagacaugaaacaguacaggcaggagcauacuugggaaauauugcuuaaaagggaauucuucagugaaaaagacagcuaguuuuuacuuuccucucaaaaauaggauggcaacaggagugcuuggcugguguuccuccuuuagcaaaaacagguccucauuccuuagccuccaugguggcuuuaugauaaagggagaaggucaucuaauacauacuucauauucaaauuuugccaauuucucuggcuauucuuuuaaaaauaucuuuacugaaguaugaugcauacaauaaacuguacaugcuuaauauaugcaauuugaucaguuuuguuauauacccacgaaaccauuguuacaauuaagguagugaacaucuccaucacccucaaaaguuucuugaugcuucuugguaauuccuuucuuuuuccauucuccuacccuucuccuucaucucuaggcaaccauuaaucuacuuucugucacuauagacuaguuugcauuuuguaaaacuuuauauaaauagaaauaugcaguauguagucuuuuuuucuggccuuuuuuuucucagcacaauuauuuugagauucauccauguuguuccacuuaucaauauuucauucauuuuuauugcugaauaguaucccauuguauggauauauaucaaaauuuguuuguucaucacuuacuggacauuugaguuguuugaguuuuuggcuaugaaccuucauguacaagccuuuguauggacauaugcuuucauuucucuuggguaaauaucuagcagaagaauggcuggauugugugguagguguauguuaacuucuuaagaaacugcucaacuguuuuccaaaaugguuuuccaguuguuccacauccucacuaaucuuuuuaauuuuagccauuguaguaggugugaagcaguaucucaauguaguuuuaguuugcauuuuccucauaacuaaugauauugagcauauuuucauguauauuuuagaagaugucccucuuuugaagacgcagagagaaacaguuaucaaauuaugauuaucucguaaaaucugacuuuuguccuugccccuauaaugagugaaaagagagaaaaaaaggcaaaagggaaaggggugauuggccugacucucucuuacugcgaggaaagaggcugagaaguacagccuagaaauaaguauggagagagguugugcgggguaaccagggaaucagauggaaacaaggaggguagaaaagaaagauuagggccugugccaguaccgucaguguguauuaucagauucuucuguuuuuuaaagccuuguuuccuuauauuccauguuaaaaaucugaaugagacuucuuuuagaaaagugcagaggguagcauggacuauuuacagugucugcuuucuuccuacuuaccucauuuccuuuuuccaucugacacuuuuucagacuugaguuuuugaagaucucuaggagccucauacuugucauaugugagccuguuuucagcucucaucuuugauuuuuuguuggaucuuacuuucuugaccaccucucuuccagagacucacccccuugguuuuaaugacaccaccuauguuucucugcuccuucugugacuucucugugggcuucacuuccuucaugagucuggguuucaagaagggcugugcucagugugcuggucucauuuuugcaucagaaucuuuggagcuucuauggauucagccauccuuucugagcacagggcuccccuuccuguuuauagcccacaucuuuacaugcugacuuuacuauuuucuuucuggaugucacauugauaacaaccugccugaaaccaaauuuaccucuuuugucccuagauuaauuuccucuccagaguugucuuuucuucucauggucgugccuuuauucucucaguccgccacuccugaagcugcugugucauguuuuccuucuuccuucuucaugcaagucugugagaauuucuguaaugccugucacuccugucuccaucuuuauggagacaugccauaaagaugguacugccaccaugcuaauucaggcuuucaacacuuuacacuaggauugugacaguggccuccucauggucacuuugucucuggcaucucucuucuucaauccgcucagugaugucucugauggauaaaucuucuauuaauaaaccaacuggauuauauauuguuucuuuuuuuaaaaaaaccucugauuuucagcaaccaugauuuauuucucugaaauuuuggguucucauaauaguaucccuggcuccuuuaucuuauucaaucuuaccuucuguuguuugccuaugcaaaaguccgcacuacagcaaaaauagucucuacuguucacugaauaccugauggauacacaugcuugcugccgcuuuguuaacacauagccauggggaagaggaugucuuguccuuauuucaagguuccccucgauuuccagcucuuccauaaaauguugcuuggucaugucagcucucuccuuugaauuuauggucuguuauaggcaaucaaacauuuuuguguuauuguuuguuuuuaacuuaauuuuccucuccaaccaggguucaccuuucuugaguuucacaucucuauuguguuccagugauaaugauaccuugcaauaauucuaaaaauaaugaugucuaacaaaugaaaaggggauaccaagcugucugauugcauuugcuaucacuuaugucuguuggaaaucaaagggcuuugcucauuuugacuguuaagugucugcaaugugccagguacuuuuagugguguucucucacaaaauccuaaugguguuugaggcaacgguuguuauccccauuuuacaguuggggaaacugaagcucagacuacuaugugcccaggguuauacaacggcuaaauggaagagcugagauuaaaauauuucccaugucugucugauuccaaaagcuauccuguuccagucccaugcucuccuuugcugugugccaauaggccugguuuguuaaggcauucauauagggguuacaccauuagcacucaguuucuagcauuguagaugaucugugggaaauauuucaagguuaugggaauggaaauaaauugaggagauaauuuauuuauaccauucacucauguuuauucucuuugcuuuucuuauuaccccucacagcuccugcaguguaaggucuauccaaaaguccuuuaaauaaugaccaggaaaauguagauuaaauauguauauaggauucugaaaguuauccuaggcaagugguuuucaucaguuugacagguaacucuauuucuggugugaggcaagaaguuugagaauugggggcuggcuccucagaggaagcuaggcaauacucucagauuuaacucagccugccauugagaaggugguucaauuauuugguuaggaguguuauggauuacaguacauuagacgugccugaguuuucaaacguaagugcaagaacacguccucaaaaguucaaucuauaguuucccuuccccaaacgaucaugcaaaauaaaauuaaacauaguauuuagugaauaucaaaaaguggggaaauguaaaugaaccauaucagcugccuggggggcagaaacagugauuuauagacuugagauuuagaacucaaacauucuugguuuguacucaaggaagagcgucauuagguaaguugcauggcagaacagaaaagagcuuacugauagugugggaauaccuuagaaaggaauaaaaaucaucaccuuuaucuaauaucucucucacuuuauauauguguauauauuuguuucuucuacauuaacuauuaaguugaaggaauuacauuuuagaaaauguugauuaugaggaauugguagaauucucauguacaaaauggacauuuucuacuuuggggagcuuuaugaaucauauugaaaauuagaguaacugaguucuuaacaaguaacagcaacagcuacuucuuaacuccuucauccaugggaaacagaaguugcuuuguguguguguuuguguguguguguauguguguuuacucaugcaauuauuacugaucaccauacuagagaaagauggucucauaggaugaaaauaugauguucccuuaaugauuagauuaaacuucccuuggcaguguugaaucuaaacugaaaaacauuuuugccuuccuuaaauugaguaggaguuauggcuaugaauauuuagacuuauaucaugccuaugauauuaugguuuacuuacuguaugucuacuuucagauauacugcacuaccuugguacuaccuuggugccuuuuuuuuuuuuuuuuggagacagagucucacucagucgcccagguuauagugcaguggcaagaucucagcucacugcagccucuaccucuggguucuaacgauucuccugccucagccuccuguaacugggacuacagacacaugcuaccacaccugacuaauuuuuguauuuuuaguagagacaggguuucaccauguuggucaggcuggucucgaauuccugacuuugugauccaccugucuuggccucccaaagugcugggauuacaggcgugagccaccaugcccggcccuugguggcuuuuauagaaugggugcccuauaaagguuugucagauuaaucucaucauggaaucagagaagauuaauacuauggagggucuuuguuaaccuuuccauuucuucuaguaugaaaguuuaagcuaaauaauuucugcugggcaugguggcucaugccuguaaccuuagcacuuugggaggccaaagugggaggauugcuugaagccaggaguucaagaccagccugggcaacagagugagaccucaucucuacaaaaauuaaaaauauuagucaggcaugguggugcacaccuguagucccagcuacuugugaggaugaugcggagguugcuugagcccaggaguuugacguugcagugagccaugauaauaccacugcacuccagccugggugacagagcaagaccuuaucuauauaaaaaaauuaaguacauaauuuuugauaugugcucuuuuuaaauuguaaaaaucauguaacaaaauuuaucauuauaaccauuuuuaaguguacaguucaguaguguuauauguguucacauuguuaugcaauagcuaucuagaaguuuuuuaucugggagaacugcaacucuauaccuauuaaacaacucccuauuuuuuccucccuguagcccccugauaaucacuauucuacuuucugauuucugugaauuugacuacuacugcauauaaguggaaucauucaguaugugucuuuuuugugacuggauuauuucacuugguauaauguccuaaagauucaucuaucuuguaacaugugacaggauuucuuucguuuuuaaggucaaauaauauuccauuguguguauauaccacauuuuguuuauccauucauucauucauugauagauauuugaguugcuuauaccucuuggcuauugugacuaguacuaggaacauaggugugcaaauaugucuuugagauacuacuuucaauucuuuuggauauauuuauaccuagaaguaggauugcuggaucaugugguaguucuauuuuuaauuuuugagaaacugccauacuguuuuccauaguaguuguaccauuuuacacuccugccaacagugcacaaagguucaguuucucaacauccuuggcaauacuugauauuuuauaauauuuggggaguagccauuuuuaauggcugugauaucucauugugguuuugauuugcauuuucucuaaugauuuguguaacugagcauuuuuuaucugcuuauuggccaucauuuuauaugcuuguuggcuuucuguaugucaucuuuggagaaauauuauuuaaguuuuuugccuauuuuaaaauuaguuuuuuuuugucauuguugagugguaguucuuuauguaguccagauauuaaucucuuaucagguagauaauuugcuaauacuuucuccuauauuucuaauauauuuuuauaacuuuuuauauugauauaauuucaaacuuacaagaaaguugcaaggcuaguacaaggaacuccuguguacccuuuguucaaaguccucacuguuuuuuuaaggagcaucuggguacuugaaauuauguugagccaaucuaaacacacugaauuacuugcggcugugggagagauaaaaauacaaaaguggucccugucugaauaugcaaaacaaauaggaauguucaugaagcagcaaguacagaugagacuaagauagaauaacuugaauuauuagaacugagagaccugucccagugguucucagcauggguucauuugcccucacaaggggauuuuugauaaugcuugaagacauaugaguugucacagcuguggggagcaugggggaaaguuguccaauguguagaggccagagaugcuacuaaguauccuacagaacacaggacagcccugugcaacccaggaauaggacuauuucacagaaaaccugucuugagaacuuuaaaggcuuugagcccagaagcucucucaaacucauucuaagugcuuggugaaaacugugguugguaaagaauaugguaugaaaaacuauuucuuuuuuaccuuuuugugcauaauccacaauaagagggcucaguuggucuguuuacuguagguuuucuacaguaaacagucuaaaaaugcuuuguuuucccugguuuuauuuuguguuauaguccuguuuccuguuauuacauuuuuuuuuuuuugcuacuuucugcuguaaaaaaaaaacuguguaaacgcugaaaaaagcaaaugucauuagacaaagaucuugaagcauagagaaagaaagaggugguguugggagaaugugacuuaaauggcuuccuuucaauucucaguuuacuguggagaagcuaggugucaguucugcuuuaucacugacuccagaaggcagagaaggggauagaaauaguaugggcauuuaaauccuguagaucuggauuugaaucaaggcccauccauuacuagcugucugaauuugagcaaauaacuucuacacccugaacuuagugucuucuucuuugcuagggggauaauaucugcuucacugaguggugaggggcaguggagugcagugguuaaugauguggacucccacaccuaauugccuggcuucuaaccuucacucugcuacuuuuuuuucuuuuuugagacagggucucauucuguugcccaggcuggagugcaguggcaccaucucggcccacugcaaccucugccuccuggguucaagcgauucuccugccuccgccucccuaguagcugggauuacaggugcccaccauuaugcccugauaauuuuuguauuuuuuuuuuuuuuaguagagacggaguuucaccauguuggccagguuggucuugaacuccugaccucaggugaucugccugccugggccucccaaagugcugggauuacaggcaugauccacugcguccggccucugcuaccuuuuaguuaccugcccuuugguaaguuuuacuaguuuucuaggccugaguuucuucaucugaaaaaaugcgaaugauuuuuuuuuuaguauguaccucauaggacuguuaagacauuaaaugaauucauacauguaaaguacuuaaaguggugcauggcacauaguaggcacucauaaaugcuagcuuuuuuuuuuuugauacugggucucauuccuccauugcccaggcugugauaacaguggcaugaucacugcccauugcagccucaaacuccugggcaagugauccucccaccucagcuuccugaguagcugggaccauaggcacaugccaccaugccuggcuaaagcuauuuuuuaggauuaauuugggacaaaggauauaaagagcccuucagcaucuagcaaauagaaagugcuugauaaaugaucucuagauauuuaaauuuuaguagcagauaguuuguuauaauauaaugccauuauaacaaaauuucaucagccccugaaaaauuagugggaaccagucuuaagaagucuuuagaaugcaaaaagggaaguggucauucuuucacuuccuacuuguaccuggcaaaggcuccauuggauccuuauucagaaaugugcuuaaggaauugcaggccuagccagacuucuguggaauuauaaaaggcuaauaaacagcugcuugagugcauggaguggugaggaagggaaauagcuauuacucuaguucagcuuucaugacaguacccuuguuggugagaaaguggagcagaaguaaagaaauagcauggaguuugauuccuuucgaacucuauauucguccucaggaugugggugugugucaagguggaagaaugggccuuucuuuccuacuugauagcacaggagauuuagacucaauaguuuaugguggggccaaccaucagguuguagcaguuccugucaggcagauauuggguuguagacagacauauuuuuagggcacacaugguucaguucuuuuuugaaauacaagaauauauuaucuuguuuuaagauaaaauguauguaaaggguuuaguauagugccuggcauugugguauuuuaugaagaguuagcugucaucaucauuguucucuuuaacuugauguuuuauuuuagugaagaaacuaaugaagucuuuacucuucauuuagcaacucuguuucccucuuauuuauuuuuuacuuucuauggaaguacacauauuaacagguauacguugcuauucucuaacuuaaugaauuuucaccaacagaacauuaccaguaguaccccagaagccccacucauguucuacuguggucacuaucccuuauuuuuuaggaaaagaaugguuuuucuuuuagugauagagcgacucauggcuuuuuguaaacucuuaauagcuauggcugacagauauagcuuagggauggccuuauuauaugcuuuuauuuucuuuggcuuuaaaagcaugucugcuggaaagggauuucaguccugcagauuguuacauuuagacaugauaggcugagugaucuuguagaucuuccucgccaaauaggugagguguucuuugcuuuuauuuguauauacuauagaaguccauggaaaccaaaaaguuguccauuguauuaaaagaaaaggaaaauggccuagcugcacagaccucuuagauguccccucuaaaagcauuucacauucaagagagcucagggcacaugaaagaaauccugugguggaggaaggcugcacaaugcugggugcacucauuuccugcaauaggagagaugauuaggcugaaggaccggcaacuucuagaaguaauggacuacaguguguuuacccugcuuuugucugcgcauauuuagaaaaccagugguaauuuuucagaaggcagcuucucagaggaagccuaacgauauggggguugagcuuaggcccuuuauauaucuucuuuuugaaaucaaagugcagaacauguucauucugaaacacccuggacaugagccguaccuaugugucuuguuuaacuuccugugcccagcaguggcucugcuaaaauacuguauauguauuucagaaugucauuacuuauuuuuggccaguguuuuguuccuuaagauuuauuugguuuuuaaagaaauugagauauaauuuacaugccauaaaauucaccacuuuaaaguguaugacucacugguuuuuaauauaguuauaaggcuuuauagccauuaccacugucuacuucuagagcauucucuucacuccaagaagaaacccugugucuguuagcagucacucucccuauucuguuuguuuuuuuuuugccaaauaaauguugucaugauuaucucuauuacauaggagccugucuuccgcagagugucaugacaguuguuugaccuuucgcguauagguuuaucacguucaccuuuuguucuaagguugauggagguugcaguuuucagcacuaccaccaccaccaccauguugacugaaauuauuauaggacauaaaaugacaguguguuacucacaaucacuugugaaaguuucagugcuuaugaacaacagacaacugagcacugugcagauuucugacuaugugacaaaguuggccugugcuuuaaaauuuaaugaauagagaaguaaauucuucugggcuauguggaaagguuuagauuuauuuguuucuuacacuaauuaguuuuuugaaaaaaaugcauaaaauguguucauacuuacacuuauuucugaaggacuggaauugguuguuccuaaacuaacaugauugacuuucuuaaaaaaccucauuuauaauuuaaaacuauuuugaaucuguguuuuuauuauuccagaagugauauaugcuaguugaaaaauuuuaaaaaauacauagagcuuagaaauguuguaaaguaaaaaaagaguucuuugucauccuuucacuuuagaguuuaugcuucaaauuuuuaaaaaugccuaauucuauaaccuacuugauucuuugcucaguuuuuaaauacuucagaaaugcuuguuuauugaauuguguuauucuuuauuuuaauacuguuugaaauugaugaaaaacuuuaaaauuuuugccuuucaaaguggugauugcuaagaaaaacucccagugauuuuucuuaaaaauuacuuugcccucuucaugggccaguggaacuucugagcaacuauagaaauguacauacuucaagaccuggaacuguuuaucaucaaagaaggccacaauccuuaaaaaggcuuccuccuuuagagcggcuuuuauagaaaggcuucaggacccaaugacuuccaaagucacaucugugucuuuucaggcacaauuguuucaucaugaugaugcuacauccugcaguuauauuagcacauuaaaaaaaaugauucucaggaaaagaaugacauuuaucauguccugucuauagacauuaaauaauggaggcugggugcgguggcucacgccuguaaucccagcauuuugggaagccaaggcgggcggaugaccugaggucaggaguuugagaccagccuggccaauauggugaaacuccauaucuacuaaaaauacaaaaauuagccgggcgugguggcgggugccuguaaucccaguuacucaggaggcugaggcaggagaauugcuugaacccuggagauggagguugcagugagccgagaucucaccauugcacuccagccugggcaacaagagcgaaacuccaucucaaaaaaaaaaaaaagaaaaagaaagaaagaaagaaagaaauuaaauaauggagguaucaaaauucugugguuuaaagaaaaaaaauucuaugguugacuugauugacuaacaaaaguaaguaguuaccauguucccccucuggauguuaaaugucucucuauuucucuguugaaucccagcuuucugcauuguguccugaguuucccaaagucuccuuguaauuauguagggaugccuaacuuagaacuauauucuaaggaaucagguauugaacugaagaaauaucugauaguuagaagagauggcucuaguaguaagauuuuugaagauaccaaaaaagugauuuugaagagaauccuacauuuauuuuagguuacaaguaucuaaaaagaauauaauuuaugugaauuguuauuuaaacauguuggauuucacuauugccagaaccuaauaauggcuuuaacaucuuugaaagugcaacgauguuuucauucuucuagguuaacuuguagcaauuuaauaauuuuaauguacuucauaaugcuauacuugcuuuuaaaaaaagcguaccuaucuauauucacagauauauacugauaccuauauguguauauauuuucacuguuucacuauauguguauauauuuaaaccauuuaaaaugguuuaauacuguucuaaucuaccauacuguuucauucacauauaguaucauuuacuagaguugugugguuuuuggaaugugacuugauauugauaauggacuggaaaaguuguaaagagccaagcaaaucaucuucuaccauaugaauaguuaaucaggaauaagaguuucuugcagaaaacuggagcuuuaauggauauuagauagcacucacuguugaaagagaaaauggaaagaaaaaaagccacacaauguaaaaugaggucggguuacccauacugcuuuugcaauaaaacagagaagaauuuguaggcuuuaaaguuuaccuugugaguuuaacaaucuacaaaaggcuggacuuaauacuuauuaaaugucuuuuaaaaaaugguuuuguuuuucucucccuacaugcucucucacucaaagacaaacccauuuccuauguaaucacucuaucaaacauuaauuuaucucaacauuccuuauuaugcuccauaagcacugaauuuuguaucaaucaguggucaguugguuaguugaaaggaaaguacuuuuauuugucccagauaaaccuuauuuaagggaagguugaaggaggggagguugaagaaaaaaugugcugaucaacaagcuaggauuggaaagacaaaaguggugauuguuugggaaagaguaugucaggaaacuacucugaccagucuaucuggcucugugguuguucugagggugacuggaaacuuucuaagccuuuggcacacccaguaaauuguugcucauauuugaagacuagcacuggggaguguguuuaguuuuauccaguccauuuuuuuccuuaucuccuucaacaaggauuuauacaguguuugcuuacucugcuagccacugugcuagguguuaaacacugugguuagacuguuagaagugugcuucacagucuaaguauccacauuuuuauagaaaagaauuuuaaaguucauuucuuagaauauuuugaguuuucuauacauuuuuaaguguuguauaagaaauaauaaauuauuuuauuuaguuaaaaagaaaauaguuuauuauuuaaaaagaaagauugauuuuguuacuaaaguaccauaaaucugaaagcaaaaugaaggauguauuacuuuuuauaacuuaaaaugcucaaacuaaacauuucaaacagcauaaaaaugcucaauaaaaaacuuaaauuuucuucuacucuggaucucuaaaaccccuccccagaaguaacugucauuaucuguuuucuguugcaucuuuugagcaauauuuuaggcaugugcaaauauaucuaugugauucuagcuuccuuuucauauaaauagaagcauguuauguaaacucuucugcacuguggacuucuucacuucauguauuuaagagaugaacuuagacacaucugcauuccuuuuacuggcugcucaguauuccauugugugagugaaccauucauuauguaaccaucccuugcugauggacauguaaguuguuccuucauuuuuguuuguucccuucauuuuguucuuacaagacagcggugcacuguuuuuuuuuuuuuuuuuacauaugucuuucccacauguguauauuuuuagaaguaaaauugcugggugaaagagcauguauaguucuaauuuuaauagauauugccaaauuccauuugauagauacugccaaacuccauuuggcaauaucuauaaaaaaaaaucuaaaggggguugaccaauuuauacuuccauuagugcuaugugagaguuccuaaaucccacuuucaugccagagcacuguaucuuuaaacuuuuugauuuuugcaaguuggauaaagauggaaucucauuuuucucucucucucucucucucucucucucucuguguguguguguguguguguguguguguguauauauauauauauauauauuuuuuuuuuuuuuuuuuuuuuuuuuuuaagacagagucucacucuguugcccaggcuggagugcagagacaugaucuuggcucacugcaaccucugccucucgaguucaagcgauucuugugccucagccucccaaguagcugggauuacaggugugagccaccauguucaguuaauuuuuguauuuuugguagagacaagguuuuaccauguuggcccggcuggucucgaacuccugaccucggguuauccaccugccucugccucccaaagugcugggauuacaggugugagccacugcgccuggccuaauuuuguuuuuuaauuacgaguaaaguugaacaucuucuuauggaauaaaagccauuuggguuuuuuuuuuuuuccuuccaacuuuuauuuuagguucaggggguaccuguauagguuuguuacauggguaaauugcaugucauggggguugguguauggauuauuccaucacccagguagugagcauaguaccuaauagguaguuuuugaaauccucacccucaucccacccuccauccucaaauaggcccuggugucuaucguuaucuuauuaguguccauguguacucaauguuuagcuccuacuuauaaguaagaacaugcaguauuugguuuucuguuucucuguuaauuugauuaggauaauggccucuagcuggauucauguugccgcaaaggacaugauuuuguuguguuuauuuuuuaugacuguauaguaguccauguuauauagguaccacauuuucuuuauucuauccaucauugaggggcaucuaaguugauuccgugucuuugcuguugugaauagugcugcagucgacacacacaugcauguguuuuuaugguagaacaauuuauauuccuuuggguauauaccaaguaaugggauuacugggucgaaugggaguacuauguuaagcucuuugagaaaucuccaaacugcuuuccacaguggcugaacuaauuuacauuuccaccagcaguauauaagaguucucuuuucuucacaaccucaccagcaucuguuaauuuuugacuuuuuaauaaucaccauucugacuggugugagauaguaucuuauugugguuuugauuuguauuucuuuaaugaauagugauguugagcacuuuuuguauguuuuuuggccacauguaugucuucuuuugaagugucuguucauguccuuugcccauuuuuugaugggguuguuuuuugccuaauuuauuuaaguuccucauagauucuggauauuagaccuuuauuggauguguaguuugcaaauauuuucucccaucccauagguugucuguuuguuuacucuguugauaguuucuuuugcugugcagaagcucuuuaguuuaacuaggucccauuugucaauuuuuguuuuguugcaauugcuuuuggagucuuuaucaugaaaucuuugccaggaccuauguccagaaugguauuuccuagguuuuauucaaggguuuuuauaguuuuagguuuuacauuuaaguccuuaaucuaucuuaaguugauuuuuguauauggugaaaggaaggaguccaguuucaaucuucugcauaaagcuagccaguuaucucagcaccauuuauugaauagggauugaauaggaaaauugaauuuuccucauugcuuaugauuguugguguugugaaacaugagaugguuauagguguguggcuuuauuucuggguucucuguucuguuccauuggucuaugugucuguuuuugaaccaguaccaugcuguuuugguuacuguagccuuguaauauaguuugaaguccaguagcaugaugccucugguuuuguucuuuuugcugaggauugcuuuggcuauugugggcucuuuuuuuugguuccauagaauuucaaaauaguuuuuucuaugucugaaaaacaacuuugguaguuugaugggaauagcauugaaucuguaaauugcuuugggcaguaugaccauuuuaaugauauugguucuuucuauccaugagcauggaauguuuuuccauuuguuugugucaucucugauuucuuucaucaguguuuuguaauucucguuguagagaucuuucaccuccaugguuagcuguauuccuagguauuuuauuccuuuuguaaaaccacuuguuaguauuuuuauuuugugaacuucugguucaugucuuuugcccauuuuccuauugcauuguucuuuuucugaugaaguguaagaguucuuucuguagaaagaagauuugcccuuuaucauaugugcuaccaauauauuuuguaguuuguuauuuguauuuugauuuauggauuuuuuuuguagaucaaaacaaaucuuaugccaucacauuuagcaauuuuauuauuuugggauuuugaauuuuacuuagaaauaacuuucacauuuagaagugauaaaguuuaucuauuguuuuugucuaguauuuuaauggauucauuauuuuuaccuuugaucaauuagaaaugugagaauugaguuauauaaaaauuuaguuuuauuuuuccagcuugcuauaauaauccaucuuuucucugcuuuuuugaaaugcaguuuuauguauaccaaauuuuuaccuguagggucuauuucuggacuuuuuucuauuuuauuacuuuucaugaagccaguguaaacaaccuguuuuaauuacuauaacuuuacaauauuuuaacauuuagaauguucugggcuauuuuaauauacuuuauuuuuguaagugacauuuagaaucagcuuaucugguugcaaacaauaacagcaacaaaauucuguugguauuauugagauuacauuaccuuuaucauuuaauuuagauaaacugauaauuuuacaauauccaggaauaggauacuucuuuaauuuauuaaagauuucuauuauggauuuauuaaagucuuaaaguucuucauauagauauuuuacauuuguuacuagacuuauucucaagacuuuuuaauuuuaguuacagucuuagaaaugagaucguuuauggcauaauguuuucuaauugguuauuuuuacauacaggaaagccacuauacagaauucccuuaugguuuauaauuguucuuccaaugauccugauagauuuucuuguugucuaaucauauuguaaaugcugauaauuuugccucucacucuucuauuuguaucucucuuauuauuucuuucuucuaauuuuauugacuugugcuuuuugaauaauguaaaauaauaauggugauaaaugugcaucuuuauuuuauucccaagcuuacugguucuguuucuagaauuucaucuucaaucaugacauagauuuuggacccauaauauguauauaauuauacauauguuaauuauguuaaggaacuauauguacuuuuuuguuuuauuaagaauuuuucaaaauuuguaguuuauauugaaguuuaucaaauauguuuucaaauuuauacauaugaucauaguuuuuuuuucuccuuggaccugcuaaugguauaaauuacauugguagaucuucugauaucgaaccaucuuuauucuacuaguaugaaucucacaugaucauguguguauagucuucccuugguaucugcaggagauugguuccaggagaccccuccccacuguggauaccaaaauacauggaugcucaauuuccuaauauaaaguggcauaguauuugcguauaaccuacacacauucucuuguauacuuuaaaucaucucuagauuacuuauaauaccuaauacaguauaaauuauauguaaauaguuguuauacuguauucuuuagugaauaaugacaagaaaaacaguuuuuacaaaguucaguacaugaaaccauccauuuuuuuuccccaaauauuuuugauccaugauugguugagucuaaggaugcagaacacacagauacagagggcugugagguaggacuuugacaucuuucuuaguuacaugaacuguuauuaacuaauuuugaugauauuacgcugauaaaugauuuguuuauuugacauuaauuuuguuugugaguucagaucauuuuuaacacuuaaauguuuacuaauauucuuguuccuccauagcaccuuagaaauuaagcaugcuucuuuaauuguaauguauaaaaguauuuuaucaggguauaaaugcagcacaguuuuugcaaauauguuguauguaaauauauaacaagagaaaauaagcuggggaaggcaaacuggccuggcagagaagcagcaaauucagggagaugaacaccuuuuuuauacugggggcucuacuaauagagagagucauauuugggaacacugauuuuggaaagcagagggacaggagggagagccuguguuguaguggagauacucugaggguaggauguauuauugucaugaaaacuugacuugcugagguuacauuacuuaggaaugcucugugcaauuguaucuuuuuuuuggagguagaacagagugacagagucaggcagcagagaagucacagagggauggcagagauuaccaugggaagaccagcaauaucugggucauuuaagaguuggcauuuagauuuauauguagaacaauuuucauauuuucucauucauguuaaucucaaaguauguauguuugacgugggaaggaaauuguugaggauuauguuagucagauuuaagcugaucuguuaagaguuauuuucagguuguauuuguacaguguucaugggaggaggauucugagggggguuaagucauccuuuaguuuaaagagagauccagaaggucuuuugacuuguaaacauucucacuggcucccaguauuuucauucauugugccaaacucgauuagcacuacucugucuucuggucucucacuaguuuuauaaggcuaaggucacaaugacagucacugcacuaggcaucccaguuuucaugagaccauuuaaagagagacauaaaaugaacaguggguuuauaugucaaagaaggaguggaaaaggcauaggcuuagagucagucagaugcaaaaucaugucacuuuugccauugaacuccuuauuaaaccuuuccuagucucuguuucucaucugaaaauaguaaguagggauaauaauauauccuuuacagaguuuuguuaagcuuuaaugagauauguacccaaagaacuggagcagcauaacuaggucuuaguaaguuuauuucucuuucucuuaauagcuuauauuuuagucuuauugcauaauuuucuuuaaaucuacuuucauuuuauccauucauucaaccaaaaaccguucacugagcacuugcugugugacagguauuguuccaggggcugacauuagaacagugaucaaggcaggcaagggcccugugcuuaugaaauuugcuuuccaguggauaggaagagagaauaaaaagcagauuaaacuagaaaauaaucagauaaugauuaguaaugugauaaaaauauaaacggagaaauaaugaguguuaggaaugcuucuuuagauuggauggaugaaaaaggccucuuggauaaaaucacauuucacugagcucugaauaacaagaaggagccagcuguauuaagaucuggaggaggaacagucuaggcagagggacgcuacugcaaaggugacaugaguuuuuuuuauuuuagaaagagaaggauggaacuguuuagccaacaaccagaucuugagggaucucauuggcuagcaccuggaguuugguguaaggggaguuuggaguuuuucacaugccuaagguagauggguguguguuaacuuauggcugaacuacugugguaauagucuaaugucagcaugcacccagguaauauucauaauacuauccuuugagggagaacaagaaagaaauccuuacuuuuauauagugaaguagguagauuaaaagucaaagugaggcuaagacacguaacuaauuuuuuggguuagcuaaucagaggugauuaaaguaauaugcucuuaaauuaacuuuuaguuauuuuucuuacuaucauuuaguuuaugauaauucuuuggaauugugguauaauaugaaaaguuaugaccacuuaaguaacaacuuaguaccaaagaucacuuauuucugauggugauuugguagcuuagaauucagauaaagguguauuuuuuaaaauaagcuuuuaauuuuagaaugguuuuagguuugcagagaaguugcaaagauaguacagaguucccauaugcuuuacacccaguuuauuauuaacaucuuagaaugguauauuugucacaauugaugagccaauauugauacacuauuauuaacuaaaguccauacuugcaaugcaauccugaagcuaaccacaaugaguaggugcagacuucagaggcugaggucacagucgucccuaaggcucuucucauuucagauaccagcugcaaacucugggguucccagacuauccagacuaucuauguuucugaccaacuagcuacaaauucaguaauuugcuagaaugauucacagaacuuagggaaguaccauacuuaugauuacaguuuuauuauacaggauacagccagugaaggguuacauagggugaggucaggaagggucacaaaugaggaguuuccuugucuucaggacacaaucacucucccagcacauugauauaugauuaccaacgagcacagcucauugaggaauguuccucaauuugggguugugugauguuuuucucauuauuagacugggguuaugguuuuuugaaggaaggucacagagguaaagugccuaucauaucaagaauauguaacugacaugacuuaugacuuuugauguuaaccuugaucaucuggcugagguaguguuugucagguuucucaccugugagauuacccucgcccaccucuuuuucauaccucacuauuuggaaggaagucacuacaugcugcccacacuuaggucuuucccuccuugagaauguaguaagauaaagagauuuugauagguagaaagagaaaugauuuaaaacuuauauauuauuaaaaaucuauuaaccuuuucaaauacuagaaaaauagaaucauggaguuggaugggaccuuucuucagaugagcaaguuugaaagagccauacagagacagaguucacuguuggugagagggacuuugauaauugaagugcugcaucuacacauuucugucaagucguuaugaucuguggcaugugagagaugaccuaugguuacccuguugaauaauaaguuaccccuaugucaggccuucaaauguguuuugggauaagaaauauguugagagcugcaccuuucuuuguagaggauuuaaaauaagcucaguaaagugugcguguugauuuccaugaaauauaauucuuccauggcuugacuuuuagaaggugaacuuuggggauaugaacaaaaguucucugaaaaggaauuugaaugaaagagacuuuauuucaauagacaguuugcaaacugaggagaggcagccuuagguguaaaacaaaggugcauuccagagaacaauggcaggguuccagcaaaaguucuccucuagguuaucaaucagguuuguuuaugcaaaugaaggauuaaaacuugcucaguucugauugucaagacaacugaauccugauugguugauacagcugagccuaauuggcuggggcaguugagcucugauugguugguuuccaagccagaaaccagaagucucuguuagauguuuauuuuauaaauaagacugaaaggggagguccugugauauuuuuacaucucucugagaauagaguacaugacugcucccucaccgagcuaugucugccugguucuguuuuaacuuugagcaccucagccacaggaaauccauuuuaucuagggccucuuuaacagagguuuuguuguuguucuuaucuguuuuaucauagccaacuuuuggcuuauggaaggauuauuuuaguguaucauauauauucagguucuguguucuggaaugucaaauuacuugucgaccuacuuaaagaugaucacuauauuaaaucugauaguugaugaguggggaaaagggcauucugaguugguugaaggaauugagaacccuacugugacuagugucucuguguccaauagcucuccucaugauaaaacucuagcuuccagucauacgcaaauaacaugaaauuuuaggcaagaauauucaccgaaaagcauuugguaugagaggaaaagauguucacuuuguaguuugauuugcauauuuuuauuauuacuccuuuaacggcuccaagcagcaaggaaguaucauuuguaacuucuaaaacacuuagccucuuuugucuucauuguaaagcacgaaguucuuaauggacugauuaauccaaacaacgcccucugagagcaagauuguuaucuucacuuuauaacaggguguccaaucuuuuggcuucccugggccacauuggaugaagaagaauugucuugggccacacauaaaauacgcuaacaugauagcuggugagcuuaaaaaaaaucgcaagaaaaucucagaauguucuaagaaaguuuacaaauuugugcuuaggccucauucaaagcuguccugggcugcauguggcccacggguagaggguuggacaagcuugcuuuagagaaagaggaaacgcaggggguaauggugaaaugaucugauuugaggcaguggcugaaccugggagaagauaaaccuaguauggcaugacugagcccauauuugccugaggaagauaaaagcugcugcuuuaacuucaggugagccucacccccauacagggaauaagauuuccaggaaggaagaaauguuacuuaaggacugggaaagaugaaaaugggaaagugccacauacauagcagauuguauaauauauugguaugucuuuucuucaaaauuccgauccaccaauaagcauuuuuuucaaaauaauuuuucaaaguuugucauuuuuaaaaaagacaguccccccuuuucuaaguaacucuagaccaggguuuagaucuggucuuaacacgguuagcauuuggggcuggauauuuguuuauugucguggaggcugucuuguguacuguaggacaucccuggcuucuguccuuuagaugauaguggcaaccaagcuucccacccccacaaacaaaacugacugcagacauugccaaguacccugcugggggcaaaauugccccugggugagaaccgcugcccuaggguuagcaaaacaacccucagaccccaguugugacugugauccguaaguugggugcagugccucaucaccaaccucauuuucucuagcuguaaaaugggagacuuuaugggugccuuuuuaucauguuucuagaaccgguuuagaagauaaaacauuaauaguaacuuuauauggcaaauuuaucuugauacaauaucgaacaauuuaaaaguaauacagaucauauuuacacguuaaguacauuuccccaggugaguaaauugucuucaaucacugcuuaauuuuauucuuguuuaccuuuucacuuuuaggaagacugcaaacuuacccccacuuaccucuucgugaagccucacagggcucccccagguuuucucuguagcucuuugaucucauaguggcuuugcaaaccagugcucagugcuacugauuucaacuaguuauuuucccagagaaagcccuaauaagguugaucuuagggaaaucccuuaacugauuuccccuaaaucugaaucauggaaccaaccagcaaccagagaguuccugaucucaacuuccuucuccugauucaaaccugggagccuaggaaaacccuggucugggaaugcuuaaaauaauaaaucucuacucuuuucuuugaacauuuuauguacguauaugaugucuggucaaaugcccucauguaaaauuggaguaaagcaaaggaaagcaugcgagcaugucuugccuccaucaucaccuccuuuuggauuugcauauuuauagcucucuuuuuugggagguugcuucugcagagggcuggagguuagguggggucuggggcaggguagaaugagcugccuagucucugugacagguauuucugugcugcaucucugcuaccuuuuuuccugcccuaaccauuacccuuaauuuuugaaaguaucucuuacaucagauagcacauuaaaugucuuccuuugggugaucugaaaagaaauaagaaucccugagaagaauguacacauagaagaaucauaaggaugucaguggugcaacuucacuuugcucuuugugggaccuuaauuaguuugaguauucugccuguuaucuuuggcuaucucagcuguuaucuuuggcuaucucugggaagcagaggagcaugacgaagggcuugaacuuuggaguaagaaggaucugcauuuaaauuugauucuccccuuuacuagcuuucuccuggcuucucugagucucaucugugaaacagauguauaaauuggugugaaacgccuaauuuauaggguaagaguauggaauaaaagagauaaugugcuuuaucaggcacuuaguaggaauucaaggaaauguagcuccuguucuuucacucucccuuccugccugucuuucccucacugaagccaguuauuuccaaauacccuggauaaucuaggguaaacacaaugaccucaugucacaccacucucccaugcucacucugucacuuuuacuaauccucagcacuccaaguacagguacaccuuguuuuauugcacuugauugcauuucacagaugcugcaggguuuuuguuuuguuuuguuuuguuuuuaaacaaauugaagguucguggcaaccccauguugagcaagauuauuggcaccauuuuuccaacagcuugugcuuacuucuugucucugucauauuuugguaauuuuugcaauauaucagacuuuuucauuauuauuauuauaucuguccugguguuuucuggucagugauacuugauguuacuauuguuauuguuuuggggcaccaugaaucacacccauagaagacaaugaacuuaguaaaugcuguguguguucugacuacuccauugacccaccauucuucagucucucucccucuccuaggccucccuauucccugagacacaacaauauugaaauuaggccaauuaguaacucuucaguagccucuaaguguucaagugaaaggaagaaucccacgucucucacuuuaaaucaaaagcuagaaaugauuaagcuuagugaggaaggcauguugaaagcugagacaggucagaagcuaaggcucuugcaacagacagccaaguugugaaugcaaaagaaaaguucuugaaggaaaucaaaagugcuacuccagugaacacaagaaagacaagaaaguaagacagccuucuugccaauacgggaaaaguuuuaguggccugcauagaagauuaaaccagccacaacguucucuucagcuaaagccuaauccagagcaaggcccuaacucucuugaauuguaugaaaccugagagaggugaggaagcugcagaaaaaaguugaaaguuagcagagauugguucaugaguuguaaguaaagaagucaucucuacaacgugaaagugcaaggugggccgggcacaguggcucacgccuguaaucccagcacuuugggaggccaaggcgggcggaucaugaggucaagagaugaagaccguccuggccaacauggugaaaccccgucucuacuaacaauacaaaaauuagcugggcgugguagugcgugccuguaguccuagcuacuugggaggcugaggcaggagaaucucuugaaccagggagguggagguugcagugagccgagaucacgccauugcacuccagccuggacgacagagcaagacuccacuaaaaaaacaaaaacaaacaaacaaacaaaaaugccaggugaagcagcaaauaaugcagaagauauugcuaaaauaauugaugaagguggcuacacuaaauaacagauuuucauuguaggcaaaacagccuuccuggaggaagaugccaucuaagaauuucguagguagagagaaguagucagugccuggcuucaaaacuucaaaggacaagcugacucucuuguuaagagauaauguagcuggugacuuuagguuguagccaaugcuuauuugccauuucaaaaaaaccuauggcccuuaaaaauuuugcuagaucuagucugcuuaugcucucgaaauggaacaacaaagcuuggaugauagcacaucuguucacagcaugguuuacugcauauuuuaagcucacuauugagaucuauugcucagaaaaaaagauuucuuucaaaauauuacugcucauugacaauacaccuagucacccaagagcucuaauggagauguacaaggaaauuaauguuguauucaugccugcuaacacaacauccauucugcagcccauggauccaggaguaguuuugacuuucaggucuuauuauuuaggaaauacauuuuguaaggcuguagcugccauagauagugauuccucugauggaucugggcaaagcacauugaaaaacuucuggaaaggauucaccauucuaaaugccauuaggaacauuugugauucaugggaggaggucaaaauaucaacauuaacaggaguuuggaagaaguugauuccaaccuucauggaugaccuugagagguucaauagcaagagaauuagaauuagaaguggagccugaauuucuguagcugaauuucuguaauauuaugaucaaacuuuaguagaugaggaggaguugcuucuuauacaugagcaaagaaagugguuucuugaaaugggaucuauccuggugaagaugcugugaacauuguugaaaugacaacaaaggauuuagaauguuacauaaacuucguugauaaagcagcggcaggcugagagaggacugacuccaauuuuuaaagaaguucuacucuggggaaaaugcuaucaaacagcaucauaugcuacagagaaaucuuucaugaaagaugacagauuucauugcaaccucauuuuaagaauugccacaccuaccccagcuuucagcaaucaccaccuucaucagucauugaggcaaaacccuccaccagcaaaauugcugaaggcucaguugauuaucagcauuuuaaaagcaauaaacuaguuuuaauuaagauauguacauuguuuuuauuagacauaaugcuauuguacacuuaauagacuacaauauaguguaaacauaacuuuuauuugcacugggaaaccaaguuugugugacucucuuuauugugauacugcuuuauuguguuggucuguaaccaaaaccucaguaucuuugagacaugccugcauguucguauccuguaccuuuacacuugcuauucauuuugccuggaacauguuccccugcuuauccacguggcuugccccuuuucuuucuuugggucucuaccuguaugucaccuaucagagaggccuucuguuaccacuauauauaaaauaggacuugcccucuauuuucugauacuucccaacaccuuacugugcuggguuuuucucaaugcuucucaguaucuauugaccuauuauuuauuuguuuguguauuguacgucuccccucccuaguauguaagucucacaaggauagggacuuuuuguuaauugcuguacccucagugccuaggacacuacuuggucugcauuugguagucaauaaacauuuguuaaaugcaugaauaaaggaauaguauuuuuuauucaugccacauuuuccuucaguuuuucaagaaaaaaagugcauacugauuuuaaaaacagcuaaauuguuuaaauugucuauuauuguuaucucaggauauuauucaauuuagaggugaccauuuuuagccuuuaguguuucauauuaaaacaugauuucuucugaggcuuuuuuccuuuagacaguuuuaauuuuagagaacuuuuaauuguaucauuaacauuccugucuguaggucacuguugugugguggauugggaaaacagggagagaccuauguucuacuuauaucaauucuucgugaccuucagcuauugucaaaaucuuuaauacuuuuuuccccaaauccccuauucugagaagcauuaauacuuuuuuuaauggagaaauugaaaauacaugauauauugagguagauuuucuuaguaaccuaaaaugauaucaagaauguuuuggauccauaagccaguuggcuuauguagggagaaaucuucugaguuuuuuucuuuuuucuuuuaauuucuuuguuugaauagcauguaauauuuuaacagccaaaguuguggucauuuuuauuuuaacaauuccaaugauaauuacacuugcaagccaggugauuugucauauaucuuuaaaacucucaacuaagaugcuguuuuauuucugcuccauuugguucuucaccucugauucugcaccuaggcucucuuggauuaauaauguacucuaagauuuggaaggucuggcauccuuauaauucuguacuuuucauguauuuucuguauuguuuuagguagaaaacaaugauuaacaauuuaggcaacauuuaaacacccuuggaugagacagauuuuugaaauacaagccaguucacauguucugugguuuuuaaaaauaagacugcauaaaguuuuuauuuuuuauauauuacugcauaugaagccuguucagugaguguuaugcuuugccauagguaagcuuacagaauuuauuugagaaaacguagauauauaaauaggucuauuuuucaacaggggaaugguaagguuuacuaaauguuuagugauacacacacacacacacacacacacacacacacacacacgggaauuuuuugcccuuuaauauugaugaaggaaaaagcaaagauauuuuucauguuuuuugcuguauuuaccuagacuauuccaaacauuggugauuuuuaucuaggagguuuauccauuuaagggccagagucagccuuuccugaauacgaacauaaaaccuuugcuuugaaggacauuuugcacuuggggcaaagcgaaauuuguuaaguaaauggauuuuauguguuggaggacuagagaaguaguaaccugggacagagaaacuguccaauuuaagacuaccaguccauggccagucacaggacgaagaacauuuagagcugaaucaucuauauuuucuaaguuuugcgcacaccagcaaaugauucagacuauguuuguucccaugugccagggagcucuugugcugaugugaugaaacuuggcauagcacaguccuccagcagagcagugccugccuguuuaugcugagauaacuugcacucucuugauuuuacucaggggacuucugcaguuuuuuguuuuguuuuguuuuuaaaacugugucccugccucuagugcauuucccuuuuaguauuuuuccucucccacagugucucagccugagguaauuugacugucauauaugggagguuugggguuuauauuaucuacagauuauauauguuguauagguucccauggcuucguuucauacauaguuugaacuuauauagucauuuccagcauuccuuccuguuucuucuuacuuuuagccaccgccuaaucugccgcagagcuauuugugucgauugccuugguugugaaagcaacagcuccccacacccaagcccuuagcuucagaagugcuuuccuuaugacuuuacagagucaucuugguggcuacgucggguucugcccaacauccucuacuuagacaucuuguccuaggaauuaacucuauaauacuccuccuuucucaacugccuccuugcaugggaaaggcucaucuuagucuuuuugguuucacaguguuucagaaagcuguaguuuucuuucaacucugcccucaugguuuuaccuuccuuucucucacccugggucccugggucccuaacccuggucagugaucugugacaguaccuggucauguaauuaggagagagggaucuggucauuauauaacuagguuguggaaugccagcugaacaaguggcuagaaaccuacaauccggcuuggaacugagguuucaugguguugaugugacuccaugcaagugagcaauuuacucuguguuagaacguuuuuauuuugaaaagguagacaacagggucucauuugaucguuaggaagaacacuaauguuuauugagcgccgggcuggguacuucauucucacguucuuuuucagcccucagagcauucuugugguagggcaagugaguggcagaugcauugaggaagacaugcauguggauacacacauauucguaguuuauuuauacuguaaauuuuaaauaugccuaauaaaguuauacuaggagacagugugguauaguagaaagagcaugggcuuugaaaauucaugaagaccugaguuuaaauuucacuuuuaucuuggcaaaagcaauaaaacuccuggggcagaguacuuuuuaaaagguacuuuuuuuaaagaggcaaauacaguguuuuggugaaaaaaccaggcacaauuaaauauuuuuuugaauuaaaaaucucacuacucaugucacugguguggcuguacagagucuugggagauagaccauggacucuauuaagauagagauuggcgaaauucccuucauggauuaacuucaagauaccuggauacuccagaaagcucaaagaggugaaaauggaagaaacagugcuggccagcuggucuggcugcagcauuaaggcgaauccuaagguuaacucaccaucucaguguaaaauaugcauaagggacauuuagggugcuaacucaaaagauaaaccaggagcaguagaaagagauguucuccccucccccgaaaguaggcagucauaugcucauaccauucacuuuccuucuuuucuauguggugucauuagucuaaucuucucucuuugacaggaccauccuuauuccagcaucugaugauuugcuuaaucaaaauuauuuucucugaauaauaaccucagaaauuaagaaaugucauauuuuagagagaucacugguaauuuuugcacaaauaauuucugaaucaagaaaaaauuaaaaugguaugucagacaaguuuagauaaaacaaugaaaaguguucauacuaauauauguagacaugccuuauggcuccacuuagaaaugucauauuuuagagagaucacugguaauuuuugcacaaauaauuucugaaucaagaaaaaauuaaaaugguaugucagacaaguuuagauaaaacaaugaaaaguguucauacuaauauauguagacaugccuuauggcuccacuuagaugacuuuguuuauuuauuuuuugcuaauaaacaaucucuucuaauaauuuuuacugcuguuauuucuuuauuuagcuauuuaauuaugcaugacaguugauggauagagagcaguuuuucaaguuaagcuuugagccuucacauucaaagguauuuuuccuccuguguuuagacaucuuuuuugaguuuacguaguauuuaaucuuuaaaaacugagacugagagacacuuagcauagagauuauuaaauguaauuuauuuauuuauuuauucauuuuuugagacggagucucgcucugucgcccaggauggaguacaguggcgcaaucuccgcucacugcaagcugcgccucccagauucacaccauucuccugccucagccuccugaguaucugggacuacaggcgcccgccaccacgcccagcuaauuuuuuuucuuuuuuuuuuuucuauuuuuaguagagacgggguuucaccguguuagccaggauggucucgaucuccugaucucgugauccgcccaccucagccucucaaagugcugggauuacaggcgugagccaccaugcccggcugagauuguuaacuauaauuuaacuuuuaaaaaaccuccucccugucaaagaaaggaucauuguuuuuguugaauuaugaauguuauuguuuaagcuuccagagauuuaauauuucaaaguucaguaacccaucuuugaaagucagaaugccucagagaaucccauuuccauaucuaaaauuagaaaugacaugcagaggcuacaggccuuuuaccagacaugguaauuauauguuuucucuuuuugagaaaaccugaagaaaaaaaucaagcauuaguucuuuacugaauaaauagucuuucuuuggacaguaccucugcccauuuauuuuguuugagaauuaguuguagccaugugucugugauguauuccuuaccauugcucauuuucuuauuuagaauuuuauuuuucccuaaacaaaucuauuaggucacucaaauguuauaauuuccuaauuuuguuuauagauaacuauguuugugaaauguuuugccaaauuuacacaaauaaauaccuuucuuucugugcucuaauugccauacaugggggcuaauguacacucuagcuuugccuugugacuuuaaauggaucccaguuucuuagaguguguggaggaugcacauuugugguuagccccuauaguacugaugacugaucaucacauguaagggaucugccuccuuccucacguuugggaaauugaccuuggggaggaguuugaggugggacucaaauggaggaagggaaauacucucuggagacagugugaccuucuccuggcaucuggguucuccaccuccugcugucaggcugcccugcuugggaagcuggcuauguucccagccuacagaggauugcugcucagggccuagagcccuagcccagcuaggcagaucaucugugauuuuuuauuacuaccucuguauuccacuggcguauguaauucaguacugaguguaauuuauaucacuuugaagucuaauaagugugcuuuuuaucugcaucuuaauauuugccaaauuguuuuuuucuucuauuauugaaaguaauaauuccuguauuaaauuugagaagugaaaaaguaggggacgaacuucagaacagugguaccuccacuaggauuacuggggaaaacuuuguacuauuaugcuuauuacacugcugucugccacacugcuguucaacuuuacauuuaaaaauguacuugaggccgggugcaguggcucaugccuguaaucccaggacuuugggaagccgaggcagguggaucacuugaggucaggaguucaagaccagcuuggucaauauggugauauccugucucugcuaaaaauacaaaaauuagucaggugugguggcaggugccuguaaucccagcuacucgggaggcugaggcagcagauucgcuugaacccaggagacggagguugcagugagccgagaucaugccguugcacuccagccugggcgacagagugagacuccaccucaaaaauaaaauaaaauaaaaaugaacuugaaucuaaauuggauucuaccucccccaccuuuaaaucugucaguaguuaaagguguagcccauaccuguagcccauaggcagaaucuggccugcagacuuauuuguucugcucagcauuuaaaaaccuguaaguuucacauaaggaccagauucucagcaucucuugaaaaucugcaaaauaugucaauauugagcccauauucuugccauggcuggaaaaaagcaacaacaagaaccacccccugcccccugugacauccucgguuugacaguuugccauaccaacugaugucucacacucagccugcuuggcccauuugcauuacuagucugagcccucuagguacccuggaaaacuacuccagccuuauuucuuucuuguguuuauauccacugucugccuuaucuguagaacaacuuucagagauccaagguaggggcugugcucucuagccucuggaccuuugcacauucuaaaccuucuucuugaaaugccuuuccccacuuccuucuccugguugacucauacuuagcuuacaagacccagccugaucauagugcuugggaagccaucccugacuuucucugccagguuguguaaagaugccccccugcagagcacccuucauugcucuguacaucucagacauguaauaacuguucuauuacaugucuuucuuccccuuagaucuagggucuggagggcagagucugugcuacacuuuucuguuuauucaacuauucacaauuguugguacacaguaagcuugcaauacauacuuuuauugauaugucauaauauugucuaaggcaaugaauccccaccuuagcugcauguuagaaucacccggacagcuuuuaaaaaucgaaguaacaucuuggcacaguggcgggcuguagacccagcuucuugagaggcugagcggggaggauugccugagcucagaauucgaauguagccugagcaacauaguaagaccucuuggucucugaaaaagaaagaaagaaagaaagaaagagagagagagaggaggggagagaggacagaaagagagcaaagagaaagaaaaagaaaagaaagaaagaaggaaagaaggaagggagggaaggaaaggaaggaaagggaggaaggaagaaagaaagagagagagaaagaaagagaaggaaagaaagagagggaaagaaagaaagaaagaaaagagagaaaggaaagaaagagaaagaaagaaaaagaaauccuaauauccaggccacgucuagaccaguuacaucagaaucucugaagauggggccgaggcaucaaguuuuuaaaacuccucuggugauuccagugugcagccaaaguugagagccacuggucuaggacauguaggauuauguaaagaaaagcaauuuccccugauuugguuugagauuaaaacauuuggugaugauuuuaggaaaaucacucuggaugaacauuuuuuuacuuaacuuugguagcauaugggcauuuaaacaaguaggcacccaccuucaaugaaucaguuccucccauaacaauucugcaagcuauauugcugacaaguuauuaaucaucaaugucauaugcaauuauugacagauuuuuauaauuuugguaguuuauauuguauagccaugcaccauuuccuaccuugcuacauuuugauuuaaauuucaaguggauuauuuuucaggcgcccuacaaauuaacuuagacauuuauugaguuuccaaugccaauugcuuuucuuucuuccauauucuucuuuguuuuauauugggaccacuauuuggaauaaagacagacaaaaacagaacauuaacugguaucugauguggauaacgcaccuggaagaaaagccacuaucacuuagugaaagcugucagcagcugcauuguccaauaaaugaucaguccugagcucaugguuaguuuggagggaguuucaggaaaaaaaaugaaaauagugaaagaguugaggaaacauuuaugaauugggauugcuuuuauuuuggagaauaauagauugagguaaaagaauuccugcuugggcacuuuuuuuuuuuuuugugaaugaugacuugacuuuguuucuacugagaauaaggguaguagacauuugguuuagaauuaagggaguuuuagaaauuaaugucuaaagaauuuuuuuuguuuauaaagacuaugagaugauaauaucaaucaugugaucuguuuucugggagaguguuaugacgaggauugacuacugucugaucagaaaacuucuuuggauuuauuuuuaacucuucuauuggaaaaucucuuuuaguuaaucuuuuguaucugaaacaauugaucuuuuucacauugccuguuuaucuuacugagaaagcugauuuaucuacacugaauuggcagcagugccuuguugguguaguaauuuagauuuucuaagauuuucugcuuaaucaacucuguuuuccccuuugagcuaacugaggcuaagagggaagaaucugguuguuccaacugcccuuugccaggauuuuccucugugugugugugugugugugugugugugugugcgugcauguguggugggugagggaagcugggcuucauaagagcugcagugccaggauuuuccuguguguguguguguguguguguguguguguguguguguggugggugagggaagcugggcuucauaagagcugcagugcagguaacaugguagaguccugauaguggcagccugaggagcccuggccuauagcuggggggccucccuuuccaacccugcucuuugaccccagcuggcucauuuucagacugggagcaguggcaucacuugaccugggaggagaagcagccagccccaaagagccagacucaaagcucugcccagccuggcugucaccuucaggcaccugaggacacucagcauguaauuaugugccucgagacaguggcuucccucacagagcagagaagggaacugauuaaucaguuagucuagugcacucagcuggaucucucuucacagccuagugaaucagggguugaauuaugugaucucuucccuccucccaucuuuguagagcagccccuuucugaagaggagaggagggucacuguggggcauucuaccuuccuggucaccugucccucuccucauugcucugaugccagcuuucuuccccuacccccauaugaucugggaacugauuagaugacuugaguagagaagugcuggcaguugccacagaagggugcgugcacugccaggcagggaagggcugccaggugcuaaugucacugugccuggcaccagcaagcgucccagaaucugcucccgagguccagcucugccagcaugaggcugcuguuuggaaauguaaaguucugaucuaauucuggcaaaauauauuuuuuuuucuugaauugcuuagauuauuauccugauuuccucuuccuuugauuggccugaagugaaggccauuaacagugccaugauggcaauuuuauagaugaagaaaugccaaggaaauugauuauauuuggcauggcucugaaguaaaaaaaauucccaucccuaccucauaaguccugccuuuaccucccucuuccucccuacauggaguuucuuaacugaaggcucaacuuuaguuuucaggccaauuuggagccaagacaaugucuggcuccaaaugguauuuaaauagcuucaaccccuccguugugggaguucagaguauauuuccagacagaugaccuccuggacucucauggugcccacggagccucagcucuccccacucucuacuuugugcccugacuucuagcuucacuuugauagcagugggccuugggagcugacuuugugaagguuauugguaccaaguaugacaucauuacuagauauagcacuuguguccuugcuugcucuuaccaucucuccagugggacaguagaguccuggcuugagcuuagagcccugcugcuuaccaaugccaccugcuuaucugacuucugaauguuauuuacuccauccuguguuuugguacuuuuuugaggggcaugaagccugguggaaugaaaaaggcaaauuugaucccugacagaccuagcuguaaugcuaggccuggcacaucuuacuucuaaucuuagguauguuucucuccaauccucaguucuucagagguaaaaagaggguacuguuucuuaucuuacaaguuuguaaugguuauaugauauacuguauguaaaauaucuagcgugcuucugagcccuuaggaggaauucacaucuuaauuccuuuccuuuaucugccaucccugcuuggugucuugcaucaugacugauauuacuaugcccuucauauacaggaaagcauuuccuugcuugacugcaccucuauaauuggcuuuugcaguuggucacuuuucucccagucucugcuuaauguguguuaguaggucuugggccaggucuucauccugacuguccugucccucaagaggugauuauacaaauccaagaagggagcugcuuuuauugcucucacuccuguuucaauuugcuagcuguuccugugauuaaaaucagccuguauguauuugccccuaagaugggcaaugugguuccacauguagccuuaugaaauaaguuaccauccuuuggaaucuggagucuucugguuuccaacugguuuagcucagcaaugggaauaacauuuguugauauuaaauuggucccugguggccaccuucuuuuuccacucuguaguuaccaagcagcugggcaugaaucagcagaguugaaaauauuuuaaccagaaacauuuggacuuggcaccaaaguuguauugcccagaccaaggcaauacagaggucagccagccaacugacagggcacauagcuacuagcauuugcuuacggaugaccugccagcaaauccuggaugagaguucaguaucuaaaaagaaaauuaaggaggucauaaauuguauauuauuuugccuugcauagcaaaaucugaaugucguuuaaaaugcuccucauuaugcucucucauguugaugaccuggauccaguuugcaacaucuguuagguugacuugauggugguugcagauuucagggauauucaaaagccuguuuuacaagugucauaaaaugaacggaaaauauuuucuguaauuucaaauaauagagccccagaggccuuugaucauacugaaagagcccauggucagcuuaaaucucccucaguuucuauucauuauguuauggcccugugaagcagucaauucuaauuacacugaagaaagcauuugauuuucagugacagauuaaugccuaagcuggaauaugcaaaggcauggaaauaguggaaacaaaugaaauaaaugccugauagcuugucagacuacucuaaugaaggggucuaaguacggggccacuuuaagaauggaauguauaugaagugacuagacugaauacugauucucuucuaucccccucuuuucuccccgucuugaaaugaaagacacuguagugaaucaagaugucugugaguaaucagcacuacaguccucauccaucagaaucauugagccuugcuuggauuguguuuucuaacauagggcuugacaaacuauggccuguggccaguuuuuguauagccucaugagcuaagaaugguuuuuauguuuuuagagaguaagagaaaacaaaaaugaauauucaacagaaaaccuaugugacucaaaaagccuaaaauauucucuaucuggcucuuuacagaaaaaguuucccaacuccuguuuuaauauauuaaugagaucagucucucuaugagcuuaaauugaauauucuuaauugugcucucugugagguuagcacaguggaaguguggaaaagguaugggcuugagagcuagauagauaugguucugaaucuuggcucugugacguucuaccuagagaaccucaggaaaguaacuuaagcucucuaagccccagaguccucagaguagacucagugccuucccuuccacuuaauaggaucauagcaaaugauaauucuucagucaaaaaauaguagaccaccuauaaagccugugggcagcuguaaaaacguugcaacaggcuugugugcaaaugggcaaagggagaagcaagacuuggugaacacccagggcuugccaggcacuugguguggcacugagugggcaucauuuuauuacuucaaucccaaagcagguuccucuggacuauggcauugcuauucucuagagcuggcuucugcuucagauuuugaugagggugcuuuuuucucagcucacgauguuagcgccuuccaugcucuuuagcugccuaaagauguucaugucuuugggccucugcacuggauacuuauccaaguguaugugaggcuuuggcccuuuggugguaaucugcugccaagaacgguucuuucuccccuuuucccaccuuccucuuuucuuucuuaaauauaauugugcauuaauugggucaaagagaauuugauccuuccuaacuguuccuuuccuaaguugucacugugauuuccaaguaacuuuagacaagggauuuaaaccauuguuccuuuuucuuucuucauaaaaugaaauuggcaguauugcugcuuuauaccaggaggacucagaagcauugcauucugggcugagaacgucuagguacuuuucauaggaggcugaaauugcgggugugauuucagaaauagucuucuuugugcuugcuguuuugaaaugacugauccuagaaaggucucuggcuguguaguuacacacugcuugauuuuaauagaaaacguuuaauaggagcauuuuuuuuuggagccuugcauucagucuaugagagucugcaaggcuuuaaccaagagaguaugcaaagacaggguguucucccuuucccuggaaaggugggauugcuuggcaaguagccuuagaggaaguguuuagugugugacaucagggaggggggcagcuggccaggauuucuaacaccgugauuacagguagcacaugcuaaauuaggguucuacaccgcuaguacauggcugcauuuagcaggaaagugaagaagccugaaugugagaaaguccuugccaaccuuauaauaaaguaggugauguuuauaaugucuauuauguauauagcacuuguccuuccagaacagaauuucuuguuaauauguuacuuaaauauucuacagggauauuccuuuuguccucuuugguacuuuuuuguuguugucuagcagguauuauuuuuuugaacuggcuagagaaaacccuguuuucuggaugucaaauauuuauuucauguacuuaaagccacugaacacuuagaaaugguuaagauggcaaauuuuauguuauuucuauuuuauuacaauuagaaaauucaauuuuacaucccccaaauuauggagaggcaauuagcuuuuaauauuaaagaaauuauuuaaauaacagcuaucucuaguuaaguuuuaauuuuuuuucuuugguucuuuuacauuuucaaguuuaaaaaaauaugcauuacuuuauuuuauuuuauuuuuuuugagacagagccucacucugucauccaggccggagugcaguggcacagucuuggcucacugcaaccucuuccuccuggguugaagugauucuuguuccucagccuccugaguagcugggacuacaggugcgugccaccaugcccagcuaaguuuuguauuuuuaguagagacaggguuucaccauuuuggccagguuggucucaaacuccugaacucagaugauccaccugccucagccacccaaagugcugggauuacaggugugggccauugugccuggccugcauuacuucuauaaccagauaaaauuuaaaaaaauuagcgauguucugugaacacuaauaaauaauccucucauacuucuauaacaaaguuuagcccauugauuugguuucaugcaugcauuuaagccaaaguuuuuauuucugaauucaaaaauauuacucucugauaacccuugccucagagauucagaagugaaguugguacauuugauucaauggaacauucugcauacguuuuacaucuacuuuauucuagaaaauaaguuuugacaacuugacaguacagaucacuacaucugaaacaaguaaaaugcaccaaugguauagucuacauauuugguaaauuuuguuuauagagacauagaaaaguaaagaucuuuuacuauuaggcguuuuaucuuuuaaaaacugcaacugacgggauauauuaacuugcuuagaucaaaagaauguugaguuaagaaaauauuuggaaggggcuuacaaccuuuuauggccuagaaacugccuuucuuuucccaccuaacaucucauuucauugccuuccccucaucuacagagcuaugucuucaugccuaucuggacagcuggguccugaugggaucugaacaguagauacugccccggaucagguuaaaucuggagcauaggccagagugaacuagcuucagcauaagugaaauagguggaugauucaaagugacggacuugucguuauaugaaaaagacacucgcacaugcauguuuauggcagcacaauucacaauugcaaaaauauggaaccagcccaaaugccuaucuaucaacgaguggaugaagaugaugugguguauauacacacacacacacacacacauauauguauguguauauauauacacacacauauguauguauguguauauauacacacacacauauguauguauguguauauauauacacacacauauguauguauguguauauauauacacacacauauguauguauguguauauauauguauauauacacacacgguauauaccauauauaugguauauaccauacguauauguguauauauauguguauguauacguguauauauguauauauguguauauauauauguauauaccauauauauacaccacauaaugguauauaaacacauaccauggaauacuacucagccaugaaaaggaaugaaauaauggcauucacagcaacuuggauggaguuggagaccauuauucuaagugaaguaacucaggaauggagaaccaaacaucguaugcucucacuuauaaaugggagcuaagcuaugaggaugcaaaggcauaagaaugauacaauggacuuucgggauucaggggguaggguagaaggagggugagggauaaaagacuacacauugggugcaguguacacugcucaguugcaccacaaugggugcaccagaaucucagaaaucaccacuaaggaacuuaucuauauaaugaaauaccaccuguuccccaaaaacuauugaaauuaaaaaagagagagagagagaaaaaagugagggacuugagacacauuuggcauccuuuuugccuuucuucuuauuucugcacaguuaaauuuuaccuauccuucaguaccuggcucaaauacucuuuuacgaggcuauauuuaauucuuccacuccagcauaaaugcugucuaccugcucugaauucuccaagcacaacuguucucagauuauuuuguggaguacuaaauagauguucauugaaaguagugcuggucaaguaaguuugggaauuccuguaugucagggcugcuuuuuagggagcagguacaggggagggggaggguggugguacuuauuagcauauuaaaggugcugaggagccugcuucauccaguguuaaaaaacuuuugauuacagaauuuuuuucuccaggaacaaugauuagcauuucaaggaagguucaaauugucuauaauggugcuuaauaaacauuauuucaagaaauaacuccuuauuccaucauaauauaguaucuaucauucuaccauuagaaauuauucccaaggacugugcagagugccagauuucugcgacauauaaucaaagagaaggggaagggugaagaacauaaagagaaaauagauuuuugccaacauaaaccaaacauuuuacauuuugcuuagggcagggcucugaauaagggcacacauccaguucucuggacugguacugaacagugaaagguuauaaauguuuugaguucuuuuucccuaggaaggauugguauguuuaaguuagaugccagaaacugaaaggaagaggaaucuaaauggaaacacaguugauuuaccugaaagucaccuuauacuccuuuucuauuuuuugcauucuugcacaaauauaccaucagcauacaaaugagcuucccuuuuccauagaucucuuaauuuuuccuucauugagagaagagacaaaggaagggagaaguuuuaaaauaucuagauuucaauuaaacugauucuucucuccuccuuaagaguaaaaaguauuggggacaauggagaaaggaguggauugugucuauguguguguacauuugcaaucaagagcaguuucauuugugugugugugugugugugugugugugugugaaacccauagaucucagguuaaagcuuuaaauauuugugaguauagugagaauuguugguuuguuucuuuucugugaaaaacaacauuuuacgaaaugggaaagaacauuuauuuuccuuugaagaugcaaauauggccuaaggaaaugcaguuaaaaugugagauuuaagaaagacagagucuguuuuuuuuuuuuuuaacccagcuaagcacagccuguauaaagacaagauagccuuaguuugauguugaaaaauuucccagguuccuuaauuuuauauugaagacauuagccaacagaguucuuuucuguagauauguaucuucaguggaggaaaacccaaggcccuguguagcuucugaugaaauauaggggaaaaaaucuagaaaacuauaacuggaagaaguuauguuuaugcuacuucuauauuccugaauaaauggacagcaaggcaucuucaccacucagugaggcccccaucauaagauuugagaacuuguuuggccucacuucuaaccuuauuuuagaauugcacugagaaccuuggacaaugguuauucuacaaccaacgucuccuuccuucuacuuuccauucuguuaugucugagucuuuuuuguugguaauuauugauuagaauagugaucaauaaucucuuuaguucuuggcguuacuagugauuauaaauucuugcugguaacauuggcauaaagaagaauguggaaaagacaaugaguauaagaaagugguagaaaagaagaaaaguuacaaggaggaaaacauguggagagaaagagaacaaaaaggaagcuguagauaaguuuggaucuaccaguggucuucuugaucucauacuugcacgggugcuuucaguuuguaaagugugaggauguaucugaagugggagggcuuuccaaaaccaggaguggaauauaagauuauaugucagaccaaguaguuugaggaaucccugaagguuuuuggcuaagugaaugacauaauaaaugauaugcuuuagcaugauugaugucagaggcggaaggacaaaauggacuggaagagaggcaagauuuguugagaugugagguaaugaaagugugaacuagagcagugguauuggugaguagagaggaagggaugucuguaaaggcaaaaauggcuaaagauaauuggauguauaugauuaccaacaucugaauuuuuacacggcgccuacuucagauauucuguuuucaaauucuagcaacgugggaaaucccaauauuuuaaucuucaaacuauuuuucuuuaauugcuuuucuauuguguuggcauuuuucuguuuucuuauuuuugcaggucauguccuaauuuugggugccuaaguaaagauuucagugccuuaauggacugaaggagacagaaugggcaaaggugacugaagaucuaugcuuuaguugcugagagagcuguggugccauugauagaagacagagaaguugagaaagggaauugguuugauugaagggaugguuugaaggaggcaaguucagcuuugggcauauuuagauugaggugacaauuggccagauaaguauucucuuuugaugauagccuggaauggauaauagagacagggauuggaaccagagauuuaagagucagcuauguggagcuguugguuaaaaccauggaauacagucuauucaucagggacuguguuuuguagaauaaucacaguuaacagauggaaggaaaaggaguauuuaaagaaaaauaaaaucauagcaugggaaaacccaaaaaguacuagucagggaagcucaaaaagaaaggaauuugaagaaguuuaauauuaccagaugcugaaaagauaucaaagugagcuaagcacaauggcuuuguugagaaguuugaagaucuucaagagcaguaucgaacacaaaagaaagguuaugaagcacagaccaaacuacagcuugagaaagguuaguggugaaguugaaaccagcguaaacuuaacaaaaagaauagugucggacaugguuucuaugaaauuagcaccuuacucagauugcugggacacaguauuuguuugaaagccuuuguuuaguauuuguggcauaguccuaguaaacuggaaugccuuggaucugauguccaacugaguuuuuaagcucacugcccuacauuucuuucaguucuuuacccaacuuaguagcacuucuaguacaucaaaauauuggcuaaaauaaccagacgauaggguuuaaaacuuuggaaaguaagauagcucacagaaaaaaguagcaguugugcuauuaaaaaucugauuccacuugauagagucauuuucacuguccuuguuucccacuuucauuggucuuguuagacuacuuuccuucuauugucauuuuuaauuuuauucauuuauuuaguuuuuauuaacacauaauaauuauacuuauguaugggguauacugugauguuuugauacauguauauauugugugaaaaucaaaccaugguauuuagcauauccauuaccucauacauuuaucauuucuuuuugauauguuuugggacaagcaaaaacaagcuugacuuuuuaaaaaauuuauuuauuuauuuauuuuuuuacuugugcaugguucuaacuucuguugcccugucuccucuuuuggugagcugccagaagucuugccuugauauuuacuauuugguauuuggucaaaagugauuaauauauugcugguuaacuuggugguaaaguugagcaguagaugaaaggacauggaaugguauaaaccauaaugaugguagacaguaagcauugagccuaaaaugauauucugagucuaagaauucugaacuaggcuuuaaugcaucuaacuucagacaggucacuugauuucacuuggccuaaauuucuuuuaaauuauaggaaaaaauguuuaaaaauugcacuuuguaagacacccugaaauguguggaaugacauugccuagccucauuuaauauaacauaagaaacugaguaguccaaguuauaaaaaucacuugauggaggucuagacucuagaccuaaguuuuuguuuuaauuccagcauuguugaaggcaagguauuuucgccuuuccaaaacucauuuuccuguggacaaaugaagccugcacuacagauacaaugauaaugucaguaacaguuuccauuuauugagcacuauuuugucauguauuguucauucacucauucucagcaaauaguuaucaauuaccuacuaugugucagauugucuucuagguguuuucuaagugguguuauaggguauccuacagcaaugaaaaaauucuugcccucauggaacuuacauuccagaggggacaauuagucaguaaacaaaauaaguuuucacuguguaacauacuguauauuuuauguauuuauuuuguuaauuguccuucucuaucugcuagcauggauagagggaauggauccaugggggaagggagaguagccuggagaaguagguugguaccauuauuguuguuauuuuuaaaaaaauagaucuuagguauacagaauuauauuaaucauauuuuuugcuccaugacauccuuugucauuuuauuguuauuuauauacuaauaaugcaaggaaauccuaugaaccuaucacugacuaugacaucuagaacacuggcaagaauuuugaucuuuuaaguucucccauucaugccuuauuuugacaucauauuuuaagccaguaaguggggacaauguagaguccagaucggaggugggaagagaccaaaggugaggagaccaguuggaggugguagaugaggagaggaugaugaggcauaaccuuagcagugauaguggaaugaagagcuggaugagauuggcuuuaugagagaaugcaguauugcauugucaucauggcauggaguuauuauucaucaacucuuuauguuuagauaaaguacaugaugaugaaaucauccuugguuuauuugcuuucaugcuuucaacauguagugcuacaaagcuagagaaucucaaaauuuuuauuucagauuuaaaauuuugcuguagauuaauuaaaacauaaaaguacaugcaaaaggauguaaaauuuaaugugcuagaaccccauauucacaguaccuagcauaaaaaguuaaguauauuaguccucauauuaccccuauugauuucauuucuuugucuucagccccaguaguaacucugcuguuuaaauaugcugcuucucacuuucuuacuuaacaacuuuuacuacauuugcauguugcgcuaagauagauauuuauaguauuguauggucuuaaacuucauguaaaugauauuauacuguauguauuccuuggcagcucuguuuagcucaaaauuguuugugagauuaauucauguugaugcauguagcauucacucauuuucacugcuguccauuaugugaauauaccaucaucuguuuaucucuuuuucuguuaauggauauuucauuguuuuuaauguuuuggcaauauguuguuccuauaugccaauguuccuaugaauguuucuguaaauauuuccuuguguacauaugcaagaguuuuuuuaaggauauauuuuuaagaguggaauuucugaguaauaagauauacauaccuuaaaccuuacuagcuauuacuaaauuguucuccaaauuguuugaaccaguuuauacccccauuuguagugcaagauagagagcaucccugaauuuuacagcugggaagacagccuguauuuuguagacuaguacuucucaacaggaacaaagcggugugugcuguaugagaaucaccggucauggcccuugaaagcacacaucuuuuccuuccccuauuccucucuagguuuucaccccuugguguguacauguuuuggugcugggaacuggaacauauaauuauaaaaaacauauaauuauauguuuauauguuauaaaacauauaauuauaaaaaucuuacuuguugagccuaauuugcucuuugaugacugucaguuuagugguuaauugauuuaauagucuauccugaaagccuuuguaaccccauauuuuguuuuguugguuaugcugccuaacccuagucauauuuuuuaauuucugcaguuuaaaaaauugaaauauauuagaaucauuuucucuaacgucgucaaaauauuugaagcaauggauuacaguuuucauauguaauccuuaagaaaucuuuuuugcuuagcugacguuuuaaagacagggaugcuuuaauguaauaaaaccacaaaaaauaauucaauuuuuugggaguaaauuuugguuuaaaaugguacagcuaagaguccugcaguggacguaggauucagcuuucuccacuaguuaugacauaucuaucuguuuuccaccugcuagaauuuuguuuuuacugauuuuuuuccuuuuuuccauuauauuuguggacuucuuuaucuuuaaucccauuauuuucuaguagaacuuugggagggagcaagacuaaauagauauucaaugugccuucuuuuaauuccuuuuuuaaaaaaaauuaguaaugguauuauuaaucacugaguucuuacugugugucaggcacugcacuaaauauauuaucuauauaauuucguuuaauuaucuugauagucuaaggaguaaagaggcaaaggugggaucagaacuaaggucuucugguugcaaagccuguauucacgcuauaccauauacccucuaggccuaaaaagaaaauuaaaaaagauuuauaauguguguacauguuuaguuuuuguacuuuuuuguaguaccauuuauuaauuuauaaaguauuuaagauuaaggauaaauuacccaacauaauugucauucuuuugaaauauuuuccuuuuagcuuuuuuuucuaaaagcggacuucuuggcaaaucaccaaaugaaauauucuuuguaugaagaaauuaguguuuuuaaaaagacaauaugagaucaucccaugauccagaacuccaucauuugaauaaacaagauaucuugucuucucuuaucuuugcuccuuuaguuauuacuguaccuuauaggacaccucucaugauuacgguccuugaagaaaaaguuccuaaggauauuuuauguuuuauauguauuaaaauaaaaaauauguauaacaagaguguuucuggguccaaaauuuugauauguguauuuguuauuuaauauuaugucauugucuuuagguucuuuaaaagucugugucuuuuaaaaaacauugcauauuuauuuuuuguagauaaacuucuuuccuaacucuguugagcauuaugauaguaaguauacaugagcgauauagauuagaaggcauauuucaauucugaaauauggucaauagaaauggugaaaauauauuaguagcaaugacaacuagcaugcauccauuuguaagaauguugcaaauggcugggcugaccacaggugcuuuguuacauuuauuuaacaaauaguggaguaucuauuauguucaaggcaguguccuaggcccugaugcauaaaauuggaugugaaauuaagaaaaguugaauaagaauaucuaaaaggaagagcuaguuaaacgaccaucuguaagaaaaauaaaaugagaucaaaaggggaaaacauauaaacaaaaaccaugaaagaaaaaagcaauaugaaaagugaaucuuagaagacaaaguaaaaaauaaaaggucccugcucacaaagagauagaacuaucuucuguuaucucaagaggaaaaaaaagaagccugcuuuacauaaauuauuaugcauaauuuguacaggcacuggacuccuggaagguugccaggguagcuuuuguugagaugaaauucaggggacuucuuauuuauaggaaacugguuaauguuguuuccuauucuuuauuuacuuucuuugauuuuucuuaauguucuucuugaucacugaugacuagaguagugagagaauuuucaaaaauaguugauauaugauauauuaguacaaaauaauguuaaguuucuuaauauauugugcaaauguauaaaugauuuuuuuuuuuuuuuuguauuuuuaguagagaucggguuucgccauguuggccaggcuggucucaaauuccugaccucaagugaucugcccacuuuggccucccaaagugcuggcauuacaggcaugaaccacuaugcccggccuaaaugauuauguuuauacuuuuaauuuaucuucauauaugaugauucuuuauaaauuucauuuuucauuuuccauauuuaucauuauugguauagaaauggccagaaauaauuacuauaauaaugcuaauuguuaccauuucuuaaacauuugccauaugccaaauacgcuaugcuuuuuauauauuagcucauuuaauucucacaagaauccuaugaagcaagcguauugguaucccccauuuauggaugaugaaagugaggcacagaaagauaauguaauuuguuuaagaauccuauagcuaccaaggccaggauuuaaauucaggcagucuugacuccagagcccuugacaagaaugcuguucaguauugaugacuaggucugauuuauucuguaaauuggcuuauuugaaucauuguggacauaauaucaagagacgggaaggacuccugcuuuuauuguacauuucauaucgagacaaaguucucacugaauuucaaaaagagauauaaauguaugagugugcaauagauugaauauuuguauccccaaaauucacauguugaacuccaacccccaaggucacgguauuuggaggcgggacccuugggacaaaauuagaugcggaguguggaacugucaugaaugggauuagugugcccuuccuuaaaagaagaggguggagaguuaguuugcuuucugccaugagaggauagaaugaggaauaggcagucugcaaccuggaaaagaguccuaaccgaaaccugaccauauuggcuccccagaucuuggacuuccagccacuagaacuaugagaaaucaauuucuguuguguguuagcuaccugccuaugguacuuuguuauagcagccugaacuaagugugcuuauuaaaguacugaaccauaagggugaugguauuuugaauacauguuuuagcaccauuaguguaugauuagggcagggaauucccuaaugagggaaaggucauaggcuggaauccugugcgugucuguuugcucauuccguggccuaagucugaucuuuuaacguggcuccucaccugacaguugcaggcccuugggcaugaggggugccauaugagagaauacggauggaucaccauaccuccaucacuaggaucauggccacaaaucagagcucugucacugauaaccucuuuggaaacuaauaguuuugcaucuguacauacuauauguauagauuuauguuuuucagaacacgagcaggagaugguucuauuuuaguauuaugagacuaauuuuuuuuaaaacuguaucuucuaagauucaugccuuauauauguauguacuuuuuuaaagucucauauuuuuauacucucuuuccugccuugggccucauuuuauuuccuucagcuuaguguuuuugcaauucuuccuuuagggauuucuaaauauucauauuuuaauuugacuuuccuuaauuuggaauuccauuuuaugcuccagagccucagacagugucauaaauaugaugauggcucaaaugguuaaacuaugugccaaaaaaaucuguggucagcucagccacguguaacauccuuauauccugauguaugcuggcuuucuuuauuccugacacaucuuuuuagaaagguagacagauaaauagauagauggauaaacagauagccauuugcaauggaguaauuucuauuugucuacauuuugcaauugaaauuugaguauuugggauccuaaaauagaaccguaaggugucaaaaaucugucaauaacaauauuauuaauaauauuaacaaauugaucaugaugauugauaaaaauuuuagaucaaaccauaugaaauugccaauauuagaccauuuugaccuaaaaaagugucauuuucuuauggucucacuuaaaauacuguuaacaauagcagcucacuugcauugauugcuuacuauaucugaggacaaugccaagugcucccaugcauugcugcauccucugaucucaugagacaagcauuguuaccucccgcauguuaaagacaguggaacagguuacagauguuaaguaacuuuuccaaagucacuaagggcaacacuauuaacuaauguuuaacuuuguuauuauuuugccuggcggugcugauuaaaucaauagaauaugacaagauaagaagaaagauaagaaugacuuuaccguuaaaacagugucagauuugacaauuuuuuugagccagugguauuuguaguaauuuuagcaacaagagauaaaugcacaaaggcucuuagcuccuuuuggcucuggcugauauucgcgaacccuccacacucauaucuaguaacugauauaaaauagggcagaaugcagccagcuucaauuauaugaacagggaucauugucccuucucauucugguugcuuuugccaaucuuugaauuuucuaggcgagaguuugccuuccugcucagacuuuugaaucauggaugcuccucauugccuagcugauccacauggaucugaucacuuucugccuugacuuguucugccugccagacccugugcugcaaggggaugcuaguuuuguaucucuugguuggccugacuacccaggccuuggcaucacagucaggauuccauuauuuucagacacgacuucucuguagguaaaaguaauagucuuaccucugagaugaguaccaugggaaggcuuucaugauagacauugcacugauguuuggguauucaaaccuuaauuguuaacaaagaacaugaugaguuguaguuugggcucuaauauggaauuuggcccauggcucagaaugugguuuggggucuuuguuagacccuggcuuaaagaugcuauuuguuuuaacuuuuucuuuaauuaugcuuucuaacauacuuagaggccauuagagcaauugauaaauugaguguaguaaaugaaauaagauguuuaguaaaauuaaugaauauggagauauauuaauagcaacaaaaaugucacuguuaagcagaugaauuccauuccugauagaaucuuuauucaaaguccauuuagauuuauucuauuauuuugucuguuaaaguucauuuuuuaagguaaugugauuuuggaguagggagugaaacaaauuguggaaguguuaucugcuguuaccacugucugguuuuucuuauuuaaaaguacuaucuuuaaaagaaaauguacauuuacaacacucauugaaacaaauuuauuggauaguggcagcagucccuggaugaaaaacagcauugcaaaauuugacuuaguuuuaucacuacuaagaauuuuuauuagaacuguacagaauuaucagcuauaaauagagaucagcuaauuugaugaagaggcuguaggucugcagguaauugaacaaauauaucaugguuuaaaaaaacacacaugaaaugacaguaauagugaauagggccaaggaaagaaaagcagggggaaagaaaggagaaaauaaaauacaaaagaacaauuauggauuugugugcgacaaaaugugguuccaauacuggccuacuuaacacacuuucucacuaggacacuguuguucuuucucaaacucuuugugcuuggcugcuuuccuuccccauuuagaagcaggauagcccacucucucccacucugguccuuugaccagagacuaauguugcugaggucgauagggaaguaauggaauuuugcaucugcaaaugugaucagccucugcaagccuggcuuccagcagaaauccuccuguuguccucugagauacuuuuuuacuggcugauuuuuuaaaaaaauuaaagagccuucuuuaaauugaccaauaauauuucuuguuaccuucucuuuucccccucuuguagggguggcaugcguugauuuacaaaaugaacauugggaaaguguuuugauauaaguuuguguguguguguguguguguguguguguguguguguauguauguguguguuuuaagcuccaaggguaagaguuacagaacuggggaaaacgugugcauacucuaauauccagaaagacugcuacuuuuaaagaugacacuuggagaguuaagauagaaaguauaaaaacauguggccaaaucauaaugccugacaaagugauagcuauuagacuguguuuuuaugcaggccucugcauacucuaucuaauugacuaaugacugaaacagauucauguguguagaaaccagaugggucaguggguauauuaggccauucuugcauugugauaaaggaauacuggaggcuagguaauuuauaaagaaagagguuuaauuggcuuacaguucuacaggcuguauaagcauggcacugcaucugcuuggcuucuagggaggccucauggaacuuuuacucaaggcagaaggugaggcgggagcaggcaugucacaaagugagagaaagagcaagagagguaggggagaggcaccacacacuuuuaaacaaccagaucucacaagaauucacuugcuauuuugaggagaguacccagccucccucaugagggauccacccucaugacgcaaacaccucccaccaggccgcaccuccagcauuggugauuacauuucagcaugagauuugagggguggggaguggggagucauccaagcucucaguagguuaaugcuucuuggugcuaucuguguaaggauagugcuuaagcaucuuuacaaauagcagguauuaagcuacuuuaccugccacuuuaccauguauguauuccaugccuugcuugaccauauuuaccaaaccuuaaagucaugacagcugaucuaagaauagggcuaugguguuuauauggacagugugacaguguuuagaauugguacuauccuauggaauucauacacugaguaggcauucaacaaguccauauugaaugcuuacaauauaccaggcauuaggugggugcuaaggaugcaguggugacaaaauaggaaaaaucccuuauucuguaaaacagagagauagacaauaaguaaguaaaaagcaguggagguugauaauguuagguacuagggaguaaggcauaaaaaggggcuagcaaguauugcuggggguggguagagacugcagguuuugguaggaagugagcgucauucacaccugggacacauggucaugguaccacccauauguucugcccaggcacagcucuugcgucuccugcauuauuuccuuagacuccauaaccugcucagaccucaagaaaagagaaccuuucagcauauagacauagguagagccacuaaaagcuaaaccagagcaaaacaccccaaacacccuuuauuuauaauagguugccaaaaaucagccaaaacuaaguagcaaauauccaaauauucugagaaaaugcauaauuuuuaaaauaaaaacuccuaauucaaacauuuccaccuggaucucuguaccuccaacaggacagccauucuuaguuaaggagaccaaugauuacaaguaagcaauaauuucagggcaaggaaaucacacagugagaacaugauacaugucgucauuggcacaaggaagaacaagcaguggaaggcuuuggucucgguauuccagaacgugcccuguacuugcugcuugccucugccuguuguuuccccuacccccuccuuggguuuccuuuaccuggaaugcccuccuccuuguuuuuguuuagcaaaacuccacccuugauaaaaaaaaaaaaaaccuagccuuuuaugucuguuucugugguauauggcaccaaugaauacucaauaaauguguaauaugucaaugagagaaucggaugaaacaagggagcacaacuggcauauaccuacuucauuucucuguccacaaauagcugucagaagugacauuuccaggcuuugucccauuucugacuuaaacacucccucuuuucacacucuucugauuaaaacaaagcaaaacugugguuaaggaggcugcuagacaacucacucaacugccagagagggaggcucuuuugcguucauguuuuugaguggacaucagauacaauuuacucuuuucucauccaccuuugaaacguggcugauuuucccuuaucagggcuuucuguuuccuucuugccucacuaacucccuucucauccugcagguagacaggcuggaacaggauuucauuuguagccugucagcucuucuugucagcuggcagagauaugguugagcauuaagagggguugggagguaaaguuauuaagggagcagcagcuuugguuuaucaggaggugggaggugggggaugaauacacagauauuuuccaggucauuaaagagagcaaaaauccugagcuuuugucccauuggcaugccuuuccuggccuguucucuaacacauuaggguguccuucacacaugcugcaccucaacuugcaaagguacagccuggcagcugcgucucagccaugggaaacaaaguggauuggucugucacauaaacagggcugaaaucuuuagggcaguugagaaaacaagaagaaaucccaaagccuugguaugaugaaucuuggccuugugagcuggcuuuguucucugcuuagacauuucuuuggguguagugguuguaaaaacaaaaccuaaggauuuucuauuguuaccauccuucuuaucauccuuauagucauuguuguagcuacuauuauggaaugccaacccugaaccaacuguggacccugugcuuuacauggauuagcucauuuaauccacuaauaaucuuaccaaggaaggguugacccugagcuuuuaaccauaaucuaguacuacaucagaaagaaaaagcauguauauaguuccaucauggugaaaauguauuaguagcagugacaacuagcaugcauccuaguggagucauuuguuugagguagguuaaagccgugaagggaagccauuuguaaaccggaguauuuuacguuauucccaccguacccugaaaauuuaggauuaauuuuucuaaauggauuauggaaguuuggauuaauggaagagaaacaaguuaaaucauaguuaugcuuuguugcucuaaaaucugaggauuuucaauuuuuuggcaaauuuuaugguuucaagauuccugugagaugauaggucagagucuauccucagucuaccauugcacgugcugcaguggagaaaacuaugaccuaaaaauuguacucaaagcuuucauuuuucuguugaauauugguguuauguuuucucuugcaauuuuaagacuacuuuaaauaguuuaaaaauaguuucauaugcuacuuauucauacuucgcaugaauaagauuacagcaguaguagacuuaagaguauuuaaaaacuauuuaaagcagcuuucuaauuguccacuuuagcacagauuguaaaucagcaaaaacauuuucugaauuccaugccaggaacucuguuagguguuggggauggaauucagcugaacaguaccaacugcaaucugcccauaccuuggacagcacccaaggggguuuaauauuggaugcauuggaaugcucuuguuuauacauguuucauaguugcuagggagaacccagguuuuucacugguggacacauauuuaaaagucaauuuauauauggucugacuuaauuuuuuaacuaaaaaucagugaugaguuggauguucccaacaugaagaaaugauaaauguuugagaugauggauaugcuaauuacccugaucugaucauuauacaugauauguaucaaaauaucaaaaagaaauuagugaugaguugggacaagggaauaugaagugugauuugaauaugagcugauggcaguagaggcuuuguucauauauauuuuauuuuugucaguaacccuuuuuaaugccccaguaucaugaucuaauuugaguggaauuaagcuuaaacaguucaaaauuauauaguuaagacauucuguuucaaauauuauuccaaguuaaucuaagucaacuagcaugaccucugcuacacaaaggcugguacaaaaaagauuucgaggagcagguggccagggcccucaugggagcuaauuagaugucucuuccuguucagcccugacuacugggucccccuaagccuccccaccgaauaaucuguuaggccgucuucuagagucugaaaggcuguuugugaggaguucaggauuugugugaaacugugagcagaguuguaagaaauuuagauuugaguuucaaccauguccuauuuagcaccuguguuaucuuaaggaaucuucagcucucugagauuugguuuucucauuaguaaaauguauaugauaugccugacauguuccaggcauugcuggcuaucucucuucagucccuaguaauccccagcugaggaauggugcuagagcagguacccuguauuguucuacaaguaguauuaaugaaguuaaugauagucacugguuuuuguauugacugcaguuuggaauauaguauuuucauuacaagucagguguaaauucaaucuacauuuacuuauugaauaccaucuacgugguaggcuuaguagaagagauuagagauguaaagaugaguauguguucauuuuauucagggagcucacaguuuauuaaggaaaggggauguugaguuaacuaacuagaguauggugaaauguuuuacucccugaguggauacacugcuauguacaauggcaguggaggagaagaaacaggacucugcuuggugggauggggaacucaggccaggcaaggcuucucagagaugucauuuagcugggccuugggauaugauggaguucagagaaagaagguggaauggaaggggauucuagguggaggugauagccugaggacaggcauggagcugagagagugcuugguauacucuuggaguuauggggaaucuacuguggcuggauuuuaagguauuugggauuguacaggugagacuggaaauguaguuugagacauaccuuguucuuguuuuuaauuuuaugagucccaaaaacaauguuagugcauuuuuuuaauuuugaaaugauuguaaauucacaggaaguugcagaaauggcagauagagucucuugaacccuucacuaagcuucccccagugauaacguucugaauaauuucaauaaaagauuaaaacuagauauuagcauuggugcaauaauguuaacuacauugcagaauuuacauuuacuuuuuaccaguauuuuauuauuaauuuuuauuuuuauuuuaaguuccaagauacaugugcaggauaugcagguuuguuacauauguaaaugugugucaugaugguuugcugcaccuaucaacccauccccuagauauuaagcccagcaugcauuagcucuuuuuccuaaugcucucccucccucgaccccaccccaugacaggccccaguguguguuguuccccucccuguguccauguguucucauuguucagcucccacuuauaagugagaacaugcgguguuugguuuucuguuccuguguuaguuugcugaagauaaugucuuccagcuucauccaugucccugcaaaggacauuaucucauucauuuuaauggcugcauaguauuccaugguguguauguaccacauuuucuuuauccagucuaucauugguggacauuuacguugauugcaugucuuugcuauugugaauagugcugcaaugaacauaaguaugcauguaucuuuguaauagaaugauuuaaauuccuuuggguauauacccaguaaugggauugcugggucaaaugguauuucuagguauuugagguucuagguauuugaggaaucaccacaccaucuuccacgaugguugaacuaauuuacauucccaccaacaguguaaaagcguuccuauuucuccacaaucucaccagcaucuguuguuuuuugacuuuuuaauaaucacuauucugacuggcgugagaugguaucucauugugguuuugauuugcauuucucuaaugaucagugauguugagcuuuuuuucaaauguguauuggcugcauaaaugucuucuuuugagaaaugucuguucaugucccuugcccacuuuuuaaugggguuuuuuuuucuuguaaauuuguuuaaguuccuauauauucuggauauuagaccuuuguuagguagauagauugcaaacauuuucucccauucuuuagguuuccuguuugcucugaugauaguuucuuuugcugugcagaagcuauuuaguuuaauuagaucucauuugucaauuuuuuuuuuguugcaauugcuuuuggugauuuugucuugaaaucuuugccuaugccuauguccugaaugguauugcccagauuuucuucuaggguuuuuauaguuuugggauuuauacuuaagucuuuaacccaucuugagguaauuuuuguauaagguguaaggaagggguccaguguccaguuacaaauuucugcauauggcuagcaguucucccaggaauuuuuuuuuuuuuuuuuuuuuugagacggagucuugcuguguagccuaggcuggagugcaguggcacaaucucgguucacugcaagcuccgccuccuggguucacgccauucuccugccucagccucccaaguagcugggacuacaggcacccaccaucaugcccagauaauuuuuuguauuuuuaguagagaugggguuucacuguguuagccagggugaucucgaucuccugaccucgugaucugcccgccuuggccucccaaagugcugggauuacagguaugagccaccgugcccggccuuaaauaaggaauucuuuccccauugcuuguuuuugucagguuugucaaagaucagaugguuguagaagugccgucuuauuucugaguucucuuuucuguuccauuggucuauguuuuaccaguuuuuacaugcauuuguguauguguaugugugugugugugugugugugugugugugugugugugugugguuguguguaguuccaucaccacaaaggaacuuccuuguacucuccauuuguauucauauccccuaucuuccuggaauccacuaaucuuuucuccaucuauauaguuuugucauuuugaggguguuauuaagugcaaucauauaguaugcacuuaauacucaauauguaacuuuugagauugacucuuuugccuccacuaaacagaauguccuugagauccauguaaguuuucucauguaucaauagcuuguuccuuuucauuuccguguaguauuccauuguaugaaugugccauaguauguuuaaccauucaccuauugagugacauuugggauauuucuaguguuggguuauuaugaauaaugcugucaugaacauugaugugcagguuuagugucgacauagguuuuuuuuccucugggauaaaugcacaaaagaacaauugucaggucauaagguaaguagcguuuagucuuaggagaaacugacaaccuauuacuacuacuacuacuauuacuacuacuacuucuucuucuucuucuucuucuucuucuucuucuucuucuucuucuuucuuuuuucuuucuucuuucuuccuucuucuuucuucuuucuuccuucuuccuuuuucuuccuuuuuuuuuuuuuuuuuuuucagaaugggguuuugaguguuugggaggaguaccaaauccaugaugugaagcuauuuguaguuuguuuuagacauggauuugccuccugcucugaaaacgcauuguauaguggucaguuccuuagcucuuaagcaaugaguauccacaucucauuguguuuucaguauucucuaaagugacucuugcuuccuuacugaggcugugaucuguaagagccagucauaggguuaagcuauaaaguauuuuuagaauaacuaaauuuuuuuacuuguguuucuaaaauaacauacauagcucaccccaauauuucauguaaauucccuuguuuccucccuauucagcugcccucacaucuauagcuuuuauuccccuucucuaagauacuccaccaucauccgugcauuuuuauuucuccucaucugcuguaccuucuuaccaaccgaucucuuaucuuguccacuccucucuaccacagacuucuccuaagaauuuccucuucucauuuuugccuuuuuauuguauugaccauguugccaucccuagcccuaccacuuggccgauucugcaucauagaaacuagcuuagcagcauauuaucauggaugugaauauauuuuugaguagggaauaugaucaagaguucuauaguaucuuuccaaaaacauuuuuuagagacaaaucuuuucucccaaauauucauuuaguuuggaacaucucugcucuuacuguaaaucacagugacauuauccaggggguaucuagggauacccccuggauagucugcuuuuugaucacaucccaugacuucuuauccuucucuguucuggccagaaaucaauguguccauuuuuuucuaggccagcuaauauuugaggauugaaauaucuuuucagguaucuuauuauuuggaaauacaugauaggcucuaacuaugacagauaggaaucuguugcucucaagcagucauccuaaggaaacuaagcucugaaggcuucuggaaguauuuuuaagaaguaggaagcugcucuugaauuuauugcuuuucuuuggaaggaaaggaagagagaguauuuuuaagaaguaggaaguauuuuuaagaaguaggaagcugcucuugaauuuauuacuuuucuuuggaaggaaaggaagagagagagagagagagagagagagaaagagagagagagacagacagguuagcagugugaauagugggcaggggacuucagagccuuccgcucuguuacugaucuuguggcucucuagcaagaaggcucuugugcuuuugagcaagucauuuuaccugauuuccaucaucuguaaaauguagcagcucaauugaauuuuucagucucuaaaauuuugguaucacugacucacagauacagagaaaguaaaugaguugccuaaaguuacgugauuuacucauggcggagccagcacucaucccccucccccaucuaggucccuguaguuccugccuuguauauugguaguagauuaucugaguguaguuuggacacuuucuguguuuucugaguggacuccucauuaauccaucuuuagucaaucaagcacucuugguuauuacuuaaagugauaacauuagguucuuuaguugguuuccuguuuuugaccuguuggugaauuuuuaccaaucucaugugacaaagaucguggaagcuuuaaaaaauguucucuaaaaucuuaaugcaaaguggcauucuccuucccuucuuagagacauuagcuccacuggaggaaaaaggcacaaaugccuauuucaucuuaaaaaucaauuaucuugccuuacaacauaaagcaguauuuuacacauugaauuauuugaguuccaccuugacauuuuuucuucuuugauugccccccugcuguuauuuucuuaacauuuuuucuuuaaauggaccuacuuuauuuuacuuaaguguauuuucaaaauuugauaacugugaacucacagguugauuuauuauguuguuuccaauucacuuuaaaguaauaaacuauauauaaaaaaagcuuucuuguaccaucugaaaccuucucauguguauauacaguacuuugggaaacuuugcauaagaccaucugggucuacugguugaaugguaagagaagggaguaauaaaaaaauaagaaacaaaaaugauacuguuauaagcuuauaagccauguggguaauaaauuagaauggaaacaugaguuuguaaagacagauaaaugaauuuccuugacuucaagccacuguuauugucaagauaaaguugugcauguagagaaggaagucuaacaaaaugacauuccauucuggggcuuaaaugcuugcccuuccuucuuuuuuaugacucuugcuuuauugaauagcacuggggucauaaggccccaguagauguaaaugcuaugcuguacaucuugucaggaaggccagccuuugugucugcgggaggaaugcuuguccuuguugcaagaagguaaaacagucagaagcaaaugagaucagauuuagauugccaagccucgggugggacccuuggaggucagaacacagacaaaaggaaacaggaaagcauguuuaagaguaagagaaggguagggcuagcuucguggucauguaaccaugugaacuugugguugcacaaguucccaugccuagaagggcccugaacuugguuuaaugcucugcugucacugucuugaaauucuuauuaauuuuuaaaugaggaagcuuguauuuuuauuuuguacugggcccugcaaauuauguagccagcccuuggugugggguagacaaaugcuuauagaagacuuugugguuuagguucaugggguagaacuggaagagugagaacuagauaguaaguugcaaaaaaggaaaaaguuucagcuacuaacugguggugucucuucugauugaccuuaguucauagauuaaauaauuuaacauuggacuccaggauucuuuuugccuuaaacuccuaggcuggcugacuaacuuccuuccaugguuaugaaguaguagagggaauggcaaauuauaucuggagaacauggauaaugaaaugaauagaucucugagaacuugaaaaaauuauguaguaaguuuguuccugaugaguuaaaguguaaaaccaacucauaguggauuaaguaggggcuugcauguaaauauccacaaaggguggcuauaagacaacagagagugaugggcaguagaggugauggugggcacccaaggaaacauagcauguuuaaaggaaaaucuguauugaauuucagccuguuauugccaaguuauguucagucuguuauuguuccuuguagcucaaauccuuccagguuuuuuagaaguagcuggaaaucuggauuuuugacuguaauauuuuucaauuaaagaaaaacaacuauguagacuaugucugaguugaauucauuuuaauccuuaaguggacuuuuuaaaaaccucuuuucuaaagauuaauauaagaagugaccauucaaauuacuguuuuagggagggagucauagcaaugugaggccaucucuaguaaggagauggaauuagaguaagaguugccaguggauacugaggauuaugauacagaaggagcucuaaauuuucuauauuggagggucuuggggguuaaaaacaggcuugucuuugaggacuuaugcuauggcuugaauguguccccaaauaucauguauuggaaacuuaauacccaaauuuauauguugauggcauuuggaagugaguccuuugggagauaauuaggauuagauaaggucaucaggguaggccucccaugaugggacugguagcuuuauaagaagaggaagacagaccuacacacuacuugccuucucaccaugagaugcccucugcucuguuaugacauggcaagaaggcccucaccagaugcuggugcuaugcucuuugacuucccagccuccagaaccauuaucuaaauaaaucuuuauuguuuauaaauuacccagucugugguaauugguuauagugacagaaaacagacuaagacaacuuauuuguaauuauguuugcguagcaaacucacuguuuuuacuuagauuauaugacguagucauaagaaauagccaaccuuucuaguacauuuuuucccacaccuuagauaagauugaaaaaccagcaauuucccaucucuaggaguggguggggaacucuuagagcugcuggauuguaaggggaaguaaaaaaaaaguucucacaccccagaccagucuuuuacccaccacucuuaugguuuauuuuuaaaacaaggucaucauuauuauggauacaucaggcuuucuuagccugauaucauuaaacaugcaauucauuuugugauuuccccugagugugugcuaaccuucugaauaugauuuggcuucccaacuggauuggucagagggagggaauggguagguccugcaguuuagaauauagguguuucuaugacuauuuauuguuaauuauaacuuaauaaauugacauucuagcauuaaacagcagucuugugacuguggucagugaaccugccagugaaauuucgaaucucuuuggucagcugacacacucaguuuugaacuugggcagcucagaaccagauccuagacuauagcaaacuggucaaaguaaugaaugaaauuuugggagccccguuggaaagccuuucccuaggugacauaaaaaauauaucucgaauguaugcauuuuuccuauuugaauuucuuuagugauagaguugagacauacgguuuauaaaagucauggaguagggagggauagccccauggaaguguuaauaggauuucagauaauuuugggaaaugcugguuuaagugaagguaacugauuucuuuaugaggacuuuuccagaacauuuauucuucuaaugagugauccaguaggaacaaaugguaagugguguuucucaaccucauuugcuaaugguacuuuuaaaauguuuccuuggcagcacuuuuggaaagcaucgugaaauauuuaccaagugcagccuuaagaauacaaugaaauugagauauuucuggaauuuuccuggugucuagucaguuuugggaaauuugugcugaaccccaguuugcauuggguuucauaagaccuaccagagaguucuggaauccacaggaaugaccauuugcucacuagguaucuguauuagugagaguucuucagagaaacagaaccaauaggauguagauacagauguacauauagauauacgagcugaaauuuauuagcgggauuggcucacacaauuaugaaggccgagaaguccuacaguggacggcaugcaagcugaagaacccaggaagccaguggcuuggcuuaguucaaguccaaaggccugagaaccaaggccugguguaacucucaaucuauggucaaagaccugacaaccuggggaugcugcuggcacaagucuccaaaggcuggagaaccuggaguucuuauguccauggguagaagaagaugguauucuaucuccaggggagagagagagagagagagagaaggagagagagaaagaaggagagagagagagaaagagagagagagaggagagagagagagaaagagagagaaggagagagagagagaaagagaaagaacauauuugccuuucuuucuaucugggcugucagcugauuggauggugcccacccacuuugggugacggaggaucuuccuuauugagucgacugauucaaaugucaaaucucuucuggaaacacuuucacagacaugugcagaaauaauacuuugccagcucucuggguaucccuuaaucuagucaaguugacaccuaaaaguaaucauuacaauacaugaaccuggaauugucccaguguggacccaaggcagaaauggaauuuaguaaucugggguugggaauuuggauguacauauugugagucaucuuggaauugccagaguccaagacuuuuuuuuuuuaucuauauauauuuucuccugauagcuuacuucuuaaaagggaacuucccagguugaauaugcaaugcuuauuaagacccauuccagaacccggcuguguucucacagauaggacucaaugagcacaaugguuaaaucuuuaucuuuacagggauuuuuuuuuuuuucagaggauuggagauuagauuauagaguaauaugguuuuauagacauucauguuacuuucuuuguuucuagaauaaggaaaaggaaugcagagcuacauuucuuaauaugaaauggugauugccaguacagcccaacuguauauuuucaguuuguaaugacaacauuaggaggaaaauugauuaguacuuuuaaaacaguaggaaaauuauuucugcccaaacauugauuagccuuugaauggacuuucuuauaauucuuuucuuccacagacugcagggugcagcacagucauauuuuaggcagagucaagcagagaaaccuacuugccgcuauuaaacuuauuacugccuuuuccagugggugcaaauaacuuugucuccaguaguuacacucuccuggcuugauaacacauaaggacuucuuuguuuauuuugauuaaagagacuaaagauacuuuugucuuaugugaaaugugaauacagugaaauauugaaauuuuuugaugacauauauuccuccuuuuggcuuauaaaugucaacuuguuuagcuuccuugcaugagugcuuuaaaauuuauuagcugaagcucagguaauauuaauuuguuccugguuaaauguuauauaaaauauaggaauaaagaaaacugagguccuuacccucagguaacuuauauauuugaggaguuaagacauagaaauaagauaaauaggagaguuuaugaugagccccagaugaguggguuggaauauuacauaaccaauacaggguuucagaaggagagagauuuugugugcgugcauccugaaauaguuggggaggacucaugcaggagcuggaacuuggagauaggaagaauucaugcagguggaagaggguaggagggaugcuggugccauuagcagagagggcuagaccagaacaugccugcuuuuucaacagugaguagaucuguuuggcucuaauagaggacucaugaugggggguaaugaauaaugggaaauaaaacuagagagguagguugaauucaaauugggaggggcuuugaaugccaggcaagggaauuuggacuuuauucuguagaaaauggaugaacagugaagguucuuagccaggaauaagaagaaaauugaagaaauugcuuuguaguuuaguuagagcagaagcagcguacagcucugaacccaagugccuuagauggaagauaagggcaaaaagaacuguaugcaagcucugucuucacuucugaugagaugcaggaagaaguuagcugcuuaauucucuuuauuuuuccuucucucauuuaaggcuuguauuaaaucucuuuuucagucuuaaaaugcauuaauucaaauuugaccuuccuuacugucugauaguugaauauccaaagcuauuuucaguuguuccagauugucacagauuuugaugucuaggugccaacuggaagggccaaaccuggccugcggaggauuguuuuuaaaaucugauucuaaauuaagcacuuugagacagaagaaaugagauguggccuaguucuaacucaccauuuagcuaaauguauauguauuuuuuucucugccuaaauauuugucuuauucuuuuagacccaaaaaucucagagccaagaauauuuagauucccuuucacucuuucacuuuuuccaauaguuuuuggcuuuuacuauucuuaauaaguuacacuuauaaaggaaugucuccaaaucuaauucuuuuuuuuaaaaaaaauuguuuuaaauuccuggcccuccuccuauccuguaucucacaaauuauuaaaauggaauugaauuuauuucuugaaggagaagcuacugauaggauuuagacuuuuaaauaucuaaaauuaaguucuaaacaauaguguuccuauuagcaauagaaauugugguuauagagaaacauaguauaguguaagcuuuagagcacgccuguccaacccgcgguccaugugccauaugcagcccaggacggcuuugaaugaggcccaacaaaaauucguaaacuuucuuaaaacauuaugauuuuuuuuuuguguguguauggcaauucuuuuauauauauauauauauauauauauauauauauauauauauauguuuuuuuuaauuguacuuuaaguucuaggguacaugugcacaacgugcagguuuguuacauauguauacaugugccauguuggugugcugcacccauuaacucgucauuuacauuagguauaucuccuaaugcuaugccuccccucuccccccacaccacaacaggccccggugugugauguuccccuuccuguguccaaguguucucauuguucaguuccccuaguucaaccauuguggaagacaguguggcgauuccucagggaucuagaacuagaaauaccauuugacccagucaucccauuacuggguauauacccaaaggauuauaaaucaugcugcuauaaagacacaugcacacguauguuuauugcggcacuauucacaauagcaaagacuuggaacuaacccaaauguccaacaaugauagacuggauuaagaaaaugugguacauauacaccauggaauacuaugcagccauaaaaaguauuuggcaauucuuaagaaaagcucaucagcuauuguuaauguaguuuauguguaacucaagccaauuauucuuccauguggcccagagaagccaaaagacuggauaccccugcuuuugagccagaaaaaccuguuuuaaaauucucccucugccacucaccacuuaggugaucugaauguauuacugugacuacacauccuuauuuggaauuccauggguagaacuuaaagcaaguucuuuucucuuuacauaaguggacucuggucuaauacuuacagugauagaguauggguaaauacacaaauagacuuuuaaggguauccuuuagccuucagacuuucugagacccgcugagauacagaagagaagaaguggagagauuccaugggcaaaaagggacuugagaguuauggcuccucaagaucuagguucuuauucucacugagccucggcuucuucaucucuaaaauggagaauauuuaacuuguagagauauuaugaagguaaaaauagauaauuuagcacaaugcuauauauauauguuuuaaauacuugucuuuugccagauaccgguuugcaaaucuuuucuugccaucuauggauuauguuuccauccucuucacaugucuucugcagaggaaaaguuuuuaaucuuaaugauuuacaacuuguuaguuuuuccuuuuccuggauuaugcuuucaaugucaugucugagaacuguuugucuagcccuagguuaugaaaauuuuuucuauguuuuuuaaagagccuuauugaaauauaauuaacauacuguacaauucacccauauaaaguguacaauucaauaguuuuuaguuagguucacagaguugugcaacugucauucugauaaguuuuagaacauuuucaucaccccaagcagaagcuuuguacccauuagcaauuaugcucuauuucuccccaucuuccuuguccccccaaccuaggcaaacacuaaucuacuuucugucucuguagauuugccuauucuggacauuuuauauaaauagaaucuguggucuuuugucacuggcuucuuucacuugaacaguguuuucaaaguucauccauguuguagcauguaucaguauuucauuccuuuucauugcagaauaauauuccauuguauuaauaugaauauauaagauuuuguuuaucuauucauuaguuuauggacauuugauuguucccacuuuuuggcuacuaugaauaaugcugcuaugaacauuuguguacaauauguguauggacauauguuucuuauauauccaauauguacauaaaaagaauaugguacauauauugguguaugguugguagaaaugccuauucagagucuuuguccauuuuuuguuuuaaucuuuuuaucauugaauuguaagaguuuuaaaagauauucuggauauaagucguuuauuagauauaugauuugcaaauguuuuuuccauucuuuggguuguguuuucaucuucuugaugauaucauuuguagcacaaaguuuuagauuccauugaagcucaauuucucuauuuauuuauuauuauuauuuuuggucucuugugugcuguuguaucuaagaauccauugccuaagccaaggucacaaauuuacuccaauguuuucuuuuaaaaguuguauaguuuuugcugauacauuuaagcccuauuauacauuuugacuuuuguguaugauguaaaaauuucuuaugcuuccuucuaaaaauuauauagguuuguguuuuuguguuuuacauuuaaaucugcgauccauuuaaguuaauuuuuguauaauguaugucaauuaugccaguaucauuuguugaauguaagcuaaauuuuuagguaaaaauuuaagugcccuauauacagucagacuucaagcugguuuuucuucagagaaggaaauacauuugagaagggaucuuccacuuuauuuagacuuuaaagaagaaaaauaaauagaaaguagaaauauuaagaaacuacgaaguagguguaccaccuccauuuuuccaauugcaaaaagaagauaguuuuuauaaaggugcuucauaauaccacuuaaaagauuugcaaauagaauaguauuuaaugagauuaucuuccaauaaagaaaauggaaagguuucucacugaaggugaaaacacauauauuauuuuaaaaguucugaagucuucaaacuaaaauaauguacuauaacaaaaaaacuugguuuuucauauuucaagucuuuuugucuggaucuuuguucauucauggcuuuuauuagguuugcaaacaguugguggacauguggugaagucacaccucauuaacagaauauaaauuuuccaugugguuuuguugccucuuugcaguuauuuugcucuaagacaaacuucuguuucauaaaaguugggccuuucugucuugggaaaucucugcagauacuucauauuuguuuuaaauuacacaucgucucuuaaguuuuccagucaugcuuuauacuucauugugugccuuaaaaauguuguauuauuaggauccucaccuugaaagauuguuucaaaaaauuguuauuacauugaaauaagucuuuuaaaguacaacaguguccuguuaucuagauuagauggauaacugaggauuagaauauguauggaagaucagucaccaguuaaauugguugguuaguuauaaaguauauguugacagugugcauagugcuuugugauacucuugaaaaaaauuuuaauugacauauaauuuuauaauuagcauaccauaaacuucaccuuuuaaaguguacaaguuagugcuucuuuuuaauauguucacaaaguugugcaacuguuaccccuaucuaauucuacauuguuauuuguuaauugcuuauuauuuauuuauuuuuuacuaguuuuuuauguguagcuuacuucaaaauauauuugagguaauuuacaguaagagacucauuauaacagggccacuaugauauaagaggucaaaaacaguaguagaaaggaaagaauaccaaaaacucaaacugaaauuaauguaguauugcuauuaggcaaagcauauaaauccagaacucugaaucugguagcauuuuuuucuucuaucauggugcaaaauuuauuucuccuaagaacuugcuuuucuuaaacaagucaaaucacacuguuucuucccucuuuaaaguucccucuugauucucacagccaaaagucauguuucauauuaauguuugagacuuauucaaggucacauauauuuggggggcaaacauggcauaucuucuuguaguaucaauuuuuccuaaaaaauuuagagaagaaccaauauuuuauauuaauuuuaaaacauugcuuaauguaaaaaauagauauagaguggaaugaagaauuugccugaaaucaaugcaagauuucaaauagauaugcucaauugugaucucagcugagaaaaaaugaagugaaaauagaguagaauaacgaauuugccugaaaggaaugcaagacuucaaauaaauguugugcucaauugugaucucaacugguaagugugaucucaggaacccuucugcccuuccuaguacauauuuucucuuugccaguagugaugcugccuuggaaauaccugcaaaaacugcaaaguucuggcuuaccaaaccaaacacacacacccagggacauaccaaaaacaaaacaaaacaaaacaaagcaaaaaccucagaaacaaaacaacccaacaaaugcccaagccuuauuuccaaauccuaagauugguauaaaaccacucacaauaugcuaaacuucucucagauugggaccaauauugggccuuuuccagauucuucuugccuggaacaccaccaugcuuccugcccagacuaucagaucaccacuccuuccucgggucucagcugugaaauuucuguacaaguugcuauguucccuaggcauuguguuucugacucuguccucuguugcuggaauuaccacagugaauuauuauggaauggagggcagucugauuaggcauagaguacgaugguaauggauguauauuccuucuuaacugcagacuccucaaaagcaggguucaucuuuuacucaucuuuauauucuuggugcuuccuauugcucccgacacauaguacauauuuaauaaauguauucuggaauuaaugaauaaauucugaaugauaauaauuuguggaguauaguaaugcagauaauuuuauuugggcuuaguaguuuguuguuguuuuguauuuuagaauaaaugguuuucucauauaucuuauucccuucuuaguacaucccaguaagacuucuagcacccaucaguguacugaaacugcucuugcugggucaacaacaacccaggguccaaaucuaguggacuuuuuuuucccguugcuuucuuaauggagcuuuccauugcauuugacacuauuguaacuucuucauuuuugaagcuccuuacucuccuacuucugaaacagugcccucucccacaucuucuuauaucaacuauuacaugucaacaggcuauucuucuggcugcuucuuaaguguuuguuaguguccgcagguucuaucuuccacucuuguccuucucuaccuugcacuggggcaucucccucuguagucucccugugucuguucugugaccauaauccuuagauugggguccuuaguucaguucuugugugaauauucuucucaucucugcagcugccuccuuggcauugccaccagaauaguccaaagcuucacaaauguuuuaugucuaaaaugaaauuccccuucuuuccugcuaaacuaguucuucuauuaacauauucuuucucucauuuuaugaaaguauaccaucuacucaauuacugaagcuggaaaucuggcaguccucuaggauccuucuucuuuacuuuccccuucaaauuaaccaugaaaaccucucauuuuuuuccccuguguauuucacaaauuaauuuuauuauccaaagcgauggccuucucucuccaguacuaccgcaggguggagagugcauauggggaguggagaaacugacacuaucuagcccagugaccucauuuugaaccuaguaauccaggacuugucaguuauaugggcauauauuaaacauuaaauaauugguguuuucugguccuggcauuuccagaagcacucugucuuuuuuucacagcuacacaugcacuauuucuugguucgugccucauaguuccccugcuggccuguccugcccuaggauucuuuggauuacccuagaccuagaaugacuugggucuuuuccagagccacauuagggaauguucuccagaacuucuuucacauucagcauucccugcauccaaguagcagucagaggacucuggcauggccaggagaccugcauucucuuucuuucuuucuuucuuucuuucuuuuuuuuuuuuaagauggagucucgcucugucgcccaggcuggagugcagugacacaaucuuggcucauggcucacugcaagcuccaccucccggguucaugccauucuccugccucagccucccgaguagcugggacuacaggugcccaccaccacgcccggcuaauuuuuuuuuuguauuuuuaguagagacgcaguuucacugugugagccaggauggucucgaucuccugaccuugugauccgcccgccucagccucccgaguaucugggacuacaggcgcccgccaccacgcccggcuaauuuuuuguuuuuguauuuuuaguagagauggaauuucacugugugagccaggauggucucgaucuccugaccucgugauccgccugccucagccucccaaagugcugggaacuugggcuggaauccggggaugauuaggaaaaacaagccaugccuugucuuccauacacucacacccaacacugauacuucgcuucuggccacuaaaauauguggagguuuuuccuacacagccaauucucugacaccagcugagugucuuacaauucaacgcaguucugacacuaucuacccacagguuaagggcucagucccacaagacugcccuuauuucagacacugaucacaaguccagauugucacuuacacuccucaccuacggcuaucaaucagagguucccaugaguguguccuuagguuugaucauuugcuagaauggugcacagaacacagggaaacacuuuacuuauguuuaccuguuuaauacaaaggauacaacccaagaacagccagaugaaagagauucauagagcaagguccaggggaagcacuagauuuggacaguggguuguuguugacccagcaagagcaguuucaguacacugaugggugcuaaaagucuuacugggaugcacuaagaagguagcauuccuagcaccuccauguguuagggaagcucuccaaacccugucuuuuuggguuuuuauagagguuucauuaaauagucauuguugauuaaaucauuggccauuagugauuuagucaaccuccaguccugccccucucccuggacuuuggggguugaggcugaaaucccaacccucuaaucacauggcuggucccucuggcaaccagcccccauccugaggcuauccaggagccuccagccaccagccauccaauaaguauacaaaaagaaacaucauuuuggagauuuccaaggguuuuagaagcugugcacauggauacugggcagagaccaaauauauauuucuuauuaugucaugggcaauuaccauuuucuccugggcuggcagggaauaggucugcuuagccagcucucaaucugcagcuccaugucaugacucuaccauugauuccauagagggagaaucuuauuucacuuuaaggauauugcuucuuacucuuuuuuuuugguggggggggggucauuauuguuuuucucucuuacaguuuuuuggucauuacuguuuucccauacuugucagagaguaauccccccaccccaccucccuguuuucucucuccugucagucccagcacucucuaaaagacaugcuuguaaauacggucauuuuuauaccuuuuuaauuuucuucccucugucacaaaagauuugaaauauuauaccacuguacgaccagauagauguuaaauuucacuuaccuuauaggcaagaguuucuuuuuuaaacaggauuguggggugauaggaucucauuguuuagaaaaccagagggguagcuccuguugucagcgaugauuaaaaauuaaagguagugucugcuucugauuuaucuguauuuacuuaagcagauguguuuuugauugucuaucaccuagggcugaaaaaagggcaccaaaucagugauucuauuauuuucuuugaaaaguugagggcuauguccaaacuugaggccaaacuauguugaaaauagguaauuuaaaugccugguuuguuaggaguaaauuaccgcugccaguggauuccguggcugcuuggcagggguaauuugcuucauugcaguguuuucuaguugagguaaauuauuccuuuuagaaaguuaaaucuucguagagaaaguaaacauuucaucuuugagaaggaagaauagcuuguuaaaauauugaaaacauuuauugaacaucuaacaugaagcuuugacgggaagaaaagagauacauuuuagagaacaagacuuuuuaccgagaguaugccuugaguaaagcacuuaguaggggcauuaguuaucuagagggaaagauccgauacuuggggaaugaagagagaggcaagccaggaaaugggaaggaaggaggaagguggaaagguacccaagacacauucugcuguuacuccguagugacccuuuccgaagccuguauuuccugagccaagaccuuccauugucuuucaaauaucaggccugguuuugcucuucauaggaaaugaguucauuguuuuugacguccugucgauuuuuuccccucaaagaguagauaauuagaacuuugaugaagaaaagguccuauguucuguuuuauacauaaucauuuucugaaccaucaaguguaauucagcuucaaucuucagggcgaaugaagauuacuuaggauguauuaaacugugugaauuuaauguucaugacaaguguuucauaaaggaagaugcuggcuauuaucucuccucagaaggaaauuguugauaagaaaccauucugagaaguaagauuuauggcaacaucagaggcuagagaagcuggggcagcugagcacccaggacgaucaggacaacuaggacaauucaguuuuucuugugcugucuuuuguguuacaaaaacaaaaaaaaauaaauuuuuauauagccucacuccaaaagcaauuaaggaaaauauuuauucauuaaaagcaaugcuguauuuuaaugaagcauguuaauguuugacagagauaguuuauuaaaaagggauagcagugagagagcuuucccccuuuuuauuguuuuuccccucaaauaaaauccuuacauuugaauaauuuauugauucaggacagaguggguugguaauuuuaucuugaccucauucauccaaagaaccauauaacccaaauacaaaaagucagacucuuaugcuucaaaaaccaaugcuauuuaaguaaaugaaguuaauuuaacucauucucuuuaaacaaacuggcuggaagggucaacuuuucaaugacuguacaaucagcaacuaugcuuuuaauaucguacuuuuccaauuguauucuguggaugguuggucaucucuaaagguacuucaggucauuuacuguagaauuuauguuuauaacacuguauuuuauuucuucuagaguucaccaaaagcagugucauuucaucuuuuaacugaaaacagauauucuuuaagauguuaguuuccugugguugcugauauaaauuaucguaaacuugguggcuuaaaacaguggaaauuuguuuucucacagcucuggaggccaaauuucaaaaaucaaggugucgacagggucccacuccauaugaaagcucuaaggaagcauccauuuccugccucuccagcuggagguagcuucuggcauuccuuggcuugugguugcaugaugccagucucugccucuguggucacauugcuuccuccucuuuugucugaaaacacccucugauugcauuuagggccaaacuucucaaggcccuuaauuuaaucacuuuuucuuuuuggcagugggagggagcauauaaaguaauaaucacagguucuggagauuaggacauauacguaauuguuuugggggccaccauucagccuacuacaaauacuuuauucuuuuuuauugcuccauagauuuagaauguucacucuaccuauccuaccuguauuaagaauauaucaucauaaucuuucuaaaaucccauguagaucuagauagagcagaaaauacaaacuuuucccuuucccaguaaucaaccuacauuuaauuauucaugcuaugauggacugcauaaauuaaagaaaaaauagaaaaucugaaagggaagauaaugaucucauuguuauuuguaguugaccauggucaacuauaaaaguauaaaaauacuaaaauuauuaaaugucauauuuaugaucauuuguucaccugaagaguauugaauaauaagggguacauuuggguuauacugaaugaguguugaaaaugauugaaaaucaugaaaauaauuuauuugggguugaaauuuuaucaaauaaauaaucuauaagguguauacauuaugagcaaguuagcaagagugucuugauacaaaguauugguaaaagaaaagauaguucacacugaguuuguuuucaauuuaauucauuuuugcagaugucaacaaaaucuuucaccuuuuuauaguauuuaggaagaagagagcauguaaggucaaacuuuaauuaacuuuucuuugccuauacuggacuuucccuacacaaguagguacuuauauucugaucacaaguccccacacgucgguuguagauagcaaugucaaguuagugcauacccagcuacuaaaguuuacuggacuuucagguguucuuggcaugccaggcaggugguacccaguuauuuagagagaucuuucuuucagaccuuagacaugucuuuuacauauaaauuacuuagguacuuugaccgcaucaugugguucaguuuguuuuacaaugaagacuagagcuuggggaagggugguuuuuguugcccaugcuuaccugaaauucagaaaacuuaucuugaaggagccagagccaguugguauaucucugagaacuguccuuagacucuuagcugggugguguuuuccuaguccuuguguaaaaggauaaagaugguggaauguauaagguaaaguguuuuuaggauauacguaucugggugccacaaagggcaugaguagggaacagugaaggauaagggugaaaccauucauugauccuaaucauggaaagccuugaauaccaggcuuagaaguuuggauuuucucaaugugcaaaaaucgguagcauuucuauauaccaacaauauccaagcugagugccaaaucaagaacacaauucaauucacaguagagacacauacacacacacacacauacacacacauacaccccuaggaauacggcagaucagggagguaaaagauuucaaugagaauuacaaaacacuguugaaagaaaucagagauaacaaacaaaugaaaaaaacauuccaugcucauggauaggaaguaccaguauuguuaaaauggccauauugcccaaagcaauuuacagauucaaugcuauuucuaucaaacuaccaaugacauuguucaaagaauuagaaaaaaacuauucuaaaauucauguggaaccaaaaaaaaaaaaaaaaaagaguccgaauagccaaaacaauccuaagcaaaaaaaaaacaaagucacaggcaucacauuacucaauuucaaacuauacuacaaggcuauaguagcaaaaacagcauggugcugguuuaaaaacagacacauagacuaaugaaacagaauagagaacccagaaaaaaaagcugcauaccuacaaccauaugaucuucgacaaagucaacaaaaacaagcaauggagaaaggacuuccuauucaauaaaugaugcugggauaacuggcuagcccuaugcagaagacugaaacuggaccccuuccuuucacuauagauagaaaucaacucaauaucaauuaaagacuuaaauauaaaaccuaaagcuauaaaaacccuugaagaaaaccuaggaaauacuauucuggacauaggcucuggcaaagauuucuuaaugaagacaccaaaaguaauugcaacaaaaagaaagauugacaaaugggaccuaauuaaauuaaagaacucugcacagugaaagaaacuauccauagaguaaaccaacagcccacagaaugggagaaaauauuugcaaacuaugcaucuagcaaaggcuaauauccguaaucuguaaggaacuuaaauuaacaagcaaaaagcaaacaaccccauuaaaaaguggacaaagagcaugaauagacacguuucaaaagacaccaaugcacggccaacaagcacauaaaaaaugcucaacaucacuaaucagauacaaaucaaaaccacagugcgauaccauuucacacaagucagaauggugauuauugaaaagucaaaaaacaacagaugcuggcgagguuguggagaaaaaggaacacuuauacacugcuggagggaacguaaguguuucagcuacuguggaaaacaauuuggugauuucucaaagaauuuaaaacagaacucccauucgacccagcaauuccauuauuagguuguauuaggguucucuagagggacagaacuaacaggauagauguauauauaaaggggaguuuauuaaggaguauuggcucacacgaucacaaagugaggucccacaauaggcugucugcaagcugaggaguaaggaagcuagucugagucccaaagcugaagaaccuggagucugaugugugagggcaggaagcauccagcaugagagaaagauguaggccagaagacuaaaccagcuuagucuuuccauguuccucugccggcuuuuauucuggcuguacuggcagcugauuagauugugcccaccgagauugagagugggucugcuuuucccaguccacuuacacaaauguugaucuccuuuggcaacacccucacaggcacacccaggaacaauacuuuauauccuucaguccaaucaaguugacucuuaauauuaaccaucacauugguaaacccaaaggaauauaaaccguucgaagauacaugcauucauauguuaaucacagcacuauucacaauagcaaggauguggaaucaacuuagaugcccaucaaccauggacuggauaaaaaaauugugguauauauacagcauagaacacgacacaggcauaaaaaaagaaugagaucauguccuuuguagcagcauggauggugcuggaggccauuauccuaagcaaacuaaugcagaaacagaaaaccaaauaccacauguucucacuuauaagugggagcuaaacacugaguacacaugaacacugagaaaggagcagacacuggggcauacuuggggguggagagugggaggagggugaggauugaaaaacugccuaucagauaccaugcuuauuaccuggugaugaaauaaucuguacaucaaaccuucgugacauguaauuuaccuguauaacaaaccugcauguguacccugaacuacaauaaaagcuaaaaaaaaaaaagaaauucagauuuucuucuuucuuugauucugucccucucauuuaauucuucucccuauuuauuucaccuuagauggcaguggauuuauucaguuuuuguaguugauuguuuaauaguauuuuagucucuauaguuuuaaccaaauuucugaaacuucuuuccagaaguauauuuugauguuugauucuaacuuuccuauccuuuacuugccaaaagcaacaaacaaaaaacccagauuuuaaauuguaaguuucuaccacuuuaaaagaaagaaguuaauauucuugauguuacacuucuuuuuaaaaaaaugccuuuuguuuccaggaaaaauacggaaauuuuuuuugcuuccaaaaggucaugguuucuuccuucuaauuacauucuuuaaaauucugacagugugggcuuugcaaauuauaccaucauaacucuugaaugugcuuuucauaaaauucaacacauuuuaucuuuagccuccgaaguccuuaugacuuauaccauuauucauacaaacuacagguuuagaaucaaguaaacaaaauuccugcuuuaauauacaacuacaguuguuuuuugguuguguuucugguuggauaauccagaucagacuuugugacuaggagcuguaaguaagguggcugccuuaaaauguaaugcaaaaacaguccuuuuuagucuuuuugucuuguggcugggaccauaugguuuucugaaguucauauguauaauaguccuuuuuugugugggcuccauucauuuauauucuacuguuuauuguuuauucauucuuucauuuugaguaucuauucuauauuagucuugugaauauagaaaugcaaggcauggugccugcucuuaaagagguuaaaggcuuaugggagaggcaggcauauaaacaaauaauuacagccuaaaauaauaaaugcuauuguagcgguaagacaaaguccuucuuguggcuuaaacucucuagcccacauuccccagcuaauuauuuucuucuguggauuuucauccuugucucucaaucucuuuuucagauauaugcauauccauauugcuuacuuaaucuuuucugcuuccagguucccauuuuggguguggaagccuuuugcagugacuguguccugucaugacucuuuugguagcccucuccaguauuccagcuuugccuuuaaauuuuaacggagagaaaaauaauguaucucauucuuggugaaacauuuaggcuguuuaguugacauuugaaauggcagagucuauuguucuaaaaggaaaauuauccauacuguguaauguggacuauugauagaauauggaaucaggcauaucuuuuuauguauuuaugaaaguaaagcagugcuuccauuuuagcacaaauaacuuucaaagcaaaguuauuuaaaauuucucuuuucuuuucuuuuuuuucuuuuuucuuucuucucgcucugucauccaggcuggagugcaauagcauggucuuggcucacugcaagaaccgccucccagauucaauugauucuccugccucagccuccugaguagcuaggauugcaggagccugccaccacgcccagcuaauuuuuguauuuuuaguagacacaggguuucacuguguuggucaggcugguccugaacuccugaccucaggugauccacccgccuuggccucccaaagcaaaaguuauucacuucaagugcagugaaucacaauaaaucuuauuuccuuauuuuuauauuuguuuuuauaaugaaugggacuacauuacccucaauaaaagguggacaguuucacccuuuacuuauuaguuauauuuugaguaaaaaauacaagaguguuuauagaguguuuacuaaaacaaugaagcacagguaaauaaaauucaagaguaucuacaugggugguauuaauuuaccuguuuaaauucugaaugaauuacuaaaagcuugagauauaguccuaacucucugacuucaguuuccucaucuauaauaagauguuauuaugguagacacuuguuuuuucugcucagcuuccauuucucccuguacuugaaaaaguuccuacuuucaaguacuggguccaacccagucuguucccuuuuauccaggagugagcaugugacccagccuaggucaaugaaucuauacuucccguggccacugggguaguuaggguggguaggcaacccagaauggauggaucagaagucaacuucugggauuugucuggaacuauuaaagaagaugcuuuuuucccuauaauauuccuaaguaaguagaauggaaagguggaauugugggcaaucugcacauggagguaacuagagauggagccuauauggaggaaagcagacccuaucuaugcaugaaucuaacacucccuuuucagguguuucuccaguaaaggcuuuuuugauuguuguuguuuucuuaugccaguuugaguuguccuuuauuaugucacaugcaaaugauaggauccaggcuaauucaguuuggucaguuaaccuuuaaggucuuuccaguuucuacauugcaugauuccuugccuucuuuuauuucaugcaaguuagauuacuaugauugaaugagguuaggcaaauaauaacuggauauucucaagaggaauagcuucucuaucugggaaauaucaguguauuucucauaggaguugucaagaguaauuguucuacauuuugaucuuacuuguguuuauuuuauggcauaacuucaccuuugacuuuugcccaccccuggucuagcuguauucacuccuacuagggcauauaaaguuaaagaaaagaaugaaaugcaaacauugcuugauauuaaaaugauaagcaaaauuuauuuccuucugaauuguguacacaaaugaccccuuucugagccacccucaccccugggucaauaugugcauuuugugaggauaacuuuucagaacacuacaugaaaauugaaacaagaaaauaccugggagcugccugauaaaaguguauuugugagaagguuuaugagguggugaugucaaauaagaacuuggaugcggaagccucuggugaguccuggcuccacccuuuauuuagcuguaaccucgaucaaguucuguaaauuugccuugucuuuccaaugguuggguugcugugagggugaugugauaugaaaugugaaggcaguuuacaugucaaaccugaugaagggcugaaauuauuuaggaaugaaugagccuaacuaauuuagugagugucauuggugauuuguagaagaagcaacagacugggaaacauugggagauaagauuacacauguggauaguuucagauuuuaaaaucuggacugaggaguuuaaacuuguuuaaaaauaaagaagcaaguuuuagucaccacguccagaugccuuccuccaaaucauuuuuaaaacuuuguucuuuucuuuucauucccacaaccaguacaaacuccugacucaccuuguagauucuaauauauuccucagcuaacguccuguugccacauuuauuguccuaaaaauaauagacccuaauuacaugaagaaggcaacugaauguggugccugacagacucuagagaaugaaacauagggauguguaaaaauguaucacaaagacugggaaaauggugguauuauuaacaaaaggaagcagaugguaagggacccacgaugaaguaauaaggcauccagcuggcaucauugcacaggaaauugcagauuuaggauuagcacuuagacaguggaaucccuguauggauuuggaaguuacaaagccaggacuuuauaucucaaagcauccugccuuagguugggcugcuauaaugaaagaccauagaugaguggcuuaaacaacagacauuuauuucucacaguuuuggaggcugggaaguccaagaucaaggugcuggcagaucuggugucugaugagguuccucuuccuacuuugcagguggcugccuuccugcgguauuguacaagguggaaagagaucauuuaucucuugucucuuccuauaagggcucuaaucccauucaugaggguuucaucaucaugaccuaaauaccucuaaaaagccccaccuccaaauaucaucacauuagggauuagggcuucaauauaugaauuuugggggaacacaagcauuuaguucauaacagauccuuaagacauugucuggcuuugacuuuuucagauaagagcuucaaaguagaaagagguuuuucauauaagagguugaaagguucaaaguggaaggucacguaguguaucaucaguggcgcagcugggaauaaaaccuuuauuugcugacuccaaggccaguauucuuucguugccacugugcagcaccucuguggcauuaacccaaagaguacaauggaaguuguauagaguaaggauuauaaugagaagcaacuaugugcugggcagaauauaguguaauguccuacuguugccuagauacaacucugaagauacugauagcuuuaacaugagaaagccgagauguuagaucauuuagacaggauggauaacagggaaaagcuagauuaucaagugcuuggcagcugauauaaauaaauacuaaauaauucuuaugccaauugcucuuaaaggcauuauaguguaauuauuuauuuagaacaugaauuuuuaugccaaacaguacuguguucgauuucuggcucuguuacuugcucucugagaugccuuugagauucaguuuccuaaucuguauagcgggggacaauaacaaccaccuaauaggguuguuguauguauugaugaugguauuaauuuccuacugcugcuauaaauuacaaaaaaaaaucuagugguuuaaaacaacacaaguuuguuauuauggcucugaaggucagauaucugaaaauggguguuauggcacuaaccaaggugucagcagacauguguuccuuuugaaggcucuaggggagaauuugcucguguuuuccagcuucuagagacuggccagucuuuggugguguagccaccuucuagcaauggcaucaguucaacuuuugcuuccauugcuagauuuccucuggcugauauuccugcuucuuucucauaaagaccucugugcccaccuaauacauugggaccaccuaaguaaugcaggaaaauauucccaucucaagacucuuaccuuuaucacaucugcagagucccguuugccauguaagguaauguauucacagguguuagggacuagggcguggacauauuugagggggggccaugauucugccuaccacacugaugaugaugaugcuaaugaagaugaugaggaaaauuagcugcuguuaguauuucacucacucccaaaauuacuuuuaguauuuugucaaagaaaauaaguucuaucccaaaacauguaacaagagcaagccuggccugaucaggggauugagcuucugauuugauaaaagcuuccucaccccuucaguugaaagugguuuccuucagauagcuuccuggaaacuucugggcugugcacauuagucccuuucaauucaggcacugaaaugcuagcaaaaugaagguauguuuucuggaaaccagcuaucaaucuagcacaagcgacuauuaggaaaaucaaggaggugcugcggggauguggaauaggacaccuggguuuugauuuaaaguaacuuaaaggaauugcuuauagcagagaguuaacauucauaugggaaauuuugagcaaccuguuugacucaggucccggugagagggcagucuuacauaggagauguacagaaaguuuuagucuccauuccuaauccuaggcacacgcacacacacacacacacacacacacacacacacacacacacaaaauucugaaacccuaauacugucaaauccccagugaguuucaauuuucaaugacaacuauggauaaaaauggucauauuuaggagaguaggggggaaaaaagcuuuaauaaaguggcagcagaauaaaaugauuaucaguuuuuuaaaagcacuaguguaaagaauaccucucaguuuaauuuuccuuuuaauuuauuauaaauuauagguuugcuuaggagaaaaauaaaaaaucaaacugccauuuucuuugaaaacacaaaucagacaaauuguuacacagcaggauccuuugcuaauuuugacagccacuuauucauuuacuagccuuuguccgacacaauaccuguguggcuuuuauuuuuccagacuuuccacugacacauuuucacaauuuggguguuuuuguccaaaacgugucauguauuuugucauauauaugacaaauauaaauuggaauuuuuaaacuucaaauaaaauaccacauuaaacuagugauuuuaaacugaagaugauagaauuuuuaaaauacagacuuggagaccacauucaaaacacuucauagcaaaugagaggcccucaguuaucuggucuuaccucagcuuucuagucgucuuugucacuuuuucagccccugggguacuacucagugcugucugccagccugcuaaguucacuuuuuccugcuuagcacuuguuauuccucuuuuuccacuaaaugccuuuaguuauuaaauuauuguuuccuacagaaauuuaacuucaucauuuuuguugucuggagaaagcuuuguugucaucacucaguggugagaagguugacuuucucaugaaagcuccaacccuaggucuuagguuugauguaagucaugugcugcuguggaaacugucuagugccuguacagugugauccgaaguuacuggacugugagggggcagucuaucaaguauggacagcuaucaaguauguuguacaguuugaucuuuaacaauuuaaaaucaauauuggguuccuuggucacacaaauagccuaguucuucaaguaagcaguucuuucugccugaaaccucaugucccacuguucuacuugagcacccuuccagguaucaagggcuuaauuauaggguauacauaguccccugcaagccccuuaugcaucugaaaaugcagguaugaaccuucauucugagaguaaguuagcuagucuaaaugaauauuugagauggaaaaaaacaucuagauggauauagguagaugaaguaacccuggguagguaaagaagcugauuuuagcagugccugaaagacucuugacaaaacaccucagaaucuacuuccauuacucagaacauuuuauuagauuuguuaccacuccguauugaauugcuggggucucacugaguccuuuugaaaaaucuugucccaaaaaggucuuagaaccucauucucccuugucugucuguuuuucuuuuauuuuuucuuucauuucuuuuugagacaggguaucacucugucacccagguuggauugcaguggugugaucacagcucacuguagccuccacuuccugggcucaggugaucccccgcugaccucagccuccugaguagcugggacuuauaggcacuugacuaauuuuuguauguuuuuuguaaugacaggauuuugccauguugcccaggcuggucucaaacaccugggcccaagcagucugcccaccucagcuuccccaaaugcugggauuacaggggugagccaccacgcccagucacccuugucuuccuugacuaccaucugcuucuauccuagaaggaacaugugaaaggauauauaaaugaaaauuggaguuccagaguaauuuauuugucuccauuuagucauguuggcuucaaaucuuuaucaguucuuucacagauauguuuuugagcaucugucauucaccaggugccagauauaaauggaugaauaagacauaagucuuguggucauggauagcuaccacuacugacauggcaccauuuccccaagagauucuuucuguuuccagaaaggagcccaaggcccaguccucaucuggguauuagauagagugcuuuauuuucaacaguaaauaaagggaagaugguuguagacauuucugggugaaguguuagccaagauuuucuaggaaguuuauauccuauaaguggguagaaaaauuggguaucuaaacuucagauaaaaguccaacacuuuaaucuaccauguguugucugcagaugaauucaaaccacugaggaaguuuauacagguuaguaaaaacuagcaaaacaagaaaugguuuuugaaaaaacaaaauuuaaaaauucuauuauuuuuguccugacuguuaauucguuucuaauguauccaguuuugaugccaaauaucagaaaacagagagcucaggcauucugggaaagucaauaauugaggcuaaauggcuucaguauaaugacuaaccaggaagacugacuuucuagaaagauaaagucucagagaagacaugauccagauuuaugaaaucaugaaauaugcaaauaaggcaaauauaaacauguucaucaaauccuagaaacauuuuaaagcuuugaaaaaguaauuuuaggguagauggaaggucccaggaauuguauuuuauuguugaccuuaaggucuacucuauaggauugcugaauauaaacuacuuuaaaaaauaucuuuugcuauuauaguaauuagccccuuuggguuaauuucaaaauuguucugcuuaaaaaaaaauuaguuggccgugcgugguggcucacaccuguaaucccagcaauuuugggaggccaaggugggcagaucacgaggucaagagaucgagaccauccuggccaacauggugaaacccugucucuacuaaaaauacaaaaauuagcuggacgugguggcgugcgccuguagucccagcuacuugggaggcugaggcaagagaauugcuugaaccugggaggcagagguugcagugagccgagaucaugccacugcacucuaaccaggacgacagagugagacuccgucucauaaauaaauaacuagguuauaagacaaauuggucuuuuagcagaauuuucagauauaagcaggaaauucuuuauuucagugagugacauagauuuauccaguuaauacucauuaaguaguggggguagauuuauaguagguuauuaaaaaacaaguaauauuaaauauguaucucuuagcaucagaaguugucagggagaacaauuguauuuuugccuuagaauguaguuuuguguaucugucaaagaucaaauaaccaaguugacaacugaccuuacucaguaaggccucuuagguuauccuggaccauugaagcugcugcaguuuguuuuucucccccuguuagacauagggaguuuuucuccugucagugcucagaaagguacuuggcuaaugcucuucugaauuucaggagaggaaagccuccuacuuaaaaaauaucugcuguauuuaguacuauacaaaauagucauacagacacacuuucaacuuuuaauauuaauggggugguuucacuuuauucauuuuauaaauuaugaagguuauugcagcuguuugcuagauuuuaccaggcucaugguaguaaagccauacauaguccaugaaaacauaacaaaacuuuacaauuucauucugcuuuguugcaaagauccaugucccuuguacauuuuaugacuuauucacauuuccuuuagaaauacucaacauuuaggaacuuaauucuuacuauuuuagauaauaaugugcucaugaugagaauaauaauacuaaaauaaugauauauaucaucacauaagcaucaaaugucuuugaauuuggagauuuucagcuuagaaccacuuuaauggagcucuuaaaagucaaaugugauuuucaugggacuguacuaaggugugauaaugguaaaccaucucuccuaagacaauuaacucauucccccauauauuuuagaugcuuuauuuaugaaauauuuugagcaaugaauaugacaucugauuaccucucuuuguaauucauaaucucuuggacuaaucuuuggacucaguagauuucuuucauuaccauuuuauguauuuauuauuuuuuugagacagaaucuuguucugucgccuaggcuggagugcaguggugcaaucacagcucacuccagccuugaccuccuggucucaagcaauucuaccucagccucuugaguaguugggaccauaggcaugugccaccacacccagcuaauuuuuauuuuuuguagggacagggucucacuaucuugcccagucugguuuugaacuccuuggcucaagugguauaccuacuuuggccucccaaagugcugggagccuguauauauucuuagaaucaauuuaucuuacaacuuuuaaaagaacugagagguaagaugaucagcaaauaauauggaguuacuggaaauuauuugauuguuuuuugaauuuuuaaugaacucuuaaaaugaccuguagccuuaguugauuuaacaggaaucuuaaaaucagauucacauuuacuauuuuggccugaaaugaguuccauguucuuuuuuuuuuuuuuuuugcauuagagaaaacaggcuugugaaguuguuuguauuacuauccuuuuuucagauuuuaaggacauguaucuaaguguucaucuggguucucuaacccccuccucuauacuguuaugguguuacuaaaauuuuauuaguuauaaguaacuuuacuugacacuuucuucacauuuccuuccuggcuuccuuccuuucccuccuuuuuccuuauaugcuuaaaucuggaggaaaauuuuguucugaauuauauauuuuuuaaucaauauugcaaacagacaacuguaaaccucaaguuuuuguuaaugaaguacuugaaaauaugauuuuuuauuuuuuugcuauuaugguuagaaaauagcgauaauuuuuuaaugaauggcuggugaaaugcagcagacacagugcaaguugguggcaugguaucauuguaaagguuaaacagcugugcuggaaagagucauuuugguuuaguccuuuuaauuuggaacuuuuuuggcagcugaauuccaggacagacugucuaugacacuuuaauauauuuaacauauuuucaaaaacuaucagaacucaggcuaaauaaccuaaaccacuuugacuucauacuggguuacauuuugcuuguugaaaaaaacuuaaguugguuuuuaaaagaacaggcuggucugcaaaaaggugaugaagaaauauuagccuuuguuggaaguugagaaguauuauauaaaccuuagacugauauuguagaauggcuucuaagacugaaaaauuguaggcauccuguuuuaauccucuguaacccagccauaugcgucaaacugagcacuccuaauaccugauacuuagaaaaaagaguaagagagcuguuuuucuguguacaaauacacaagugacaccuaguaucuaucccucuauucccccagcucuggucuuagggaagggggguccaggcauuuuccaccuggagaaguaggugccugacagcagaugcaacauuggugacuuccuggacuguggcuugucuucaaggcacccugccaagacuucggugucgggggaacuagagaauuaggguaaaauuucagggccucaccuguacaacauggucauaacauuaacaccagcuacucugacaucugucagaucauuuauuuaauuaacaucccuuuucucugggccaccaaagcagggcugcuuuucacuggcccaucuucuuugcauguauuucaauaaaaguuugggggcuauuguuucauugucauguuuccaccuaaaaccuagucugaggaauagggaucuacuuauuuuugaugcacaugauuuauuuuaguaaaguggacagauuuuaaugacacuuaggaacugaggcuuuuuuuuuuuucagucaugguuuuacuuguagaaagcgaucuguauuuuaaacaaaaaaacacuuaaucuuugaauugaaacacauuuaauaugacaguuaauuucuucuuuuccaaaggagaaaaucacaacagaacuuuaagaagucuccuaugcaacuggauacaaauauuguugauucauggaacgugaugccucugacauuaaggguaauaguuauuguuuuggguuuaaaacuucaaggucuggcuccucauuuucagggaagccucuuguaucugaauaguguuucuggaauugugcuuugaucagguguauaaggacucugaaccaggaaugcgggcuuuacuauaccugcucugagaauuuguuuaauuacucagcuucucuaauccuugcuuuccucaucugcacgaugauauuaaauucaugggauuguuaugaggcuucagugaauucacguuugugaaaucuagaaguacaaugccuggaacagagaagauucuuuccuuuuccccuuuucuccagccuaaauuaauaacuggacuuuuaggagcagcagcguagagguaggacuauaugaaugucauuacaauaauaauaacaaaacuauuuagauauaaaauuuccugccuccucuuuuguaacuuuccuaugcacaucauuaucccuuuucacuauuguuugcucagcuuuggugugauuuguaaaagcuccugguuauuaaggguauaaaccuuauguuaggcauaaggcuguaaccuuauaaccuuauguuaggcauaagguuguaaauuuuuuaaaguuuuccucuuaacaguauauaugguauuuuuugucauauagaaauuucaaguuuuguuuuuauguugucaggucuauuguuuuuuuccaaaaauuguaugacauauauugauuucagagauguuaaaaugugaaaaaacaaagucuuagauucaauggaauagaauaacaaucuuuuauagguucugccuuuggugcaauguauguguguguguguguguguguguguacaaauauuuguagguauguaaauuggucucauuuuuuguacuuaaaagauauuauugcaaacaugacuggguaugggaauguucucuccagcuaagaaaacucuaggaagaauguaguugcauagagcuuagaagcccuggcauuugcuucaggcauugcuaugggaugcuuuagucuuggcuuguccguuguugcuagaaucacgugcugcccucacugcugcucuuguccagcugccacuguuacucaaucccuccugauagauaucucugugguagcaacaauucaaaauuugcccugaggacaagguuaguauuucuugccagcaccugccacuuucccuuccagauccugaccaugggagaaguguguguggguguggggguaggggaggaggaguuaccaaacccuguaaagcagacaucaagguagaaggcuagaaugccagguaaaggcucauaggacagagugcuauaacuacaucuucaccacuaugacaaaguugucccacccacucuccggaaaagaguuaauguugguugaagaucacgaagcaguuguccuccaaaaugccccaagaguauuagaauaugauagaagauuguuuauuugcuaaugaagacaucagaacuagccgaaugguucaaaaauaauuuuaaauacuuuauacauugaaacaaaucaagccacuauaauaauuaggagccccuugcucuggugcagggcauaauaaucgcuagcaaauccuuaguugaugacaucacaguaaucugagacagagagguggggacuguaguggacacuuaaagcaacauugcugugucuccuugguaauucaugaaugacaguucccggcaauucaugaaugugacacuucucggucauuucuguguuuuggcagguacugguggcuuuaaagccagggaaucaaaguccuuaaaguuguaauuaauuuuccugaagcugauaaugagaccuacugcgauccuuucacauaagacaggucuuuacacacaauuuaugaaaacagaauaauuaauagaaaaugauuucaauuguccucuguaauauuucauugaaauaaauguuguagagugguuuuagcucuuggcaaaucaugcaauaauaauaauaaaagagaagacggcugugugggaaagaguaguuauuuuuaaaucuugguagacaaaugggaccugcccacuugucuauugagcacaucucuguaauuucucagaaauuaaacagcaugacccuuugauugaauccaaagcuggaaguuuaaauagauaacuucaaaguaauuggcuugaaauccaaggaucuauucugggaugcuuuagaaauuuuuauucccuuuucaccucagcuuuaaaauauauauaaaugucaaggcuucagacuuuaaaacuguugcuguuguacuccaaacuauuuucuuauaauuggcacuguucaaauccuuuuuggaacaggauuugagcuugagugagaagagaagguaguuuggaagaaucaagaaguauguaacagugggaucuaaaaaucuaaacaaaaagagguuaaagggacagaucugauguauuucagaggagcaagaguagaaaggugauacauuaucaaaaaggucuucaugcacaugaaguguucuauuccagacuuaggggauuagcuguucuucaucucugcuaagggcaaaauaaaaggaaauuauuuugagacagaagcaugaagagauuaagauuagagaaggaauacuuuaaaaauacauguuuguuaaaccaagaaccucagccaucuaaacaagaguaaauaugccaauaauucuaccaucuucgucugauuaggcuaugaaaucuugaaucuuccuuggauagcuuuuaaacugauauggaaugguuaguauguuuuaugguuauuuccaguucuaagauugagugauccacuucauuucagcaggcucuguacguauuauggacuuguuucccucuguuuuuuccucuguugucuccuuccuuuuuuuuuucuuauuuuguauaauauuuaagaguauuuuacauguaggugucauuuauaauuuuuuccuuacuaaaguauuccuuuuuuauuaugguucacauuguaauucaaguagcauaauuauaacauuuuuauugagcagaaaaugaccacuuuuguauuuuaauuaaagcaucuuuuuuuuaauuauuuaucuuauccagcagucauugaacacuaaagcuguguuaugugcaacacagaucuucucucauuuuacccagaacaaucuuuuccugagaaauaagucuuugcccaaagcaagacacuccugcaguguugaaaggugauaugggcuuuuagugugcacuguagcuaacagcuggcaaucacucaccgguuuaagaaguacauguuggccauuuucugucaguuuuugggggcaaagagaagaauuaucuaaauuuuggaggagaaggguuuaggggguuauuuauagcauccagcuagccagaagaaaugaaugaacaauucuuagguaucauugacccaaauaucuuuucuaaaauaauccauuacuauuuucuuucuucuuuuugcuacuuuuuucucccucuuucaucccuuuaaaacuuugacaauaacaacaacugaugcucucaagcaccucccauaugccccauacuaggaacuggggauauagcagucaacaagacaaacaugucagguccccugcucucaggaaguuuaaauuuucuccauuauuuugugcucacuuauauaacagggaacaaaccagaauuaaauuuugauugcauuuuaauuuauuguuaaaugauacaagaaaaacacuaaauacacuacuaguuuuagacauucaaaauuuauauaaagauauuagggcugggcgcgguggcuuacgucuguaaucccagcacuuugggaggcugaggcggguggaucaugaggucaggaguucaagaccagccuggccaacauagugaaacccugucucuacuaaaaauauaaaaagauuagcugggcgugguggcaggcgccucuagucccagccacuugggaaucugggacaggagaaucgcuugaaccccggaggcagagcuugcagugagccgagauugcgccacuacacuccagccugggcggcacagcgggacucugucugggaaaaaaaagaaaaaaagauauuaguuauacuguuuaugaugugaggaaaaucaaaguuugucaaguaacuuuguauucagaaguuugugaaguauuuagauugagucuuuauccuaguauguagguaauguuaaagaugauuuuuaaaaaagucacugugcaaaauuuccuugcauaugaacaguuaccuuggcauggacucuuuucuucccacuguuacaggguagcuaacuuccuauucucaguaaagcuaaggcaaagagagucuuucugucaccaagguauucuagguucuaacaagcauaugggcaucucucccuuauaaaagccaugauauaaacacaguacugcuuauauucuguaaacaauauuaauggcuagaaucagcugcauaaauuucugggcuaauuagaugcuuaugugcuaaccuggaaauuuaaucauugcugggaaaauuuuguucugaauucaaaacggcugacuuauagguagacuauggaauauuaccuguccuugcccuggguauauacaaacccauucucugugaagagaacaaacacauuucuauuguggcauguccauaguguuagaauuggaccuugcucuaguagaauuauuauuauuauuauuauuauuugaggcagauucucacucuaucgcccagguuagagugcaguggugcagucuuggcucacuccaaccucugucccccggguucaagcaauucuccugccucagccuccugagaagcugggacuacaggcacaugccaccaagccuggcuaauuuuuguauuuuuguagagagaggguuucaccauguuggcuaggcuggucuugaacuccugaccucaagcaauucaccccccucagccucccagaguucuaguagaauugugauccuaauuaauuuaauacacgucacuaugagaaaauggacuugcaucauggauugaggauuuggccuuuauuccaaauuaaaaccugauuauuaaccaggcucuagucuuauccuuugcugacagaaaaugguauggucuuuuauaucaaaauuguagagggcuauuaauuuucugucuauaucagacauuuccuagguuuuuggcuacccagagucugaaccucuguuuuuaucuggcaugaauucuuuguuaugugggguuuugugggaggcgggguuccuuuuccagaaggggucagauuuucuugucuuuagaagcuaggcugcagccaugugaauuagguucagccaaucacuauuacucacccagaacuuugaaucuugagugcauaacucaaagaugcagagacaguuuauucuuuuuagcaguggugguguugagaguccagcgacaucauugucuaguugcagcaguggugaugagaaagguguguuaaccagacucuuuuguggcugagucccuguguccuagccucccuucagccucccuugauucuagcucacuuccaggucaggcuucuagcuuuuccuucaagauauuucuguauccuucaaauauacuuuuucccuuuaagucugccaaaauggauuucuauugcuuguaaccaagaacucugacugauacacugcgugaaaacuaagcuaacuguggcagguuauacuuuccaaaaauuguaccaccaauauauauccuauccuauaugcucuucuaacagugugauuucacauuccuccauugagagguagagggcuguguucccccugcuuaaaccuauguggaugaauagaauguguagaauuaauaaugauguguggguuccaaggcaaggcccuaaaaggugauacaaccuccuccugguccucuuucuuuccugugacaugugccuuggaaacugaguccagguacccugaauaugccauauuagagagagcacauggaaagacuauauagaauuagagggguaugccagaggaaccccagcuguucuagcccucagcuguuugaguuuucccaguguaggcaauaggacagacaugugaucaagcaagcugucccaugacuucucagccccagccuuccagcuggcccaggugacauaggguagagcagaaauaaacucugagcccuucuccaaacugcagauucaugaacaaaaugaacauuguuauuauuuuaagccccuuugcauucauuuugcauauauuauauggcauauauauauuuccagaaugauggcuauuauaaauauucaaacuguaacaccuaaauucuaaucucuagcauagaauuaugccuucagacucuuacaaggcaggauuauugauauggaauguacuuauuuauuuaguuucacauuuuugcaucuuacaguuuaagagagugucauuugggcuauuguaaaauuacuuggcuggaauaacauuacagagcuuuauugcuguuagaaacaaggcuaucuuccauaucaagauguuuaaaauacuaguuuucugaauauuuauaguugugugacagcuaaauccauuaauucuaagauguugcuugguaguccccugugcaaauaagucucuaaauguaaguucauuccuucuauuaggauccuaacacaucuuuugggaagcaggaugaaaauucuacuuuucuuuuggauuugauauuccaccuaauaaggggauuuggagagagcuuuagaaauuaaauaaaauagcuagaaguuauugaggauuuacuaugugcaaggcacuaugcuaagugccugcaggucuucucauuuaaucauuauaacaauuguaugagguagauuuuuauuacucuuccuuuuuuauaggugaagaaacacauuuagguuaaguaaaacuuucccaggucacauagcugguagcugggauuuguauccagggcuauaugugacccuaaggucaguguguucauaaccgucaugcagaauggcuaugagugauacuucagcauuuuaucuccuaccuuccucugacuuguccuggauuauccuuaagacucuugacauucaauguaauacacaaauucucgcccuuuucacacauuuuucuuucagaaucaagccugccuucucuuauuugcuguaaguccuagucuugaagaguuuuaagggacuccaccaaaucuauuaggaagaauaugcaaacauaagcuuuaugcgaaucuugaugaccuugguggaaccuucuuucaucaauuccuuaaaucugcuuuuuguaggaaguguacagguuguacauaaacgauucaaaauaaccuauccuucaugaugacaccaacuguugaguguuuaaaguagaagauuccuaccucuaaugcuucagauuugaguaacuuaugacaguaaaucaaggguuugagaacuucugagggaaaaacuugaagaccauucuggcuuuguguguauguuugugguugugcacucucccugccacacuuguuaguguggaaugauggcaaacugugcugcuguagaguugaagaagaacaaagaaaacuguacugauguugaaugagauccugauuacuucaguguuuuauauguauaucaugccuugcuucaucagcauagauaauuuauaguagaaaauuggcaaacaagauguuagaagaaauucaucucugugcuccucagcaaagcccaaaucucucugaaagugcuccuguuacugcagacacugugcuauuacuaugugaguggcacuacugaauucuacuuuagaggaauugauuuacuagaaaacaaugggccucuggaaacucagcacucccauauacucugcauugaguuacuagaaguccuuuuaauacagagucucugugugggcacaacuacaaugcuacaauggcuggagcaccauauuguggguggccacguggggguggucauuuucccuaaugacacagaagggaaugaaaaaaggcuucauguuguuuuagagucuugcacacagcagccugagccuagcaugugacaaaaagcauuugcuauuuuuauauccuuugggaaugacuucugcaccuaggcaaccaaucauaggcuaagaauccccaacaacaaggaaaagguuaguuuuacuaauuagccacagagaaagggacauugccacguucuggagagucuagguuugcaggaauccagccaaggacaaggcuuugcauuuuuuaaaaagucuaauauuugcuuugguguuucauugcagagaccuagauuuaauuugaauacucuucaaaggucuauuuaucauuagccuugugugucauggguauaaauauaucuucaaacucaguucuguaagaaauaauaauaaucaaaaaucuuuuugaauagcuugauuuccugcagagaaccaggcuggagaaaaauuuggcuuuugccauuuuuggaguucucaucuccaaguucguggcaagcuaaguuuuucacaucuccaauuucauggcaagaugugugcaauuuauuucagcugagaugcuucuugccucaguguacacauccucuucagaucugacagcuuucuguugcuuuccaguuaugcccagcucauagaaauaauuuuguuuuugaggguagguaccaggugccaucgaagcagcaucauugucugguguaaauaccugagguuuguugucucaugccaaggaaauagaguaugcggacacaugagaaguggguuuaggagcauagguuuaauaggcaaaagaaagagaaaggagaacagcucucucuccuacgagagagaggcucccaagugggacuuccgguccaaagugaaguacacuggauuuuacagacugaccugaggaggugaugucugauguacguaggguccaaagauugguuggacaggugugauauuuacauaacacacgaaggagcuggccaccccacccuaaucuucuuauuaagcaaauggguuuucuacuuggccagugcucuguugucugcuccuuacuguacaugugguuggcaaggaagagggaagauggagccaccauguugaacaugccuaagguagucuuuuccuauuggcacagcugcaggcauucaccuguguaagcuuuccuaugucagcagcucgauuuuacaggcugcucuuuguuagagaagaaaugauuuggggguugcuuuucauuaaaagggaaaccuuaucgaggacuuccuuaaccucacuaucugccuaaauaauuucuuuuuaacuccuauaaucaccaucuccacccugcaggccaucacacauuggcccaguuggagugcauacagauaauucagcucacacaugcacuggcauaugcaaacaaaaggcugucuuagcuuuaauaaggauuuggguucagagcucuacugagaaggcauggaauaguaguucaggguugguauaucaguccacuugggaugcuagaacaaaaaaucauagacuggguggcuuacacaacagacauuuauuucucaugguucuggagacugggaagucuaaaaucaaagugcuggcuuauuuaguuccugcuaagggcccuuuuccuagcuugcggaugguuguuuuauggcuguguccucacaugguggagagagaaaucacaugagagccagcucucugguggugucuucuuauaagggcacuaaccuugucaugagggccccacccuugugaccucaucuaaaccuacuuacuucucaaaggccccaucuccagauaccaucacacugagaguuaggguuucaucauaugaauuuuggggcgacacaaacauucaguccauaacagggccccuuucagauuggcuugaagaaccuacagauauauuaauuggagaagugggagaagcagguacuguuaaauguguagccccuuuuuaaaaauaucagguauagauuauggaaggcaccagugauccuuuccaucaugauguagaauaucuuugcacauucaguuuaauaggauuucugcugggugcuaacagaacacaucugaacacauuucauuuauuuaugccugauugaagaaugucccuguuguuagguccucccuaggaaccaugacuaagcuccaaacauuuauuaaacucagaaccugaauuauuagcaacugagcaacuaguucuacuuugcuugaggauagugaggacaccuugugugcaaggagaaacauuugccuuuuaugcuuugaauguagcaaagaaagagaaggcaaacagaacauuuucauauuaaaaguuugaagguuauauccugccacagggguaacuaagaaacuuucccauguauauggccccuacugggugcuucugagaaagaaaugcuaccuuuuuuuuuccacucucuguucaaagucaccaagcauuugggggaaauauuuuauagaacuuuuaauuuguuuucaauuggauuacucaaauucugaaguugagcaguuccaucccaggaaugaagaguccucuguaaauaggauuaaggucuuuuuacccuagauuauaauuaagggaauagauaccucaaguggagggaagugucauuaaaaaaagacuuucuccaaggucccccuccccaguugcuaucauuauaaaugcucauuauguuuucuuuuuagcgcugcaugagguacuggugggugauggacagcaaagaggacaagggaagagaaagaauuuuugucccaaaggauccugugaauuagugagaauauauacacaugaaaauuuuuaguaauaauuugggugacauaugguuaaaagccagaauaaauuggcagauaacaaauuccuuuaggacauuggucaaucaaaucagaaucccagggcaugccuguuaaaacacagauuucuaugucccacaccuagaguuucugauuuuguaagucuagggugugugcagcuugauaauuuggauuucuaauaaguuuucagcuggugcuuaugcugcugaucuguccuuuucuccagucucucacagugauacaaauugagaacugcuccuguaggagaccagagacuagagaggucugcaguaugauugccguguguugagaugaugcuuccuuucaucauucaccugcugcaguuacccauguuucucuuuucuggcccucauuuuaugacaacagcugguagcacucuuuaaaauguccacuucuguaaaaagugcuaccugguagcacuucugaugucauaagcagagagcaugcccuuuucuauaauuagguaauucucuacagagagaggaaauuauaccaucuucuuggcagcaguaggaggagaggaacaauauucuuguuuugcuuugaccauuuuuuuuuaucuuuuaaccauuaccuuacagcauucaccccuacauucccuaauagacauuaagaauuuuuucuguagccaaaagcaaauaggaaacaugaguuuucagauucacaaccaauuaaguuaaaauuagggaaauggagaggagaaaaauugagaaaugauacagggugaagaguucaaaaaacaagccuuuugggaaggaguuauuuggugcuuuugagaagagcauuugcugauugaguauauauauauuucuagagaagaaaugcaauaacauuuucccaugcugcaggugaggcuuugucauaauguuuuacugcagugaagugggagguuucauagcuguuaaauuaguagcaguccaaacuaucauacucccaaauauguguuccuaccaaaucauauuacugguaaaauagcauucugugguuaaaaaaaaaaaaagucaaggaauccuuacuuaaauuucuguuucuaucaaauaccaauacaggcagaauaaaaacuuuuccuaaaguaucuguccuuugcugaaaccagcuucucaccugccgaaaguuuaacacugacccaaucaaauugacuuucagcaucuugagcagggacaaguuagaaucuccuauuuccaccccucuccacccagauuuugccaccaguuauucuuuuucccagucucucacagugauacacauucaacccucuuucaaaugguauuaggauauauaguaggauauaaugaaacuuaguggaguuuuugugauauaaugaaacucuguuuauuucauaggacaguagaucuuugauuuuaugguaauguuuuaaaugguuguaugugugauucuugauacagagaacagcuugugacuuuucccacuuuuucagcagcauuuaaaaauaaaacucucuaagguaauauucuucuaacuuaaagaauaucauugcauaccuauauuuaggcacuaaggaguacuguacuauuaugcugcaaagauuuuaacuacggggcuugggaaauaaucucaaugugaagauacauguuacaucaugucaguuauuauuguucuauuguuacuuccaagauucaggacuugguucuaagggagggacauuucuuuuaaauguuuuguuucauuuuuuucaugauggagagaugacugaauuacuguauugucaguuucuggaaacuugaauuaucaguuuuuucuaauucagcuugggaacagggcuaggagagaggacagugugagaaaguaugucaagccugauugguauauaauacugcucuuggccaauauauuuaaaaaauaauuuucaauacaccucccccaucuuucuuaagaugguggaauccuccagcaugacuccaguuuucguuauuuuagcacuagacuuuuaaugauuucagaauuuccgucugcuuuugacuauucucccugguguuuuaaaaauauuuauuucuucuauucagaauucucgauaggguuuuuaugacauugaccucacuuucuaguaaugugugucuuaucucccaagaugcuccucagaguggucaaguaagagguauguauuccggccgggcgcgguggcucacgccuguaaucccagcacuuugggaggcccaggcgggcagaucacaaggucaggagauugagaccauccuggcuaacacagugaaaccccgucucuacuaaaaauacaaaaaauuagccgggcgugguaacaggcgucuguaaucccagcuacuagggaggcugaggcaggagaauggugugaacucgggaagcggagcuugcagugagcugagauugcaccacugcacuccagccuagggggcagagugagacucugucucaaaaaaaaaaaaaaaguauguauuccauaucauugaucuuugaauaaagugaaggaggaagaccugccucauauacguuguugaauaucacuuaaaauuugaucuuaauauuaauuucccaagauucaugaauaacgcuuucacuacugguugauguaaucuauuucuucugcaauuauuuauuagagcagacaucauccuagaggacaggaaauaucugauuucuggauuaucuagaaccuuucccaggccaucucaucuggcgcaggguaagcacuuaguugaaguuugaauuaaugaaggaauaaaugaaggaacauguaaagcuuugagaacaaguaugcauauuuuaguuauaggaucaagauaguuauuaaacuguaauaaaaagcagaacuuuuacuuuauuuuaguuugauuaguuuuugaguagguucuacaaucauguuauguaaaaucaaaaagauauuggauuaguuuccuaggguuccuaaaaucaggcccacucuaauccacugucauaugaccucaucuucacuuaauuacaucugcaaagacucaauuuccaaauaaguucacauuuacagauaugaggguuaggacuuaaacagaucucuuuuugggaacacagauguacccacugcagauauaaaaguauauaaaugaaaaguuucccacucaccguuguucccaggucacccaguuguccuccucagaggucaccaauguuauuuuacuuuauuuuaaacaacuuuaacuagucuaaaaaugauguaaagguaagugauucucacuuuauccuauaagagacagucuuguucuuaucuguuucauucaucaaaacuuuuuggguuuuagucuucaaauuuaucccauguccucagcuggguucagggauggggagaaaaggcaaaauguucaaguagacacuaaauauaguaaaccuguauuaaucauugagugaaauauauucuacaugcacguaacucccucauuaaaugucaggcauuauguggguagcacuuaaucacucauuugcuggcacaaaguagauugcucuaguuuuaaauccuaguaacauuaagucuuacagcauuuuguugucaguuuuuuacuuaaauacauguuauuaaauaguuugggaauaaauuuguuguuaugcauguauuauauugcuguuaaugaugcuguuaaaauaaaacuuuuuuuuaccugacagugcuauauggaauuagaugaaauuuaugaaauguaguugcauuccaugauacuuaacaaaauauaugugauauccugugucuuaaaaaugaaauauguguacaaaagcuauguauaaugcugcauaguagcaaauuaaaugaucugaaaaguccugcaguaagcaaccaguuuaggcuacauuuucccguaaagucuuucuuuaaaaacaacuacauccugcauuacuauuguuucccagaauacacuuugagaaaugaaggucuacaaaccgaagacagaguuagaacagugagucagaagccaggcagugaauuagggcagaaaaauagaacuuuuaugcugccuaccuccaguaggagaugacuuagguccuuuuuguuuccauaggauguggcacaggacauggggcgagggagaaagaaguuaggggaaagagacuggguuugggggccugggcuuuggggcuaggcagauuggguguaauucccagcacugccacugacuaguuauaugaucuuagacaaguugcuccauuuuucuaagccuaaauuucuuuauccaccaggaguuugagaccagccugagcaacuuagugagaccuugucucuacaaaaaaaaaaaaaaaaaaauuaaaaauuaaaaaaaaaaucuauccaggcaugguggugggcaccuguggucccagcuacucuggaggcugagguaggaggauuucuugagccugggaguuugagacugccacgagcugugauugagccacugcacuccagccugggagacagagugagacccugucucaaaaaccauuuuuuuuuucuucaucuaaauagggggaagacacaauuccuaucccuaaagaauuuaccauuuaauugggacaugagauuagaagaccuacgguuauguaaagauaauaugauuauugcuuuaagagauauacaaugugauugggaguuuugaaggagggagaagccaguuaguuguggacaaucaagaaaggcuuuguggaggagcuggcauuuagguguguaggucuccauggguuaguaaagcuucaacauuuggagacuuguuaguggagagugcauuccagguauuaauagaucaagaagcaagagcaaagguauggagaugggaaaggaaagacauuuuaaagaauagcaaguggccucauuucucuggagacaguagaaaugaagcagccauuaaacuuugugaccuaugugcuguaagggacccaguggcacugauaguuuuagcagugcugauaguggcuuuugaguagacuaauguauuuaauaaucgcuuugacaccauuacgaaguaaacaaccuuguacuugaguagaauuuagcuucugcuggauggucccuguccugaggugcuaguacacauauuuuaaucuggcacagagcccacauacaauggaauggggccacuuucauaaauauuucaggauuucuaaauuaucuucccugaacaauguugagggaaagcuuaguagaugaauaagauuuuaagaccacuaaauaaaauaaaacagauuucuuuacucauaaacuucuaagaaaguuugcuaugcuaaugaguaguguuagucccauggagggagauuuagugugugggauucucugaacuuggaccucagaaccuucuguuguucccugaucucauacugacaccuccucaaaagauguucucuucuuauguuugaagucaguguucuuauuaccuguggagcuuuuucaaaaggcaaauucuauaguucuuuucuuuacccuugucaccuucaagcauauuagacucuuggcauguaggggagggauagguacucaguaggauaguaccucucacucccuaucuccaccccuucacugaccugaccuaagguauuagaaaucauucugucaaucacaugaacaauuaaggcccacucucuaaaucccuaauugcuuacuuuuuuuuggguaagaaaaccuuuuuuaaaagcuaugaagaaaaauauaaauagauuuauguaagcaaaggcaaagguuauagaucacccuagaauaguagcagaucauuggagaagaguauaacaugccuagacuauuaugaaugcauuagguaggauguucuuguguugcuauaaagaaauacaugaggggggcaaggccaagauggccaacuacaaacaguggugauuggagacucccauugaaaagaaccauaauaaacaugugaauccuucacuggcaaccaagauauccagguucucucaucagaaccaacuagacucuggcuggcaugauccacgaagaggagggaacacaguguggugugguggcccaccugagagccacacggggcagaggagcccccaacccacagccaagggaggcagugagugagcaugcuaccuagccggggaaacugagcauuauccacagaacucugucagccacggaucggaagaucccacucaccuacccacgccacggggucuagggucccaacccuggagcugcgcagauucucaacagccucucagcugcaaucugcuuaagccugcggagcuccccugggggaggggcaaccagcaccacagcuguggcugccugcuguguaagccaugugagcuccuugggggaggggcagcagccagcacugggacucauaacugccuaacacacuaaccucccugggugggggaagggcgucauucaucucuauagcuccaggccacacuuugcuuuuccccugcuggagccagugaggcuggauggcuuggucccaaaaggugucccccacaggccaacacaccagcuguggcggacugcagccagaaagccucuucaggccugacccugacucauauuuccuuacugggcggggcucccugcaguaacuccaacaacuccagccagaggcucagggacagaacacggaucucccugggccugugccccuagugggagggauggcuguagucucuguggaccagcagacuuagguuuucuuccuggcaguucugaggaaucugggcagcccagaugaguggguuucccccagcaaagcacaccccauccacaaagggacaaagugcuucguuaaauggguccuguucccuguaccaccuaaaugggugagacccuccaacagggguuuucagacacucuauacaggagcaauccuacuggcaucagauuggugccccuugaggucagagaucccagaagaaggaucaggcacccaucuuugcuguucugcagccuuuuugagugacaccuccaggcacaggagcgaaccagaugaauacggccugaagugaauccccagcaaaccgcagcagcccuacagaagagggaccugaccauugaaagaaagacaacagaaagccacaacaucugcaucaacaacaacaaaaaguccccacaaaaaccccauucaagggucaguagcuucaaagauggaaacuagacaaacucaagaagaugagaaaaaaaucaacaaaaaaacgcagaaaacccaaaaggccagagggccucuuuuccuccaaaugauugcaacaucucuucaaggaacagaacuagauggaggaugagguggacaaauucacagaaguagacuucagaagguggguaauaaaaaacuacacugagcuaaaggagcauguucuaacccaaugcaaagaagcuaagaaccuugauaaaagguuagaggagcugcuaacuagaauaaccaguuuagagaggaacauaaaugaccugauggagcugaaaaauauagcacaagagcuucgugaagcauagauaaguaucaauagcugaaucaaucaagcagaagaaaggauaucagaguuuuaagaccaucuugcuuaaauaaugcaugcagacaagauuagagaaaaaacaaugaaaaggaaugaacaaagucuccaagaaauaugggacuucauaaaaagacugaaacuaugauugauuggaguaccugaaggagacggggagaauaaaaacaagguggaaaacacacuucaggauacauccaggagaacuuccccaacugagcaagacaggccaacaugcaaauucaggaaauacagagaacaccacuaagauacuccagagaacaccacuaagauacuccaugaaaagaucaaccucaagacacauaaucauaaaauucuccaagguugaaaugaaggaaaaaaaagcgagagagaaagaccaggucaccuacaaagggaagcccaucagauuaacagcagaucucucagcagaaacucuacaagccagaagagauugggggcuaauauucaacuuuuuuuuuuuucuuuuuuuuuuuugagauggagucucgcucugucacccacgcuggagugcaguggcgcaaucuuggcucacugcaagcuccaccucccagguucaccccauucuccugccucagccucccuaguagcugggacuauaggcacccaccaccaugcccggcuaauuuuuuuuuguauuuuuaguagagacaggguuucaccauguuagccaggauggucucgauuuccugaccucaugaucugcccgccuccuaaagugcugggauuauaggcgugagccacugugcccagccuccaacauucuuaaagaaaagaauucucaaccuagaauuuuguaucuagccaaacuaagcuucauaagugaaggggaaauaaaauucuuuccagauaagaaaaugcugagggauuucauuaucacuaggccugccuugcaagagcuccugaaagaagcacuaaauacgaaaaggaaaaacuguuacuagccacugcaaaaacacacaaaauauaaagaccaaugacacuaugaagaaacugcaucaacuagugugcaaaauaaccagauagcaucaugaugacaggaucaaauucacacauaauaauacuaaccuuaaauguaaaugggcuaaaugccacaauuaaaagacacagacuggcaaguuggauacagagucaagacccauuagcgugccauauucaggagacccauccacauguagagacacacauaggcucaaaauaaagggauggaggaauauuuagcaagcaaauggaaagcaaagaaagcagggguuucaauccucaucucugacaaaacggacuuuaaaccaacaaagaucaaaaaggauaaagaagggcauuacauaaugguaaaggaaacaauucaacaagaagggcuaacuauccaaaucauauaugcacccaauacaggaguacccagauucauaaaacaaguucuuagagaccuacaaagagacuuagacucccacacaauaauagugggagacuuuaacuccccacugucaauauuagaucaaugagacagaaaauuaacaaggauauucaggacuugaacucagcucuggaucaaguggaccuaauagacaucuacagaacucuccaccucaaaucaacagaauauacauucuucucaguggcauauggcacuuaaucuaaaaucuaccacauaaguaaaacauuccucagcaaaugcaaaagaacugaaaucauaacagaccacagaccacagugcaguuacauggaaauugaauaagcugcuucugaaugacuccuggauaaauaaugaaauuagggcagaaauaaagaaguucuaaaugaagaagaaauaaaggaauaaagaagaaauaaaggauggagaacaaagagacaauguaccaaaaucucugggacacagcuaaagcaguguuaagagggaaauuuauagcacuaaaugcccacaucagaaagcuagaaagauuucaaaugaacacccuaacauuacaauuaaaagagcuagagaggcaggagcaaacuaauccaauagcuagcagaagacaagaaauaacuaagaucagagcagaguugaaguagauagagacaugaaaaauucuccaaaaauaaucaaugaauccagaaguugguuuuuugaaaaaauuaauaaaauagauagaccacuagcuagacuaauaacgaagaaaacagaauaaucaaauagaaacaaaaaaugauaacggggauaucaccacugacaccauagaaauacaaacuaccaucagagaauacuauaaacaccucuacacaaauaaacuagaaaaucuagaagaaauggauaaauacuuggacauauacacccucccaagacuaagucaggaagaaguugaauccuuggaugagaccaauaaaaaguucugaaauugaggcaguaauuaauggccuaccaaccaaaaaaagcccaggaccagauggauucacagcugaauucuauuacagguacaaagaggagcugguaucauuccuucugaaacuauuccaaacaguugaaaaggagggacuccucccuaacucauuuugugaagccagcaucauccugauaccaaaacuaggcagaaacacacgcaaaaaaacaaaacuucaggcuagugucucugaugaacaucgaugcaaaaauccucaauaaaauacuggcaaacugaguucaguagcauaucaaaaaacguauccaccacaaucaagucagcuucaucccugggaugcaaggcugguucaacauaugcaaaucaauaaacauaauccaucacaugaacagaaccaaagacagaaccacaugauuaucucaauagaugcagaaaaggccuugauaaaauucaacauccuuucauguuaaaaacucaaacuggguuuugauagaacauaucucaaaauaauaagagcaauuuaugacaaacccacagccaauauaauauuuaaugggcaaaaguuggaagcauuuccuuugaaaacugguacaaggcaaggauccccacucucaccacuccuguucaacauaguauuggaaguuuuggccagagcuaucaggcaagagaaagaaguaaaggguauucacauaggaagacaggaggucaaauugucuguuugcagacaacauguuuuuauauuuagaaaaccccaucaucucagcccaaaacuccuuuagcuuauacgcaacuucagcagucucaggauacaaaaucaaugugcaaaaaucacaagcaugccuuuacaccaacaauagacaagcagcgagccaaaucaugaacuccuauucacaaauugcuacaaagagaauaaaauaccuaggaauacagcuaacgagaugugaaggaccucuucaaaauacaccacacuacucaaggaaauaagacaggacacaaagggaaaaacauuucauccucauggauaguaagaaucaauauugugaaaauggccauagugcccaaaguaauucauauauucaaugcuauuccuaucaaacuaccauugacauucuucacagaguuagaaaaaacuacuuuaaauuucauguggaaucaaagaagaccccauauagccaagacaauccuaagcaaaaagaacaaccuggaggcaucaugcuaccugacuucaaauuauacuacaagacuacaguaacaaaaacagcaugguacuguuaccaaaacagacauauagaccuaugguacagaggagaccucagaaauaacgccacacaucuacaaccaucugagcuucgacaaaccugacaaaaauaagcaauggggaaaggaucuccuauucaauaaauggugcuaggaaaacuggccagccauaugcagaaaacugaaacuggaccccuucuuuacaccuuauacaaaaauuaacucaggauggauuaaagacuuaaauguaaaacccaaaaccauaaauccccuagaagaaaacguaggcaguaccauugaggacauaggcaugggcaaagacuucaugauggaaacaccaaaaguaauugcaacaaaagccaaaauugacaaaugugaucuaauuaaacuaaagagcuucugcacagcaaaagaaacuaucaucagagugaacagguaaccuucagaaugggagaaaauguuugccaucuacccaucugacagaggucuaauauccaaaauuuacaaggagcuuaaacaaauuuacaaagaaaauuuaaagaaaaaaaacaaccccaucaaaaagugggcaaagaauaugaacagaauauuucaagaaugucuucuugaaagaagacauucaugcagccaacaacuaugaaaaaaagcucagcaucacugaucauuagagaaaugcaaaucaaaaccauaaugagauaccaucucacaccagucagaauggugauuauuaaaaagucaggaaacaauagaugcuggcaaggcuguggagaacaaaggaaugcuuuuacacuguuggugggaggguaaauuaguucaaccauugugcaagacagcauggcgauuccucaaggaucuagaaccagaaauaccauuugacccagcaaucccauuacuggguauauacccaaaggaauauuaaucauucuacuauaaagacacaugcacacguauguuuauugcagcacuauuuacaacagcaaagucauggaaccaacacaaaugcccaucagugauagacuggauaaagaaaaugugguacauguacaccauggaauacuaugcagucauaaaaaggaugaaauuauguccuuugcaggaauguggaugaagcuggaagccaucauccucaggaaacuaauacaggaacagaaaaccaaacgccacauguucucacucauaacugggaguugaauaaugagaacauauggacacagggaggggaacaucacacaccggggccugucaggggguggagggcuaggggagggauagcauuaggagaaauaucuaauguugaugacggguugaugggugcagcaaaccaccacgucacauguauaccuauguaacaaaccugcgcguucuucacauguaucccggaacuuaaaauaaaauaaaauggaaauauaugaggcuggauaauuuauaaagaaaaguuuaauuggcucacaguucuguaggcuauacaggcauggugcuggcaucugcuuggcuucuggggaagccucagggagcuuuuauucguggcaaaaggugaagagggagcaggcacaucacauggcgagagcaggagcaaggcugggggagauaccacacauuuuuaaaugaccagaucucaugaggucucacucacuauggcaaggacagaacuaagacaugaggaauccacccccaugacccacacaucuccaaccaggcccuaccuccaacacuggggauuaaauuucaacaugagauuuggacuggacaaauauccaaaccaugucagugaauauauuuuagaguuuaaaagucuguuucuaagcuuaacuuugauaugaauaauuuaaacacacaugaaugugccuucaaaccaaacuauacaauguguaaaaaccccuucguuccacauugggguuucguauuaugaaauauaaaaaagaaaaaaaaaagaaauacguuauuuggcucagaauuaucaagaaucugcucugcaacuaauauuacuucucacuacacauuucuuuuuauuucucagauucuuagcacuuuuugagagaucagagaaaagauaaauuuaaagauuuuacuacuuguuaucaucucuagaugcgaaggagauuacaauuaaucauuagauucacagaauucauugauaauaaaaauuauuauucuuuuggccauauaacaggauuucuguuucuaauguagguguuugauauuuuaacaaagaucccuauguuacuuuuucuuaauaguuuucaguuggaaugauauacaugucauauauauauaacuggaguuagaauguuauauuguacaaucauugcauauauaaagguaauauaagguagaccuaagaaggccauuugcaguaauacuuggaagcaaaauuucuuaacuuccugaugaagaaccuuaaaauauguugaacuugcuuuccucucaucaucaaauugcacauacuuccuguuagaaauguuaacaucucuccuuauuuuugugagggacaaauauuuucucuguauagaaggcagggaaccaauauagggaaauuccuaaaggaauguguguaaguugccagcauucauaccuccugagauguuucuaaaagcaucaugaauaguauauagugaacaucuucccuccagcugagcuuuugaaauagcucacucagcauuuuuguuuaacaauaucccugggacauaaaccaaauagcauuuccuauucagucucaucugucauuuuccugauuucacaaccagccuccagaugucaaaauaugaaggugaaugugaaugaaauuguuuuucuaucagagcucccuaaaugaaauagaccaagauuauccuguaccccugaugccccaauaaauuggucagucgucccaaaguaaaagcuugaccccaugaguuucuaaaucauuuccaacguguauuguaguuuaaaacaaaaaauuaugcuauacuugaaggccauuuuagcugaguuauaaaauuugcuucuauaaaucuugccagaguaaaaugggccuuggauaaucaucaaaacaaauacagauggucccugacuuaugaugguucaacuuauaauuuuucuacuuuguggugguacaaaagcaauaccauuuaguagaaaccaagcuucaaauuuugaauuuugauuuuuuccuagacuagggauaugugguaugauacuuuuacaugagauagucaacacuuuuuuauaaaauaggguuuguguuagaugaucuugcucaacuaggcuaauguaaguguucugagcacauuuaagguaggcuaggcuagacuauguuguucaguagguuagguauauuaaauacauuuuugacuuaugauauuuucaauguaugauggguuuaucaggauguaacugcaucgugaguuaaggugcaguuguauucuaagaccucuacaaaaaacauugacagccuauugcuguuuuaauaucugugggauugcauucuuacaauuuagauguagauuuagauuagauuuagaccauugguuucuguuuccauuacaaccacuuaauauauaauaugaaucuggcuccaaggcaugggagaaacauguaaaagugcacugucaaacaccauauguaacuguuggcuauauugauuuuguggcacuuaucuauucugugugcauuuagguuuuugaaguaugcaaguuuuaucauauucuacugggaaaaauggcugauguagucuuuugaauggccccucacacaccacaaagcuugggaauucuagauucaaauaauuuuuaggaaagaaggacuccuaaauauuaccuauuugaguuguuuguuuuuucagaggccuggaaagguaagaugccuugcccaagaucacaaagccaguuaguggcagagcugaguuaggaacccuguaauucccagauacucaguuuauuauuuauucuucaauucauucuuuaggaaucuuuauuagcaauagcaucaacaaucacaaaacaugcuuguuuugcccauuuugguugguguacucuuucaguuuuuuccauaaaaaguauacucaguaacaaaucugccuucagcauaauuucccauaaucaaacaucaugauuaauuuuaaaguaugaaucuaaugauuuuggcacucuagauucuugugauauuuuacuucacuuuguauaaacuuaauuuauuuaucuguuuugauuccuuuuuacugaguuauauaucuuccaccuuuuuuccuauaccuuuuauuaaacugugccuuggagaagaaaauggauuuuucauagcuuguauucuguguuacagucacauuauugcuuaaaaauagagguuagauguaaccagggacauuacuguaguauagccaacuuggaauuucuuccuccuuuggugagcugaugggaaaagcucuugacuugccauuggaagaccuggcuaaauuccugcagugccacauuucacccauuugugggguuuuuuuguuuguuuuuuagagacaggaucucauucuguuacccaggcuggggugcaguggcauaauaauagcucauuggagcuuuaaacucuugggcucaagcaauccucccaccucaaucuccugaguagcugggacuacaggugugcaccacugugccuggcuaauuuuuuuuguuuguuuuuuauagagaccaggucuugcuauauugcccaggcuggucucaaacuccuggcuucaagcaauccucccaccuuggccucccaaaguaaugggauuacaggcaugaaccaccaugcccagcccaccugcuguuuuaauuugggucaucacuaaccccucugaaccuuuuucaugauagauagaaugggaauaauacuugucuauuuugugucuuggaaugugacccucauagcaauucugagaaauuuauaaaggaguacuuuguuuuguuugugguucuugauccuuugguuaucuucuuuuaauagggacaucaagagugucaccucaaacccccaauaucuguuggugaauaaaaaggugaugauggagaaaauguuuuauaaauugaaaaaugcagucuaaaguggucuaauauuguuaccaaguaauccccaaaaguuuuuaaauugguaccuagggaucaagaaacugcuucacucuauuugcugugcuuucuuaucuuucaaaauuuuacccuuccauaaagacaccuuucaaaugcuugauuucucuuuugucuuuucugauucaccuucucccuaccccaacauuagcuuggaucucauguucauuuauuuuuuacuuaguccagaacuagaaugauagcaacuuuagggacugcucucaugaagcauuugaaggaggagaaggccuugcauaugauaguugcuuaguaauaucucuuaaagugagauuuagggaaaaugcauuuuuuagcguuaucaauuucuuccuuauaauuuuacuuugaauuacuuauuuaaaguuuaaauaauaguguaugggaaaaaaaucuuuauuuuuaaacgccuucuaguauguauucuuuuaugggcuggaauuugaaugguugaaaacaguagcauuuuagaggauuaaaauuuauaaauuaauuuaucuaaacaucuuuuuugaaaaccuucauuuaaaaaaucuauuuuccauuuauauuuuucauuucucucuaggugaucauauuuaaguauuguaaguuaaggaccugggcaaauaauuccucaaaaauuauauuaauuuauuuuuaaaaggaaguuuauucacuuacucacggcaaaccaacuuuaaagauaaaaauguguugccuuaaagacugaagacauguucaagauggcaaaaagagucuuccuaccccuuuuaaaaaguaaaugcagaagccguugugagcagugauacuucauguuuuguuuuccaguaguagaaguguuuuaaaaugauaaguguucuuuaaaauguuauggucaaaaagaaaagauauuuauuggcugggagacuugggcuucugauagcuuugccuggaauuaugauggaaauuuugacagaaucauaacucaaguugacauuaaugggaaucacuuccuuaugauuuuguguagccuaauaaaaaggucauuugaaaauuuuagauaaucagaugguuuaauggccaaguagaaauagcacuuuauuuuuuguguguuaaucuuugggugcuuccacuaaauguagauuuagugugugucuuuccuuugacuguuaacaccucuuacagcuauagugauugcuagucuagucacagucaguggcugacauuucuaugacuacugacucuuuuuuuuuuuuuuuuuuugagauggagucuugcucuuucaccaggcuggagugcaguggugugaucuuggcucacugcaaccuccaccucccggguucaagugauucgccugccucagccucccgagcagccaggauuacaggcgccugccaccacacccagcuaauauuuguauuuuuaguagagaugggguuucaccauguuggccaggauggucucgaucucuugaccucgugauccacccgacuuggccucccaaagugcugggauuacaggugugagccaccgugccuggccaacuacugacucuuauaaagauuuauuaccagaugaugacauugcuccugaugucucuaacuagguggucccccuucacuuuucuuagucuucugccaugaccccucccuguaccucuauaguggaagugguucacauuaguucguccuuaaccuuaauucuaacauaaaugaauguggaauaccgcaaagagaccaaaagagcuagcuguaugcuagcacuggcucugacagcuaacaagcuuuaaggcuuugagcaaaggacuucuccucuccagauuucuuuuuccugauuuguaauaugugcauuggauuaggugaucucaaagauaccucucccuucuaagauuuuauauucaucaaaauucaucugccagaauggcacugugauaauuagauagacugccagcuggaugcagggaaauagcagagcuaaaagcuccagucuaaacuaucccuggugaauauucauuuuugcauauuuuaauaacaauacucucagugucucaccuccacccagucacucuugcacccugucacucacuuagcaagacccuuucuuuuccuucacguuuuacaacucuguaauuuaacaaaauccauuaguaccaacaaaauggaguaacagugauguuuuaauauauggcauguacccuuaauaucauuacuaguauuugagaaacuaaaugaaagauuuuuaacuuugacuuuuaaggaagaaaaaaaaaucaccuuucuuuauuuaaugaguaaaaaggaccuccaguaaagaguaaugcaccauaauuguuauucacuucacacucauuccuuuuuuuggcaugcagagccucauauauucuuaagcauaaaaugcuggaugacauauuaaaugaagggucauucuggaaaauaaaauagacaaaauggcuuuacucucaaagauaauugugaaguaaaaaccaaaauaauagcuuauucauaacuauuuggaggccuuucuuaaguccagaaaggucagagggaaauugaauaaaugucaacacugucagguggggagacucucagcgucuccugaggaauuuaauuuauauuaaugagaagugagaccugcuuagggcccucucagagacugcucuggugucaaauuuuaaugauuuaacuucaugaaaaggauuccuaacaaguuauccaacaagauaaccucacauaagauugcuuuuuaauugugaggccucaauugcucugaccuccccaaaccacaggcacauguuggggcuucuugaggacuugccucaccaagucgauaacuugccgucaguucuggcccuucuaggggaccaggugaaccaagugagauucugacgauaaaguucuaauucaauucagcagacauucaugaagaccuaucacuggggcaaugugugagugacaauaguaggugccacuuaugaacacuuaaugugugucaggcucccugcucaacguuuuauguucccaauuucuaaucuucauagcaacguuacagaauuacagauguggagaaggagacucagagacauuaaguuaacaugcucaagauuauaaguauugccaaguagcuagcagaaccaggauucguuaggucaguuugccucccaaauccauggcuuucugcuacucaccuaugucuuagguuuuuuucuuuacucaucuaacguuccaguguucauaauagcuuuccuuugucuagcuauguuccagauacugugcuggguguuuuauuauguaaaccuacugaauagaugauaguagccccacuaaugaaaaaggagggauggaggauucagcagcuugccccagaucacacagguagaaaauggcagggcuaaaauucuaacugagaucuaacugaucuuccaaaccuaugcucuuacgauuagagaacagugacuuuaacagugcugugcccugaggugauacagaaguguuaaagcaggccuguucacucugauagcugaaaaguccacuggguugagauggacuuggacucaagugucuguaaagccaagcagaauaaaugugaaaugaagugauuuugaaaagauguuggggaaguacagggguaaggaagauuaauuccaaauagaaggcacagaaugguuuugccaaugaauuggauuuuaaaauacaaagaaugaaagaaaacacauuucaggcagagaaacuaguuuucccuugaguaaguacagcuuuggucacuucacuuagguuuggauguauaguguuuuuguuguaauuucaaguaauuaguaacuuuaguuuuaauuuucucauuggcucaugacuuauuuaauaguugucagaaucuuuaauuuguuaguuuuguguuauuuaauaaguuauuuuuauuuguacugccuuuggguuggagaaaauaacugagucauuaguuuaugaauuuauuaagguuuucuauguggccugugaaaugacugauuuuuauaaauguuucauggauauuugaagugaauauuuaaauguagaugaauuuucuaaagagugagugugaagguagaaacuuguuuauuagauuauuugaaucuucacauauuuuuucauugucugaugagcuaacaaauuaucacacaagaaucuccuacuuguauuuuggguucaaaggcuuuuucucauauucuugguuuuuacuucauguaauugaugauguguguuuugguauauauaacuuugugauuauuaugucuucuuggauuauaccuauuaucaauauaaaauauccaucuuugcuguauuuuuuuugcuuuaaauucacucuguuaugaauauuguuagagcgaauucaguuuauauaacagauaaauuguugcccacauuuuucuuuagaguugucuuuuauauuaacagguuucuacuccaucagauggucuuuuaaacaauuuuaccaacaaacauuuauuuugauugcucauaugauugauuuuauuccugacauuuuauuuuguguuuucugaugcuuuuuugguauguuuucuuuuagccuccuuuucuuucuuugacuuuauugauuuuuuaaaaaugcuuuaaaacuauauuuucuuuccuacuagcagcagccuuuuaaucaauaccuacauacuuuaucaauauuaaaaaugaaaauauccaugggcuccaaccgaacaagaaaacauauuuaacaugcuuugauuuauccuuuuuauuccccuuccuucagugcuucaaguguuuuauggaaauaauaugagauuuuauuuccacaucauuaucuauauagguguacuuuaccuauacguuuugucucuuaaaaauauuauaauguggcuauauuuauagccacauuauaauaauuacauguauuuaacuuugaguuuuacugaguucauuguucacuaccauuucuugccugcuauacacuccuuucuugaguuuuuguuugaguuaauuucucauuucaucgcaguauuucaaguaauuuuuccagaaaauguaaaugggugaacaguaugaugauacugugucaucagugaccugcauauugcuaaaucuaaaugaucaguucuuuguccucaccuuucuuaagcucucaguagcaacuggcaaaugauuacuuucuugucuucauuuggcuuuuaagauaccaguuucuuuugguucuuuuagcucaauggacacuauuucuugacuugcuuuuguucaucuccccaguuucuuaauguuaggcuaucccagggcucguuccucaacucucuuuucuucuguuuacuuguguucucuaggugauuccaucuagguucguggcuuugcaugucaucgguauaaauccaaaguuuacaucuuuagcucagaccucuccugugacugcauguuucccauuguauacuuuauaucugagacuuaacaugcuccaaaaugaaguccuggucuccccacccaaaccugaacuuuccuaaauauuauuauccaucuauuacuauuauaacauagccuccuaguugguuucucuacuuccaucuuugacccuccacaccccauucucugacacagcagccagucagcauccauuucuucaaagguucauguuuuuauaagggucuacaggaucugcaucgaccucacacucuaaacucaucuuccccuaaaauucuccuccucacccagucauauuggucuacuugcuauucuucccucacagcaaguguuuauuuaaaugucuucacacaugcuguuucuucuaucugaaugccuucccccagauuucuacacggcuuccucccccacuuacuucaggacccugcgcauaggucaccuuaucucaagcgcuugaauaugccucauaugauguagcuccuugguacauacuuguugaugucuguggggauaggcaaaaugccuuuugucauguuugggucuaguauuuuacauccucauucuuuuuucuuagaauucugaucagaccaauuauugagaagcuuuugggaaacacuguuuaucuuuccucauaggguguggaaaaucucuucugugcuaguuuugggugccaggcagcuuugcauuauuuguuuuugcguaaguuggucucauuuguucauuuugucaaaaaaauccuuuuaaauuucugauuuaugguuuccuaauuuuucaaugcuauauuucuuuuuauaauuauuuuuguuauuuccauaggauuuuugagaaggaugggagguaaauguguagggccaauucugaaucuuuaaaauagaaaugcauaaaaugugcuuggcucuguucauucacaaccauaccuauccauuugaaaaauuaagcauuuuucuguuuguguguguguacguauguuuuaauuuauugagucugauuacaaugcccacuucuacauaugaauuuucagagccucuuguaauaguuccacagcccuaaaauugggaaacuaucugcuaugaauauauagcagaaacauagucauuggaaauggugggcacauugguaucccuaaagaguagaguaaaauucauuuucaucuaaaggaacccaauccucuuguuucacauuuagaaaucaucuuaugucauucccuguuacucucacagaaaauucagaguaaggaacacagguggagaagaaaugggcaggcagcuuugcagagauguuaucaagauaacauuuuucuucacauucuguagacucuagagaaaugguuuacaagagagcuuuaaagguauuguuuuaacauacauaugagcuguacuuauguaugacaccuauuuuacuuuuucauuuuuguuguuauugucaaaacaaggccaguguuuuucuacaucgacugaauuucuggacccacuucccauucaaacuguuuuuuugaaaaacagucuuauuaauuuucuguauauuuuguuuucuuuccaacauuuuuagauucaaccaucagacacaaauuucuuuuuauaucugcuuuguuaguuguggacaugccuuucuaccgugucccuugauacauacacccauuaagauguuuaucuagcucgacuaacacugagugcuggaaucugcaaaguuacagaauugagaggauuuagaucacauaucauuuacucugaaaagaaagaaagggcacagauucuggaaacagacaaguuugaacccagcccugcuaccuauaaacugacuugugggaccuuagauaagguacauaucuuuaaaaagguggauaguaauacacaccuuguuagauuguuguagagacagugauacgaaaucauugcccaagguuagguguggaauaguagcugugucagucaggguuguccaaagaaauagaagcaauagugugugugugugugugugugugugugugguauguguguauguuuguguguguguguguguguguguguguguguguauuaagagacuuauucuaaggaauuggcuuaugugauugcaggagcuggcagaucaaauucuguggggcaggccagcaggcuggaaauucaagugggauuucuuuguuacagucuugaguaagaauuccuucuucccuaggaaaacucaauuuuugcuguuaaugucuccaacugauggauaagacucacccauauuauggaaaguaauaacuuuuacuuaaaaucaucugauugugauauugaucacauucucaaaauaccuuaaaagcaacaucuagacuaauauuugaccaaaacaacugaucaccguagccuuaccaaguuuacauauaaaauauaccaucaaaauauuuaauaaaugguagcuauuauuuuuaaagaugguauuuucuauuacuucaauuauuauuauuuuauuccauaaacaucucuugaggaucuaccacauaccaggcacugugcuagguaugugugugugcacacauggaggugggggaaagggagagggauaaagguggauaaguuauaccacuuguucucuaggcgucuauauuccaauggaagagacaagucaaagggaaaugauaauguauuaggaauuauggauagauauauaauacuguaaauuauauauuuaugcuuuuguauuguauuuauuuauauugauaccuauauuuaucuugguaaaauucuguccaucucuucauccuuccauccauuuauccaucuaaucugcaggaccuuguuuccauuuuugccuugaguugaagggaagagaaaaauugucuuggaugaaacuacucugaauaagcauugguugaugucaagcaggggaaugaaccucuaccaugauuauaaugagucagguagcuuuguuguuuuauaaagguauuucuaaaacccucuucagaagcaaugcauaaguaaaauaaguuuucuacgugaaccaaggcuaaagcuccacuccccugcagguuuugcgauuuuacucuagauaauauguacuguuuaauuaugguucauccauauaauaaaauauuaugggucuguuaaguacuuuuaaaagcauauaugauguucuuucaauuuguuagguagaggacaugacuguaaaauauuacuuaguauaaucuuuauaugcauugaaaaagacuggaagaaaauacaccaaaaacuuuacaguaacuauuuuuggacagagggauuaugguugguuuugauugauugcuguauauguuucuguauuucucaaguuuucuaauuugaauguccaaguguggaagaggaacagaugguaaagaguauggcuguagacucuuguauugggaagaugaacucaagcaggugggccaaauucuuauugaccuugccuuguuaagguaucagugcuacauuauugauagcugcacuuauaacuagaucuucuaucauguucaauugcagugucuuauuaucauaggcacauuauauuauggggggaagagggagagagagaaagagagagggagggagugaaggaaggagagauagagagagagagagggagagagaaaaugaaauuaucuuucacaauaugagaaucuaucuuucacgauaugaguggcucccuaugcuauuccuggagccagccugagaugugagaugugaaccugcuguuccucaguuauauugguugccuugugugucucauguugugagccucuugccaugcugggugugauuuugguguugaaagauaaaugauuuuauaaaauaugauccaacuuauucauuugguucacagcagaaaaauaaagaucugcucuaguacuggaggagggacuggcugaguuggacucauugagcgauguuacaaucuuuguuuccaugaacuuuucuaaggaauguuaaggguaguuuugacuguaugauuugcuaauccaaccucauauaucuuuauuauacgaaauuuauuuuugcauuucccuaccaguuccaauauauaagugucucucugaauaaauguucuucccauuguggcccuacuuugauaccacuaucuaauuauagagagcauauuuugccaaugguaauucuuaaucucauuauacucuaaccugaauuuguucaucuuggaacauuauauucuuacagguugacacugauuuauugauaagcucugaauauuagcuuuccagucuuucaaaugcccgucuaauaguucugagauauauacuuuauuuaacuaguuuuuuuggugauagccccaucauuaaaguuaagcuuauauuagaucaguaaguuuuaggucuaggacuaucuuuguuuaauacuuguaaucagaaucauaaucauaauauacugauacuuuauauacauuggaagugccuuguuuuaagcgauuauaacaagugauuuucgagagacagaugcaguuuauuuuaguauaccaaaaggaagucaucaaaaucuacagauugaaauacaucuagcuuuuuauguuaucuuucauuaguucuuucccuuccuuaguuuaacacaguuuucuguucuuaaaauucuaguauugguugacccuauucucauuugauuuuugaugggaaaaguagaacuagacaaaacauuuuuuuaaaaaucacauuuuuuucuaagacuuuuuucuuuuuauuugaaugcuuuacauuuuaauugcucauuuaaaccuuuuaaaaucuuagcccuaguuuuccuuuauccaucaguuuuagccuuucauuucuauugcuuccuuuugggcuucuauucauugaacaauuucuaauuuuuacuaguuuucuuucuuucuauuuccugcccuuucuuaacauuauuauuauuauuuuuuuaggaaagaccauguguucugauucuuuaaaauuuuauauuuuucccucggugcuuuucuauuggauucuacaaauuguauuucuauaggaguguucauuuuaaaaaacaaggugaggugucuggaucaguaugucuauuagguuaucuauugcugcauaacaacauacccuaaaaauuagcagcuuaaaacagcaaauauuuguauaauaauuguuguggauuaaggacccaggcaggccaggugcaguggcucacgccuguaaucccagcauuuugggaggccaagguggguggaucacgaggucaagagauggagaccauccuggccaacaucaugaaaccccaucucuacuaaaaauacaaaaauuagcugggugugauggcacaugccuguagucccagcuacucaggaggcugaggcaggagaauugcuugaaccugggaggcggcgguugcagugagccaagaucaugccacugcacuccagccugacaacagagugagacucugucucauaaagaaaagaaaagaaaagaaaagaaaagaacccaggcacaauuuaccugggugcuucugacucaauagcucugaugaaguuacagucaggaugguggcuauggcugaaugcucaucugaagguuugaugggguggauucacuuucaagcucacucaugugguuguuggcagaaaaaauuuaauuccuugugggauauuggacagagagccugaauuucucacuguuuguuggcugggggccucccuugguuccuugccacauaagcuuccacagagcagcuuacaacauggcagcugauuuccuuuagaacaagcaaaugugagagcaagacagaguacuuaagauggaagccauagucuuuuuauaacuccagaauaaucacuuuauccaugcuuuauuuguuagaggcaagucacuugguccagcccauaugcaaggaagcaauuacauaaauagcaggggcucagauuauuggggacuauuuuaggggcugcuuaccauuauauguguuuuagaagcagaauaugauacauacuuuaaagcaacaaaagcagagcucccuggaacauggaaggcauggaauauggaaggcaguagaaauacaaguuugagauaauaucucagacuacaagaguagaacaguagcagggcuuuguaaaaauauagauagugagaaauaaauaguuuaggaugaagauuaaagaaaacuuucuuaucaauauuaauucuggucuacguauuuucuguucauugaagcuaccuagcuuuuugaaaguaguuaaaacaaaucacauccaaaacuaagaauaacuaugcaauuuauguucaggaauuuaucauaacauuauuuuuaaaaauuuaugugcauacauuuuucuuuuucucucaaguuuauuuuuuauuuucuguguacuucuucauuucucuuggcaauauaguguuuucccucuuguauauauaaguguuuugcuuuuaauugcugagauuuuaucauaaacuaucuagccaaauuccuuuuuaaguauugucacuauguuuaaugaauacuaaagcguggcagaguuaaggauaaucaaaaagggaugauaaaguguuccugggcuagcaacagugggaaacuaucacuaccccaagcauguaagggcaagaggagggaaucauguuccuggaaacuagcaggagcugaacauaugacggagggaaugcccagcuggagcaggaaugcagccgcugcuuguggucugucagggaagaauccaaggagaugaauaccccaacuuugcucuccucuuacccucugaucucuugccuccccuuggccaaaccuacgagaauccagaagguaagugagcccaguugaugcaggcugugcaggucagccucucagggcagagcccagcagagaagagaaagggagagaaugauucugaaggggcaaaaggagaauauucagcaaagaaagaaguuuuuuuaauucuuuguauugucuguguuuggcuauuagccuauuugaauguauccacugucuaacuguaaaaguuuugaguuuugguuagucuuucuacucaaauggccccauaaugguuacaaucaagucuucaagaaacuuuguuguugguuuucuuuuuuaaguaguaggcuauauuuauauuauguuuuauuuaugaucacaagcaugguguaagagugcuuuuacuguggaaguuugacuuuaaaauggccuaccaagaaggaauaugcauccucguuacauuuggaacuauaaaaauaaauacaguguuguucacacaaacaaauaauuuuugcuggauaguuguuuaucaguuuccuggagccuuguuuuauaaauacucauaaacuuggagaaaaagucuacuugagagaaguugacacuauauguagucugcuuauuacuacuuucuuuuuuuuuaaaguguaucuuacauuuagaaacagauacuauaacauagaagcaaagaugacugaugagauuuuuucaccaaauauuuauggaaaccuuccacuuaauaugaacacacagagauaaauaguguaggcguauggugauuaccaagacagaguccuugcucuaaaacaguuuaccaccaaguaggguauuuaagugcauaaacaacuaacuguaaugaugaguagugucccauaaauacugucuuacagggacagguaauaguauaggagugcacagagugauuucagagaagcuaguguuugagcuaaaccuugaguggugaauacaauuaugguagaggagaggagaauucauuuugggcuuagggaauggcaugaauaaggcacaacucaauaaaaauacaaauaugaaggugggguaagaauuauucaagaccgaaccuuggugaacaacauauacaagcaauggcaagagugaaggguguucagaaacaugguagaagauuagguugccaagagagaacagggcuaaauugucaagguccugagugcuuugcuaauaauuuuauguuuucuacauagaccuuagaaacguuuuuguaaaggggagauaaauaaugguaagguaagggaucagcucaagauggaagagaauggggcagagaggcuuuuggugauaguguaggaggaaugaggaggaauuugcaugaaggaggaagaggauuugccugaaggccauggcaugggaaggaaauggagaacauagauauaagacaucauaagugcugauaauagacuuggggguuucuugauuucuguuuggaguaauugguagaaggugaagcuguuaccuaagagacaguagaaaagaaagagccggcucuggaaggaaguuaacaaauucgauuuuagacuuauuaaguuugagguauuagcacuggucuaauguagauguccauuuagauccacuggaaauuuugucuagagcucaggaguugccuggguucagaauagaaaucugggaacauaagccugaagauauuuuuaaagccaugaaaguaagcgagcccucucuuaaggagggaguuuagcgugaaaaaaggaccaaacagagaacugccuacagagagguuggacaaaaguccauuuaaaaagacugagaagaagaaaucaaagaacuaagaggaaaaucagggaacugcaguugucauagaagccaaggagucggggaguuuuuagaagauuuuagaacaaugcgacauuaagaacuauguuuauagcaacuuguaaauuaguccuuucuuuuucccccaggagcuuuaaauucugcccauguggguggguugagggagucuucagaguuuguagaaguagcucuggguuucugaaaaaugugaaggugauguacugaccuaguuaauaccccguaauccugggaggaaggaaggggcuguggcuggaguauuuauuucuugucaugauaggucuugucaugaauauuaacuauuuacucuuugaagucacaagugaaagaagggucuggcuguucuguuuaagcaugucagaagaacaauaaugcuuacuaugaugacuucucaaucuugaaauauauucagcgcuugaaacuuucuuucccucccuguccccuuccccuuccccuuccccuucccugucccuuuccccuuccccuuuccuuuccccuuccccuuuccuuuccccuuccccuuuccccuuccccuuccccuucccuuuccccuuccccguucccuuccccuuccccuccccuccccuccccuuuuugacagagucucacuggucacccagucuggagugcacuggcacaaucuuggcucacugcaaccuccgccucccagguuccggugauugucaugccucagccuccccaguagcugggauuaaggcaugcgccaccacaccuggcuaauuuuuguauuuuuaguagagacgggguuuugccauguugaccagccucaagugaacuucuggccucaagugaucagcccaccucggccucccaaaguguugggauuacaggcgugagcuaucgcgccuggccggagccugaaacuuucaagcuuucaguuuaauuccauggcuuuuauuuucuuuuccauuuuaaacccaguuauuuccugaaucuaauuuauuuauuuuuguguauaugucuuuaaaagguuuccuaacaauuacauuugguaaauaaguucuuauuaaguguuucuuuuaguuguugugcuuuuguuuauugagagaaauugaaauuuuuaaauuuugcaccuuuauugcaggcugccacagguaaucaagaugauaugcaccaugguaaacaauuucuuuggaaauccaagauauuucuugaacucggggauucaggaacugaaguuugaccuuaucuuauuguauaaauuacuuuaacauuaugguacuuuuguaccucauuuggagauuaaagagcuugaccaaacaagauagguuagcauccagucaccuguaaugaggaaggaguuaguuuucaugugugaugcuuuggguaucagggauaugcauagcuucauaaauaacugggauuuucauugguauuuuccuaccgcagguguacuauuuugauauuaauagucucauccuuuggaucucuuacguuuggcagaauauaaguaagaaaucugaauaaaggugaauguucuuacauguguucuugguagaaguauaugucacugucagaguaaugagauugagggugagguuguauguuauguaucucugauggagauuuugagggguagccagacaggucaccaauccucaaccauagcugucuagcacugccauagguucugcagagaguucugcagagcagaccuucuuagcaaaugcaccuucuuccuugugcugggcuuugaccccagagccuuccauggaagcuauaggucuaguggguuggccucaaccacuugugagugaguauucccuuuauccuucuggccuaugacuuagacuaaaagaagucugccugggcuccuuuuacugaggucuaauuuuuauccuuggauuccugccauuccuaugcaaugagaaaaacaaaccccagggggagagaaagagaguguacuagcauugccuucuagccuagacccucacaagacaggaguccugccaagcaagacacagccuuuucacauaugggaguaggcaauucaaaggaggaccaguaacuucuagugaugcagauagaggaauccaaaaggagcacacagaguggauccaagaaauuuaacuguaccacuuccuaacauguaaaccauuuggcauugguuccauacuaaugccaauucaucugcuucucggagugauggaggaggaguguugaacccugagaguaguuuguaucucugcauucaagagagaaaacaagagaagcugguagaaaaggcuucucaauuugugagauuaaucuguguuacaucagaaguagugagaaaggagaguuaggauuuagaaggcuugggaagaccugaauaauguggauaaugguaugugcaaagccauaaaaugugugguuuugaugagguuagaaucaugccugaaagcugaauggggauuuagacaucaugugggguauguaaucugcaagcuccguccugggcccagugaaaaccuuucugugagcuuucccuaaggcuguacuucaggcaaauuauuauacaagggggaaucuauuugccaucucugagcaaauccaugccucccuaccuacuauagguuaggaaauaaucuuuuauaucuguugguguugcauuuacaaagggcuuccccguauauuaucacaucuaacucugccuguuaaucacagaggaauaaaucauggcaucugcagaguagagccucuaccaggguguguacucuucauacaaccauggaccugcccucuguuaacaggauucuguauugggagagcaaacccuuaaaagcagggauaaagauauuaagaggucuuccugucuuuuacuaaggucugaaaugccaccaauucuagcaauugauuuaucuggauccccuaagaccuucuauuagagugugaauauccaugcaaaagaguuaugggcucagauugaagugugucauguagaaauugaugaagaagcgauaauuauagcagauucauugauaguuuuauguauguacuaauuuacuugauguuauuaagaaauuaugaaguuuagagcauugcuauagucacugugaggauuaaaaugcugaaaaauaaaugaucccuuccccaaagauuuuacaguguaguaggagguccuccagugaagaaagggggagacuuuggaaacagaauggcuguaggaagugaugaagaaugauguagauaacccuaagcuuucuuuuguaaaaguuacauuugauaaccucuuugaguuguucauuugguggcauuacauacugugaugggguaagaugaauaugaaacagguuaucaugggauagaugggaugcccuguggacaaaauccaugaagaugguauaugaauuuuugaaaauagaugagguguuccuggagacaugauuaaaaggaagaagaacagaggcucaaguaauagcucaaagaguuuuaggccccccaacagguagaagaguuggauuaauggguuuugaaggagauaaugcacaaaaaguuaaauuaugaggucacagaauagguaaauucuguauucuggacaacaagcaggaaaucuagcccaccuugguguagacagugaacccugaugucagaggucgaagaaaaucugauuucaccuauauuuuuuaguuuuguuagcaugaaacuacuuuuuaaaaucacuuuauugaggcauaauuuauccacaguaaaacaaacccauuuuaaguacauuucagugaguuuugauaaauguauauagcuguauaaauaccaccacuaucaagaucuagacuucaauuacuccaaaauguuucuugugccccuucccaguuauucucuacccugauccuuggccccaggcaaucacugcccucugucauuauagauguaaauuugucuucucuagaauuucauauuaaugagaucguauaauauguacucuuauaucuggcuuuuugggggauucagcauaauguuuuugagauucauccaugucguuuuauaugucaguaguucauuccuuuucauuucugacuaguauuccauugaauauacuacaauucguguauucauucagauacugauggacauuugaguuguuuccaguuuucugacuaccauuaauuuccaguuuuugacuaccauuaaucaaagauauacauaucuuugaguacucaaauauguacaucugaguagaaauauguuuucauuuuucuugggugaauaggagugggauugcuagauuguauguuaaguauauguuuagcuuuauaacaaacugacaaacuguuuuccaaaaugguuguaucauuuuuuucuuauuccuaccaguaguguaugaaauuucaaguucuuccacaucuuugccaacacuuggcguagacauucuuuuuaauuuuagucauucuaauagguguguauugguauaucauuguguuuuauuuuucauuucuuuggugacuacuaauaugcuugguggccauucauacauguauuuuugugaagcaucuguucaaaucuuugauuuuuuuuacuguguuauuugacuucuuaguauugaguugaaggaguucuuuuuuuuauuauacuuuaaguuuuaggguacaugugcacaacgugcagguuaguuacauauguauacaugugccauguuggugugcugcacccauuaacuccucauuuaacauuagguauaucuccuaaugcuauaccuccccccuccccccaccccacaacaggucccggugugugacguucccuuuccuguguccauguauucucauuguucaauucccaccuaugagugagaacauacaguguuugguuuucuguccuugcgauaguuugcugagaaugaugguuuccagcuucaucugugucccuacaaaggacaugaacucaucauuuuuuauggcugcauaguauuccaugguguauaugugccacauuuucuugauccagucuaucauuguuggacauuuggcuugguuccaagucuuugcuauugugaauagugccgcacuaaacauaugugugcaugugucuuuauagcagcaugauuuauaauccuuuggguauauacccaguaaugggauugcugggucaaaugguauuucuaguucuagaucccugaggaauugccacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucuuuaugguuuugauuugcauuuaucugauggccaguuggaaguucuggccagggcaaucaggcaggagaaggaaauaaaggguauucaauuaggaaaagaggaagucaaauugucccuguuugcaggugauaugauuguauaucuagaaaaccccaucgucucagcccaaaaucuccuuaagcugauaugcaauuucagcaaagucucaggauacaaaaucaaugugcaaaaaucacgagcauucuuauacuccaauaauagacaaacagagagccaaaucaugagugaauucccauucacaauugcuucaaagagaauaaaauaccuaggaauccaacuuacaagggacgugaaggaccucuucaaggagaacuacaaaccacugcucaaugagauaaaagagggauacaaacaaauggaagaacauuccauguucauggguaggaagaaucaguaucaugaaaauggccauacuacccaagguaauuuauagauucaaugccauccccaucaagcugccaaugacuuucuucacagaauuggaaaaagcuacuuuaaaguucauauggaaccaaaaaggagcccgcauugccaagucaauccuaagccaaaagaacaaagcugggggcaucaugcuaccugacuucaaacuauacuacaaggcuacaguaaccaaacagcaugguacugguaccaaaacagagauauagaccaauggaacagaacagagcccucagaaauaaugcugcauaucuacaaccaucugaucuuugauaaaccugacaaaaacaagaaauggggaaaugauucccuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuugaagaaaaccuaggcaauaccauucaggacauaggcaugggcaaagacuucaugucuaaaacaccaaaagcaauggcaacaaaagccaaaauagacaaaugggaucuaauuaaacucaggagcuucugcacagccaaagaaacuaccaucggagugaacaggcaaccuacagaaugggagaaaauuuuugcaaccuacucaucugacaaagggcuaauauccagaaucuacaaugaacucaaacaaauuuacaagaaaaaaacaaacaaccccaucaaaaagugggcgaaggauaugaacagacacuucucaaaagaagacauuuaugcagugaaaacacacaugaaaaaaugcucaucaucacuggccaucagagaaaugcaaaucaaaaccacaauaagaaggagcucuuauauauccuagauauaauuuuugaccaccggaaauuauuaaaaaucuugccaugauagugcuuucagugcauuacuguaauaaaaauaauggucuagaugcuaaaauguaacacaucugcuaugauauagcucauuugaggauaauagaaaaauaucgauaaaaauauucuuuuugucaucuucaacgugcaugaucucagauuucaaaaaggaugccugccuacauaucucuucuuccaguacacucugcaaucuacuuaaaaaaaauuuuuuuuaagauagcugcuagaugagugccaguuuuauauucuuuuuuuuuucuggcaacuccuuugagaaacauauguuucuaacuuaaguuacugcuuuuuccuccauaugcuucuuauuccauuucuagguaucagaaaggcauuuggguugaauacgugcaugauuaaguccauggagcuuauugguggagucaggcccuccaaauaggaaagaaaagagaaccugaucaccaccaauuuaaaaguaacuuagaaacaaaacaucaaacucuuuuucugccagugacuuuaauuuuuaaacuauauaaacacuugcucaucagcuauuuuuugugcuauuuuaugcauuguuccaagcuaaacuuccuggggaagaacacaggcacuacuuucaagagcucagagaacaaaugcuggaggacaagagagggaauuaggauucuugaaugcuacuuauacuauuuacuucuggucuuccacaacuucauguaauuuaucaucugcccuuauugacuuagaagcuuacaugauaguauuugguucaaugacauugaguaagcauucugcaaauuaauuagugggacaaauuuggucucauaauuccacugcugcuuaaaguuauuaaagaaaucucucaaucugcuagcauuguaaauagccuauucuagcuaguuauauagauucaaaacuuacuuuauuauguaaacuauagagugacaggucagugaaaguguuucaacuuuuagaaauuguugacuuuccaggacuugcauuucuggccuuaauuaucuugaauauaacaaaucaguguacgguaagcaaagugaucucuggaugacuaaaauagauauuauaucucauaucucauaugguucaggcacagcauaauuccuccaauaucacucagagcuuauguauucuuauauuaggcaugauuuucauaagacugguuauuuguuuccccugccugcagcuauuaaaagcaaaaaaggugggaguuguggggagguggugguaaagagggacuccuauaugcaaaaacacugauagcagauuagagaaggagagaaucauauuuuaaaaaaaacaugauuucaaaggaaggccaauuugggaccguuuaguacauguauggcaaagcccaguggaucuuaagggcaucccugugucauaggguacaccaacaaugugauggcccaugaguuacaaagacuuuacauugugauuaauauuccuuuucuuuguucguaauaaaauucaagauagauuucaaaccaaaaugauaaacaaaacaauuaugugucaagauuuagcaccuugaccaccuggaaaacuuuguccuguuccuugcccuaaugccuuugugcccucccucuccccagcugcacaugcacacuugcacgcgaauccuucucacucacaggagucacccaccgauggaauuuucucugggaaaaacugguugagcugcccuuccuuugagcucccuuugcuuauaauaucauggcacuaacaaccccauauggugauuaccuguuuauuugcucuucuuuccgaugagacugaaagcuauuugagggcaaaagcuugucuuauccacuguuauauaagccuaucacuuaggacaguuguaccuggcacaugguauagaguuaauacauaauucuuaaauaaaggaaugguugaaugaauguugaauaaauccagaauaacuucugaggaaccaagauuugucugcacaguacuuuggaaaagcagcaugcuaaaaccuuuggaaaauuugcgcucuaaucuguuuggaaauuucuauuagaaaccaucacauggauaagaguuuagaguaaggugucuuuaaguuagaugucuuuaagcugugaaaaauaaaacugaaucugaaaaaugaaacuaugcauaaauauucuagcauaauaaagaaguuauggauuuugucuuuccuuaagaguucuuauuugauauaaaaauauccuccauagcaaaaugaaaaauugaauaugcuauauuucuauaauuuuaaaaaauacuuuugcaagugauacuuuaagaaccauuaauaguucaccagugauuuggcugaaagagaacaaucagaagcauguuguuucauggaucuaguaacuaauaaaauacccuugccuggaauaauuuaaauccagaaaagagaaaaagcucauuacugacaaguuugcuaaugauaaaaaauuagauggcaguaaauaacauuaggcaauaacauuaaaguucaaaaaugccauguugaaguuauuagacuuguaaguacaaugauacauacaaaugaaggagaccggguuuaaagugcaguaccaggaauaaaacagagauuaaagagaaggguuauuuaacacugggaugguuagugaaaaagcucgugaaaucuccucagacugggauaaugucuuugaaauccuuuuuauaugaaugaguaaaaaucauaaucauuaauauuauuuaguuuuagaauaaaauuggggaagcccacuaaauacaugaaguguuggauuagacagguauuuuaauggucuuugauucaggaggcugacugcucuacaagccuuuucugagagauucuuuuuccuucugccuuuuccucuccaucuggccucugugacaacuauguucuucuacuuuuucauuuaucuaggaucauaguugggccacuuaagaacugggcuuucuuccaaaauaggauauuugauuguggccauuuugacaauguugucuuaaauauaaaaaggcacacaaaaauuuuucuuaauaaccaaugggcauuauaggcaugcgugggugucauccucaugcuaccuuacaguaccugguaggcugauggauggaggaaggcucuuggagcgagagaggacgucuguugcaaauauugcauuacuuguuauguauacaaaagcuaagaacgcguagcuuuuuuguuaguuuguuuuagacugaauagucuaauauauauaguuauaauguuaguuauguuuugacacaaaaguuauaacauuauaacugacauaguuugucagcuuaguuuguuuuagacugaagaaaaauaucccccuuucagaaaaaaagcuacaucaaaaugucauauaccugcuuauuucuguuuugcauuaggaaguuaauaagcaaguaggugggugaauugcucugugaaaccugggcucaauaaaacauuuuguuuucuuuuuauuacuuaaauugguuuuugagcccugcuugcuggugagguaucugaugucgcccauuguugggauuccuuccccagcuuucuccccacaaugcccucuccccugcaacacuguauugccuuggacucccagggcuuaaauggguccugggaacaugggcagaugucugguccugagccaucacuauggucaccauggcuccuucuauccacuuuaccacgucugaaauggcacuucacuccuuggggguggggagcucucaaaagugucucuccacagcucuugucucugcaggcgggcuccagagugucagccaagggcaggauauucugaagccagccagugcccacagccauuuguggguacccugcucagaagucugccaccucugggagcucuauggcaauaagggccaggccucuaagacucuagggcccaacugcacucccagcuugccccuucuccuccccaggcucccaguaucucaaccaugcaagggccuuucuuggccuuuucuuucacaaugggguuuaaugacccauguggaauuucuaaauggauaaaaccugaagaccaccaaagccuguuuacuuuuccugcacauaagaaggacuugauuuuuaggagugcgguguauggucucccaucuaccaaggauagacgguauauuucuuugaggcagcugaaacccagcaacugcacuuaugcauuuaguuucucucucucucucucucucucucucucucacacacacacacacacacacacucacacacacacacacacacacacacacauauuaaagaucugagaguauuuguuucggacaaucccuuuuagcaguaggaggguggugaugagggaagcuuuauuucaaaaugcuaauacuguaaaguuauuuuacucaucuccuugacugucuucauauacuagaaacugacuauaacaugauccaauuguagugugaaauuuagcauaaccagguuccccuggcagcuaagaagguauaguuacuagaaggccugcauuauaagauggccacaaugugagacagcagcacaguagugacuaucucaccauuuucuuacauuuuuauucaguuuucucgguaucagaaauuuacaaaacccuuuucucuuacuuuccaucuuugccaaaaacauagaaaucugaccagauuucaccagucaaaacucauugaaacuccugaaauuuaaguuaggcaauuccugcuuuucacuauaguauguuccuguaaagaauaacagaaaacaaagacagcaaaaaauuaguauuuaaucuuuccuccugcguaacuguggagccugcaguuacccuuuuaaaucacuagaugacgcuucggcauuaaggccagcuguggggacuggccagucagcaggcugaauauuaggaugguaaagacacaggcagugagugauaugagauuuuuuuauguuauccagggugauuuuuauaugugacaaaaagacuauuaauaagguuuaauuuugauuuuaaaaacugacauuuacuuuuuaaaaacuacuuuaggcuuuucaguucagcuuccaacucuaguuucuucuuuuuuauguauaagucagacagaaguuaguaauaauuucaaagggccuuugaauaacguuuagucccauuuacaaaauuaauuaaacauuuaaacuguccuuauacauuuaauauauguauuucuuuuuaaaaacuuaaauuaucuuauuuaaaaugucacuggauaguaaauaauaacuucacauuuaauaaaucaaaucuauaaauacagugauccucaaauuuucucaaauguuccaaauauauaaaaugucaaaaauuaauagauucuugaaaaauaauuauuuuauucuuaaaaaucuuuacauacuuacacuuaacuuucuaaacuucugagguauaaaagauacaaccccauuugaggaaggcaguuaaaaauucaguuaacuaagguuacuuaugaccagggauuucaguauuaagaccuagaguugcagagacccagagcacuuugucucaucaccaacuaaggaaacuaccaaauaucaaguaauucagggcauuucucaguauacaaagguuacuaaugaccagaaauucccaucuggaugcugauuagauuccugcugacggcugggcacgguggcucacaccuguaaucccagcacuuugggaggccaaggcgggcagaucacgaggucaggagaucaagaccauccuggcuaacacggugaaaccccaucucugcuaaaaauacaaaaaauuagccgggcgugguggcaggcaccuguagucccagcuacuugggaggcugaggcaggagaauggcgugaaccugggagguggagcuugcagugagccgagaucacaccacugcacuccagccugggugacaaagcgagacuccgucuaaaaaaaauauauuacauauauuccugcugacuagauuccaggagaucuggaugaugauaguagaacccauuuuauaguuacuuucucagggauuucaaaacaggcauugagucuuauauguuccucugucccugggucuagauuauuuacacauuacuaaguccucccgauuacucauauaauucuccaucacccaccagguucaucacuuauaucuuuuugguucccaaguuauacaaaugauucaucuaagucuaaggucuuuugaacuagauggcaucuuauauucuuucauauucucaggaccauacaacucuaacagauacuuacaaugagauagauugaauuuggauaucucaguaucuacuuugaagucaccugucaugaaguaaugguucccacagcagugaaaaguaaaaggauuuauacacuuuugguacuugcagauaagcaaaauuauguaauaaaacuuuugucuuuuuaaggaaccaucuauaugucagguacugugcuaggcaaaagaauauaaucauaguuaacacagacauggguucucuucucauaaaggguaugauaaagugagguugaccauauccuaauauugaaauuuggauaauaaaagggcagguaccuaaauauuggaccugauuucugccaacgaauaaacuacuaauguacuuaauuuccucuuuucuggagugaaacuaaugccuauucagcuggaguugcuguagaauuaacauggagauuauuacuagcaauguagcuagaacuuguggcaauuuacauuaagaaugaccucauggaacaaagaaaaaaguucaguuuuaagaguaauuuauuuauucccuauucacugaugagguuuauuuuuaaaugaaacuacucuaccuuuuaggaucucacuauagauaucauaguaaagcuugaucaugagacuuugggcagcuccuguugaagccaguaaggaaauuggaaugagucacguguuauagaaaccaguucaucugauuuuugccuuauuuccauuugacgguacuuucugaauuaauauuuuauuguucugaagagcuucauaaaaaccauauguguuauuuccugauucuuaagaaagggcuuuagaaguuguucuagucccucaagauaacuuagaaaauauggccuuauuuuagcaaguuuuaggccauugaguggcauaugcaacugguuucugaaaugggcucaacccauggcaacacuugggaaauagcuuuauucuucucucacuauugcucucaaaucacgucacaucaaagaauauugaaaugguguccagaauauuaaauagaaaaguaguuaaccguaagaaaauaucaguuuccucuucagucaucccuugcuuuuaaaugaguaguaaggcuggguuggaaauucagacaguguaggaugcuacugcauuugauaugccccaagaaugauucucugacuggcaaaauaguguuuucaguagagcauguggcggugcauuugaagccuuaagaguaauaaagucucaggacaguccucuccuugggcucugggacuccugauaccuucacaaaauguuuuuuauuuuucuucucaggggaagcagauggaaugaacaacuucugucuauuaucugcuauuuuuaggcaagguaaaccaucaucugugugcccccuuuagagaaguugagcuaauuuagcaaaaacaaacaacaaacaaaaacaguacaacaaauguccuguuaaaagucuguuuucauuagaaauuauauucacuuguuucuguuuguuuuagaaaagagguaaaugcugaaagagggugcgauuugguguugccauugagccacaauuucugucccagggaaauaauuauccucuuuggaauugucagucaguugcucccacagagcuuggcuaugggcugugagcaaaacccagcuauaccagcuugaagccuagaaauuuuggauacauugaagaauccaaucuucugcaaagggucggaagcaguguggguaauaguuaaauauuguauuggauagggacauuaaaacguuuggcuguucucucucuuuuuaucugaaacuuccagaaucaaaaggucuagccaagaaaggaaaucauuccuaauuuuggcagguucuguaauaggaagaaagaaucaagucuagcuagccaaaucuagccuaauaaccaaugggacaacuuccaaauguggaagucagugccuaccuaccauuguucuccaggacaauauaaaauaguucaauaagccauuuagcuuagguguuagaaaaacgcagcauccuuaguauaguugguaccugaaaaacauuugcuauuucaaggcuugauagagauacuggcauaugccuuccucaaucucaauguaauauauaguaccucauggccuaucaaagagaaaaaucuccagaguaaagggagcacuuguguaauaggguauucuucuccauauaggacagagauaggucaguuaugguacuuuugcaaagugaaccugaaauuacaagcuaaauucugacuuauaucuaaugauaggaaacaauucgcauuuagauuuccuuucugguauguuguccuuuugucagcucuuuacugacauaaaaccucauugcagacaugcuagagguucauuuuuugccuagcuuagcaaaaauauguaaaaagacuauucucuccuauuuguuuuauauuuccuuucagaauaaacugcaucugcccaaacaaauucaaguuguaaaaagcagaaaaucaagaagcuauaccuaaucauugaaaucagcuucuagaauuauaaauauggaaacugcuuguuguuaucaaacaagaaauggucaugaccauuuacaacagccgcugcucuacaacucugauuuaccagucacuaaaaccccuguuuauaagugucacauuuauaugcgcagaauugaacuucucauuccaguuuauacugccagugaguuuuggaaaugggaaucaugaauuuuuugagagguuuuuuauuuauuuagcaugguauguuacagaguaaaugguaaauagauggaaauaaaauguaguuuuacuuuaaguuagccauuuaggugaucaaaacaucaauucaauugaguuuggcauauuguucuaaugugauuauuauuaacaaaauuuagagucuuggauuuuuacacuaguuguaaaguguuuagugaguccucguguucucaggaggcuguuuuacuggaaacuaacccgccauuacuggaaguagaagaccaacucuuaauucauuaucucaacaaaucauaacaaggaugaaaauaacucuaccauauguuuugagaauaccuuaugguuuaauuauaccuauuauuucauguauaagagauacaugagauccuuagaugaaaucagugauauaaguaagacagauauuuuggaggaggaaaaugaagucuaaagaguaaguggcuaguccagagcugaagaacuaauuagggguagggccagagaaaggacagaaaccccaucuuucuaguucuacucauugcacucuuauagggugcugacauucuuuaaaggaucuucuugagagaggugauggugguggauauucuagcuguaguauaagcuaaucucacagccacaaaccucuggauucagaauucuagcaccaaggaauauuacugagagaaggagaagaggcagcguugaggguagcugaaugagagagacgggucuuguaucuaggaacuuugagacuaggguccuggcagagggucuccuucaggaaccuauguaaauacagccagaaagucugguuguauaccuaccugccccuuugccccuuuccucuagcgucuuuuucucuguggauucauaauguaauucaauugaaaccuuucuuucuggagggcugcagcagcagccucucuuaaagauuucugagccauaauagguuguuccaugcauuuugaugcuugauuagaaucuuagaaugugggaacugcaguuuacagacaaucuagcuagguccuuguuugaaaaugaaugcagugagaagacugcuguguugauaugaaagcugauaaauaguaaaccuggaaccagaaccccuaauucagaucucuuuccacugcaugauugcucuuuuguuucauuucgauaaggcagucagcacaccaagaguuuaagcuuuuuaaagccaaggacuucuuagaaccucccccccuuaaugccuaccccaugcugaauauguuccaggguaacaaaaguguacauugaauugacuuuggagcaaaagaaucuguuagcugugcugacuauggcucccucugauuaaguagggggauguuuguuucaaugugagaaauuccuuuucugggcucugcuaugaauaugcuaugccagugguggcugugggugguggguacaaagucaagauacuaagccacaggacugcauucugacccagaauaguuaguuggucauuaugauagcauucaccugagcucuccugacuugcuuggguuauuggauauguaaaacauacauugauaaaggaaccucuuuaagaggcaaggcacuugugcguguuuuauuucaaguauauuccaaggagcuuguuuaguccuauaaauaaucauugauccucagugccucacagcauguauuauuuccauuuugcagaugaaucaagaaagucagacuuguuagguuuuccaccuaaggcaaauguguuaauauuguguaaauagaagcucugaaagacaaugggauaggaggccuuuuucugcaccuuuaccuuugccagacauauguacaaggaacaucccaugacuuaaagauagaaaacccuaaccuguauuacuuuaauacaccaacgucaacaaaggcccagaaucaaagcugggcuguguuaucuuuucuaaccagaagcucucucaagaaaguacagcuggaaaagcaaaguaauuuccaguugugucuuugaaguugucuggugugauaugauggauguuuaauacaugcuguggauauuuuuaaaauagggagcaaucauaaaaucauaacauagagcaacuuuugaacaacaacauuuaaggucuaaaaaaaaacccuacauagcauuuuuuuucuuccuuuacuuuauagcugugucuguagucugaugcugaugaauuuucuuuuuaaacuagagauuuagacucauugguagugaaacuguuacauauuaugugauuuuuauaccaugaaaaauuucucgauuucaugagaucuuucauuucccuaugugugugugugugugugugugcgugcgugugcgugcgcgcgcaugcacguaaaugcguguuagugguuaacaugucuauaagaaaagcuauuugccucucucccucugguagcuggucgaacgaaacuugucacuaauggcuacuuuuaagcagugacuauaugaauuuauuguucuauuuuuggucaggcaguugcuaugugguuuaguggcuuuguuuaguauuagggcuccuagaugagcaauacagcaagagaagagugucuggcacauaguguguaguagguacccaguaaauguguauugaaugaauuaauuaaauagagaaugaaugacuccagaucauaccacaaagccuggacuaaaccaguuagugaacaauuuuagaauguuagagguaagugacauuagaagucacuuaaucuacuuuccuguugggagauaucaaaugaauuagaucuauuugcucuagaaaauauuuuaaaggagagauuuagaguauuggaaaggauaccagauuuauaguucgaugaucuggcuuccauagacagcuaaacucuugcuuuuuuguaugaccuuggauacguuccuuaguuuuucgcuucuaaaguauggauaaaaugagauaauggauguaaaauuguggggugggguucaaguauuuaaucugccuagcacccuucuucacuucuagcaacagacugcacacccauccugaccacagggcauauggccugguaccucaccucaucugaacacagugauuggcucaggagguggucacaugauugaaacagggccaacuagagucuuccugugggauuuuucaaugccauccugacaggcguuuuucucuaguaugguauugcuguaaggaucagcguuuggagcuacugguagccaauugcuaccuuccgacucccucuauuggagagaauaugauagcauacaaagaguaucagugcuauguuugaauauuuauguacucaccacaguuuguguugaaacuuaauccccagugaacaguauuaugagguagggccuuuaggagaugauuaagucaccagggcagagcccucaagaaugggacuagugaccuuauaagagggcuggagggaacuagcuagguccuuuugucccucuuucucuccuaccaugcgaggacaccuagauggugccaucuaugagaacaggccuucgccggagacugaaccugcgaauaccucgauguugggccucccaguuuccagaacuaugagauaauaaauuugauuuauaaaaugcucacucugucguauauuguuauagcagcacaaaucgaugaagacaagcagaucuaaggcagagaugcaaggcagauggggucuaaguuucugauuuaguuuucuuugaggcaaaccuaacuccuauguuuacagcaguuuuuuguuuuguuuugcuuugcuuaagguagcuugucagguuucuaugauuugcugacugaaagaguuucaacucaucuaguaaccagugaauugaaaaaaacaagauucaaggggucuaaccagaaagcauuuuuauuuuccuauuuuccaauuagaguguauucaguagaggaagcuccucccuaccccaaaaugaaaacuugggugguccuaugauuuuucucuuaauuuuaaguaauauacuuuauuacaaugacuuuuaguuggaaauuaucagaguagaauggccaauuccaugagguacucaaaacuucaaaguugauaugaguuaaaucuucucccaguuucccuuccccaguuaagaccuuugacaguuagaaacucugucuuccuuaaguuuccacuugcuaguugcugauccugcagggucuaagcuggaaaaggaaggaaaagagggagaggaaaagagagggggcaggaaagugcuuacuuggcugauagugacacauggcuucaugcuucagugucuaguuaaguguuuaaagcugacucuuccugcuggucacugugaguuucugccaugccuacccucuucauuuuauuuacuuguaguguagucagugcauuuuccccauauccugguuuucagcaaucuguuccauaaaugcuccauugugagguccuuucacugcuccaggcaguccucuggcaggaucgaaguggcuucaggccagcucucucccccuuguggcucgcaucuguccacagggagcacucaugauccuggacagacaagcacugggagugcaggccagucuagcacaguccccaccaccuucccaccucuccuucagcuucugcucuuccagcuuuuccaggcaggagucacacacauauccccuccaaacuguaggggcacaugccaggcuuccugaacagcccuuuugaggccccucucuccugacuugcccacgucaccaucacucaucccucuguguuacaugugagaagggggacacugugcucccaagaaaccuuccucagaaacucucccuugauuuccauacuuuugacucuuucauuuugaauguggguuagggcuuuuuagaaccacaaaacaggucgcaaaguguuucuuuuacaaauguacacgugggccuggaacuucagaguggaauuucaugaacaugucuugguaucuguguugaaauuucuaauuuagcagucccuuaaaaaaaaaaaaguguuuuguaaacugugaagugcuacacaaauguggggaauuaacucccuuugcccugaagacauacaaggacugaaugaaacaaaagagagaauaaaaugugguuguacuucuugaagaagaaaacacuugcaagagauuuaugggggcuagccugagugacuuguuucuguaucucguuaguucauacuuuauuacuuaguugagguaguauuguucauaauacacagcuuccaauuuguacugcuuguaaccgaauuccgguuuagcugcuccccaccugaaaaaccaaauacaugagaggugagauauggugcaaggaaggcaguuuuauucaaaugccaacagaagacaugaccaggcugaagccucaaaggaaccaucucaaaauuuuaggcggagugaaggaguuuaagagggaagcuucguaugggaaacacgcaggaguggugcaugcugugggucugcaugucacuuucugauggccgucuucaguucuuacacgccuggagugagagcuggugccauuuugguugcggcuggguuguagauucacugccuugagguaccucuaacugggggagaauuccauaccuaagucuucaugccugguucauuucaagauuaccccuugaauuucuaagcaagcauaugguuagauaagugcagagugccagggagugggaaagagagggaaacagugaauuuuaagguacauuuuaaggcuguaguuuaagacaggggacaaaaaaaguuuuaaaaugcauuucuaagcugagagguucaguuacaugcucuucuaacuaaauguauaaaugacacuaauuaagacaguaggggacaaacauuugaaauaaaaaauaugaguugcucaggcagccaguauuucucugcuuuuugguuuaggcagccugaaguuuguacagacacauaccauguccacauacucaguguagguuuuugugguuaugguauuuugccugugugcacaagcugauugaccauccuguaccacaccagaaaaguacuuucuccacucaaagguuggagaaauugcuagagaacaggagagaucaaaugggaagcugcacccaucaccuggaauccacacguccucauuuauccauuuaguucauucagcaauuauuuacugaacaccuacuauuuuuccaaggcacuaugcuagccaguagggcuauaguggugaaauagaguuugcuaucuaaugggggaaacaagacaucacacauugucaugcccaauuauaaauugugcuaaguggcaagaagaaaaagaaaaagaugggagaagagcagggaucuccuaacuuaguuugguauguguggggaaggcauucuuggcagaggauacauaaagggugggucucacuauuuguccuuguuuucaguucacauauguuccuaauuaaaauuaaauaccauuagucaguaucuaaauauccuuagguuaggauguaguauuuuccaggguuuugaugcaaaccuauucuuccaaaauguuuucuucuucagauggugcuuuauacuuuucuuaaguagagcuaagaauuuguuuuaaaaaggcuacuuugagaaacaucacuguuuauuggaauauaaauuuguguauaauacuuucucuaaguagucaauucugccuucucagagacuuuuuuaaugccaaacuugaagagcucuugcagaggagucauucuuuuguuuuuuugcucuuucucauucuuuauggucaguucuuccacuaauuuauuuuauuucaaagcagggauccaagggaaggaggagugaggaaaaccuuuuuagcuauguauguuuucucaaaaaaaaauuuaccuaagguuuucuucaagaaagcaauaaagugaauaugguuuugagcauguuaugaacacagagcaauuugacuugacugaaauaggauggauugagaaaagccuguauuuccacugugauauaauaucugcuuaaaguaugggcuacagggaaugcuuggcaccucuucaagcuaucagaaguuuuauuuugauacaaauuauuucccaaaugcugcaugacauaggagacauagugcuggacagugcauuaagaaacuuuguuucugacuucuauuuugucaccuauagucuuauuuggguaaguuguuuaguugcuguaugccucaguugccuuagcuacaagcugaggguggugauaauaccugccucacugcuucucagaauuguuggggaaauacaugaaguaaucuuauaggaugaagacuccuuuaaaugaucaaaaucuucacauuugauaaaugauuauuauugccauuugucuguuuuuggguaugauauucauggcugaucuuagucuaucaaaucauuuuccccaaguucauuuauccuuagaccaagauucauggcaucuuaccugugugucuagcuggguaaauguuuuaugacauggcugccacuaauacagauauuccaggaggucauguauauuagaaaaacgugucuuuugaaauagaacugaauuugaauuucagccucaucauucacugcuaaacgaccuggggaauuuaaucuuuuugugcuucaguuuucucauugggaaauggcugugauaauuaaaugauaaacacugugaaaaugcuuaacacacugccagguguuaugguaggcuuuuaauaugugcuaguucucuuucccuuuaaaacaagcagaauggaauccaguauuugcaacacagguuauuuucuuuauaagagauccaugaagggaguaugauuaacacaaauucaguuucuauuuacauuuugcuguaguugagaaagugaggcacaucuguacuuguuuucugauaaaaucauaauuucuuagauaaaauugccuuguauuauaugccauuuuuuuuagagaacugaguauuagcuguuuguugauagaaauggcacagaaagcaauuuguuguuuuuauuuuauuauaauuugaaaugcuauauuuugagugaauuuuuuuuuuguuauuuacguaggacuuauaucuaccuauuucuagaaaaguuuuugaacuguucacaaaauuaagcccaauagaaaacaaggcaauuaaaaaugaaauugaaacaaaaauaggguaagcauaaagguaucuucagacaccugaugauaagugguauaaaauggaaggacaagagcucuucuuguuuguugcauuucuuguuguucauuaucauuuuucauuaucccuguuugagcaucccccaccucccucucuuccuugccuccucauuauuuggaggaaugggagacaugggagcuagggaaguugguggguaauaagccacagcugaccaagaauuugcagcaugcaaauagaaagcauacauucuuuuuguugccuugacuuuuuuuuuuuuaauucacagcuucaaauauugcaucugcaaauauauugucucuugccugggguauaaccuuucuuccugucuuuauuugaaauguuucugagccaggaaugauggaaugaaugacucaaucugauuacauaaaaaaagauuuugauacauagcuuuguauuugugaauuuaaaaugacugaauuuaucuuuaauaaaagugccuccugagaaauguguuuaauggagguuuaugcuguuauggauauuucaaccuaauaguguaauuaccauaugucauuaauccuauuucuacagggaauuuguccccuuguuucuuuuaaagcuagaggguaacaagagcaaauguuuuuaacuuuagcacauuauucauuuuagauguaaguugacaaguugaagauaugaaaauaagaaaucuggaugaucaauuuuuuaaaaaguggcaaccauuaagcuguguucaaaaagaaugccucauggcaucccccuccugugcugauauuaguguaaaacacuuauuuuuagcuuuugauuuucugugcuccccaccccaaauacuuuuuugguaggccuccugcugugaccaaagucaaauaaguggaaaugagggaagguuaacauuuaagugauaaauuuaagagaagauuacacauucaguguuugcuugcucagucuucugagagaaagagguggugugaucuguuguuuuuuucucuucccuucuuuccauuauucccauccaacauuauguuauaaugaaaguaauauauguucauuguagaaauccuuaaaaauacagaaaacuuagagaaggaaaaaaaugucucauguaauuccuucacuccaaaagaacaacuauugcuagagguucuguaaugauauacaucauuauuuuaugcauauauggauucaggcuguaggacagcuuggugaacuuuuuuuuuccaguuaccaauauacuauaaauauuuuacaucauuggccgggugcaguggcucacaccuguaaucccagcacuuugggaggccgaaguggguggaucacuugagccuaggaguuugagacacgccugggcaauguggugaaacccugucuccacaaaaaguacaaaaauuugcuggauaugguggugcaugccuguagucccagcugcuugggaggcugaggcaggaggaccacuugaguccagggggguugcagugagcugagauugugccaucacacuccagccugggcaacaacagagugacacucugucucaaaaaaaaaagaucacaucauuaaaucauguuuuaauggcuguaugauguuuucucuacaauauaaauguaucuagauauggacaaaacauaguuacaugaaaacaaaagccuuuaagccccaaacccugaagguaagucacaaaucauauaacccuggcaugagugaagaccuguguguuacucagcaguggcugagcugcuugggaccauccagagagcuuguagaaccaaauauguagucgucagggacugcucaacuucuuuugauuauaaauaauaacuccuguuaacuuuauauuggcaauuguuuaauucugucacccugaagauguaguuucgauucugaucuguugcucuuaucuccacccuaacuuaaucuucuuuaaagaaugguauaauuuacaacagucaggguaaccuuucuggagguaaggaggcuaggagagugacugggugcguacaucuguauguguauauaaaugcccccuucuuguuugguuuagcauaguuaaaaaaguagugauccaucagauagaguuugcugggccagaaauacugcagugcagcagagaccuuggaaaaagugagauagcauaugcuuaagcaauacugcacuaguguugcauaaaugguggaggcugcggcuccccuguuuguuuuucccagcagacuuguccugaggcgaagcugugcuaccugaaaggagaagcuucagugauggaguccuaauuguaccaaaucaaaguucauugagucagcuaggucauuaacucguugauauuuaauuacuagcugcuucacugcuggaaaaugucauuaagccguuguacuaaaucugcuuuaaagaaugcauuuuccuuuuugaaugguucauguuuuguagucuuguagaaaaaucagaaaaacaucugaacaauccaguaaagcuggcaaucccagcugcuguguccucagccaccauuggucucucaggccugcaucugauugugggcaggcccugcagaagaaacacaucuggagauucggcaauaaacuaagacuuaccugggucaaggguguggaagagcuuugaagugggucguuguucuagauguuuuaucuguuugggucucucccaccucuucuguuaacaauuauaaggguuaugugggggaacuuggagagaauuuuuuuuuuccccaggcuggagugcaguggcacaaucucgacucacugcaaccuccgccuuccagguucaagcgauucuccugccucagccuccugaguagcugggauuacaggugcccaccaccacgcccggcuaauauuuuuuguauuuuuaguggagaugggguuucacuauguuagccaggcuggucucaaacuccuaaccucgugauccacccaccucggccucccaaagugcugggauuacaggcaugagccacugugccuggccaggagacuuuuuaaucaaauuucuugacauuauuuuaauggucugagauucauucaacccuagguagcaaucuaauguugugaagaauguaugcaacagcuucucuaaaacagcuguaagugcauaaaguuucucggauguuuaguauucccaaggguguauuuugaaauaugguuucagaaucaacaaaauuguuucuuaauguacuguuuugcuuguguaauuaugccaguuaguuaauggcagaaacauuauaauggaaaacaaccuuaaauaugaaguauuuaaaacaguugugagauuuuguuucccaaauggacuuaauaaauccuaccugauauuauauuuccuuuuuaggagaguuuaauccauuugucgucauuauaauuaucuuauugauccugaccuuuuaaauuacuuucuuaugguuuaucaugucacacagguggagccucauauguauugauaguuauacaguguuugauauaauaauucuaaaaguagaaugaauuucacuugaaaaaaccaaucuagugugaauuuuguucaggcugagcggguuucuuuccccucuuaauuuuaguuuaauugagagaauacaucugugguucuuagcuuagugccuggccuauaguaaaugcucaauaaccgucagcacuugugaacauuuuuauuauauucacuaaaauauuucaguucauuuguuuuuuaccucuaguagaagcugguaugcuuuuguuugaaauaaugaaaucucucaguauuuauauuuacauagucuuacacaauuaaaagaaaaguaaacucuaugaauauauucuaauaaaauacguuucccaggagcugguuaaauaauuuaaauucauuuaauagucaucucagaauuauaacuuuucucauuuaucauccauuuuauuuaaugaugaaagaauacaaaaccauguaagaggccaggcgugguggcucacgccuguaaucccagcacuuugggaggcugagguggguggaucacaaggucaggagaucaagaccauccuggcuaacagggugaaaccccgucucuacuaaaaauacaaaaaauuagccagacgugguggugggcgccuguagucccagcuacuugggaggcuaaggcaggagaauggcaugaacccaggaggcugagcuugcagugagccgagaucgcgccacugcacuccagccugggugacagagcaagucuccgucucaaaaaaaaacaaaaaacaaaaaacaaacaaacaaaacauguaagagaaaucuuugacccaauuggaauaaaauggcuauugucugcuuaaagcauuucaaugcuuuguacuauuuuuugaaguccauauagucaaggucccaaauguuuuaugcccucaaagcacaaugaauuuacaugaagagucacuaaaugguaggaacuguugugucucaaguucaggauacuuucuaaguguauguguuuuaauauuuuuauuauuguucaacauuacuuuuugcagguaugaucuacauaaaauuaagagagugugguuuaaguuuguugauacuuaaauuuauuuuaaaagacugaccucaagagugcuuguccugaaauguuaagugauuuuaaauucuugauaggaaguccauacaaguauuuuuccugcuucauccuuauaucauuacuucuuauuaucaccacacucuuauaauguugaaaaucagucacauuuggucucauuuuugcugccuuaguuaaggcucagcaagagaauugcuauuauuuaauaaauagauuuguucauugucccuaaugugacagcaggaauuugaagccaucugauuucuuagcugguucuguuaauucaauaauggcguccuacuaccaacugauggcugcuaagucaccaaagcuaagguagagguguuggagaaacuuccguuucaaugauacaugaaaauaugagcauauuuguaaccuucuggauaaucaauaugcuucuauccuuuagguuuauggaguuuaaccuugcgagauuaccacuuaauaugauagcugcaaaauagauugucauauuaggagccugugaacuauuaucuuuacucugcuauuagucuaucaauauuaugguuaauucucaggauuuccagauuauauaggcuuugcagauucuuuguagccugccuuaaauuacucauuaacaccuccgaaguaggguaguuugguagagggaaauaaauaacuaaaauuuauggaauaaaauuuaagacauaaagugauuuugaagaucuucuaauccaaucccuuuagcccacuccccuguuuuacagguaaggggacugacagccagugagguuaaguaauguguacaagagcacacagucacagaacuggcugauugcugugugacugggaacccagauuuccuagucuuguucaggacuccuuccagaaguuggaauaacagaacuuuauugcccugcauuuuacuauggaacagaaugaacugugcaaaaacagcaugccuuacccacuucuaaagacuuuugaaacaggugaguuguggggcgcaacuguuauuagagcagcuccaaggcaagaacccaaggacagagcaaugacagggcucugaaaaauagguauagaaauagcacauauguuugagagucauaaugaggaauaaauaagauaaugcauuuaugcacuuagcguaguguucaacauauagagaguuuucaauaaauauuagcuauugcuauuuaucauagaauuaaaauucuuaaguauccuuauagaguuccagccugcuguuaguucugaucuuccgccauuuccuuucccuuccccuccaaacacacguacauacucuucccuccagcucuauaacucugcagcucuguagcccaauucuaaaccccaaauauccauguuuuucaugccuuuaugucuuuauauagaauguacucuccaccuggauugcuacccagcccauuauucugcuccgcaacuccuuacaucccucaaaauuuggcucacauaucccuuuggacaugguaugauaugguuuggcuguguccccacccaaaucucaacuugaguuguaucucccagaauucccacguguugcggaagggucccagggagagguaauugaaucauggggcccugucuuucucaugcuauucucaugauagagaauaagucacaugagaucugauggguuuauuaaggguuuccgcuuuuacuuuuuccucauuuuucucuugccaccagcauguaagaagugccuuucaucuccugccaugauucugaggccuccccagccauguggaacuggaaauccaauuaaaccucuuuuucuucccagucucagguauguuuuuaucagcagcaugaaaauggacuaauacaguaaauugguaucaguaaagugggguguugcugaaaagguaccugaaaauguggaagugacuuuggaaccgaguaacaggcacagguuggaacaguuuggagggcucagaagaagacaggaaaaugugggaaagccuggaaccuccuagagacuuguugaauggcuuugacaaaaaugcugacaaugauaugaacaauaagguccaagaugagguggucucagauggagacgaggaacuugcugggaacuggagcaaaggugauuuuuauuauguuuuagcaaagagacugguggcauuuugccuccgcccuagagauuuguggaacuuugaacuggagaaagaugauuuaggguaucuggcagaagaaauuucuaagcaggaaagcauucaagaggugacuuggguacuguuaaaggcauucaguuuuauaagggaagcagagcacaagcauuuggaaaauuuggagccugacuaugcaauagaaaagaaaaacccauuuucuggugagaaauucaagccagcugcagaaauuugcauaaguagcaaggagccuaauguucauccccaagaccauggggaaaaugucucuagaccaugucagagaccucauggcagccccucccaucacaggccuggaggcccgggaggaaaaagugguuuugugggcugggcgcagggucccugugcugugugcagccuagggacuuggugccuugugucccagccacuccagccuuggcugaaaggggccaauguacagcucgggcuguggcuucggaggguggaagccccaagccuuggcagcuuucauguuguauugagccuaggggugcgcagaagccaagaauugagguuugggaaccucugccuagauuucagaagauguaugaaacugccuggaugcccaggcaaaaguuugcugcaggcguggggcccucauggagaaccucugcuagggcaguguggaagggaaauguggcauuagagcucccacacagaguuccuacugggacccugccuaguggagcugugagaagagggcugccauccuccagaucccagaaugguagauccacccacagcuugaacugugggccuggaaaagcugcagacacucaacaccagcucaugacagcagccaggagggaggcuauacccuuuaaaaccacagggguggagcugccuaagaccaugggaacccaccucuugcaucagcgugaccuggaugugagaccuggagucaaagaucguuuuggagcuuuaaaauuugacugcccugcugaauuugggacuugcauggacucuguaaccccuuuguuuuggccaauuucucccauuuggaaugacuguauuuacccaauaccuguacccacauuguaucuaggaaguaaauagcuugcuuuugauuuuacaggcucauaggcagaagggacuugccucgucucaggugagacuuuggacuguggacuuuuggguuaaugcugaaaugaguuaagacuuuggaggacuguugggaaggcauguuugguuuugaaaugugaggacaugagauuuagaggggacaggggcagaaugacaugcuuggcugugucccuacccaaaucucaacuugaauuguaucucccagaauucccauguguugugagagggaccccgcagagguaauugaaucaugggggccaguguuucucaugguauucucaugauagugaauaagucucacgagaccugauggguuuaucagggguuucugcuuuugcuucuuccucauuuuuucucuugccacugccauguaagaagugccuuuccccucccgcgaugauucugaggucuccucagccauguggaacucuuaaguccaauuaagacucuuuuucuucccagucucggguauguuuuuaucagcagcaugaaaaugaacuaauacaugguguuucugaggcuucucaauuagagaauuuguuguauuauuuuguaguuauuuauuuacaagucaucugcuuccuuaagugauaagcucuuugaggucaaguacuguuucuuuuagcucuauguguuuauuagcaaaugcuuggaguacgauaaacauuugauaaauguuaaaagaaugaauacuugaaugaauuauuaggcuuacuuuguaacucaguucagccagcccucugcuuuucauagcugugaauuuugacaguugcucauguaguagacaagaggacaaccacgcuuacuacuuuauucauuuucccuuucgagugucauagauguuaaacauuucacuugauucaugggugccaucugguggaggaaaggcuaacuacagaugcaugcuucaccaaaacauguagaaguuuaagauuauuacugcucauuaauauggaaguugucacuguuuccugguaguuuccagaaguguagucaggaaaaacuccuuggcgacugcuuuuuucauuccuguacauugguuucuuauuuuuauuuuguagagaugggagucuugcuauauugccuaggcugguuucaaacucccugacucaagcaauccucccaccuuggccucccaaagugcugaaauuacggaugugagccaucacacccagccuuaauuuuaggaaguuguucauucaugaauaauguuugaaaauauuuuuuaaaaagauacguguuauuaaauauuguuuacuugucaguguggcaauuuaugugauuuaagguaaacugauuauuuaaaguuugagauacugaauuuuuaaauuuuuccaugacacugaguuuuuuauucauucauucuccaagcauuuauugagcaucuaccuaaugccugacauuguaaaaagugcuaaagaaccagaaaugaaagacaguaugagucuugguccaaagaauaguuagguaagaauguaaaccauguaacuuuucauaagacaaaucauacaaacuucauuuagauuuucauaagaauuccuuaugugcauggaccccuccaugugcauauaaacaucauagauauaaagcuaccaguuuuagacuugccauuuugauggauuuucuucgaguauauaaaucuaaagggaaauucuuuaugauuuuucauaaaaaguagauauuuauucaauauucacauuucuguacugcuuacacucuaccuaucugaaggauagacuuuuuuuuuuuaagcuaccuggaacauuguaaugaagcaggaaguaaacaaaaaggaacugaggaguaaaaaacaaucacaaaacucauguaccuuucuccaguaagaagguuaaacauuuuccaagucuuaaggcuagauaauugugcauaaagcagccucuuagaaacaggauuaucugccaauggaggagaaccaagagcuucucacagcgaucaggguaaugugcuguggaaaccaaacucauaugcaggagacaugcaugccacaacccucccuuuguguucccaagguagcccuaaaucaucaagaaaaugcuggauuuucuucugugcauucuuuuugaaaaacuuugagaaguauguuuuuucauuuugaagcauuuucaucaaaagagguuaaaauaauuuuucaucaguuggaguauuaaaguugaguuaaaugggacauucacuuacguggaacucuucauucccugauggcacucauuaaaugagguauuguggaauuuagcuaucauuuacagaaguuguauuugaaagauuauacaagauacacacauagaaauccaaacuuaauuuucuuuuuaauugaagaacuggaaaggauucugagaauuuaccuaguucuuaggaaggauaccauuaaaauauuguauuaaaauguguuauauguaaaauuuuguuuuguacugcucuugaaggaaagauuucaaacagaauuggcauuucauuuaauugauaguagaaauucagugcaaaaauggccagccaccugucuucugaaguucuauuaaucuucacuauuuaauugccugaauguggacauagauuuguguuagaaaagaaagcuugguuuguugugugugucucauaagucauguugacuuauuuagugacuucuuuauucuagggcacuuguaucaacacaauguguuuugaagaagaaucacagguacuaccuuggggaauauaaggaaauuaauaauuggguauauuguagauggcaaaguuuauaauuuuucucaucucuuuccauaaugcuuuaugacaucuggaacuugcuuguugcaaccauaaaucuucacguggaucauccuuguuuauggacuauuuggguauaggacauaaagauaggacacuguuccacagcagauuuuuuuuucuugcuguuugagagacaccagccuucacuaagcaguucauuauuuucuaagguuggagcagcuguggaucaccauaauuauggauuuaguaugucccugccaaccuacugugaaucuuaauucaaauuuuacaugucucuuuggggccuuguuaauuuucucauuauuaugugguuccugacaaaugacaguuuugagaaucuaaaguugcuuaaguuaguuuuuuaugagguauugccaauugcucauuguuuuuauaaugcuuaaucacauuuuuauuuuuaaucuuacauuaaauaaagcagcugcccuuuauaaugucuggguguauuuuuacccauccauuuucucugaggacugcuaaaagacuacaauuucuaagacucucuaacuuuuuagguuauauggucaagcagaaagaaagaaaacgccuaagaaaaauaucuggaguguuagaauuuuuaaaucagagcuauuucaaggugaggacgaugaugugcagcuuauuuuuguacaccucaaauuuaacacagugccccauacaugaaggcacauaauaaaugcaagcuaaaaaauuaauuuuauauauaauauauauguuauauauaacauguuauauauuauauaauauauauguuauauauaacauguuauauauuauauuauauauguuauauauaacauauauaacauauauauguuauauauaacauauauauguuauauauaacauauauuauauauaauguuauauauaacauauauauuauauauaacugauguuacauauauaauauauaguggagauauauauauuauauauaacuauauauaacuauauaacauauauuauauauaacuauauauaacauauauauaacuauauauaacauauauauuauauauaacuauauauaacauauauauuauauauaacuauauauaacauguuauauauaacuauauauaacauguuauauauaacauauauguuaucuaucuaucuaucuaucuaucuaucuaucuaucuaucuccacugauuuuguuuuaguuuggccauccaucuguaacaguguuuggcacacauuuucuguaaagagccaugugguaacuaucuuaggcuuugcauaccauccagucccugucucagcugcucaacucuaccauuauagugcaaaagcagccauaggcaauauauaaacaaaugggcacagcuauguuccagcaaaacuuuauaaagacggauguuugggcuucaguuugccauccugaauuuagaccaaggcucauaaagaggucucaucucaugugcuaacuuugauugauugguggcugccuuggaauacuguauugagaaggaaucucagggucaaucuagguucagugguaaauaauucauuaguuaauggcugccauaggcauuguuuugaucuguccuauaauuuauuuugaggacacugugacuugugcagaugguugccuuuauuucuuugcauugggugccaagaaacucagaguuacuuuuuaaucaucuguaacaaauauaguugacccuugaacaaccuggguuugaacugcacagguccacguacacacagauuuucuucugccucugucaauccuaagacagcaagaccaacuccuccuuuuucuccuccuccucagccuacucaacaugaagauaacgaggaugagaccuuuaugaugauccacuuacacuuaauaaauaguaaauauguuuuccuuaugauuuucuuaauaacauuuucuucucucuggcuuacuuuguuguaagaauacaauagauaauacauauaccauacaaaauauguauuaaucaacuauuuauguuauugguaaggcugucauucaacaauagguuauuaguaguuacauuuugggggaaucaaaaguuauuuguggguuuuugacuguguuggaguuaagggucaacuguauguauguaaccccauguuguuuaagggucaacuguaaaaggaauaguaaagcacauauuuugcaucuaacuuuaucccuagcuucaucucaauuuuaccaucuuacuuuucuuagcccagaguuccuaaaacuugccuacauaaaauauuuaugaaaccauagacuuuaccaaagagcaaaggcuuacuggggguuugcaaggacacaucuacaaaacauugauaaucauaccuaccuugcaggguuggugagaauuaaaugaaguaauuaauauaaaauaccaagcacaguaccugguacauaguaaauacugcauacaugguagcuguuaaauguaugccuucagagagcuccgccaacccacauagaaggguaaaucacauuacuucugauuucuccagcccuccuugcagauagguggaaaaaccccugaagauguaaaaacucucucuugauuacccagauuucaucuuguggaacugaguccucccugugggaaauacuaggccacucuauacauuugaguauuuuuuuuuccuacuccucuguuugugggcaacuuucuguguggaauaggaccacguauccacacaggaaaauaacaaggugggauuuggaguggggagaccauugggcuucuuuccuuugccuuugaaagugccacuuucuugucauacugggcaauuuccaugcaauucuuaaaaguucauuuuaauuuuauuccacugaguuuuggggcaagaauuuuacaaauugagaugaaugauuugaaguuaguugaugcuuaucaauugaugcuauuuuagcccacaguucccuucauaaaauaauaucuuuucugacuuaaaaaaugacugguauaagacacccagauauuuuacaauucuacaugcuauagcaaagaaucaaaaugguguacauucuacacuugagagaaaugugaaaggagaguugccaacacuaaagcagcagcaugaguaagaaagagaaagagugaaaaauacacaaaguguuaacuggcaagucaggagcucauuaggccuaaccuuguucuuaacucagacucuucaucauaaacccauuuuaaugaaaagaaauucggaaacuaauuuuuccccacaacaaauagaaaguuaguauugguuuuagcugggcaaauguagugauauuucucccuuccuuaauguuccucagcagucccaauggccgguaucuagcaccucagagcaauuuugaagccuuuucuccuguaaaauacaacuucuauucacccauggcucuaauuuauccacauuuuugaaaauucauaucaauaaaauauacuguuuuuccugucuguguuagcuucuucuugcuccuuaucccuuugucugugaaccuccucaucauuuuuuagaucuuggcuuuacaucacucucucaggaaacccucuucuccccauuccuccuucacccccaaccaggcuauuuagguucuuuguuuuaucucaucaaagaaucuuguucauuucuaucuccccacuagaccauaagcaccaugagagcagggacaugucuacuucugcccacuccccaagaacagcuaaaagagcacacccgucuauguagcaaaauagugggaagauucauggguaguggugacaagcccuccaagccuggugauagcugguuguccaagauagaaucuuaguucaacuuuaaauuuaccuacagaaccacuuaauuccccuguaaauuuaacuguuagucuaaagacggacagcucuuuagacacuaggaaacaaccuuuauguagagaguaaaaaauauuauuuccauaauuggcccaaaagcagccaucaauuaagaaagcguucaagcucaacaccuaaccacccaaaauucuaaucgcaccacugaacuccuuacaucacauuggacuaaucuauuacuuuauagaagcaguaauguuaauauaaauaaccauuuaucucuagcaccuagcacaguguccagcacauagucgacauccaauaaauauuaauuaaaaggauauacuucuagcuuaugacugugacugcccguccagcuauuuucuuauggaguugaagucagacuugggaaaaagauauauuuuucucuguaagguucaugaacuguaugcccauccaaauuuuaaaauaugucauuuucuauuuacacaagcaggugcagucacugcugaaacuauagcuuuuccacacaauuagguaucucauuuuccucuugcuaaaauaagauacccuuucaaaccuuguuugcauaguuaugcaacacugccggugaugcugaguuccuuucccuucugcuauauuuugcugcagcuuuccaggauucaaagucccacuugcaguccucggcaggaggggucaggucaguguucuuaccaugccugggauggucaagaggaaaucauuguguuuucacagugcuuugccacaggucauuuuguggccuguuuuacgcagcuugcugagauuugccugauugcccacaagcuguugggaaaggauuccaggugcucccuugcauuagaaguacacaaggucaguuaguuugcuucaggaaagggcucagccuucuugaggcugagcagacuagcaauuuuguaugauuuaaaaaagcuguggcacugaggguugaaaggccauguaggaacgucauugcauauagucaagguuuucccaggaauuaaaaauguuuacuugccaaacucugucuugggggacucuucuuguggagggucuuguacaacccuagauguacaucagaauuuguuacaaagcuuuguaaaaauacacaugucuagaccuuagaaaaucagaaucucuaggggguagaaucugguguuuuucaccuguuagugagccuguuaaaauacggcaaacauuuaaaaaguagauucuagaguccuacccuaaaaaaaguugauuuacuaaauauggagcaggccccaugaaucugcguuuuuaaagaaggcaauccccucuuuccacccuaggugacuuagaagcaguugguuggaauaccagccaugaagaaacacugaugaagcccagugaccgaauuuuguagaaaaaaccgaagcccuguccuagugcccuuccccuguauggagcuaauaaggcuucaccaugacccuguuuaugagcuuuauaccuggauuccuaaaauaagacauuagauacuguguguguauuucugggaaaaggauuuguugcucucagagauuuuuuagucggguugaaaauaauacaaaaauauuugaaaauacauuuuuaucaugagauacaacaggcuguggcucuguccaaaccagcaguccuugcaaguggguuccugugguauaaaauaaggugugaugcucggcaaguauaaaauagucugacauuuauaugauuuauggcagaagagaggcaaaugucagagugauaggaagaaacauugugggcacggucccuuuuaucuuucuuuguggucauguagaguucucacucauaggacauuaagccugguuuuaaagcacccauuccccauccuuuucugccaucgugccuacauuggacuaagugucagggagacccacauagaugaaaaagcuucuguccuaccugcuaguugcucauaaacuagugggaaggcaaauaggugacuagauagagacacuuugaagugguugagagcuguaacggagaucugaacauaguacauuguggugacaagugggaaagcaauugcuuuaauucugagagacuacuuuugcaaccaaggugaugauuccuauuuguacagaaguuuuaaaacuauauguaugcaguagaugcuacugaauuuguucuuuauuuacccauaugugagauacaacaaauuaaguuugcuucguuagguuagccucaaauaagcuuugauggcaggucucgaagugggagccagagagagaagaguaauuuagaccuucaaggagcacagaucuuuguguuuuccuccacacaaaguuaaauuucagaguagagaacauuugucuuucuuuaucuucacuuucauacuuuacacuccauucccaggagucuccuugggugccuuauugcuugucaauccaccuccuuguagguaaaaaucugaucaacuugcucacacuaagacugaauauuuacuuagcauacuaccccuccuuaaaauauuuaccuuuugguaggugaagagcuggcauuaaccgaagauugaagcuauaaugauagaauuucaggcgucaaaaaagggaaaacgauuuggggauggggauccuuuugggguuacucacaucacgcuaaauaaggcaguuaccagcucucaggacagaaagaccaggccuucuccauaccccaacuacacauacaaggagccuuaaucuaauacagguuuugaaggcacuucuuaaagucaugucagaugggagacagaagcccaacuggcauucgucuggagcuucccugccacccuggccacaccugccuccuggagguccacucuaaagagccuuguagguagcugcagggcagaagccaaauaaggcccaguaggagaucucuggugcuacuccuauauaaauagugguugccggccaaagaacaguuuuaucugaccauguuuuggcuaccuucuaagcagcugcucuacugucauagcuucagaguucuuuuugauuaauaacucaugaguguuuuagaguucacuucuaccaguuccacuggcuuccugaauucccaagggcauuuucaguuagcauuccacagggaacuuucuggaauacauuuggauagcacuaauggaaguuaauauuucuccaagcucuauagcccaagauucagaaagggaagggaauuuuaucaguaauuaaccauaauuuucucugauuuaugaaacauaguucucucuguaaacaaauauuacuuuucauuuuucuucuauggaucucaagugcauagaaugugaaacaucuucuuucuguaacugcagaaaagacaggaacucacucauaacaaaauuuagccagauugcuuuggcugagugccgcuuguuuucucaacagauugaugagaaaguccgacauuaggcuguuuuuauguugccaucccucaggggaacauagauguguauuugugcuuuaaaacaaaaacaucaugaaacuaguacaaacuauucccccugaaucccuuaaccuaucccuggaauauguguaauauugaggggcaaagaauucaucaucacuguggcaguagggaaguaaggucaacuuuuuguuagacuguaaagcagauacauuuuuuaauccuuuagaguuugaggguagguuuugaucgaaauaauaagauaaggaaaaugggccacauagcugaacaauguuugauaauuuggcaaaauuauauuuuauugcaauuacaggguaagaucuagaaaagagagguaaguuauuuuuuauguacaaaaacauccaucugcaauuagggaagccaucauacagaaagugggauuugagugauauuuucacacucuggcaugcuuggugcuaccacaugaauauagugucagauugaauaugaauuagaugacugauaaaguuauuugagguucgucacauuaggaauuccaaaggaauugucugggauaaucuguaacuuaguaguccaucacuuuaaugcuuaaaugggaacuuuagucuucauauucagccguuuagaugauuucaagucuuucacacacugaguguuaugcccucugugguagucgcuuuaccacaugacuagcauuugcacgucugcagcuuuggcucuccagagcaaucuuaaaucucuguaauagguguaagauuucauuuuuaugcuucugguuuaagccugggacuuuuuccugaugccaucucucuugaaggaaucacauuugccuucuugaggcagaauuaugaauucaggagugcaagacggucaucucaaagacacuuuucuuauuugaauaaccucuccagguuagaagugccaaagacuaaaaauggcaagaaaugacacucuuggcaggcaugagagaagaauaacucccuugccuuauguucucuuccuggugggcaagggcacucacucugacuuuauuuuaaagugccuggagccaaagagcagcugucaaaaguuaaugauauguuaccguaagaaagauggauuccaaggugaaacuaaguaaauuaacguguggucugugugcuggcugcugccagaucagcaaacacacauccccuucuuuucaagggcagggaaaccuugccugcaauaaaauauuacucccuucucucuucuuucuugcucuggugugaauuucgaaggauucccaugauaaucucuccuguaucuugugaauaccuugugaucaucccucggugaccauuucccuaaauucagcccuuuuucuacucaguauuugcagaauugauucucaucuuacuucccuuguaugucuuccucagugccaaagucuccucacaggagagggccacugaucagauguccuuaaagccagaucuagcaucuuauuuaaugauuuaucaguguuuuaaaauuuaucaguguuaaauuuacuguugacaugagugcaaagaucagcccuuuugcuuuugucccuuuuuuuccagcuuuagaaggcuguguccauucacagucaacacacauaacugaagcagaagcccuguguguuuuuuaggcauauaugugguguaaacauaaauugaaaggcaguaccaucaauuauuugucccauucaguuuaauggagcuugaggguuucucucucuuuucagauuauaauuguguguguucauguguauuaaauaaaauggagggggaaagguaauuuauaaaauugugaaauuugagggguauuaaaauucuuaaacuuuuuaucuuggcaaagcacucuguagaccauccauaaggcaaaaaucccuuuucuucuuaagaugcaugucugagguuuugaaaucuuaaaaucucaacucuugguuuuucaguuacuuggaaauugggucucuauaucaggaccaacauuuacaacauacuucauuacaaaguuaaugauaaauccauuucuugguuuaaaaaauaucuucuaaauaagaauuuauugaguauagaggcacuuucuuuuugauuaucauuaccuaaaacuucauaaaauugcuuacuauucacuaagucuuagaauugguaauaaaauagauuauuuguuaaaaagugaaggaacaaaaaugaaaaacucacacaaccaugacauaugaauuauuaaguaaaaauuauuaugugaugaggcauauuuucauaguuaaggacaucagaagccuguuuuuauuuuaaguccacuaaaggucaaaaugaguaacguaacaaaaugaguaaaggaaauugaccuugacacuuuuuuucccagagaaauauacuaaaagugauuugaaacauaggucuaguuuacuugugaucuuuuucuaauggcgguucuauuagaauuuaauuacaucacuuauuaucucuucuugaagagaagcuuuuuuggcucccuggaaacuugcaaauaaguuuaauaccuuuuccucacagagauuuuggaggggucaucgugauggugguggauauucccuaaaauauggagagaugaauaguuuucaggcuuacuguuaaauuuucaagaguaaauuuaauauguuguguaacuuuauucaguuuucccauugcuuuuaacagcuuugcccucagcuuuagcuuccaauuacgcagcauugaaggcauguuuuucuuucccaucuguugggaagcuuugcucauguguucuuuuguucuauucuggguuuuaugccagccuggggcugcuuuaccuuguaaagaagugaccacaguacgcauugccaucuuuguaaaaaauuaauuuuuuuuucuaauuuaaaagcaauuuguguuuccugcucccauacucacuguauaaccgaggauaaguuucuuaaccucucugagucuguuucuucaucuguaaaaaucuguuaggguuguuguaaggauuacauacgcuaacacauuuaaagcauucagcacagugcuggcacauagaaauauuguuuuauuuuauagaauuuggaaaacuuuagagagaaaaaauaaaaaucaccccaauuuauauuacucugacauaacuaaugauauacauuaauuuaauucacccuuuuuuuuuuccucacacaugagguauacaaacuacuuuguaaucuccuuguuuuugaaaaugucucacccugucacucaggcuggagugcaauggcggcaucucagcucacugcaaccuccaccucccggggcucaagcaguccacccaccucagccuccugaguagcugggaccacaggugcgugccaucacgccuggcuguuuuuuuguauuuuuaguagagacagggucuugccauguugcccaggcuggucuugaucuccucagcucaaaugauccgcccaccucagccucccaaaauccuaggauuacgggagugagccacuguguccggacuuaaucugcuuuuuauuaugaauauuuuccuacauaauuuaguacucuuuuauaacacaauuuuuaauugcuuauucuguugauaguuucuuuugcuguguggaaacucuguaguuuaauuaagucccauuugucuauauuguugcuuuugcccuuagggucuucuuaaucaauucuuugucuaggccaaugcuagaagaauauuuccuagguuuuuguuuucccuuucuuucuuccuuccuuccuuccuuccuuccuucuuuccuuccuuccuuccuuccuuccuuccuuccuuccuuuccuuuccuuuccuuuccuuuccuuucccucccucccucucucuuucuuucucucuuucuucuuuuuuugacagaguaucacucugucaucaggcuggagugcaauggugcgaucucugcucacugcaaccucugccuuccggguucaagcgauucuccugcuuuagccucccgaguagcugggacuacaggcaugcaccaccaugcccagcuaauuuuuguauuuuuaguagagacaggguuucaccauguuggccaggauagucucgaucucuugaccucgugauuacugccugccucggccucccaaagugcugugauuacaggugugagcuacggugcccagccuucuuuuuuaaauuauuuuuuaaaauuggucuuuaaauucuaccagaauuauuuccugauuauuuuucuguguucccuccuaucuuaauuucucucccuaaaggcuguuuagcaccuaacauaacucaugcauuaaauaaauauauuaauuuaucucgggauucaugcguauuuuugcauuacuuuguaaaauguguuuuucuaguauuucauguguguuuuguuugcauauuaaaauugcaguuuccuuuaugguaaaggcuuguuuucccaacaguucaagccuaauauguauuacucagcagacagucaauaaauuagaauuggcuggcuaacaaguuuucuuuuuuuuuuuuuuuugagacagucucgcucugucgcccagguuggagugcaguggugcaauuucggcucacugcaagcuccgccuccuggguucacgccauucuccugccucagccucccgaguagcugggacuacaggugcccgccaccacguccggauaauuuuuuuuuuguauuuuuaauagagacgggguuucaccguguuagccaggauggucuccaucuccugaccucaugauccgcccgccucagccucccaaagugcugggauuacaggcgugagccaccacgcugggccgaguuuucuuuuuaagaugaauugugaaacauuuagcagcucuugaaauauacuuuugcaccaccccaccugaauucuuuaauauguauuaguucuuaaagaauauaccauauaauaguaaauaguauuuuagccuaaugaccagcaucagcauucuaccuacauuuccagaauuuagguucuuaaucauucugcuucuuuucauuuauccuucuuacccacugaguucuuuuuauggaguuuacuguaacccuuuaaugucuuccagacuaacgcuagaauggguaauauaaauauauguaaauucuguaaaaaggcacauucagcaccuuuuaugcccugccuuguaaguuuuuagcucauauuuuuacucuagcuguugccgaagucaucaucuuuucaggucuaacuggagggaaccugugaacuuuuuugcacuuucuucccuaagauuucucuucagccauuuaggauaugucuggcuaaacauagagcugaaaguccagguguaauuaacauccugcaaggcaaccuuuaauucagguguacagcucugauguacauugcacgugauuccucaaagggucccuagaagaaucagucaaccccauugccaaaugcagaaauaaaggcaagaauggagaagaucaaaugauuauggagaggaaagcauuaaauaaagccucauacagcuuuaagugugaaacacauaauuugccauuuuggcgugugaauuaugauuggguuugagcuguuuacuuuucugaaauaauggcaugaaagaaaauuaaagaccaagaauaguuccauuugccaguagaaaaccagacuuuuauucucuaucugaaauugugaaaggaagaucuguaugcaagaaagaauuaggaacugucaaaacauuuuuucccaagcuaucugaaaguacuugauuuuugcauagugucaaaguauugagcuucuaugguauaaagcauugaaccagaugugggggaacacaauaguguguaagauacaguccuuauuuccaccaguuggaggagcuaaaguaccuauaccuguacaaauacaaaauaauuggaaagcuguuggaugcucuuagauguucaaguuagguuaggcaauacuaacaguauauacauggcauuugagccagacuuugaaagauaugaaggauugacuaaaaccaauaagagaccagaguauuugguuuucuguuccuguguuacuuugcuaaggauaauggccuccagcugcauccauaagccugcaagggacaugaucucauuuuuuuauagcugcauaguauuccauggugaauguguacuacauuuucuuaaucuaguuuaucacugaugggcauuuagguugauuccaugucuuugcuauugugaauugugcugcaaugagcauaugcgagcaugugucuuuauaauaaaaugauuucuauuccuuuggguauauacccaguaaugggauugcugagucaaaugguauuucugucuuuaggucuuugaggaaucaccacacugucuuccacaauggcugaacuaauuuacacucccaccagcaguguaaaagucuuccuuuuccuccacaaccuugcuagcaucuguuauuauuugacuuuuuuuuuuuuuuuuuugagacggagugucgcucugucgcccaggcuggagugcaguggugcaauggcggcucacugcaagcuccgccucccagguucacccauucuccugccucggccucccaaguagcugggacuacaggugcccgucaccacgccuggcuaauuuuuuguauuuuuaguagagacgggguuucaccauguuagccaggauggucuugaucuccugaccuugugauccgcccgccucagccuccuaaagugcugggauuacaggcgugagccacugcggccggccucucguuguguuuuaauuugcauuucucuaaugaucagugauguugagcuuuuuuucaugauuguuggcugcauguauguguucuuuugaaaaguaucuguucguguccuuugcccacuuuuuuaugggguugucuuuuucuuguaaauuuguuuaaauuccuuauagacguugaauauuagaccuuugucaggugcagaauuuucaaaaauguucuccaguucuguagguugucuguuuacucugaugaugguuucuuuugcugugcagaagcucuuuagauuaauuagauccuauuugucaauuuuugcuuuuuuugcaauugcuuuuggugucuucagcaugaaaucuuuggccaugccuauguccugaaugguguugccuagguuaucuuccaggguuuuuauaguuuugaguuuuacauuaaagucuuuaauccaucucgaguuaauuuuuguauauuguguaaggaagggguccaguuucaaucuucugcauauggcuagccaggaaucccauggugugcuuucaauaauauagaguacaucaauauuuguaaaaugugaauuauggaacuauuuccuguaccucauaggcauuucaaggaaaaaaauuaaugacagauauuacacugaguaacaagguagugugaguuuaaaaacaguuauugugcagugugucucuucauuuuccagugucagggaaaaaauguuauuaaauuuuacaauuauauauguugcacaaaugugcugaguccauuuacauuuuauggaauaauuucauuuguucugcacuagcuggcuggcagagaaauugaacaauguuuggugauguuaaaguuguaauuuugucagcaacagaguuaggaaauauaaauauaaaucuggaacuaaaacguguuguguuaccuuuggcuacucuaggggauaaaauauaacuuuucaccaccacuucccaguggacuuuuccugggaagucaguugucauuguucuggcaaguuucuuuucauccuaaauuuuguuaucauuuaaagagaaaaucaugaagguuauaaagaaauccauuuuaggguaucuacccaaaggaaaauaaguuauuauauaaaaaagacacgugcaugugcauguguauagcagcacaauucacaauugcaaaaauguggaaccaaccuaaaugcccaccaaccaacaaguggauaaagaaaauguguuguauauacaccaugguaugcuacucagccauaaaacagaaugaaauaauggcauuugcagcaauuuagauggcguuggagaccguuguucuaugugaaguaacucagaaauggaaaaccaaauaucauaaauucucacuuauaagcgagagcuaagcuaugaggaugcaaaggcauaagaaugauauaauggacuuuggggacauaagggggagggugggaaggggaugagggauaaaagacuaaauauuggguacaguguacacugcuccagugaugggugcaccaaaaucucagaaaucaccacuaaagaacuuacuuauauaaccaaaaaccaccuguuccccaaaaacuacugaaauaaaauuuuuaaaaaccaaauacacuuuaaagacaauuuuaaaaaauuacaauaguaagaacauggaaacaauacaaaaauguggaauguagaaaguauugucugugcgugguugcucacgccuguaaucucagcuuuuucggaggcugaggcgggugcaucaccugaggucaggaguucaagaccagccuggccaacaugguaaaaccccgucucuacuaauaauacaaaaaaaauuagccgggcaugguggcaggcacuuguaguccuagcuacucaggaggcugaggcaggagaaucguuugaacccaggagguggagguugcagugagccgagaucaugccauugcacuccagccugggcaacaagagugaaacucagucucaaaaaaauaaaaauaaaaaaauaaagugucuuccacaguuggaguauauucuuucauaccuucuccuaugccuauaugauaaugcuaaauacacuauauauauauguguugcuuaauuaugcucauauauauguauauauauguuguaggauauacuguaccugauauucugugacuuugauuuuuaaccucaacaauauauuaugguauucuuccuggucaguacauauaguccuaucucauuuuuuccaaaggcuauagaggauacuacucuauaaaugaaaaaaacugaaccucuguugauuagcguguaucauauauauauauauaucaguauguauguuuaaugcauacuuauuuuaaguuguacaauuaauagcuguacagaauuuuaaaaacugauacauuguaacuuuacauauuuaugagguacaguuugauguuucaauacauguauaucuuauauaguguucaaaucaagguaguuagcauaucccuuaccucauucauuuauaauuuaguuauguugggaacauucaaaaaccuuuauucuagcuauuuuguaauauacgacaccuuacugauaaccauagucacccuacugugcaacagaacacuauggguuuuucuuuuuucuauguagaugugucuuugccuuauucuaagcaaagauugccccagauaccaucuuuuuguuuguuuguuuguucguuuuuuagcaguuuugugugugugugugugugugugugugugugugugugugugugugaaguuuuauacugguuaugaauauaauuuugaacaauauaugguggacuucauugauugauuuauuaaccuuagacacuaugugaguaaagcaggacugcacugcaaggagaugcuaaacuuuugacauuccugagagagaaguuuuauaaauuucagaauuccccugauuuaugcaugccucucugucacuuaauuaugcucauaaaauucugcuuaacuagcaaugggauucucaacuuggagagaaaagaguaugcuaccacugcagccuaccagaagaacauaucagaaucuuugggaaaaucuuuucaaaauaugcauaucuuccuuccuacccccauguggaacgugcuuaccugauugaaaaucacugcauguaauuaguuguuacuaauuggaauguaacuauuugggaguguguuguacagauaguguaaaaacaaaaaacaaacagcaacaacaacaacaacaaacuugucaaaguaagaauuauauauauguaagcuuuaaggcauuuaaguggugaagagguuugguuuuguuuguuuguuuguuuguuuguuuguuuugccccagguuaaggggcauugucuuaaaucuccucauuuucuguuuaucccauuauuucauuaucagcccuagcagaggacucuccuuuauaaaauucacuuuacaagaguucuuauguaaacauuaaugaguagagacuaauaaaacaaaguagggauguggaugccguagcauggauggggucauugcugagaugagugacugucuucugcauuguagacaagggcaagucaaauuuguauccagcaaaaucacugucaggggccuucaguucacuauaauaguugaaacucugagcacuaaaucugcgaauaucuaaccaagucuaucaucuuuuauaccuuuaaaccuaguagaaaacucuuagaggucugugauucuauuugaagaucaccuuacuggguccaguggauacuaaaaaugacgaugacaaggacaugcuugucuggaggguugguuucacagugcuuugagcuuucucuauagcaccugaggguaaguaaaaagucuaaggggagaauuucuaauggaguucucucucucugacuguuuuaucugcagacugcagcugaauauguaaaaucucgacucccagaggcccuuaaacagcaucuucaggacuacgagaaagacaaagaaaauaguguauuaucuuaccagaccauccuugaacagcagauuuugucaauugaccgagaaaugcuagaaaaauugacuguauccuaugaugaagcagguauguuuguuuuuaaaacacacauuuuuuuuccuugcaaaaaaaauucauuauaaaccuugauuaaacuugguaaaagguuaagggcaaacuagauucaaaguuauguaacauggacuaauaguaaguuucuucucugcaguuuuagucucaagauggucagaagauuccuaaaaauggaucuuaaauaucaaaugccuuuaaaauuuugcuguuuuuuauugggauuuuuuuggccuuuuauuaacuggguacuccuaaaguguuauuucaacuuuggauagcaacugaaaacuuuuacauccgagaauccaagaaauguuauucgauucaaauauuuguguuaauauuagauauuuucuuuucuaaagagguauuuuuuuuucucaaacuguuaagcuaaucauugcuuucuuuuccuuagcaacucagacacuaccacaucagagacuucaucucacugccugccauagguucuucccauccaagggagcuuauuaaugaagucauggacagaacuccuuauaacauuauuuuaaucuauuauauggucugucagcuaagacccaauuuuaaugaaauuaguguaguauuacuuggaauuaugaaaaucuuuaauaaaauuaaacuuaagcagcagaaauacccugauuaaaauugcuauaccucuccaccucccccucucaaaaaaauuggagaaaaaguacaggaaaaaagguuucuaauggucaaauguuaaugguauuaauucuuauauuaaugccaagaacuucugcuucuauuuuuacaaguauuuuuuagcaugcaucuuauuuucuucaucagaaucuaugcaugcucgauacuuucuuaccauuugauuucaaguucaaauagcaaacagaagagcaaauaaacaaaacaaaacauuauacuacauucaccuaaccacuuaaacaauauuucuaguuacuaagcugcccccauguauauuccacccucuaaccccuucaccucccucucaagcaggaucuguauuuccaguuuugcccaggacaucucugcuuucucuuauucuucuuugcuuuuuuuuuuguuuuccagacacauuggcuuucuucugccuagcauuuuuguuacuuucaauauucuucucauuggaauucuuauucaucucuucucucauccuuaauggaauaaaguuagguuuugaucagucccaaccaaaauaauauuuaaauauucauagcaucuuauagaucauagaacucauauaguccgcccacuucuugccccugugaccauuuuauggugagaaaacaaacucauagacuugccugaaauaaugcaguuacuuacuuguaaaacugggacgccaacuuccuaauuacuaaucaagcuaugcuuuuacuacacuaaugcagguucucauuugcucaguaagcaauuguugaaugcacggcaauauacuagguuguugaaggaaagagaaaagcagugaaaacaugaaaaggaaucugagauguagaaaauagaucuugcagaaagucuugcuggaggacuaaaacauacauguaugagcuuuagagaaaaauuucugaggaauuugggacuaaauacacccuguaauaucuucgcguuauuaaaguuaagaugaaauguggagccaagaaauaguggaaauggcugaaauuuuccaugaaauucuguagagggggcauuauuuuaaaccuugaaggacaaauggugggcauguauuugugaagagaagggggaugcauucuaguggaugaaggggcacaaguagacaucaaggugagcaugaacauuagcugcaaucacccaccacucaauuuuuuccugcuucagacauaauuuuccacucuccugcacuguuguugagcagcaacagauccucagagguaggcuugcacauggcuuuuaggggcaaauaguuuggcauagaauuaaucugucaauaagcccuguagcaugaaacaguagaaauaaacacaagauugagaguuagaggaucuaaggucuaggccuuccaccagguuaauacuggugugaucuucagcaaauuaaccucuuagaaccuauguuucuucaucuguaaaauugggcuaauauaaucucacaugauaauaauaaaauauuaucauguuuggggaaguccuuagagaucauauugcaaaugcuaguuaaugccacuagugaugaaugagaacagauuuggaccuugucuaucccuuaaaccaguguaaaguacagcugacccuugcacaacauggggguuagggaugccaacucucugugcagucuaaaauuagcauaaaacguuugauuccccaaaaaucuuaacuacuaauagccuauuguugaccagaagccuuacugauuacauaaacagucaaucaacacauauuuuguauguuauguguauuuauacuguauucuuaagacuaagcuagagaaaaaaauuuaugaaaaucauaaaaaagaaaaaauauauuuacuguauuaaauggaaguggaccaucauaaaggucuucauccucauugucuuuacuuugaguaggcugaacagacugcugaagaggagaggaggagcuggucuugcugucucaggggugucagagacagaagaaagugcacauauaaauggacccaugcaguuaaaccucuguuguuuaagggucagccguauucuaacuuagucuuuucguggcauacaguguuugggaaggcagaggggaaguuuuuaaagugaucuucagcagcuuugaaaagucuagcaacaucuauuugauaaaacacccgcucugagcucaguuugccuuugcucaucucugcaugaggugaugcaggacaguggaugugggaggguaggcuauguguaugcaugagugaaugaguguugcuguguguugcaaaaccaaaaguuacuaccuccuccuccauaacccauacguuaauuauuucaaucaaagaaagaggauaaaauaagaaaaaacauuacuauuuagcagaaaaauauaauaauacaaaagaauuaggauagaaaauugguaguaguaggcugguugcagcggcucacgccuguaaucccagcacuuugggaggccgaggugggcggaucaugaggucaggagauggagaccauacuggcuaacauggugaaaccccaucucuacuaaaaauacaaaaaauuagccgggcgugguggugggcgccuguagucccagcuacucgggaggcugaggcaggagaauggcgugaacccaggaggcggagcuugcagugagccgagaucgcgccacugcacucaagccugggcgacagagccuccaucucaaaaaaaaaaagaaaaaagaaaauugcuaguaguauccaauaugugcagauguaaccauccuacacagaagcuuccugacuucagaugguuuaauuuaguacuuuuugacuuuaugauggugcaaaagugauacacauucaguaaaaucuguacuucacauacacccauucuguuuuucauuuucaguauaguauucacuaaauuacaugagauucaacacuuuauucccuuuauuauaaaauagacuuuguguuagaugacuuuguccaacuacaggcuaauguaaguguuccgagcauauauaaguuaggcuaaacuaagcuaugauguucaguagguuagguguauuaaaugaauuuucaccuuaggauauuuucaauuuacaguggguuuaucaggauguaaucucauucuaagucgaggagcaucugcacuaacaugcucauuugcuucaacuguuuagcuucuuucuauucuaucuuaguuuugacuuccucacauucuugauucagcucucccaguuuuaggagguaguuaauuauuaguuagaagauaucuuggucucuagagagguuaauuugucuuuaaugcuccuucacugauaaaucagccugagugacuuaaugacaauuacugcuauuuguagcgucuaaacuucuauuaauaaaaaaacaauuaaugaaaaaaacacuuagacauuuuucuaaaaucauugccucagaauuuuuucacccucuccuuuuucucuuucucucucucuuccccuuuaauacauauauaccuuaaugccuugccuauccaugaauucagcuaucuagcaaccuggaauucagcaaagaaaugggaagugagcaaaaaccaugugugugcaacccuaccgugucacagaacuguggacaaguccauacaacagaggcuuucaguucucaccuagaaucuauauauuuuuauuuuauauaguucugacucauuagguuauauuuuccaaugugguauuuccuuuuauaaaauuaucugacuuaaaauguuauacuuuaauugcagaaaugaacagaaauauguagaacaguauaauaugagaauaauaauugucaguaaucuuacuauuguaaacacuuugguauauuuuccucacucuaagcauuuuaaaaauguaguugauaucugguaguuuuauugugauuuuauauccugcuuuuugcauuuaacauuauuacauaagcacuuccuuauuucauuaaagccucuucaugugaagauaauuuuaauggcuacaucauauucuauuugaaaguaccacucacuaaauauucucuuauguuggacauuuucauuuuuguuuugcucuuaugaauaaugcugcaagaaauaugggauucauuugucugcauuuuauauuacucuagaggauagacuucagaaaacauaagaguuuagaauugaaaugagaagguggggaaggggaugauacuuggagcagcaucacugaaaacaguaaguagugagagcaaagaguaaauccauaaaaagcacuuagcagauuccugacauugcacuacacucaaagucacauuagcauucacagacugugaguucacauuguugaacuucacaauagugacuugauucacagagaaaagguucaauaauguuuuuuauauucuguauauaaaagcaggaauuauguaaaccaguguauuaauccagucagccugugauaugguuuggcuguguccccacucaaaucucaucuugaauuguagcucccauaauccccaugugucauaggagggaccaggugggagguaauugaaucauggggguggguuuuuccugugcuguuuuugugguagugaauaaaucacacaagaucugaugguuuuauaaagggaaguuccccugcacaugcucuucucguaugccaccauguaagacaugccuuugcuccucuuucaccuucugcuaugauugugaggccuccucagccauguggaacugugaauccauuaaaccucuuuuucuuuauaauuacccagucuuggguauuucuucauagcaguaugaaaauggacuaauacacccugcuuuaacaaaauaccauagacuggguggcugauaaacuacagaacuuuauuucucacaguucuguaggcugugagguccaaggucaaggcaccagcagauauggugucuauaagggccugguuccucauagaugguugucuuuucacuguaaccuuacauggcaggagggcugagagauuuaucuggggccucuuuuauaagggcacuaauuccauucacgagggguucaccccuuugaucuaaucagcaucccccaccucauaauaccaucaccaugaggauuaguuuucaacauaugaauuuugggaggacacaaacauuuagacccccuuucuaacauuaguuuagaaaguuuuucauucaaaugguuuauauuuugauaauuucaagaacugauauguuuugugguauaguugaaagaaaacuuggaaccaaaagauccagauucuauuucuagucuagcucuacugccaaccauauacgugaccuugagcaagucacaaaccuuccuaaagcccauuuuccuauaaacugauggcaugaacaggaccucauagaugucuucuaguucuaaaacuaugcuuugggucuuaugacaauggaacacucaaauagcuauaauaucugcaaggcuuccuguagcuauggcuuuucugcuuuuucuauuuguuuucuucuuucuccuuacacagccacauaauuuguaccuaauuucugaccaaaagaagaccaucacucagcuuucauagcaucugcucaugaauauucccaggcauauuuuuauuggugggauggggagugagacuguaugagucaagcaaaaguagauuuuggaauaagagguucuaagcuaucauucauggauccucauuaagauaguuuagaccuuuuauuguauuagcauguauuaauacuaagcaaaauccagaguaacaaguaaggugugguuuauauuugaucuauuaauguuuuuauuuaauugaaguacaaguuuucguacacuucaguagauuggguuuaacacagagaaguuuucaaggaaagcaauggcauaauuugagaugaagagaucaaaauagcauuuuacacuguccaaagcaucaucaaccuaaauauuuauuaugugucauagugggcaaaagucaaaggguuaaaauaccaagagagggaaucuuuccucauauuuauuuuuaugcuggaguauuauuuauguuucuguagcuaaucucaaauucuguuuuuaauuauuuuugaguuugggcaugaauaaauauucccuacauauuccuuuguuaaggauaugguuuguaaugccauguguuugagggaauuaugaggagaguaggcccauuuauuugagagugauauuuucugucacaggcucaagaacccuaagccaugggagcggaagucuggaaacaggagugaagagcugcauauuuuucccuuugggaaaagcugaguacaccugcaauggguagaaugcucaaugguagcaucuuguugcaggccucaagauaguugccuaagcugcugcuuagaucuccuucucagaguucucagaccagcaagggcuuucuguucuuacaguuuggcuagaaaccuauacagccuuccaaugagcacaugcuucugcaauguggaaaaugcacuuacgcguagaaagugaaccagauggugcacaugagggaagaagagagcucagcuggcuguuucuuguguuccuuuggguaucagaguugggagccugcauauucauuuauaagugucaggcagucacauacagcuuucccagaggaggugagaaaggaggagcagcauuaauuucucagcuuuugcuuuaugauucccugauguagcucuaccugcaggugaaagcuaccuguggugaagacacaccaagcacuauaauuuuuggaaaaauagcuuuuuaaaagcguggaggaaugugcucuaagcagcuuaggaaguagcuggaggguuaccuccuauugagcugauuuuauucuucuuaaaauagauggugccugaaaguuacaucuacauuuuaauugggacauuagugucauaguaaucaguaaucucaaaagaaaggccauuuacugucaugggggaaaaaauugaacauacauccagcaaccaaacccaggaaagaguguguugaauuauuuagggacuuuccagguuuucuaagaacauaaaaaaucuaguaaaaggcauuugcaggaaguucuucacuccaacaaauagagugaauuucucaguauauuucucaaacagcuccuaagggaagaggugacacuaagguuuccuuacuuuauaucuucaaucaggaccccauuucuuagcucaaaagauacccucuccagggacuuguugacaagaauuggagaauuuggaaggaagacaaaaacagagacccaaaagaaacuaauaaagggaaguucaauauugacugugcaaccucugacaccaacuucuuauuuucuguagaaagauuuaaucuauuuuauuuuuccauuauaaaacuaaauaaauauacuuuagaacauuuuuuaaacguggaaaaaggaagagaaaaagauaaucuuuaauucuacuaccuaaacauaaucaacaucuuugguguauuuauuucuugccauuuuucucugcugaguuuuaauuauuuaugccaaauuuuauaucuuuuuuauuuaacauuuuuaaucauauuuuaugcuguuauaaacuaccuauaaaggucacuuguaauaacugcaguacucuauugaguggauauaccacaguuauucucacaaccuuuuaauauuuuuaauaugguuccugucuuguauccauguuucaguucucuuuaccacauagaaucccagaauuugguggucuguuucuuaucugugaaaaaaaugagaaugguaguaugaauaacaaaaacauaaggcuuuuguaaugcagacgauuacuagccauguauaauaacaguaggaagaggggaguaaaauggguacucaaaauccacuuauaaacugagaacuuauuucuggcgauaauauuaaauuuguuuuugaggcuacguaggugacuaauuuaucaaucuuuuuaaccaagcugaauauuuuuuuuuuuuuuuuuuuugagauggagugucacuuuguugcccaggcuggagugcaguggcgcaaucuuggcucacugcaaccuccgccuccuggguucaagcaauucucgugcaucagccucccaaguagcugggacuacaggcaugugcaaccacgcccagcuaauuucuuuacuuuuuauuuuuuugguagagaugggguuucaccauguuugccaguuggucucaaaguccugaccucaagugauucacccaccuuagccucccaaagugcugggauuacaggugugugcuauugcaccuggccuaaccaagcugauuuuaauuucaguuauaauuuuuuuuuuuuuuuuuuuuuugagacggagucucgcugucgcccaggcuggagugcaguggcgcaaucucggcucacugcaggcuccgcccccugggguucacgccauucuccugccucagccucccgaguagcugggacuacaggcgcccgccaccucgcccggcuaauuuuuuguauuuuuaguagagacgggguuucacccuguuagcucaguuauaauucuuacacuuuccauuuagacuguggauuuuaaaagccaaauuaucuuuuggugauggggagcaguaacuaaacaaagugacuuugacaucuacaaaauagaaaacuauuggccauaguuguuugaaaguaccgaaacauguaauuuacaagccccagccuagguuuuugucuauggugggacguugcaucucucugcaugguuucuucaacuguaaaauaaagguauuggauuagauauuuucuuaaaucucuuccagucguaacaaugugugauuuuugucuguuuauuuaacaguuauugguucauucauuuauucacucuguaaacacugacugaaugagcaucuuugagccagacacaguacccaccacuagaaaugcucagaugaccacguggcccuuaacuccaggugcacagugugugcauuuguaugugugcucaugugggagggcagagagauagccaguaaaaacagacaacuagaguguaguggaauugguguuauaggggacgguagaugugcagaggaggaagaaauuagguuuggaauugguaaagaguucuuaaaucagaaaaucaugagagaacccguaaaucuugugaacuguucauguugaacuuuacugccaguugcguuuuuaaagacaggcuuugaauaaugccuuguuuucuucuuugcuucuguaacugugguuauauguuggugccuuauacagaccaauucuugccuucugccauggcaacaccuaccacauucuuuuuuuuauugagacagggucucacccuguugcccaggcuggagugccguggcaugaucuuagcucucugcaaccuugaacuccugggcucaagggacucuccagccucagccuccagaguagcugauacuacagguuuacaccaccauggcuaauuguuauuuguaaaauuuuucuguagagacggguucuuacuguguuguccaggcuggucucaaacuccuggccucaagugauccucccaccuuggccuguuaaaguccuggaauuacaggaaugagccaccacucacagacucaccaccacauucuaacugcagcucuccaacugauauuaauuaguuuauuuuaguuuauauuaauaugcuaucagcauugccuguuugcuuaugauuccuccaauguagaaaaaaugauaauucagacuuaaucuuuuuuuuuauuauacuuuaaguuuuaggguacaugugcacaacgugcagguuuguuacauauguauacaugugccauguuggugugcugcacccauuagcucgucauuuaacauuagguauaucuccuaaugcuaucccucuccccuccccccaccccacaacaguccccagugugugauguuccccuuccuguguccauguguucucauuguucauuucccaccuaugagugagaacaugagguguuugguuuuuuguccuugcgauaguuugcugagaauaaugguuuccagcuucauccaugucccuacaaaggacaugaacucaucauuuuuuauggcugcauagcauuccaugguguauaugugccacauuuucuuaauccagucuaucaucauuggacauuuggguugguucaaagucuuugcuauugugaauaaugcugcaauaaacauacaugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauuguaacuggugugagaugguaucucacugugguuuugauuugcauuucucugauggccagugaugaugagcauuuuuucauguguuuuuuggcugcauaaauguucuuguaaaagugguaugauaggaagguauuuuaaaaaaucacauuccccaacuucaucuuaccuuucuaauagaacaccucauauccacucugaaaauacauugaucuaaauuuuauggugggcaaaauuuuaaagaacuuugcugagaaaaccagaaaccacaaaggaacacugauauuuagaaucaggaagugccaucucuagugauuaaaacauuuggacuggagcuguauuuaucuuuuuaaucaaguuguccuuguuugccacaagggaaguaguguuacuuccugucucugaaguaguauuugauuacaaggacuaaaggaaauguguauacuucaaagaaaauaauuggaccagguggucauacuuuagaguacauuagcuauccagagacaagaugccaaugccaucgguaucucuuccuuucuguacuaucgggauuguguaaacaagauuuuauagaccuuguuagaauguuuguaauaaauuuuaaugacauacacauuaaugguaagaccuucaguuuauagagaaaaauaaaauaguuuuuaaagugccaggauuucuaauguauugugaugguccauuuguaguagugagagguagguaaaaugcauccuugguugacucucagacucugaagauauguaaucauagacagcugggcugcuguuuaaugccauuuugcaaauguuauguucagucuuugggaucuacuagacacuuuaagaauucaucugguaaauugccuucugaaaggcccuguuuuuuuuuuuuuuuuuuuuuuuuuuuuuaaccaagacuugucuuuauuuuuuuauuuuuuuuugagaaugauucuaucuaguuuuucuuuuuuuuucuaauuuauuuauguauuuuuuauuauacuuuaaguuuuaggguacaugugcacauugugcagguuaguuacauauguauacaugugccaugcuggugcgcuggacccacuaacucgucaucuagcauuagguauaucucccagugcuaucccuccccccuccccccaccccaccacaguccccagagugugauauuccccuuccuguguccaugugaucucauuguucaauucccaccuaugagugagaauaugcgguguuugguuuuuuguucuugcgauaguuuacugagaaugaugauuuccaauuucaucuaugucccuacaaaggacaugaacucaacauuuuuuauggcugcauaguauuccaugguguauaugugccacauuuucuuaauccagucuaucauuguuggacauuuggguugguuccaagucuuugcuauugugaauaaugccgcaauaaacauacaugugcaugugucuuuauagcagcaugauuuauaguuguguggguguauauccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugaauuuuuaaugauugccauuguaacuggugugagaugguaucucauugugguuuugauuugcauuucucugauggccagugaugaugagcauuuuuucauguguuuuuuggcugcauaaaugucuucuuuugagaagugucuguucauguccuuugcccacuuuuugaugggguuguuuguuuuuuucuuguaaauuuguuggaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauauccugaaugguaaugccuagauuuucuucuaggguuuuuaugguuuuaggucuaacauuuaagucuuuaauccaucuugaauugauuuuuguauaagguguaaggaagggauccaguuucagcuuucuacguauggcuagccaguuuucccagcaccauuuauuaaauagggaauccuuuccccauugcugguuuuucucagguuugucaaagauuagauaguuguagauaugcggcguuauuucugagggcucuguucuguuccauugaucuauaucucuguuuugguaccaguaccaugcucuuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaaaucaucgguagcuugauggggauggcauugaaucuguaaauugccuugggcaguauggccauuuucacgauauugagucuucugacccaugagcauggaauguucuuccauuuguuuguauccuuuuuuauuuccuugagcagugguuuguaguucuccuugaagagguccuucacaucccuuguaaguuggauuccuagguauuuuauucucuuugaagcaauugugaaugagaguucacucaugauuuggcucucuguuugucuguuguuaguguauaagaaugcuugugauuuugguacauugauuuuguauccugagacuuugcuaaaguugcuaaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuuguggcaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcauauauugaaccagccuugcaucccagggaugaagcccacuugaucaugguggauaagcuuuuugaugugccacuggauucgguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacuccuuuugguugguaagcuauugauuauugccacaauuucagguccuguuauuggucuauucagagauucaacuucuuccugguuuagucuugggagaguguaugugucaaggaauuuauccauuucuucuagauuuucuaguuuauuuguauagagguguuuguaguauucucugaugguaguuuguauuucugugggauugguggugauauccccuuuaucauuuuuuauugcguccauuugauucuucucucuuuuuuucuuuauuagucugcuagcggucuaucaguuuuguugauccuuucaaaaaaccagcuccuggauucauuaauuuuuugaaggguuuuuugugucuguauuuccuucaguuccgcucugauuuuaguuauuucuugccuucagcuagcuuuugaauguguuugcucuugcuuuucuaguucuuuuaauugugauguuagggugucaauuuuggaucuuuccugcuuucuguugugggcauuuagugcuauaaauuucccucuacacacugcuuugaaugcgucccagagauucugguauguugugucuuuguucucguugguuucaaagaacaucuuuauuucugugaaagacacuguuuuuuuaagucaccuucuagugcccagaggaauuaucuuuguguuuccuuaguugauaaguuugucucaaggcuguguggcuuaggccauuucugaugaagcugguuugauaaggaguuucuuuaguauauacacuggaggagcuccuggaugugcucuuuaguucuuuaaucaauccuagggaauucuaaauugacuguguagaaauugcuaggacauacacuguucauucaacacaaacauuuacuaugugccaaguucuggcuacgugccgagagucuaagaaauggguaaagacagaugaguuagaagucugcuuccuucgaauuuauugcuaaucuuugacuucuguaucuaugaaucuauuuucuagaauuuguuucaaaauaacaccuguacuuaacugacuuauuccuuaccugagucacucugauuuccauucuccugucuuagucugccucauucaaggaaggaaguaacacaaauuauauuuuuauuauuuauaucccacuucuucccuaaaaguuugauuugccauucuuauaauaauaauguuacaauaaaaauagaucaaagccauaaauaaggacgaaagcaaauguacuauccauaaagaauacuaaaguauaauaauauacuuuaauuaagcauccaauuucuccuaagcuuucugauaaccagagcaaaaagagaaaccuaaugacuuauaaaguucucacuguuuuaauagauaaaauaaaaguuuuucaguggagacaacuucucuuuuggcacuaaagaucauaaagacuuuaucacaagacuuccuguguaugggacauugaacaacauugucuuagucuggguuccucaaauguagagccugaagcaaagacuugcuuacaauugguuuauuuaggaauaucaccccaaggaacaggagugaggggcacugggaaugaaagaggaaacaaggaaaccuacuaugaggacacuuauggaguugggcucaucugaggacaaaugcugcuuaagcccagguaccuucuaagguagcuugugaauagcaucccagaccauuuagcuaccaguaccacucccacauuuggccaaugguaguuccacagacauuaacuucccugaauuucugguuuauguaggccugaaggcugagugaguucugugggcaucccaugccuuggcaucagggaaucuccaggggaggaagcaagcaauaaauaguuuaguccgaggcagcaucugagcagaacuggucuccacagugguggcggaaauaagagguacgggagcaagagaguaugaaauggugcccaggagauggccuaggcaagcacaacaaauaaaaucuuaacuucauagcaaaugcaugugagcccaucuuauggucauuucuugcauaacaaccaucuauaaaagcugagggccaggcacaguggcucaugccuguacuaccaacacuuugggaggcuuaagugggagaauugcuugagcccaggaguucaagaucagccuggguaacauggugaaaccccauuucuauaaaaauaagaaaaauuagccaggcaugguggugcauacccauagucccaguuacccaggaggcugaugcaggaagauugcuugagcccaggaaguugagguugcagugagccguguucaugcuacuguacuccagccugggugacagagcaagacccaguuaaacaacaagaaagaaagaaagagagaaagagagagagaaagaaagaaaggaaagaaaguauuauucauguuuuuuuaaagcucuuguauuggacaggaaaaugcaucugaauacucucuauguuggacauacucuauacuggaauacucucuauauugaacauguagaauaucgaguguauucacaugcauuuauagaaaaauauugcauauagcagaagaugaaagaaaagauguuuuguuugauguaacggcucaacaggacaggauccuaacucaaaccuaaauaauuuaucuucacuuuuaucacuaaugaauuuaaauaccugggcccuucaaccugaguagcauggugagauguaacauucaaauugggguuuauuuauuugacaguaauuuguauucauuuauugauuuuccaacccacuuauuccaguucaggguuacaggugucuggacccuauccugacagcucagggcacaagguggaaacccaccuuggacaggacaccaucucauccccauggugcacucacacacacccacucagacuggaaccauguagacaugccaguucaucuaaggggcacaacucuaggauaugggaagaaaccagaguaccuugggagaacucacacagacaugggagaacauacaaauuccucauggacaguggccccagccaggaaacaauuuuuuuuuuuacaucaauauucuagcaaaaugauguugaaugaaauaacauuauucaaugaccugcuauauguaaaaauuaguuaccuuccacagauaagaaacucacaagagugguuacuuugggaaugaggaauugaggaaggagacuuacuuuuucacugaguacucuuacuauauugucugaauuuuuaacuuuguccauguauuuuguauuucuuaaaauuuauaaaaauaaaacuaaacaaaaccuuccuaauccauuucccuuaucuucagugcuagaaauggaauguaauaccacagaaaaucauacuucuuguuuucaauaaaacuuuucauccuuaagucauauguaucuuuggaauaagucgacaaaggaacucagcaacaagaccagacaucauggaacugcagugccaaggucagagaaggucaauaauaagguccaaggcaugccuggacaccagggcuucuaccauaggugcuugguagccuuucuacccugggccagaacugguuccagauuccaggguagggcuggccuuauuggaaaaaaaauaaaaauucaucugaaagagagcaggauucaucgguagcaugcugguggggauccagcagaguuucugaugucaauuucuguugguugccucugcuucaucucagagcuugaucuucuugugucugacaaguuauuagauuugaugcuuuacuuggccuuuuagucagauuucuucucuccugaacuauggccaaaccucuauugcuuuucuuucaaggcggugaaguauagugaaaagagcccaauuggcuucaugauaauucuuugugauauuauacuuaauggggcuuuuuaugaagauuaaagauaaugggccaggcacagugucucacgccuguaaucccagcacuuugggaggcguaggacgggggauugcuugagcucaggaguucaagaccauccugggcaacauggcaaaaccccgucucuacaaaaauuagcuggacacgguggcaugcaccuguagucccagccacucagaaggcugaggugagaggaucgcuugagcccuggagguugaggcugcagugagcugugaucaugcaauagcacuccagccugggugacagagugagaccuuggaaagaaagaaagaaggaaagaaggaaagagagaaagagagagaaaaaaaaagagagagagagagagaaaaagaaagagaaagaaagaaagagaaggaaagacggaaagaaaaggagagggagggagggaagggagagagggagggagggaaggaagguagaaggaaggaaagauauaauguguggaaaaugauggacaugcaguaaacacucuaccaaugauagucuuucucuuguuuuugcuguuacaugacguagcauguacuugaugugguguacagggguauuuccccaauccccuucaugauggagaggauuaccuauuauuauacuuggcacaaauuaacuuccuguccagagcaugacagaaaccagcaaaaugcugacuccauaagccuccucuuccuuccuugcccuguccuguauggaaaaauauuuccucaaguuaagaguauuuguauggguuuaauaucuuuaucuuuucuaauacuguguauuaguuaccuauugcugcauaacaaauuacuccaaaauuuagcagcuuaagacaauaaauguuuauuagcucauauaauuucugaggaucaggaaucuagguugguucucucauguaguugcauucaagcugucagccaggggagcagucucugaagauuuaacuggggcuguucugcuucugaauauacucauguggcucuuggcagaaagcuucauuuccugucuacauggguuucuucauaaggccucuugccacauggcuucccucagugugagugauguaagagacagagagcaagggggcacccaagaccaaagccacagucuuuuauaaugugaaugucgaaagugguauaccacaguuucugacagaagcugggguuggucaaacaaaccaacccuaauuuggugugguaguauucauacuaagcaaggguaugaauacuaggagauggagaucauugggggccucuuggaggcuaacuaccauaggguguauugcaaaaauaucuacucuuacucuuccaacuccuccacucucucuucuacuauuaucaccuuuccuucucauuuuauuuauuuauuuauuuauuuauuuauuuauuuauuuauuuuuauugagauggagucucgcucugucgcucaggcuggaguacaauggcaggaucucagcucacugcagccucugccucccagguucaagugauucuccugccucagccuccugaguaacugggauuacaggugcacaccaccacacccagcuaauuauuuuuguauuuuuaguagagacgggguuucaccacguuggccaggguggucucaaacuccugaccugaagugauccaccugccuuggccucccaaagugcugggauuacaggcauaagccacugcgcuuggcccccucucguuuucuaaucacuaccugcaucucauuucuuggaaguccaaagcuggaguguugagcccugcaccuggauggcuuuaggauuauuuagacucagcauccuuuccaguaaucacaguguacauuucaucucuccagggucaaugccuuugauguaucaguuuuuaaauauuuugacuaucacuucugacuccucuaauucauuaagauauuuccuucuagagcuuccuaacacugugccugggcaucucgacagcuuugaaauuucagaucaguuuuuuauagcggcauccuaaaugcuucaagauuaaggcaugacucucuggauagcaagaaaaaaaaaugucucucuccuuuaucacucccuccucccuuuuguuuuucucuuuguuuccuuaacuguguucuaaaauuuaucacauuuuaaauuauaucuauuaaauaauuugaucacucauucuguuaauuuuuuaaauggaugaguaaagaaccacauaaauugcuuuuauauuucacuuuaauguucgacccagcaguugcccucaguacaaguuuccuaucccuuuuuuauugcucuugguugccuuuuguauuguguagagaaaaaggaaugcagcaaaaaugaggaagucacugaggagcuugucuuuuucuuucacuuuuuacuaugccauaauuucccuuacuguggucaucuauuuuuucaccaaaucuccaccucugauucucuguuccuaaagaaaacaacaguaaacauguaagccucucauuguaucuccauuaguggaagaagacugugauggaacugcaaguaacuuuccuagggacugcuccacuguggcuagauuuuuuaaaaauguuaugaggaaagcauuauuuuuuaaagaacucauauuuuuaacuuuuuucucguuucaaauugcuuuuuugaucuauggugaauucaaucugagauuaagcauuaaagaacuugggaaaaccaaaaugccuucacagaauuagagaugcauuugauuuuuguacucgagaaucagcuugugagaaguauuggccccuguaaauagagauaaacuaagccaaauuugucuguaggccuugcauuuuaaaaucacaccugaaaguguuaugagccugauauaauugcauuugcaaauaaaaugcaagaaggucuagggcucagaguacaauuaaauguauuaaauuuuucuuuuugcuguaaugacaguaacuuuaggccucuucaguugacuguaccucuuuguaaaccuuccccugcaggauaaucagcauuccacagccacuaaagaaaaugagcuugucuaaaaauaguugccuguuuacuagauuuuagcagauuuuuugggggguggugggauaggggguggguaauaugaaagcuuuacaaaaugaaaugaggucaaauaugacagaugugaucaaauguacuucuaaucuguaaaucccugacuagcuacaguugugcuauuuuuaaauguauacuuugaaguuauacugaauuuaugacauucucagcauuuuccuauaucuacaagcauuugggauuacucuguuguauucuguggguuggcgaucagugcaucauugcuggugcccacuggcucuuuauugggggaacccaccccugauaauucuucguggguucuuuucuauuuaccuaagugucagccagucugagaaauaaagggaaagaguacaaagagagaaauuuuaaagcuggguguccgggggagacaucacaugucagcagguuccaugaugucccccaagccacaaaaccagcaaguuuuuauuagugauuuucaaaaggggagggaguguacgaauagggugugggucacagagaucacuugcuuuaagggcaacaaaagaucacaagacaggagguuagggcgagaucacaaggucagggcaaaacuagaaucacuaaugaacuuccgugucccgcuguguaugcauugucauugauaaacauuuuaccagaguucaagagcagagaacuggucugacuagaauuugccaggcuggaauuuccuaauccuagcaagccuuggggcacugcaggagacuagggcauguuucaucccuaucuacaucugcauaaaggcagacacucccagagcggccauuucagaggccuucccugggaaugcauucuuuuuccagggcuguuaauuauuaauauuccuuacuggggaaagaauucagcgauacuucucuuacccauuuuugguaauaagagaaauauggcucuguccugcccagcccacaggcagccagacuuuaagguuaucucccuuguucccugaaaaucgcuguuacccuguucuuaaggugcccagauuugauauuguucaaacacacaugcucuacaaacaauuugugcaguuaacacaaucaccacaggguccugaggcgacauacauccuccucaguuuaugaagaugaugggauuaagagauuaaaguaaagacagguauaggaaaucacaagaguauugauuggggaauugauaaauguccaugaaaucuucacaauuuauguucuucugccguggcuucagcuggucccucuguucagggucccugacuuccugcaacaggucuuacuuaguagagugucaaaugagguccuguuuugcacugcuuuuauuugacaggaauuauuuucuaaccaccaaaaauaauaaaauugauuuacuaugaacucuuuccuuuacaagcagugguucucuaccagaggcgauaucuaccuccacccccaugggacauuuggcaauguugggaggcauuuuuaguugucacagcuuagaaaggggaaugggagggagggcugguggugucuaguggguagaacccaaggaugcugcuaaguaagcauucuauaaugcacaggacagcccccaacagcaacauuuaucuaaccaaaauguaaguagugccaagguugucuuuagaacaauaguuuucaaccuuuguagcauauuaaagucaccuugggaggcuaaugcccaggcugcauucagaugaauuacacuagagucuuugagcagugggacucaggcuuuaguauuuuuauuuuauuaauuuuuaauuucaauaggauuuuggggaacagaugguguuuuguuacauggugauuuccgagauuuugguguacccaucaccccagcaguguacacuguacccaauguguauucucccccaaugacuccacugcguaaccaagauugagaacuguuacuuuagagcaaaauuuuaaaggguaagacuaguuuagacaucaucacaaauaguucccuuacuaaaguagaugaaaggaccucauuaacaugugguuggaccaaucaggcauguccuaguauaguauuauagugagguucaaaugaacuuuuaauauucucuaaagccaguacuuaaaacaugagaaacugcuauucucauucccauauuggaaguuuguuuuccuuguuuuuuucuaauaaguucuuucuuuuuccaagcaaguggugauaaauauuuacugguagcuuuaguuaguaaaguucuuucaaauaacaccuuggguguuugagcauuggugauuuguuuuccuugaagaugucuuauguaucuuuauuacuugaauaaauaucaucauguaguuauuuaccugaauugauaaugcugugcaaaggagcuaaaguauccucucuaaaaauauuuuuuuuucauaauuuuggccuuucauuccuuuaaccauuuccucucaccaaaaauuaaaucuuaaaauuuauggacaguuacucuaaacagauaaauauucuccagggaugauuaauguaugauuuuuuuauuuuauuauagaugccuauauugauggcacaguucucagggaacacucuccacccacccaaaaaaaaaaauagcaccucaaagcuuuugagagucaggguagauagaacaauuuuuaaugauguauuauauaguaaaaacuaguccauuuauaaaaaccugccuagcaaauaauaaaacugucuucuuucacaucucaacgucucagugagaguucaggcugucgaacuauggaaagcauccagcuucuuugaagaaauagagugagguauuacucacagagagccaucugguaucuuggucauuaacccacuuuugcuacccaugcccacaugcuugucaggagaugcuggagaaugaaggaagggaacagauugaggaaggaaauggcagugauugcagagcccagaggcucccauauugguaagagguuagucagauuccucagccagggcagagacuggcccagguuuccugaggccugaguuuuacacaauuuagagaacccucuuuaggaaaaaaauaaaaaauagguacaaaaugauuucuuuagaaugagaaaagaaaucacaauaaauuacaaauuguaaagaguuaaccacuaccacugaaccuagaaaaauaacauuuguauuaauuaauugccugauauaugcuauagucugacaucugcuacaguuuuucccacaucuuuggcagcauguucuuugguuacuucuucauagaacagugaguuuguaacaucauuuccugcagaggggccugggaagauaauuuaaucuucccuuuagcaugguugagcaaaacuugggauuuuuaucuugcuuuguuuuuuaauucauacuucagagucucuuucagcuuuucauuuuguuauucguaaugucauacaaauuuuuagaguugcugccaaaucuuggaaaauuuauaucaaaguuucuuacauauucuuucuuucuuacaauaaaagauuucaggucauuugaaguuuccuuauacaguuacuaauaaauaguccuugaauuuacaacacucauuagcugauugguugucauuguccuuguuguaauggugaauaaugaguuuuauuugucuucacuuaaugucgcauuauucauaagaaccugagcuguaauggagugagaacauuucaggucaagggagaacaaaaggugugaucuggcaaaggcaugguguccaguuuggauggaauaucauguacaaguaguguagcagugggccacaggacuagaaagguaugcuggagccagacaggcaagugggaaggguugucaauacuugguagguggcuaaaaauagacucuauguuguaucauaaaguuaagaagcccaaggccauuuguggaccacugagcauaugaaaggcagcaugguguaauguuaacaucauuggccuuagaggcagccagauucuagucugaauacuagcuuuccccccaacaggccugggaagccuugcuaacaagaacuauacgugaaaauaauggcaaacuacauauauauuucacuauacccaaacuugauguauccuugacuuaaguuccucuuagaucccagccagaggccaauuuagcaucaguguauauacagggaauaugaucaaagggagguagaagugaagagacagugcucuuaccugauuacuucuuacuucuccaaguaucuucuucaaauuuucggaaacaugacccaggccuuugaaagugcuugggcaagggaagggcucucaaguuugaagcuucauuagcuucaaguaaaucugcagguggucuaggacuuauucuuccucuccuauaugacuucagaaucagacaggugaguuuuagugcaaugauuuaggcaguuauugucauuucugauaguaaugaacgauaugcucuguguuuuaaacuaaauaauaaaaugaguuuuuaaaucgucacauagcuucacuuuguuccuuggcuuaaauucuugaacuagggaagcacauuguauggauugguucuucugguccuaucggcuguggcaaaggggccaggcuuauauggcggaauuuuccuuuccugacccuggaagaggcagauucucuaagaguuaacgauugagaaggaaauaaugggaucucuagaguagacacugucaagaguggcagucacaugacugccuuccacaagaauaggggaaccugggcaagagaggaggaauagggcagacgccaugaggugacugaagcucaugggagacaccccuugucaacuuguagaaacacuuggacagguucugucaagagcaugacguuuacguuauuaauguuuauaugacauccaugggaaggugaggucugcaaacauucagguuaaggaguuaggaaugauaugagaaaagaaaaaaaaaucaaccuuguucuugaaaugagaacagacuugaccuuaagcaaaaucaaaaaacaauagagccacuucacaguugcuauagauuuccaccuuuuagaagcagaugcaaaaaaucagauuuucuuggcuuuuggucugucagccccagucaauaauuaacaacacugagugaaacauuuuuccucugagauccucaagcugcuuaacugaucagcuuagcuuagcugagcauguuaggguaguaagaaaagggaaaauaugguuucaauuuugguguaugugccacuagagcaggcacuaaaaaagaaauagaauguuuucuaaucuuccuuucugcuugggagaucuaauucauggagaaguuaagugauuuucucaggaucucagaacaacuuaccagaauagaacagccagucuuuaacuaucaaagccuuccugggagccaccacuuaagcucugcuaaccugcuuccucuguucagauauagugguagugcaguuaacagaagaugucuguacaauucuuuaugcuuaggaggccagggaaugucuaugauuucauaaacuaguucugugguucucaugagcaauagauuuuaaaggcuuuaacacccuaguaaucagaagaggggaaggcaucaaucuuuucaugccuucaaagagaucaaaccauagccagcugauauaaaacccaauguauugauuaaagggaauguguuacucacuucugaugugaaagggaagaaaggaggaaauagaaacaaauaagacaauccuuuagaaaaaucugaaaacugaagaauaugagcacuucagugcuucaugcuaaagcccugcguuuccuauuaauauuucuuaaucuguuuccuuacuugcucauuucuccucuuuuaauuuuuauaguaacauguccuauaaaaccaacaugauaauuguccuauaauaaguuccucugcagugggaaguuuagggaaaaacaauuuaaguaccuuuccucucuaaaguaguaacucuaacccuuacagaaccaaccagcacuuuuuuaaaaaaauaacgauuauuuuauuuauuauuuauuauuauuuaaaacaauuuuuuuuuuuuuugagcagaguuucacucuuguuacccaggcuggagugcaaugcugcgaucuuggcucacugcaaccucugccucccagguuccagugauucuccugccucagccucccgaguaacuggaauuacaggugcccuaccaccaugcccggccaggcugguuuugaaccccugaccucaggugauccacccgucucagccucacaaagugcuagggucacaggcgugagccaccacgcccagccuauuuauuaauuuuuagaaacagagucuugcucugucacccaugcuggaaugcaguggcgugaucauagcucaucagagccuugaaauccugggcucaaguaauccucccaccucagccucccaaguggcugggacuacaggcauaccccacuaugcccagcugauuauuauuuuuuauuuuuuguacagacaggguauaucuuuguugcccagacuagucuugaacuccuggucucaagcaauccuccugccuuggccucccaaaguuccagcauuacaggcaugagccagugcacccagccauagcaacguuguuuuuguuuuguuuuguuuuguuuuguuuuguuuuugagacaagaucucauucugucacccaggcuggaaugcaguggcaugaacacagcucacugcagccucaaccuccuggguucaagugauccucccgccucagccuaccaaguagcugguacuacagguauguaccaccacugcagcugaucuuuuuuuuguuuguuuuuuguaaagacaggagucucaucacauugcccaggcuggucucaaacuccugggcgcaaaugauucucccaccucagccucccaaagugcugggauuacaggggugagccaccaugcccagccaacaacuauuuuuuaacauuguuuuuaccauccuaaaaugaaauucauagauaauauaaucuaccuauauguauacaucaugauuuaaaaauucagcaaaaugcccuaacauaaaggggaaaacaaagggaaaauaauauauaauuauauguauuucaauauguaaauauucaagcaccaauacauuagaagucauaauggaguugucagauguguguacacagauguacaacagcugcaaaugaagacuaacaguuggauuauuuugauaacuccaacacaguaaguagcauugucauugaugaagugauuuuuuuaagauagcaauuccucuuugugaaguucuaaacaaaacaaagugaaaggucccuucauuuauacaguagcugcauuccuggaaaauucauuguauacuaaagcgauucccaaaauacucuuuguuuacauguaagacaaguuccaagcccaugugauuauaaacagauuuucacuucuacuauuugcaaguuguaugggaugugacgaagucucuuuuguaggacugucuauuacauugcagaaucucuagugucccuuucccuugcugaauaagucccagucauacccacaguuauuuugacaaccaaaaaugcccccacaaauacccagaacauccucauucaggaucacugcuuuguaggggugccaaucuuuuggcuucccugggccacauuggaagaagaagaauugucuugggccacauauaaaauacauuaauacuaaugauagcugaugagcuaaaaaaaaaaaaaagaaaaaaaucacaaaaaaaucucacaguguuuuaagaaaauuuaccaauuuguguuaggccacauucaaagucguccugggcuggugggccacagauuggacaaguuuggcuggaacaaaggugaagaauuaaauucagggaagagacauugaguucuuucccaaaccauuuugaauguuuuugguuccuuuucuuuggauuugagauguugagagccccuguuucauuuucaguuacugaaaacuuaagaccccaggguauucucaggaaaaagaaagauggugaugguguaguuauagcacauuaaauuuauggcuuucaucaaacuacuugaguuaagaauccccaaggagaguuuaguuagggaaagaagacucucaauuacagauauugauucaaaccuaaauaccaugcuaaggaaccuagaaaauaggaacaguuauaccucaggcaauuauguaacuacuugaugaaauuuuuuuaaauguucuuuccgggauuaaucuagaguuacuauaagucuauuacagucucccauaagucauacuuauuuucugugaaguccuugaacccugggccuuaacuguauuccuaacgacuguggccuaagaaaaagacccacuggaggagcuacccaugugccaaugagaacccaaucuucaacuggaaauugaccagccuacugucuacaaguguaugccauucaucucauuauacugcauucuguauacauaugauacaucuauaguaaauucaugaagacagcucaaucucuugguuucccuagguaacauaauaauaacuaauaaugauaacuaauaauuauugagcacuucuaugugcuagaugcuguuccaagcucuugauguguauuaacuuuuugaauucucucaacaacccuaagauguaaguauuauuauuauccucauuuuacauagggaaacugaagcacagggagguuaaguagcuugccuaagguuguauaacuagcaaagccagaauucgaacccaggaaaucuauaucuccagaacccaaauucccaaccauuauacuaugcauauuuaagaaauaacaaggcuuaguaaaggauauggguggguaacuaauaauccaugaagaggauuaaauaccauacugcuuccaguucugaucaagcuaaauauuugugggugauaauaguugagaaaauugguagugcuguuacagcuuuauucuuuuaaguaucugcaguguuagaugugguaaaacagaggacacgaacaccauuaucucuaaaacggagauaaugacaaguguagcuuccacucauaucaucaaaauuagggcccaagacacucuauccaacuaacagaaauucaauucaaacuagcuuaugcaaaaugaaaacaacaacagcaaaaaagaaugugaaguuuaguaguucuguaagugaagaauucgagggauauaccugauuaggaaugguuugacccaggucucaaaugaugucaaaagccuuucucuuccuuacucagcucuuucucucuuugcauguuaaccauauucuuguccauugcaaacaacuuuauccuuggagccauagaagauguucacaguuuaccaauacagggaaagaaaggaagagacccucucuuuccugguaucugcuggacagauuuugauccaguuuggaucacauguucuucuacaaaccaagaacuguggccaaggagaaagaacucugauuggcuagccugagcuaugugcucaucugacucaucucucugaaggaaggugggcaugcaccauggaccucauggcuuggaagacagaucguucucaaggggaaagggaugaugggcaguuaaaaauaacugcuuuaaggagccaaacugagccauaaccugacuacuacuauuuuuauaacacuaggccguugaaucccuaacucauaacugaauuguugauccagguacgguguacacugguguuacaacaagguuuuuuuuuuuuucuugguuuuguuuuauacaugaggauauagaauuauacacagugccugauauagguuaaucauucaguaauuguuagcugauauuauaugcuaauaaguaaaaaugauauuccugcuauugccuuuauaaugaauaucuaacaaaaaacuuucugcaggguauggcagucugaggugauggccagcaucaauauuccaaggcaugucaacaacuauaugaauuagggagcaucacuuucuaaucuagauuagucucgaguuugauaaauuauccugauucucuacaggagauuugggaggguugggggaaggaagucagguaagaaaacaugggagcugaacuacaaucuuucauacuaaagaguguccgaacagaaguggucacaaggugguaaaaaauagcuucuugccugcucaggucuggcaguuggaaaacauuguucuggugaugcuucuaaaccaucaguagcccucugcuugcauugggugaauuggggagcuuuauagaacuaguucaugggccucagcccuuaagaauguuuugguaaauguggagggaccgagauucccauuuucagacccaagguaagccugacaugccgcuagacaugagaacugcaauaagcaaucucuauaauucaaaaagagaaaacaguugucauaguaagaacacagaguagcaguucaggcacagccaaguuacaaaacuugaaccgacaaaugguauauacagacagacaguguuuauacccuguccccucuuuugaugacaaagccauuaguuccuuuuuguuuuucucuccucagggacugauaacacaaagccugcucucuccccaacucccauuuuuccucuuuuuuuuucauugcucaguuaauuucacuuuguuccauuucuuucucauguauguaaguaaauuuauccugaugccuuuucuggucuuuuugcagauuuuacucaggauuuauaggggggugggggcggauauuacuucucucuauuaauucaugaauaaaaauuaccuuaaauauacuugaugaauuauuaauucauccagaaaauaguaauugggcaccuauuuguuaugcugacccuuaucaacuccaguggggaaggcaccaaguugaagaggcugaagaagaaaccuagagccagcaaacaagauauggcuuuucccaggggcuuacaugcagaggagggaguucaguggcagcagccuuggcaggauaucugcauggcccaguggcagcaggcugggcagaagaaccacagcugcuugcaaaaggcaugcaguuuaauauggcauuuucauuuagcaccauuuccccagugaucuucaccuggcaaucuacauucaacccaaaaccuggggccucgauccccuguacagccuguguuccaugggacagccugggggcucaacuguuccucauagaaaucuccagguuggccacucccaaguucccuagcucagaacauacauucaggugcaucugcccuacaggguuauucucaugguaugcuuaaguuauugcuaucagguauguuuaccacacacuacuaugugcaggcauaguacuaaguucuggaaauucaacugugaacaacucacacaagauuccugucaucaugagauuucaguguaaggaaggagacaaaauaaugaacaaaugacuaucagggugccagaugaugcuaagcacuauggagaaaaauaaagcaggacaagagacaagagcuugacaguauagggaauaggagaggcugaggcacaggcagucagagaaaggcuugaaggaagugaaaaagugacccuuuccaagaucugcaagaaaggcgcuccaggcaaguuaccagccaaugcaaggacccugaggugggacaaggcagaggaugauaggauauaaauuugaagagaugaugaggaagguuguaggacauuucaaaugguguuuuaaacagcguuauuaaaaggugguguaaaacaaaaagcaaagguugacaauuggauuucgugagauggagguuuucaauguucucaacaagagcaacuauaauggcaaugugagaacaaaagccucuuugaaguggcuuagggaaaaauuauggaaugugaggaaguggaaauuucaaguaaauacaaguuuguuggguguuuuuucaguccgcuaugaagauuagcaaagaaaugcaccaguagccagaggguuugugauacguagguagagauuuuuuuuucuuuuucuuuugagacagagucucacucugucucccaggcuggagugaaauggcacaaucucgacuuacugcaaccuccaccucccggguucaagugauucuccugccucagccuccugaguagcugggauuauaggugccugccaccacacccagcuaauuuuuguauuuuuaguagucacgggguuuugccagguuggccaagcuggucucgaacuccuguccccaggugauccaccugccucaaccuccccaagugcugggauuacaggcaugagccaccaugccugguccagguagagacuuuuuuuaagauggaagagaugauggcauauugauaugcuaaugaauuauucuaaagaaugagagaaacuauugaugcaggggagagaaauauaauuacaagagcaaaggucuugaauagaugugagagauaggaacaaggagaaaggaaagcaagagguuuuugguuuuguggguugauaaaucgaucaugggaaaacaccuuaguuuucuaauggcaucucuugguaaaauaggugagauccugcauugagauugaaauagggaaagugguauuggaaguuugagaaaagaggguaagaugugaaauauucaacuuggacugaauuaaccaagaagugggcuaaggacaugaauagacaauucucaaaagaagauauacaaauagccaacaagcaugugaaaaaaugcucaacaucaguagugaucagggaaaugcaaaucgaaaccacaguguaauaccaccuuacuccugcaagaauggccauaaucaaaaacucaaaaaauaauagauguuggcauggauguggugaaaagggaacacuucuacacugcuggugggaauguaaacuaguacaaccacuauggaaaacaguguggauauuccuuaaagaacuaaaaguagagcuaccauucgauccagcaaucccacuacuggguaucuacccagaggaaaagaagucauuauacgaaaaagauacuugcacacacauuuuaauagcagcacaauucacaauugcaaaaauacggaacccacccaaauguccaucauucaacgaguggauaaaaaaaauugugguauauauaucaugcaauacuacucggccauauaaaauaauuuaauaauggcauucacagcaaccuggauggaauuggagaccauuauucuaagugaaguaacucagaaauggaaaagcaaacaucauauguugucacucauaagugggagcuaagcuauguggaugcaaagacauaagaaugauacagagggcuuuggggaccugggggagagggugagaggggagcaaaggauaaaagacuacacauuggguacaguguacacugcucuggugauggguacacuaaaaucucagaaaucaccacuaaagaacuuaacaccaaacaccaccuguuccccaaaaaccuauugaaaucauaaaaaauauuuuaaaaauuaacuagaaaaauacaguaaaaaugcagugaugagugaacacaucaugaagauuguguucacagagcacagauacaaagccaaaagaugguuggauuuaaccagaguugugguuguucuaggcaaggcaauagcaggaagagcaaaggaggauuucaguggugggcaggcuaggagggauaggaggacuuaaggugagugaggaacagugaaacagugguggggcuaauggaucagauauccuguugggcugaagaauuauuggaguccaaauaccagugugaaugaucuggaaaguuaaaagguagugguuggagagagagauuuuucaaacaaagauuucugaggugguucaaggaguagauggucuauguggacugugacaaugucagugguauagaaggugacagagggaauuccuagucauuaaaugaaugaggaggugaaaccaaggggacaguaaaugcuugcaacaaggagcaggaguuggauaaacugauugcacauguuugaaaggagcuggauaugugcgggagguggacucuguuccucaccaguuaucaaaugaugaagauauccccaaauaugauaucuauccacuggaaauaaccuuugaguuuuugaccuuuaguaaaagggagaaggauaacauuguuggcagaaauguggauggugauaggggaaaccagaaugggaaaccauuuguugaauuuuuuuacgagacucagguauaguuauuuaaguaugucauaagaaauuuuggcaguuccaagaagucacauugucagaugucaaauggucugguuuaaugacuagcuuguuguccucuuaaagauaaccuuagguaggauaggccuaaauaagacuaagaaaauuccaggucuugguagcuggccucauucuggcucuaaaauucuuuugaagagugggugugguggggaagggucaguuggacaagcaggaagcaaagaagcacauauagucugcaguuuuguuuuucgcauuuuauaaauuuccuccuuucuucuagauuaaauaaggacagccuaucacuaacaaucucaaaauaaaauuguauauguccugaagaaccuccaaaacuuucaauagccaagaaccauaugaagcaggauccaaguaccacaugaagcaggauccaagucuuauacacaaguaaauagguuugaggaaaauuuucagaagagcauaucacagaacauauuuggaaaauauaauagaaggaaaauaauauagaacuaaaaguuccuauuauguaauuacuuuauauauauaaguagcuuuugcauucaagacaaauaacauuacuggaaaaauuucucucuuggaagacauuuccacauuccaauuuucacauuaaaaaugacauaaugaaagugccccaaguuguauugaaaugaccacaagcaccauacuuagguauaacaggaguucaccugggacucacuaauccaguuguuuacagccggacucuguucuaauugauuagcaccugugucucacuaguuguuaauguuuuuauuaacacucuugcuagaauauguauuuacuugucaaguagcaaaaauuauguacagaaccagaacaaaacacauaaaaauuaguuuaucuggugugguucuuauccaugucauucuugucccucucucuucccucccuuuuuuuucccuuugcagcaaauuguaaaggugacuuuaucauuaccuucuucagggucacagaguucaaaaugacuuuccugagggagauuuuugacaggcaucuuugaaaagaugucuagggagacuuggaacuacuggaugacauuuugaugucauggaaauugaacaagaguaaauaaauguauuggcaauauuagaaagacuguuaaaagucauuucuucaguguaaauuuuugugaaggaagaauaaauauugaccauuaaguuauaucacuguaauacaaggucuguuuguuaagcacuguguguggaaaaugauaugauccugguaaacccagaacugaggggguugaccugaaaguuauuucauaauuguauuuauuaguaaugaguuacaaagguacaugacuuuuuaauaaagaacuugaccugguaaagagaauggguuucaguuuuuaugaaucuuaaacaaaaaaagaaaagaaaagaaagccgguggugaaaagaaccauguuuucucaguuaaggcuacucagaggauaacaugguugcuaccgccuggcacaauaaaugcaauuuuggugcaauguuggggaaaguguaaaaauacuaauaauagccuacauucuucagcacauucuaugugccuguacucuuuuauucauucuacauguaggaacucauuuaauccucacaaccacccuauaaagaaggaaccauuaauauguccauuuuuauagaugaagagacugagguuaaguaacuugcucaaggacacaguacuugaaaacggccgcgugugguuucuacugcagacagucugaucccagacccuauacucuaauaaagcuuaagaucauacugugguugcacuuaguaagccauauuucacugcccuaaucuaccuaugacucauaacauauauuugugaauucagaugauuguaccauagauccccaccuggccgccagagggaaauaagaaucucuuacaccccaguuauuucuucucaggguaagccuucacuugugcucaguguuuucuuuccagcauucuuaccuuguugcugugguuucugcugccacacucuuaggaaguuacugcugucaggcguaaacauguuuucaaugcaaccacuuuaaugcuccuacucugccuucaguaaagacauagcuuccuguaauuccccagaguucaacuagaucaaccagugacuuucaggaguccuggcacaugccaaguuuacaaugccaguaucucagucugaagcaucuauaauuugggucauuuuacuguauucagaacuucacuaggaacaaagcaaaaguacuuaccuuugacucaccagaaguguccucagaaucaagacaggaccuacagcuuaauucuaauuacuacccuaaaagagacaguaugcauacaacgcuuaauguggcgguuauuacggcugaaaaucuuggauauuuuuauuguaaguacugauuuacagguauuucucccucccaagacucugagauacugcagagcuggaauugucauguucaccuuuguauccgcagaauccagcacauaauagauguucgguaaauguuugcuuugugaacaggugauggcauaaaggccacggaaaggaacagcucuuugccaucacaaguuccauuuuggacuuguccaguuuaagaugguacaacauucaaauacacaugugcuuuaaguaauuagagguuaggugauauaaauuugauaagagcuuagaacugcagauacagacacucauauugucuauaaagaauucgaaguggaagcuguaauucaaaguagaucuuaaagaaaaaagcagugaaggaugaggaaacaaagaaugaccuuucaggagcacacacaaaguuuggaagaggaaugugauccagcagagaagcauucagugaggaagaagcaauucaagagcaugcauauauaagaagcuaagaaaaaguaaguuucaaaaagugaccaguaaaaauacaaacaaaacacauaaccaguaagcaaggucagauauauaagagaggccaagaaaaaaacagggagagaaggcugaugaaucuggaaaaaaaguuauuagagaccuuuagaaguacauuuucaauggaguaguuuauguuuuucacauuugugacuuauuuauauugauugcaaugacuuuuauaacaaaaaauauugcccaauaccuagccuuuuauuuuguaagauauacucgagaaauuuaccaauuagaaauuaucauuugauccugaguucacuggaaucauuuuagaaauuucuccugacuaguacuguguagagaagacauuccuuaguugguuguuggauuuucuauaaauacuuuacacagcucaaagauauaucugauuaaaaccucuuuaauccuucagugaccacauuaaaagcuauacugagugcuuucuuucaggaaacagaacaccagaucauugaagauuuaauuuuaauuccuaagauucaguuuacuuccuaagauuuuaaacucuuccuaggcauuuaauuucaagaauauaacuugagucuacuucaaauuauugagauuuaagaucuguaaauaacuaauauuucugauugagucuaguaacaauaaucauuuguuucugucaguuauucuguucuucuagaaaucacaaacuauuuaaauuuagcuaacucucagaggaucuaugggcuagauugcaaaacaaaacaaaaaacaaaaacaacaacaacaaaacaaacaacaagaaaauacccaaggaacuaaaagucuauaguuuuuuguuuuuuguucuuuugggagagucucacucugucgccaggcuggaguacaguggugcaaucucuacuuacugcaaccuccaccuucccggguucacgugauucuugugccucagccucccgaguaguugggacuacaggugugugccaccaugcccagcuaauuuuuguauuuuuaguagagacuggguuuuuccauuggccaggcuggucuuggacuucuggccucaaguaauucgccccccaaagugcuggaauuacacaguuuuaaagcaaacaaaacuaccuuuucucaaugauaggaaaauauaugaaacucaauacuauauguuuaucaggcccaaccauuaaaaaauuauuucauaaauaacacccccagcucuuuuuuucuucuaucaaagcuucacuagcuaccagugcccucacauucucuuucuucuccauccuauuaggauuaggauuggaaaagaucugugauccacucauaacuaaguaugaauuuacuacaaacccucccuaaaguguuuacauuuuaaggaucuuucuuuuuuuuaauucauuauuauuauacuuuagguuuuaggguacaggugcacaaggugcagguuaguuacauauguauacaugugacaugcuggugcgcugcacccacuaacucgucaucuagcauuagguauaucucccaaugcuaucccuccccccucccccaaccccacaacaguccccagagugugauguuccccuuccuauguccauguguucucauuguucaauucccaccuaugagugagaauaugcgguguuugguuuuguguucuugcgauaguuuacugagaaugaugauuuccaauuucauccaugucccuacaaacgacgugaacucaucauuuuuuauggccgcauaguauuccaugguguauaugugccacauuuucuuaauccagucuaucauuguuggacauuuggguugguuccaagucuuugcuauugugaauaaugccacaauaaacauauaugugcaugugucuucauagcagcaugauuuauagucguuuggguauauacccaguaaugggauggcugggucaaaugguauuucuagaucuagaucccugaggaauugccacacugucuuccacaaugguugaacuaguuuacagucccaccaacagcguaaaaguguuccuauuucuccacauccucuccagcaccuguuguuuccugacuuuuuaaugaucgccauuguaacuggugugagaugguaucucacugugguuuugauuugcauuucucugauagccagugauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacauguaagucuuuaauccaucuugaauugauuuuuguauaaaguguaaggaagggauccaguuucagcuuucuacauauggcuagccaguuuucccagcaccauuuauuaaauagggaauccuuuccccauugcuuguuuuucucagguuugucaaagaucagauaguuguagauagguggcguuauuucugagggcucuguucuguuccauugaucuauaugucuguuuugguaccaguaccaugcuguuuugguuacuguagccuuguaguauaguuugaagucagguagugugaugccuccagcuuuguucuuuuggcuuaggauugacuuggcaaugugggcucuuuuuugguuccauaugaacuuuaaaauaguuuuuuccaauucugugaagaaaggcauugguagcuugauggggauggcguugaaucuauaaauuaccuugggcaguauagccauuuucacgauauugauucuuccuacccaugagcauggaauguucuuccauuuguuuguauccucuuuuauuucguugagcagugguuuguaguucuccuugaagagguccuucacaucccuuguaaguuggauuccuagguauuuuauucucuuugaugcaauugugaaugggaguucacucaugauuugguucucuguuugucuguuguugguguauaagaaggcuugugauuuuuguacauugauuuuguauccugagaauuugcugaaguugccuaucagcuuaaggagauuuugggcugagacaaugggguuuucuagauauacaaucaugucgucugcaaacagggacaauuugacuuccucuuuuccuaauugauuacccuuuauuuccuucuccugccuaauugcccuggccagaacuuccaacacuauguugaauaggaguggugagagagggcaucccugucuugugcccguuuucaaagggaaugcuuccaguuuuugcccauucaguaugauauuggcuguggguuugucauagauagcucuuauuauuuugagauacgucccaucaauaccuaauuuauugagaguuuuuagcaugaagcguuguugaauuuugucaaaggccuuuucugcaucuauugagauaaucaugugguuuuugucuuugguucuguuuauaugcuggauuacauuuauugauuugcguauauugaaccagccuugcaucccagggaugaagcccacuugaucaugguggauaagcuuuuugaugugccgcuggauucgguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacuccuuuugguugguaagcuauugauuauugccacaauuucagguccuguuauuggucuauucagagauucaacuucuuccugguuuagucuugggagaguguaugugucaaggaauuuauccauuucuucuagauuuucuaguuuauuugcauagagguguuuguaguauucucugaugguaguuuguauuucugugggaucgguggugauauccccuuuaucauuuuuuauugcgucuauuugauucuucucucuuuuuuucuuuauuagucuugcuagcggucuaucaauuuuguugauccuuucaaaaaaccagcuccuggauucauuaauuuuuugaaggguuuuuuguaucucuauuuccuucaguucugcucugauuuuagucauuucuugccuucugcuagcuuuugaauguguuugcucuugcuuuucuaguucuuuuaauugugauguuagggugucaauuuugggucuuuccugcuuucuguugugggcauuuagugcuauaaauuucccucuacacacugcuuugaaugcgucccagagauucugguauguugugucuuuguucucauugauuucaaagaacaucuuuauuucugccuucauuuuguuauugguauguugugucuuuguucucauugguuucaaagaacaucuuuauuucugccuucauuuuguuauguacccaguagucauucaggagcagguuguucaguuuccauguaguugagcgguuuugagugagauucuuaauccugaguucuaguuugauugcacuguggaucuuucuaauuuauuuauucacccaggaaauauuucuugaguuuucagcacaguacuaguuucuaugaaaaaacaaagugaguuauguaugaagccuaccuuuuaaaguggcaugaaaugaugcaauuaacuaugaucucauaaaaaagugauauguauuaugagagguacagguuuucuggaguuuaggaaaaagagauggccaucucaaggucagagugggaagguguucaagaagugguauuugauaagguaccacagcauaaugauuaaauacagaagcucuggaaccagccuugccugcguuuaaauucuggcuaucacuuaccacaugaucucgggcauguuauucaguaagcugccacucaguuaccucuaugaaaucaaacagugguauauacuuuauggaucucuugugaguauuaaauguguuaugacauguaaagcacuugaaacacaauauaaguuuuccacaaagguuagcuauuauucuuuagacugggcuuugaaaaacaggauaaauaggauuuagacaugcaaaaaugagucagaaauuaaauuucagaaggugcaaagauuaaaauauaaaaagguuaaaccauaaaauuauuagaagaaaucaggaagaaaucccaggguggggaaggcuuuccuagguaugacuucagacccaaaagcuauaaauauacaauuuuaaaagaugcauuaaaaaaacauaaaaaaauacaauuuuaaaagaugcauuaaaaauaacauaaacaaaaaacacagucucaacgagauauuuuuacaacuaugcucauugcagcauuauucacaagagccaugaggucaaaacagcccaaauguccaucaacagaugaauaaagaaaaugugauauauacauacaauggaacauuauuuagccuuaaaaaaagaaaucuuguuaaaugcugcaacauggauaaaucuugaggacauuaugcugagugaaauaagcuagacauaaaaaagacaaauacuguaugagucuauuaaugcaagauauguacagcagucaaaaucauggaaacagaaaguuaaaugaugggugccagaggcugagggaagggggaauaggcaguuguuguuugauggggauagaguuucaguuuugggagaugaaaaaauucuaaagaucuguuauacaaccaugugaauauaguuaacacuaaugaacugugcacuuaaaaaugacuaagagggugaacuauauauuuuuuuaccauaauaaaagauaaaaaaguuuuuuuuaaaguaaacugaauaaugcugaaggugaggugaaaaacuuuuuuuaauaauugguuuuccucauaaucccauuucuuuucccuuuacucugguguuuaaagcuuuuaugccaucaaacacuucagaaaacccaccgucuuuccuuuuuuuuuuuuuuuuuuuugagacggagucuugaucugucgcccaggcuggagugcaguggcgccaucuuggcuuacugcaagcaccaccuccugcguucacgccauucuccugccucagccuccugaguagcugggaccacaggcacccgccaccacgcccagcuaauuuuuuguaguuuuaguagagacgggguuucaccuuguuagucaggauggucucgaucuccugaccucgugauccaccugccucagccucccaaagugcugggauuauaggcgugagccaccgcgcccggcccccuaccuucuuuccuuuaugccauuaggagaaugugccacuuguaauuacuucucuuaccaucccagucauucauucauuuaauauguaucaagcacauacugugugcuagauccuguucuagacaguguggauuuagcagugaacagaauuccuacacucaacgaccuauauucuaauggagggggcacauuaaacaacaaguaaacauauagucugucugauggugucaagggcuccagaauaaaagaugagcggggcaaggaaugccaggacauaaguagguuacuauugugcacagugcaaucaagggaagcaucauguaagcugauaacuugaguaaauaccugaauaaaauggaccaugaagguggauauccagggaaaguguguuucacauagagggaccaccaagggcaaaggcccagaggcaggaacagcuugauggguuugagggaaagcaaggaggcccauguagcuggaggagagugaacggacggggagagaaauggaaguuguguggggaguuggugcuaacuuuuugggucauuauauagaccaagcuguucaaccugcgaccugcagucugcaugcagcccaggacagcuuugaauguggcccaacacaaauucguaaacuuucuuaaaauauuaugauuuauuuauuuuuuuauuuuuauuuuuuuagcucaucagcuuucguuaguguauuuuauguguggccccagacaauucuucuuccuguguggcccagggaagccaaaagauuggacaccccugaauagacuuugguuuuuacugugagcaagaugagagccauuggggaugcugagcagaguggcacgauguaacuuaugauuuagaugguuucucuggcagcaggguagguaauaagagggagaagauagaaguagaaagaugagucaggagagagguggugguggcugagaccagaugguauugucggggcucaaaaaugauaccccaacaugaaggccucagaagcaaacaucuaucucuaucugaccuuuuccugcccuccuggcucuggcuucucauucucccugaggcuagccauagaaaguagaauuacucuuccccaaggcaguucauagaaaccagaacuccuuuuccccaaagcuaaccauaaaaccauaaguauuuuuaaauauuacucuaacuuucccuccaccuuuuuguguaaaaacuggcccuaaaggaauuaucugaccuuucuuguuugauuuuaggccauaagaccgccauuccagagagggcccugccccauacccaggaggaaggaaugcugcacagagcggccaagaaaaaucugaacagacaagccuugcaggguuuccccauucaaucuauuagaauuagaucauauccuuuuuguccaaucacauuucuucacagcuguuuauacuuuguugaaucuaagcauaaaaauggauaguuuccccuguaucuuugggucuucauucugaaagcuccaaugucacauaaaacuaugaucgaggacauuuaugugccuuuucuccuauuaaucugccuuuugucugcugguuuucagcagccuucagagggcaaagaagucuucucuucaccuuacuauagcaauggaggugugaaaaguggucagauucuagguacauugugaaggcugguggagauuucuaauagauuggaugugaaguguaggaaaaagaacagagucaaaaaugagucuggaguuuuugacccaaacagcugccagaauggaguuacuguauacugagacagggaaugcuacaagagaagaagauuugcuggaaugauauuaggagcuuaguuugggacaugcuaaaucagacaugcaaaguugggucaaguaggcaauuagauauaugaguuuuacgcucaguggacagaucaaagcugggaauaaaaguuaggacaucaucagcauagagaugguauuuaaagccaguagacuagaugagaccagcuagagaguaaauguaauuaagaaagaguucuguggaaggagcccuggggugcuuuaggguggggacauagggaagaagccgcagacagggaagaaaagccagugccagugaugugggagauaauuguuuucucagaaaauaucccuuuuugaaugacucugauuaucaaauaacuuuuuguuuggucaaugcuaauauauauuucuacaguguuuuuaaucaguugccauaaugcuguuuacuccugguuacaugagcuguguugauccuggaucacucuugaaugguaaggccaauucacuggauagagugcccacaguguuuucccuauagaugcuuuaaaugucuuuuucuuuuuggaauggaacacauguuauuauauaggcuuacauaugaauaguuaaaauaagguaauuuaucaagaaguuuuuuaaaaaauaugugaccguauuuagagaugcaguguuuguuuuuuaauaggaugcaaaucaacugucuauaauguuuuaucucaaugaaaaucauguauaagaaucccagucauacuauauuuguuaccuaaccuuccuuuucauucauuacucauccucagcaaucaauaacagccucucugcagccucuuaaaaugcagugaaccuauugauuucacuuguuauugcaucucccuccccugccgcuggcuacaaauuacucuuaagucagaaaaggugguaagauaguaagacuauauauagacuguccucuucuguucucuccaaaaagcuuuuuuuuucuauuuaacuaggaagugauaaaagcaaagcucaggaccagcuguaaguuauauguccuacaguugaaaucuucuguacuuuaaaaccaaacauuuugacuugcucuauacuauuaauuaagcacaggaagcaaugcuuacugugauuuaucuuuuccuaaagaugcauuacagaagauauucaaauauaauaugucacuuaauggaaguaguuguuucaacuccaaauuauaaaauauccauguuaguuguuuuuaugucucuauucuaauuuauacuuauacuuuaaguucuaggguacaugugcacaaugugcagguuuguuacacauguauacaugcaccaugugggugugcugcacccauuaacucgucauuuacauuagguauaucucauaaugcuaucccuccuccuccccccaccccaugacaggccccaaugugugauguuccccuucccguguccaaguguucucauuauucaauucccaccuaugagugagaacaugcaguguuugguuuuuuguccuugugcuaguuugcugagaaugaugguuuccagcuucauucaugucccuacaaaggacaugaacucauccuuuuuauggcugcauaguauuccauuuauggcugcauaguauuccaugguguauaugugccacauuuucuuaauccagucuaucauuguuggacauuuggguugguuccaagucuuugcuauugugaauagugcugcaauaaacauacguguccaugugucuuuauagcagcaugauuuauaauccuuuggguauauacccaguaaugggauggcuggguaaaaugguauuucuaguucuagauccuugaggaauugccacacugucuuccacaaugguugaacuaguuuacagucccaccaacaguguaaaaguguuccuauuucuccacauccucuccagcaccuguuguuuccugacuuuuuaaugaucgccuuucuaacuggugugagaugguaucucauuuugguuuugauuugcauuucucugauggccagugaugaugagcauuuuuucaugugucuguuggcugcauaaaugucuucuuuugagaagugucuauucauauccuuugcccacuuuguaaugggguuguuuuauucuugcaaauuugaguucuuuguagauucuggauauuagcccuuugacacaugaguagauugcaaaaauuuucucccauucuguagguugccuguucacucugaugguaguuucuuuugcuguacagaagcucuuuaguguaauuagaucccauuugucaauuuuggcuuuuguugccauugcuuuugguguuucagacgugaaguccuugcccaugccuauguccugaaugguauugccuagguuuucuucuaggguuuuuauggcuuuaggucuaacauguaagucuuuaauccaucuugaauuaauuuuuguauaagguguaaggaagguauccaguuucagcuuucuacauauggcaagccaguuuucccagcaccguuuauuaaauacggaauccuuuccccauuucuuguuuuugucagguuugucaaagaucagaugguuguagaugugugguauuauuucugagagcucuauucuguuccauuggucuauaucucucuuuugguaccaauaccaggcuguuuugguuacuguagccuuguaguauaguuugaagucagguagcgugaugccuccagcuuuguucuuuuggcuuaggauugucuuggcaaugugggcucuuuuuugguuccauaggaacuuuaaaguaguuuuuuccaauucugugaagaaagucguugguagcuugauggggauggcauugaaucuauaaauuaccuugggcaguauggccauuuucacaauauugauucuuccuauccaugagcauggaauguucuuccauuuguuuguauccucuuuuauuucguugagcagugguuuauaguucuccuugaagagguccuucacaucccuuguaaguuggauuccuagguauuuuauucucuuugaugcaauugugaaugggaguucacucaugauuugguucucuguuugucuguuguugguguauaagaaggcuugggauuuuugcacauugauuuuguauccugagaacuugcugaaguugccuaucagcuuaaggagauuuugggcugagacgaugggguuuucuaaauauacaaucaugucaccugcaaacauggacaauuugacuuccucuuuuccuaauugauuacccuuuauuucuuucuccugccuaauugcccuggccagaacuuccaacacuauguugaauaggaguggugagagagggcaucucugucuucugcccguuuucaaagggaaugcuuccaguuuuugcccauucagugugauauuggcuguggguuugucauagauagcucuuauuauuuugagguacgucccaucaauaccuaauuuauugaguguuuguagcaugaagggcuguugaauuuugucaaaggccuuuucugcaucuauugagaucaucaugugguuuuugucuuugguucuguuuauaugcuggauuccauuuauugauuugcguauguugaaccagccuugcaucccagggaugaagcccacuugaucaugguggauaagcuuuuugaugugccacuggauucgguuugcuaguauuuuauugaggauuuuugcaucaauguuaaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauuuggcugugaauccaucugguccuggacuccuuuugguugguaagcuauugauuauugccacaauuucagcuccuguuauuggucuauucagcgauucaacuucuuccugguuuagucuugggagaguguauguguugaggaauuuaucaauuucuucuagauuuucuaguuuauuuguguagagguguuuauauauucucugaugguauuuuguauuucugugggaucgguggugauauccccuuuaucauuuuuuauugcaucuauuugauucuucucucuuuuuuucuuuauuagucuugcuagcggucuaucaauauuguugauccuuucaaaaaaccagcuccuggauucauugauuuuuugaaggguuuuuuguuucucuauaucugucuccuucaguucugcucugaucuuaguuacuucuugccuucugcuagcuuuugaauguguuugcucuugcuucucuaguucuuuuaauugugauguuagggugucaauuuuagaucuuuccugcuuucucuugugggcauuuagugcuguaaauuucccucuacacacuguuuuaaauaugucccagagauucugguauguugugucuuuguucucauugguuucaaagaacaucuuuauuucugccuucauuucguuaugcacccaguagucauucaggagcagguuguucaguucccauguaguugaaugguuuugagugaguuucuuaauccugaguuguaguuugauugcacugugaucugagagacaguuuguuauaauuucuguucuuuuacauuugcugaggagugcuuuacuuccaacuauguggucaauuuuggaauaagugugaugugaugcugagaagaauguauauucuguugauuugggguggagaguucuguagaugucuauuagguccacuuggugcagagcugaguucaacuccuggauauccuuguuaacuuugugucucguugaucugucuaauguugacagugggggguuaaagucucccauuauuauugugugggaaucuaagucucuuuguaggucucuaaggacuugcuuuaugaaucugggugcuccuguauugagugcauauauauuuaggauaguucggucuucuuguugaauugauaccuuuaccauuauguaaugaccuucuuugucucuuuugaucuuuguugguuuaaagucuguuuuaucagagacuaggaugcaaccccuguuuuuuuuguuuuccauuugcuugguagaucuuccuccaucccuuuauuuugagccuauguuugucucugcacaugaaaugggucuccugaauauggcacacugauggaucuugacucuuuauccaauuugccagucugugucuuuuaauuggagcauuuagcccauuuacauuuaagguuaauauuguuaugcgugaauuugauccugucauugugauguuagcugguuauuuugcucauuaguugaugcaguuucuuccuagcaucaauggucuuuacaauuuugcauguuuuugcaguggcugguacugguuguuccuuuccauguguagugcuuccuucaggagcucuuguagggcaggccugguggugacuuuauacuauuaauuaagcacaggaaggaaugcuuacugugauuuaugcuuacugugauuuaucuuuuccuaaaguugcauuacagaagauauucaaauacaauauaucauuuaauagaaguaguuguuucaacuccaaauuauaacauauccauguuaguuguuuuuauaucucuauucucuaauuuagggaauagacugacacugucagcucauacugccaaauaucccuuuuuuucaagucaggauuuuuuuuuuuuuuuuuuuuagauggagucuugcucugucaccaaggcuggagugcaguggcacgaucucagcucacugcaacauccgccucccagguucaagcgauucuccugccucagcccccugaguagcugggauuacaggcacacgccaccacgcccagcuaacuuuuauauuuuuaguagagaugggguuucaccuuggucagccuugucucaaacuccugaccucaugauccgccugucuggaccucccaaagugaugggauuauaggcgugagccacugcuccuggccaggauuuuuaaguguaguagaaacuaguauaagcacuaaugcuucagauuucucagacuugccuucauguuuugguuugggauauuuggggauggggggagucauauuguaacaccuccaagcaacugaaauccaccacuuacggugcaaaaucauuaugccugaguuuccuuggugcuguaugcaggcaaccacuuccauuuauuggagcuggcaaagaaucuuugcuauuaaaugggaaaaggucacaguuguaaaucaaggagcaguaagucuuuuagguguguguagggcaguugguagggggaguagcaaaggggggugaaugggagaaauuuguaauggcuucucuuaacaccacucacacacaucaaaagcaucauaauacacauuucuauuuggacauauucuauuuuuaaauuaauaaucaugcgcuauccuuccuuccccuaaaccagcuggaaagcuuaguaguuauuuacagggcaccucagugaaauuagcaguagacugaaacaugacugugccacugauaugugcaaguucuucauaaaaccucauuaccagggccuggagauaaugcaguuguaguaaaacaaaacaauuugucaaaugugaucugaaauccuaaaggggauuuuccagcagcuauauuuuguuaaugcuggugcugacugaguugaucagaauaugcaaacuauaucucuaaacuggucauuauuuacaugcuucagcugcacucacuaauuaaaucccuggaguuauuucugacaccuaccaccugggaccuguuuccagacaaaggcuuuccuguggcacacagccgagauaggucugggcccuucuguuucaugucagaauaaauauuucagcucugaggcuuuuuguuuaacuggauucagugguucucuugauuugcguuauuucuuuuaccaggaaucaguuuacuaagcuagcuguuguuuggaugggcuaauuaaaaccugcucagugugugugcaggcagccucuaagccaaauauugcccuacccagaacuuggauaaaaacauggcauuuguauuuauuagaacagaugagccuugugacuuaccccuagcuaaucugacucuaguguuugcuuuuuucauuguaugcccuucugaauguacaucccaccuuaaaaagugaggagugcccacaguucccagcccuugagaaaucccauggaaaggagagauguggccuggguguuccugagaacaguccugcugucaacuucauggguggcaggucaccaaaaggugugucuauaucacauaugauauuuggucucaugagacacuucggaauuaguuauuuauacuauuuuuaucaagguuucaugcaaaguggauaaccaguuauagaagcuuugcugauacugccguucuuuugaguggaggcauucuaucuaggcaacugguaaaaaaaaauccaaauauuguuucagauaguuaaaugcauuagacuaugaucuccaucuacaucaaacauuuauucauuucugucauauugcaugguccuauauucuaggagaggccuaucauauuccccuaaggagcuuguagucuugugaaugaaacagauaugcaaacaaauauuuccaguacaaugugauaaauugucucucagauuucuaaauuggguaaguauguguaugaugaugcccuaaccaagauauggaacgcugaagaaggaacagguugaaggaggagagauggagggagauguuaaauuggauuucacacgcucacaggacauucaggcugaaguuucuaguaggcaguucuaaaugcggcuuauaagauagaugaggaacuccuugccagaaaauauuauuucaucauguuccuauuagagggcgaggcaugguacaaauauauuuugauaggagaggugaauaaacaaaagauugagaguggaggcuacccugguaggacaucagguuggggaaaaguaagcuuuucaagagcagcuuuccuaauucucaauuuuauuuagagugugcucugauuauaacaauauguggaugguguggagacuuucugagagauuaaccagugaauaagucuuuaagagaagaaugcuugcucaucgacuggguauucauuuggagaagauuguguuuuccaguuucuuagaagauaauauuuggaguauuaucugaacaaaacauaaugcacuucuuuuuuuuucuucuucuuuaugcuuaucuugccaagucaugaaagagccaauuugaaauauuucaacugauauuucuagcuagaaaugaauggauuuuugaaacauuucauuacuguacuuagaaaguguaacuguggauagagaugauucauagucuucuuuuucggagguggauuuuuagaaaaaagaguggggugugucuccaguuaucuuaagggugaaauucucccaaaugaucucaaacuaaagaacauuuuaaaaucagugccauggugaaauuugaagagggaagaaaaugucacagaauacaauaaauagaaaauuaucagaacuccaaggaauuugagggagauuagauauagagaagugucauauuuuuguuuagaccaauuauggagucugagcaucuugacacaauugauuauguugauuggcucuucaguagcauuuucauuucuucacaaaacuuauccaaaaaccuucaaguuucgaguaccuagcugaauaaacuaccuacuuuuuggugccuuaccaaggguccacaguguucuauuuucugaaguaaaugccaaccucagaaguaagugcccauuaugccuauuguauuacaauuuuucuaagcccagaauugucgugggagguugaaaacauuccaguggucaaagaaagagagcaguuagcucauuuaaacccucuuccauaucccauucuguccuuggugaaaaggugccagccuguuuuuauaagaauaaaucuauuugacagaccuggggcaguucuugucugcugcuaagguuuccacuacaaauacaaggaaaaaguauugccgagguugaguagggaaauacaggggaaaaacagaguuuuugcauccuaaaauaaccuuggaaucuguaaagcaccugcuuuacuccaaugaaguaccuaaaauuugaguuuacacuagagguucuagaaaauuuccccuauuacccuaaccugauugaauauagcuuuaaaagcuuaaaauuaauaacagcaagauacuuuuaaaagcuuaaaauuaauaacagcaagccaaugacuccuuaaaaaaaaagaaugggguauacaucuugacauuauuuaauucagcugucaaucuuaaaagauaaauuugcauucagacuguguaugcauguguuagccuccucacagauuacgugcuggcaaccccauucugugcagggacuccuuaggaaggccaucuuuauagaauucuccaugguggaucacaaagagaggauuugcauuuacacauaaaagaccauaacgcaucaauuuuagaaagagcuucuuucauuuuacaaauaaauuggcccuaaauaagaauauuucauguagaaaucuugaaauguauuuuguuuauucaauaguaauaauaucaaaugguuuucauauguucucucuucuuucuaugaacaugaaagguagcauagauauuuuuacaaauggaauuccaauauuauugcuuuggaauuuuuuuaaauuuguguuuaagauacuauaaacuacaauugaugauaaagaucauuuaauuaguuuaggacuagaguuaauuagcauuuuaaugaaauggaaucauaucucuuuaggaauuuuguagcauuucaggauuauggauauuuuuucuuguaguauaaauauuuauuauacacuuuccaauuauuaugaagcugauauaaaauuuaaaccuaaaaauaauguuucuaacaauaucacuuaauagucagaaaaaauuuugagaaaacaaauuaaccaucuuacuuguaggaagcugaugacaagaaucgaagcagaacugcacauuuuccaagguauguuccuuggcaucucggcauuccaggcauucuggagggaaaaacauuugggauauguugcauaccaugaccuucuuuggaauucacuauuugacauuauauuaaaggcuuuguaagacugauagauaguuuaacuggcuuuaacuuugagaacuuguuauuuccccaacuuauugaggcaugaacccuuuuacugaauaacuucuaucuauauucagcugaauuggcuauccacagaaaccacuucgggaaacauugaacuagaggauaagauuauuugauuaauuugguuaauuauuuuagauaauacuauagaugaugcucaaaauugcaacccaaauuaagauacuuguggucauucuggguuugcuguuguuguuguuauuguuucuuguuaggaacaaggucucauucugucacccagccuggggugcaguggcauaaucauagcucauugcagucucaaacuccuggguucaagugauucucccaccucaacuccccgaguagcugggacuauaggcaugcgccaccaugccuggcugauuuaaaaaauuuuuuuuuguaaagauagggucucacuauguuguccagguuggucucgaacuccagaucucaagugauccuccuaucuuggcuugcaaaagugcugaaauuacaggcaugagucaacaugucuggccaccaauucuuuuuuaacuacuaaaauaaauucuggacacuuuuuggugaggucaacagcugguuuuuagcuacuacaaagauggaaauuuguucagaaguaagauagaaucaaaguaccauuuagcaguaagaguuuuguauauagaacaaacuuucaaauaaauaaauuugagugaguuuguguuaccugucacugcugcaucaucagucaguuagcucagggcauuuacugcaugauauauguccacuagggucacaguaaugcauuaacaagaugauaugucauauaauuaguuggccuuuuucucuaaaaucauaaacgaagcuaacuauaaaauguugugcugcugggcaugguggcucaugccuguaauaccaacacuuugggaagccaaggcagcggaucaccaggucaggagaucgagaccauccugaccaacauggugaaaaacccccucucuacuaaaaauacaaaaaauuaccugagugugguggcgugugccuguaauccuagcuacucaggaggcugaggcaugagaaucacuugaacccaggagguggagguugcagugagccaagaucgugccacugcacuccagccuagcgacagagagagacuccaccucaaaaaaaaaaaaaaaaaguuguacuaagccuagaaaaaacaagacaucuccuaacucaauuuuauacucuaauauauacuggcauuucaaaauauuugaacauauauuuaaguccugaacccucguguaggcaaauugguuauuuauuucuacaccaggacaucuaaaauaauacccuguuuccucccuuuaaacuuauaaguaauugagaaauaagacauaggagacagucaaguagcaagaagcaaaauaacagcuuuacuucuaauaaagcugauugaggaaacugaccuuaacauaagcaaggcucauguuucagagaagcauuucagagaaggggaaauaggaaugucccuuaaauaguugcuaaaccuuaucaacuaacuagggaaaugcaagugaaaucaccauaagauacuguuuugcccauaccauagaauuaauuggaagugcuccuuccucuuguauuuuuuggaaaaguuugugaagaauugguuggcauuaauucuucauugcauguuugauagaauucacugaugaauccaucugggucaggguuuuucuuuaugggaagcuuuugauuacuaauucaaucucuauacuuguuauaggucuguugggaucuucuguuucuucuugagucaauuuuaucaguuuguguuuuuuuaggaacuucuaaguuucaucuacauuaucuaauuaaucuaauuuauugguauacauuaaauuguucauaguauuuucuuauuauccuuuuauuuuauugauauaaaguugguaaugaugucccuuccuguauucccaaucuugguaaucugagucuucuccccuuuuuuucuucaucaaucuagcuaaaguuuggucaacuuuggugaucuuuuuuaagaaccuacuuuuguuuuuguuguaucucuauuuuuguaucauuuauuuaugcucuaaucuuuauuauuuucuuucuucuuugggguuuaguuugcucuuauuuucuaguuucuuagggugguagcuuagguuuuuuauuugagagcuuucuucuuuaauauagguguuuauagcuguaaaaacacuuuagcuguaucccauaaguuuuggguguauguucauuuccacucaucucaaaauauuuucuaauuucccuugugauuucuuuuuuugauacauugguuauuuaggauuguguucaugacuucuuuauauauuguuacauuuuccaaauuuauucugcuauugauuucuaauuucauucguuuguggucagagaacauacuuaguauguuucuaacccuuuuaaauuuauuuaaguuuuguuuuauagucuaaccuggagaauguccuguguauaccugauaagaauguauaaucugucuuuauuggguggaguguucuauacaugucuguuaggucuagugguuuucuaguauuguucaagucuuuuauuuauuuauuuccuuuuuaaucuucugccucguucuaucuauuaguggaagugagauuuugaaguugucaucuauuauuguugaacuaucuauuuuccucuuuaauucuguuaguuuuugccucacguauuuuagagcucuguuguuaugugcauauauauuuaucucccugauguauucacccuuuuauuguuuuaaaauauccuuuuuugucucuaguaauaauuugucugaaguauauuuuuucugauauucguaaagcuacucuaguucucuucugguuuuuuuuauagcauacuuuacucuuuacucuuaacauauuugugccauuggaucuaaaguauuuucuagaaagcacauaguuggauaagauuuaaaaaucuauuuugcuaaucucugccuuuuuauuagaauuuuuaauucauuuauguuuaagguaauuaccuacaaguuaaaaguuauguuuacuauuuuacuauuuguuuuuuauaugucuuauguauuuuguuccuuuaucacuccauuauugcauacuuuuguguagcuagauguuuucuguuuuaauuccauuuuuuuuuuuuuuacccuuaguuacuuuuugaaugacugcuuggagacugcaaguaacaccuuagcuucaaaauaucuaguucauauuaauucuaaacuaauuucgauuuuaaacaaagacuuugcuuuaauauaccacuauucccuccccauucucugugcuguugucaaccaaauuauaugcuuauacauuauaaugucaucaauaauuucauaauuauuucuuuaugcauuuauuuuuuaaauuagaagaaaaaaguuaacaaauaagaucaaauuagaacaaaauauaauucuuuuuaaauuaaaauccugcuucuguaaaaaaauacauuucuauugucuauuauauuuacuuaauuauugguuacauuuguuuauauauucauguggauucaaaucacuguuuagcauccuuguauuucacuuugaaggauucuauuaugaaauccuuuuuuuguucagggcuucaagugacaacuuuucucaguuuuuaucugaauaacuuacuuaauuucuccuucuuuuuuuuuuuuuuuuuuuuuuuugagauggagucucgcucugucacccaggcuggagugcaguggcacaaucuucgcucacugcaagcuccaccuccuggguacacaccauucuccugccucagccucccgaguagcugggacuacaggcaccugccaccaugaccagcuaauuuuuuuguauuuuuaguagagaugggguuucacuguguuagccagaauggucucgaucuccugaccucaugauccgccugccuuggccucccaaagugcugggauuacaggcaugagccacugugcccagccucuccuucauuuuugaagcacaauuuugauggauggagaauucuuuguugacacucuuuucaugagcacuucgauauguugucccacugccuucugauguccaugguuucugaugagaaaucagcuguuagucucauuugaaacuuucuuguacauuaugaggguuuuuuuuuuuuucucuugcugcucucaagauucucuuucagucuuuggcuuuuaacaguuugauuguaugucuugguguggauuucuuagaguuuauucuacuuggaauuuguugagguucuaggauguauagauuaauguauuucaucccauuuuguaaguuuuggccauuauuucuucaaauauucuuuuguuccuuucucugucucaucuccuuuagggaauccuauauauguuguugcaauucaugauguuccacagauuguuaaggcucugcucuauuaaaauuuuuuaaaauucuuuuuucuaucuauuucucaaauuagguaaugucaauugaccuaucuucaaguuugcugauucuuuauuaugccuccucauaucggcuguaaaauccuucuauugaauuuuucauuucauuuacuacgcaaauauaaaccagaauuucuauuugguaauuugguaauuuuuucauugauacucuccauucaaugagauaucauccuuauacuuuccuuuaguucuucagacacaguuuucuuugauucucuaaacauacuaugauaguggauuuaaaguuuuuuucuugaaagucuaacaucugggcuuacuuggggguaguuucuacuauuaguuuuuuaucccuguguaugggccguacuuuccuguuucuuugcauuucuuauuuuuuuucacuucuugcuuguguagggccauaaagucaucuagagguaauaaauuagggccuuuuaaggucuuuucugcacaugcacacagucuuacacauguaucccaggaauauguuggagcuuuucaaauuccacuguggacauccauuucccaaaucuuccccuuaagauuuuuggggcugggcaugguggcucaugccuguaaucccaacaccuugggaggcccagacgggcagaucacuugaggucaggaguucgaggcuagcguggccaacauggugaaauuagcugggcaaaauuagccggacaugguggcacacaccuguagucccagcuacucaggaggcuaaggcaggagaaucucuugaaccugggaggcagagguugcagugagccaagauugugccacugcacuccugccugggugacagggcaagacuccgucucaaaaaaaaaaaaaaaaaagauuuuuggauagucuuuuguuuggcuuucacaugacugcaguguuaaauaauugccacugauugcuuuuaaccaauacccuggggauagggcuuuccuaccucggaagcucugaaucagaucaaauaagcucuggccgggugcaguggcucaugccuguaaucccagcacuuugggaggcggaggcgggcagaucaccugaggucgggaguucgagaccagccugaccaacauggagaaaccccaucucuacuaaaaauacaaaauuagcugagcgugguggcacaugccuguaaucccagcuacucgggaggcugaggcaggagaaucacuugaacccaggaggcaaagguuguggucagcugagaucacgccauuacacuccagccugggcaacaagagugaaacuccaucucaaaaaaaaaaaaaaaaggaagcucugcaaaugagguuuuuccagugagcucccagacaggucagauggugacaguuuucuggggauggagcucuucuucagaguuccaaaccuccucauccccuuuucaugaugguuaggcugcuaauuuucacaaccacugugaauacaaggcugcuaguuuucaagguugccacagaguuggcuagagaggaaugagaauagggugaguuaaaacaacacaaagcucacucuucuuaccaauauucagccauuuucuucuuaaauaagcaugccuuaguuuguugaaagcuucaggcuaauuucuagaauucugaaaaaguuguuuuuaacaauuuuuuccaguguucucauaguuucguggaagagcagacuuuuggaagugcuuacccugccauuccagaagucucuuauguauaggugcuaugguuugaauguuuucucaccaaaacugagguguugccugugugacaguaucaagagguggggccuuuaagaggugauuaggccaugagagcuucuccuucaugaauagguauaaggcccuuauaaaagauccuucaugccagguacaguggcuugcgcuuauaaucccagcuacucagagggcugaggcagaagaaucacuugaggccaggaguuugagaccagccuggaaaacauaguaagaauccacuucuaaaaacuuaaaaaaaauaaauaaauuagcccggcaugguggcaugugccuguagucccagcuacucaggaggcugaggcaggaugauccuuugaguuaaggaguucguggcuucauugagcuaugaucacaucacugcaccuuagccuggaugacacagcaagaccucauuuguaaaugaaaaaaaaaaaaaaaaagagucucaugcagcauuugguuagcuugcccuucuaucuucuaccaugugaggacucagcaagaaggcccucacuagaggcuggugccuugaucuuggauuucccagccuccagaacugugagaaaauuaauuucuguucuuuauaaauuacccagucacugguauuuuguuauagcagcacaaauaaacuaagacgauagguuaagcaaaauggaaauuaaauauaaacaaaaacucuuugagauugaguuuauuuugauucacuaggaaauuaauaguuccauguauuuucuuauaauaauauuuuaaagaucuaaagcaaauaaaguaaaaucuuaaaaguuauuaaaguugagugguagguacgugaauauuuguuauauuuuacauuuucuaguuagggaaauaauaacaaacauaaaaaaaucuuuuuaaaagaaauauaauuaagacuaguuuugcaauguaguccuaaggggaaguccaaagaaggaacccagaaaggagguaagaggugagggccuaaaagugccauuggcuguaguuuacauucaaacauuaacagauaguuauuaacugcuucccagaugcaaugguaagaguuuguacugcccuuaaggggguacucacuggugaaggguuagacaagcaagcaggugugcaugguauaguuucaaaagauagcuaagugcuaggugcuaggggaauuuccacaaaaggagggccuuuaauccacagcugcugaggaagagcugggaagaccucucagaagagguaacaucuuagucaagcuuuauaaaggaugaauaaaaguugacggccgggcgugguggcucacgccuguaaucccagcccuuugggaggccgaggcaggaggaucaccugaggucaagagcucaagaccagccuggccaacauggcaaaacccuuucuuuacuaaaaauacaaaaauuagcugggcacgguggugggcgccuguaaucccagcugcucaggaggcugaggcaggaaucccucacuugaacccaggaggcagagguuacagugagccgagaccacgccacugcacuccugcuggggaaacagagugagacucugucucaaaaaaaaaaaaaaagaaaauugacaaggagauagaagugucuuggugucuugugcaggggaaaauguacuugccaaacugguuuuuaauggccagacucaaggaacaagguaauggguggugaacaagaacaauucacauaggccaugccaauuguugaguuuaaauccuggaggcuauugcucuuuggaagauuuuaagguggagaaauagcaggggaagaagggcagugaguacacuggcuccagagaugagggcuggaaucuggugucaaauucuggcucugaaacuuacuaccuuggaucuuggacaaguuacgcaaggucucuaugcauugguuuucucaucuguaaaauggagauaauauugucuaccucacagagcuguucucagcuuuaaauaagcuaacugauguuaaucacucagagguauaucuaaccacauuguaaaugcuuagcagcuacuaggaaauucaagcaauuuuauguaaagauuggaucaugcuuuagaaagauggcuuugacagcacuguggagcagcuaugaugggaguggggagauugcaggccaagagaccuuuagacgauuggugcaaucaagguguaggccuaggagcagcagucagcaucaccugguguauuaguccauuuucacacugcugauaaagacauaccugacacuggguaauuuauacaggaaaaaggguuuaauggacguacaguuaguuaguucccugugacuggggaagccucacaaucguggcagaaggcaaggaggagcaagucuuaccuuacauggauggcagcaggcagaaagagagaacuuguauagggaaacuccuucuuauagaaccaucagaucuugugagacuuauucacugucacaagaacagcacgggaaagaccugcccccgugauccaauuaccucccaaagggucucucccacaacacgugggaauucaagaugcgauuuggguggcaacacagccaaaccauaucaccuaggaacuuguuacaaguguagacuuucuggaauggggcccagcaaucuaaggagcaccaaaagucccuccaggugaaucuuauguacaucuaaguuugcaaaaagagaacugaauaaguuugcaaaaaaauuugcaaaaagagaacucagcuggucaagcugagaagaaaugagaaacugaauaaaaccuaaccauauggagggcuccucauggccuagguacugaacauuaacugguuuaaacaguaaaucaaagguuauccucauuuuauagauaaaccaaggcuuagaaaauguggcugaaguccuuguucggccucauggcuggcaaguggugacacuaggaaucagacccaaaaccugugcucuuaaccacuaggcucuucucauaaucagaaagugauugaggagaaggggaauuucagaaaucauaaaguaauagaauuaacaaggcuuaccgggugauuugcuauggucauggagucauuguggacucccaagucccuggauuuggauaaauauugaugacauucugugauucaggcugcaugaaugaaacggcacguguaaauucuaagaaauuuuuuuuaacauaaggaguuugaggucccuacaggaaaacagaauguagagucccuguaguuuggacacucaggcugggaauaaaaauuugggaggccuaaguauacagguggaugcagcugaagaugugggugugagugagacaaucuuaggcaaguauggcaggagaaaagaaagcgggccaagggcagaacccuggggaacagguagaagaagaagcuucugcaaaguagacaguaaaaagaaccaaacagagguaaaggagaaaagggaaaggacccagacauccaggagaaaaucagcucaaagucagcucaaagagaggcugggccagcaugguuguugcugagaaucucagccuuacugcaaggcagaaucaaauuacuaucccucuccuaccaccccuccccuaugaauaaacugggauacaugacaccaacaacaaaaaggcucucccgggugguagaauguuaggagaggguacccuaggccugaggcagucauuaauaaaagcuuaucaggaugcugacagaaugccaguguacgugcccucuaaaauuguaauuagugagauuguacuccuuaacaugcaacuugguguaauagcaguaaucuugaugaacuguggucaguauggauucagggaggucauccguacuaauaaaagucuaauucaucacaguuaauacacuuuggguuucauauuacacucccagugccuuuaagcacuuauggugagcauaauacuuauuauuuuccaccucaguucuagugucagagccagcacauauacaaacaaacaaacaaacgaaaccuaacuguauguauguagucuaauggccgcucaaauaucugaaagggcagauauggauuugaagucucacacauaaggaaacauuuauugagugcuucugguggccaacauuuuacauagguuauuucauuuuauccucauaagcacccucugagauaguuacagaaagagccagacuuagugaacaaaugaaguugaguuuuacagugcuauuaacuagcuaaggucauacaaauaguaacuggagcuaagauuugaaaccccuguccaucucauugcaaguucauauuauuuucauuaaugaugccagaauggaauugguauuaaaucaucuugcacauuuuacaagaaugucauacaauuccaguaaauaagcugaaugaaaccacuuuuaaacuuugagaagaagaaagcgauauguaggcaggauauuuuuuauuuccaccaugaauaucagaaguagcaucugaaaauauaaaagaggccucaaaauaaucucuaaaagcacauucuuauuaauaguuuccaaaaagaaaaccuuaaucuauuuccauuuuuuucuugacuuugcuguuuaucaguacccccaggagcucauuuuuauacauacuacuuuauggaaaccaccuaccccucuacugucacccuuaauauacacagccccauagaauuucuccuuuccuugcuauucuacugagccauagagcagaacuggcaagagaaaacaaaagagagcaagccguuaaccucucugccucaguggcuguuuuauaaaaugacaugacuucauuauauuccugauaucagaacaacucccugccaccaccaccacccuacagccucccugaaguuuucagcaaccaugaagaaaagacugagcacaagcuggcccauggaaacuugggaaacuuuuuuaccucaugccugcagauaccgugggaguagacuuugagcugcuucaugccugucucagacaaaauuuuacagacugucuccuauuuuccauuuuacaguuuccaaaucagcaacugcuauggucuaaacaugccuccccaccugaauucauauguugaaacuuagucacaaaaguuaguacuaaaagauagggccuuuaggagacgauuaaggauuagugaccuuaugaaagagguugaaaggagugcccucgugccuuuugcucuuuuaugucuucgccauguaaggacacagcauucaucccucuucccccacuuuuuuuuguuuguuuguucguuuauuaauuugccccucugccuuuuccaccaugagaggaugccauaagaaaguggcacuuauggaucaggcccuccccagauacugaauuugccaggaccuagaucuuggacuucccggccucuagaacuguaaaaaauaauuuucuguuaucuauaaaucaccuagucucagguauuuuguuauagcagccuaaauggacuacgacaacaaccuccuccugucacuauuauaauaauaucaauaaccaagagaugccaaagugggaauuuggguauuucaucauuuagaggacuaccaauuagagucagacuucuagaugggcccaggcucccaauauuuuugcuuccaaauauguuuuucaaagccauauaucuccuuccccauagauagcauccauacaucaaaauccucaguuauaugaaauaagagaaagaaggccucuaaugugccuacuacauucuacucacaacacaggauauagaaacaaucucuguugagaaaaaaaaaggaaagcuuccagaaguucuuccuuugguauacuccaccagaccuuaggaaaggaaugggaugucagagaagacuucuaaucaaaauaagaggaggaagaaauuuuagacaaauggacuugaucucaaaaaccacaccuacccucccucuugaaaaggggcccaaaaugguucaccuccacuuucuuuuauuacuuuccuuuauaagcugcugucacaggcuccagaggacugguaaguucucuuccagagaaauucagacaggucagaagauuguauuucugagaaguacugagggcuggaagaaucagauguccuugucuguuugauaaagcaagaggucagugcaauuauggcagaaaauucaugaagauaccacaggcgcaagcuggaaaguagugguuaugguggcuuuguagauuccagugaccuggaaagaaaaccaugggaacaaacaauuguugagcaacaacuauguaccaggaugcauauugcugaaaccaaaagagguaaggucauuugccugagggcauuuagcuagacugugaagcuagguugucugacuccaaagcuuauguucuuuucaucacacucugugacagaauagcucuucucugacuugugaauggcagcuauguauucuguccuuuuuuuuuuuuuuuugagagagagucucacucugucacccaugcuggagugcaguggugcgaucauagcucacugcagccucaaacuccugggcucaaaggguccucccaccucagccuccugaguaguaggacuauaggugcauaccaccaugccuggauaauuuuuuaaaauuuauauuuuuguggagacaggucucgcuguguugcccaggcuggucucaaacuccugggcucaagugauccaccucagccucccaacgugcugggauuacaggcaugagccaccacaccagacgauucucuauaccuuaaagcagcaacaccagcaguccaugaggagguuuuagccaauuuaacuuacccgcuaaugaugcuguucccaaacagcuuucuauaagggccacugaguggaaaauagggcaacaaggguucauaguagcaucuuccucugccugugggggaagaaaagagaaagaaagagcaaagucuaacagggcugaccuaucaccuucuugucuccuuaccacaucccauacuccuucagcccauuuuauuuuagggcuugaacacaagagaccauuuuaaaauuacuccuuuguaauaguagcaguagagauaaccaaagggcuaaagagauuucaccaaaugguuaaaguggagccacuuuauuuuccuguaaguggcagcaugaaauuaccuucauucuauucuguuaggguuagguauuccaguauuucaaagagcgauccuacccucaccuuuguccauuucucuaucacucaauaggucaccccagaauaauuugugaauacucaaaguguacgaaaaauguauuacaagggcugucuuuacacauaaauggaguugcucaucaccuaccugauacacuuugaaaagcacauggaaggcuuucuuacuuacauauauaacuccuacuagcauaugacauuuccugaaaucccaccauugaggauuccugcccuuguguuaguagaucaauugcuauuauagaaacuugcuauucucagguguucaacuaacaccuaggauccucaaaccaaggcaacaggaauccuaaugaggggaugggggugaagagggaggaaguagagguggcagauuuugaaggcuuggagcaugcuuaugaagaacaaauaugaguacagugccucaguacagagaaguccuuuuuuuuuuuuuuugagagauaagagucuuacucuauagcccaagcuggagugcaauggcaugaucucagcucacugcaaccuccgccucccggguucaagugauucuccugccucagccuccugaguagcugggauuacagaugugcaucaccacgccuagcuaauuuuguauuuuuuuuuuuuuuuuuuuuuuuuaguagagaugggguuucaccauguuggucaggcuggucuugaaauccugaccugaggugauccacccaccucgggauuacaggcaugagccaccgccccuggcccacagaaaaguuguaaaguauuggguguuaagggaugggucacauccagggaggagauagaguauccuuugagauaagagucaacucccauucacaguuucuacaaagaaaauaaaguaccuaggaauacaacuuacaagggaucugaaggaccucuucaaggagaacuacaaaccacugcucaacgaaauaagagaggacacaaacaaauggaaaaauguuucaugcucauggauaggaagaucaauaucaugaaaauggccauacuacccaaaguaauuuauagauucaaugcuauccccaucaagcuaccauugacuuucuucacagaauuagaaaaaacugcuuuaaauuucauauggaaccaaaaaagagcccguagagccaagagaauccuaagcaaacagaacaaagcuggaggcaucaugcuaccugacuucaaacuauacuacaaggcuacgauaaccaaaacagcaugguacugguaccaaaacagagauauagaccaauggaacagaacagaggccucagaaaaaaaugugacacaucuacaacuaucugaucuuugacaaagcugacaaaaacaagcaauggggaaaggauucccuauuuaauaaaugggguugggauaacuggcuagcuauauguagaaaaccgaaaaugcaccccuuccuuauaccuuauacaaaaauuaacucgagauggauuaaagacuucaacguaagaccuaaaaccauaaaaacccuagaagaaaaccugggcaauaccauucaggacauaggcaugggcaaagacuucaugacuaaaacaccaaaagcaauggcaacaaaagcccaaacugacaaauaagauauaauucaacuaaagagcuucugcacagcaaaaggaacuaucaucagagugaacaggcaaccuacagaaugggagaaaauuuuugcaaucuguccaucugacaaagggcuaauauccagaaucugcaaggaacuuaaacaaauuuacaagaaaaaagcaaacaaccccaucaaaaagugggugaaggauacgaacagacacuucucaaaagaagacauuuaugcagccaacaaacuuaugaaaaaaaagcucaucaucacuggucauuagagaaaugcaaaucaaaaccacaaugagauacuaucucaugccaguuagaauggugaucauuaaagucaggaaacaacagaugcuggagaggauguggagaaauaggaacacuuuuacacuguuggugggagcguaaauuaguucagccauuguggaagacaguguggcgauuccucaaggaucuagaaccagaauuaccauuugacccagcaaucccauuacuguguauauacucaaaggaucauaaaucaugccacuauaaagacacauacacguguauguuuauuguggcacuguucacaauagcaaagacuuggaaccaacccaaauggccaucaaugauagacuggauaaagaaaauguggcacauauacaccauauaauaccaugcagccauaaagaaggaugaguucauguccuuugcagggauguggaugaagcuggaaaccaucaaucucagcaaaguaacacaggaacagaaaaccaaacacugcauguucucauuuauaagugggagucaaacaaugagaacacauggacacacagaggggaccaucacacacuggggccugucggggggguggaggacuaggggagguaggggagggauagcauuaggagaaauaucuaauguagaugacggguugaugggugcagcaaaccaccauggcacguguauaccuauguaacaaaccugcauguucugcacauguaucccagaacuuaaaguacaauaaaaaaauaaaagaaaauguggcacauauacaccauggaauacuaugcagccauaaaaaagaaugaguucauguccuuugcagggacauggaugaagcuggaagccaucauucucagcaaacuaacacaggaacagaaaaccaaacaccacauguucucacugauaagugagaguugaacaaugagaacauaugggcacagggaggggaacaucacacacugaggccugucaggggguggggggcaaggggaaggauagaugacuaguugaugagugcagcaaaccaccacggcacauguauacuuguguaacaaaccuacacauucuccacauguaucccagaacuuaaaguauaauuaaaaaaaaaaaaaaagagugagccaucuugcaguuuugacugagcuuuguucugcuuauugaauagguaaguaacccaaacggaaagaaguggugagcaaugcaggaagugcucaagccugauguaaaacaggaaaacuucuguuucaugguuuguguugcacagcgccccucggccaaagaggaaagagcuaauuuugagauaaguaaccauugcuucuaauucuuuagaaagugcuuuugacuguagacagacaugcuaaaggcugugccucauuguuugaaguccagauacguacaacuacuccuuguuguuacuguaaaaauaguuccugaaagaaugacuaaaaagaauaggagaugcaagauuaaaauaacaugaaugggagaggaaguacaagacuaaaacuuccucaugucagagguaagauugcuuuauuucccaacuaaauaaaaucaggucauguaugauuguuaauggcaauucuugccaggaacuuaaccaaaguuaaaauaauuuuacagguugcucuaacuuucccaguuucuggacauucccaauagaugacuuuguuauuuucaaggacauucuugggguuugaacacauuguuucuuuuuugcagugcuuuucagcauaugauugaacguacucaagaagggucaugguuaguucagcaagcugauuucaacauuuggugauugucuccaguuaaugagcuauacauaugauguccgcuuuuauuuucaucaucauaaaccacagaaaaaaggggaaacaguauaccagcaagucagcaaguccaaaucaagccaugacucagauuuccuaagaaagaaaagaucagacucugcuuugacauauucuaucuuaaauuuugaaauuacuuuggggacaacauuaauuauccaggucagugugggggaauagcaguuccuccuugaucauccucuucauaugguauaaucacuaacuucacagaucuguacugaaaaguuguuuaccuuuggggaaauggcucauuauaaguauguauauagggaauaguaauauaagaaaaaaucauaaagauuugaggguaaguagagaagaucagacccuguggaaguuaauagcauggcccuuggaaccagauuaccuagauucaaaucccaucuucucuucuuaauaccucugugaccuuggacaaauuacuuacccuuuuugugucuuaguucaaccaucugcaagauggggauaugagaguauuauuaguagauugaugugaggauuaugugaaugaguguuuguaaagcacuuagaacaaugcuuguuacagaguaggugcucaauaaaugugaccuguaauuguuauccuucaguaauugguaaauuuuaugucuguagucauagaguuugguucuuaacccaggcccggugccauucaagacacugcagaacauagugcauauuccuucauguuuaucuagguuuuuuucuccuuuuuaauguuaccuuuagucccauacuagucauuaucaaccuguggucaccagucagggaaguacauucguauugauugcugcaaaugcaaaggugcuuucagagcagagauccuugauuuuaagggacucccauuaagguugaaaagaugggacaaguccguuuuuccugccaagaaagacauggcuuccaugaaaucuuauuuacuauauuuuuguaucuaacaaguucucuaggaagccucucauuuuugaaucguaaaaaaggucuguauucaaagcaaaaauccuuuaaaaaaaucuuugauaauucugaucucugugcuuugcuagcccagauuuuuauuaucugacccuaugguauccauaagcaugguuuuaaagguauguccacaaguuauuugauacuucucucauugcgguggaacuuaauucuucucccuuugagugcagggaggacuuuaugauuccuuuguagugaaugaauauagcagaagugaugggauaauacuucugagacuggguuauauaaagacuggcuucugacuuugguuugcuccuuugcucuuugucucuggaaucacaugcucagggggaaaucaacugccaugucaugaagagaugauacuugggcagccaguggagagaccuacauggugaggaacugagguuugccagaauccaugugaaugcacuugggaauguacccuccccuacuugagcuuuuuuuuuuuuuuuuuuugagauggaauuuugcucuuguugcccaggcuagagugcaaugguacgaucucagcucaccgcaaccuccaccucccagguucaagugauucuccugccucagccuuccgaguagcugggauuacaggcaugcgccaccaugcccggcuaauuuuuuuuuuuuuuuuuuuuugguauuuuuaguagagacgggguuucuccauguuggucaggcuggucuugaacucccgaccucaggugaucugccugccucagccucccaaagugcugggauuacgggcgugagccacuguacccagccccuacuugagcuuuugagaugacugacagcuugaccacaagcucaugagagauccugaggcacaaccacccuacuaagccccucaggauucuugauccucagaaacucugagauaauaaauauuuguugucuuaagcugcaauuauguugaaugaaucuaucuuguguucauuucuucagcaagacugggucacauugccucauaaaaauguaugacaguggccgggcgcgguggcucacgccuguaaucccagcacuuugggaggccgaggcgggcggaucacgaggucaggagaucgagaccaucccggcuaaaauggugaaaccccgucucuacuaaaaaauacgaaaaauuagccgggcguaguggcgggcgccuguagucccagcuacucgggaggcugaggcaggagaauggcgugaacccgggaggcggagcuugcagugagccgagaucccgccgcugcacuccagccugggcgacagagcgagacuccgucucaaaaaaaaaaaaaaaaaaauguaugacagaggguugguuguagguugcaaauaucaauaaacauaguuaagaguuuuauuuuucuuguauuuuuuagagacagggucucucucugucacccaggcuggaguacaguggcacaaucauagcccacugcagccucaaacuucuggacucaaccaauucucugaccucagccuccugagcagcuagaacuacaagcaugugccaucaugccuggcuaauuuuuauuuauguguagaaacguggucucacuauguugcccaggcucaaacuucuggucucaagagauccucuugccuuggccucccaaaaugcugggauuuguuuuaaaaaaaaaaaaaaaaaaaaaaaaaaagcaaaauugacuccauccugacaucuuuuucauucuuuauugucagcacaucuuuuugguaaauauuauagucuagucuccccucuuaagugauuaaucugaaaaucaugugaacauucuuccauuuccuuuagugauucugucagaggcaugugaaccagagcaacucuaucuuaaaugggagcugggaaaaaugagcugaaaucuaccgggcugcauucccaggcaguuaaggcauucuaagucacaggagagauaggaagucagcaaaaaauacaggucauaaaaaccuugcugauaaaacagguugcaguaaaggagcuggccaaaaccagaaccaaaauggugacgagaaugaccucuaguccuccucacugcuacccucccaccagcaccaugacaguuuacaaauggcauggcaacgucaggaaguuacccuauaugguuagaaaggggcagcaugaauaauccaccccuuauuuagcauaacaucaacaaauaaccauaaaaauggacaaccagcagcccuuggggcugcuccgucuauggaguagccauucuuuuauuccuuuacuuucuuaauaaacuggcuuucacuuugcacuguggacucgcccugaauucuuuccugagcgagauccaagaacucucuuuuggggucuggacuaggacccuuuuccuguaacaauuuugccucucaccaauuaagaaugagacaauucugaggacucuccuuuggaaaaaugaucaagguucuuggaacucagccauguuaggaaguaaggugacugaauggggaagcaguaaggagggggcguguauuuuuucauccgaagcuguucuaguguuggaacuuucaagguuccagccucacuuggaauuuuaugaaacucauaccucauauuuuauuuuuuauguuuuauuuuuugagacagagucucgcucugucgcccaggcuggagugcaggggugcgaucucggcucacugcaagcucugccucccgguuucaugccauucuccugccucagccucccgaguagcugggacuacaggugcccgccaccacacccggcuaauuuuuguauuuuuaauagagacggguuucacuguguuaggauggucuccaucuccugaccucgugauccgcccgccucggccucccaaagugcugggauuacaggcgugagccacugcgcccggccauaccucauauuuuaaaugauaacaaauaacuucuuccguguggcaaauuuagauagaaagcauugaaagaaccugcuucccaucugcugaucaaacuggagccugaaucaaauaaacuucuccaaauaaaugcuacaauccugauuucugcaagcuuuuggacuuuuaaaacuugguguuccuaucucaggcaacauauaccucuuuggaaacuggguauaaaucuacuggguuuggauguggaauggguugguuauuucauuugugugcucucuuuaaggucaugagaauuugccaugguucaugaucauaguuuaaacaauauuagcuggcuaagugcuggugcuuagugaaauacacucuuuuaucuuuagacaccccuuugcuuucuucuuugauaugaagccauuucucucgagugacacuucagcauuuuuuuaauugaaauuguaaguacaauacauaguuugaucauucuggucucagagauuuaauucuuaaguagugcuaagaccucgcccaccuuuuaaaaccucaccuggaugucauucauccauuguaucgagggacugauauaacauguguacuuaauuuaagauccuuaaggguggguauuuuccauuaccauuaguuaaaauuugcaaguaagagcaacauguucccugacucuacauaaaguuaaacaugcgaacugaaaauagaaugagagaaaaucgagcaugguuauuuacuuucugcagugcucuaauugggcacuauagcauauggccaaaaccuuuacuauuaauuaaucacaaaaaauccauauggaugauuugugaacauucuaaagucagagugggaauuugcuucuuuucuaugugaggacuaaucucugauuuuuuuuuuaucuugcccaaauuccuaucuaaggggucuggggaaucauacccuacaaaccauaaauucucaucagauggguuuuauuuaacccuauauauugugacuuauuuuccaaccugacucuggcauaacauuacaagacaauuaagaaaauaaaauuauuuuauccccaaaacauguuuauuugccguaucuugaaauggcccugcaaagcuguccuuugugggggaaaauuugcaucuguaaagaaucucuguuaacauaccuagaucuguuucuuccaggccuuuccaauccuaaagagguuaccuaagagucuagcaccuuuuaaagaucugaacaggaaacauuugucaucuacugucucuaagggcauucacuauaggacuucaaaggaaccuuggccuccacaaucuuuuaucuuaaccuggacauuuucuuucugucaacuccaggucuuuagacaaacucaaccaaugacaaacucaaccaacugucaaccagaaaauguuuaaauuuaccuauagccuggagaugccuccccccacuggccccgcccuggcuuugaguuguccugccuuucuggaccaaaccaauguauuucuuaaauguauuugauugaugucucaugccucccuaaaagguuuaaaaccaagcugcacccugaccaccuugggcacauguucgcaggaucuccugagggcugugucaugguccauggucacucauauuuggcucagaaaaauauuuuacagaguuugacucuuuuuuauugaugauguuuucuuucuaaacacauuuuuucacuuugggaggccaaggcaggcagaucacaaggucaggagaucgagaccauccuggcuaacacagugaaaccccaucucuacuaaaaauacaaaaaauuagccaggugguggugggcgccuguagucccagcuacucgggaggcugaggcaggagaauggugugaacccaggaggcggagcuugcagugagcugagaucacaccacugcacuccagccuggacaacagagugagacugugccucaaaaaacaaacaaacaaaacaaaaaacacacacacaauuuucuuaaagggugccuggaucucuauuaauacuuagaauuugguaauguuuaaaagcuuugacauuucuuaaugucagaaauuuccauauugagauuugacauauauuuggacucacauuaaaugagacguacuagucaucaucauuguuaaaaaauauuuuuaaauuuuuaaguauggaagauaaaauaaaaacccguucucauucauuuacuuauucaacuccccaccaccacacauacauauacauacucauacaugcacgcaauacaaaccuuccuccccaccacccuuggcuaacuccccauucaucagucaaaacucagcucaaauaguugcuccuuguaucacggcaggcugguuucugugguugguucugucaacuucaacuguaauagaaauguuguuuuucuauucuuccuucuuuggccucccauuaagcugucacuucuuuaccuagggaaugcaucuuuuguuucugaguucacaacacuaccagaaugccuggcauggcagaaagugcuuguuaaaugccugcugaaugaaugaauaacuucagccaccagccuagcaagcagaugaguucagagguuauauaaacaacauucauaagcucagccagaaucuuguuugagccagagcagcagaagcccagaaagucagggacaaugccacccuggggcuuauaaguccuucaggggcuacacaaggccagaccaacucaggaaaccaccugcgaaggugcccucccuccccaguuccaugccaccuggcaguuuugugcugucuaugggccuagaccaacucaaagugaagaaguucucugaaaaccuuuuacuuauuaaagaacuccaauaagcaaaauagguagacauauuuucccugguggagcccuaagcaaaauucaauuaugugaaucguacuuaauauuuaaaaacauuguggguuuuuuuggccaggcaccguggcucacgccuguaaucccagcacuuugggaggcugaggcgggugaaucacgaggucaggaguucgagacaagccuggccaucauggugaaaccccgucucuacuaaaaauacaaaaaauuagcugggcguaguggcaggcuccuguaaucccagcuacucaggaggcugaggcaggagaauugcuugaacugaggacacggagguugcagugagcugagaucacgccagugcacuccagccuggccaacagaguaagauucugucucaaaaaaaaaaaaaaauuguuauuuuuuuuuuuuuucaaaucagugguugacuucauuacauuugccuggaaaauagacugguaacaagugaaaaacuaccugaagaagccaguucaacuuagagugaauccaaaagggcaguggggccaugagaagcuucauuucuuagcagucaaccagagggaguuuccagggguccugggaggaggguuuagauaagugaaaguugugccccuugcagugcucuuauuuuucaguuuaaaagaugccuccugccauccacauguuaugcaguuggggauuucaacccacuuacagcauagucuucccuauuuaaucauagaaucuccucauuuuuaacugaccuggccagcuucuuuaucaauuuuguucacauacugcgggccucaaguguucauuuaaacguuugggacuguaacugcuaaagcuguuuucacauguggaaaauaugagccuuuaaguuucguuuagcagaugcucaagccagcagccagcaauaugccccacuucuaggguggugcccagaguacuggacugagcagcugaaaugcagcuuaaguucugguuuuauugcaaaucagccaccaauguugaauugguuucuuagucccugagucuguugccuuauuugaugaauuaaaauaaguaauauaauucaggacccuugggagaaguguuuuauaucacuuugcuaacacugaagacucuccaguucucucucugaugcacuggaaacauugcguucuaaauacccuaagagcccuuucagcaguaaauuggucucagggugcuggagaggauguaucuggugguguuucgaaagugaucaacuccucccacucacuuuaccccuugggcuuguaacuuucuuguuucuggccuccaaggaaaucacaucuuccagcucagccaugaauuaaaaaaacaauuaaaaauauuuuauaccucauuuguaugcuguaccagaaagauuuauuugaauaucucauuuguauauugcucuguguauguuuuuuugagacggagucuugcucugucacccaggguagagugcaguggugcgauuuugguucacugcaaccucugccuccuggguucaagcaauucuccugccucagccucccgaguagcugggauuacaggcauguaccaacacgcccagcuaauuuuuguauuuuuaguagagaugggguuucaccauguuggccagacuggucuugaacuccugaccucaaaugauccacccaccuuggccuccuaaagugcugggguuacagacgugagccacugcaccuggccugcccuguauuuauuuauuuauuuauuuauuuauuuauuuauuuauuuuuuagugggagcaaaugcaaguugagcauugaaaauucaaaaucugaaguguuccaaaauucaaaauuuucugaggaccagcugggugcaacucuaaucccaagcacuuugggaggcugaggcaggcagaucacuugagcccaggaguucaaggucagucugggcaacaugguaagauguugcugagagauuuugucaccaccaggccugcccuacaagagcuccugaaggaagcacuacacauggaaaggaacaaccaguaccagccacugcaaaaacaugccaaaauguaaagaccaucgaugcuaagaagaaacugcaucaacuaacgagcaaaauaaccagcuaacaucacaaugacaggaucaacuucacgcauaacaauauuaaccuuaaauguaaaugagcuaaaugcuccaauuaaaagacacagacugccaaauuggauaaagagucaagacccaucagugugcuauauucagcagacccaucucacgugcagagacacacauaggcucaaaauaaagggauggaggaagaucuaccaagcaaauggaaaacaaaaaaaggcaggaguugcaauccuagucucugauaaaacagauuuuaaaccaacaaagaucaaaagagacaaagaaggccauuacauaaugguaaagggaucaauucaacaggaagagcuaaauauccuaaauauauaugcacucaauacaggagcacccagauucauaaagcaaguccuuagagaccuacaaagagacuuagauucccacacaauaauaaugggagacuuuaaccccccacugucaacauuagacagaucaacgagacacaaaguuaacaaggauauccaggaauugaacucagcucugcaccaauggaccugauagacaucuacagagcgcuccaccacaaaucaacagaauauacauucuucucagcaccacaucgcacuuauuccaaaauugaccacauaguuggaaguaaagcacuccucagcaaauguaaaagaacagaaauuauaacaaacugucucucagaccacagugcaaucaaacuacaacucaggauuaagaaacuuaaucaaaaccguucaacuacauggaaacugaacaaccugcuccugaaugacuacuggguguauaacgaaaugaaggcagaaauaaagauguucuuugaaaccaaugagaacaaagacacaacauaccagaaucucuuggacacauuuaaagcaguguguagagggaaauuuauagcacuaaaugcccacaagggaaagcagaaaagaucuaacauugacacccuaacauuacaauuaaagguacuagagaagcaagagcaaacacauucaaaagcuagcagaaggcaagaaauaacuaagaucagaguagaacugaaggagauagauagagacacaaaaaacccuucaaaaaaucaaugagggccaggcgugguggcucaugccuguaaucccagcacuuugcgaggcugagguggguggaucacgaggucaggagaucgagaccguccuggcuaacacagugaaaccguuucucuauuaaaaauacaaaaaauuagccaggcgugguggcaggugccuguagucccagcuacucgggaggcugaggcaggagaaugcuaugaacccaggaggcggagguugcagugagccgagaucaugccacugcacuccagccugggugacagagcgagacucugucucaaaaaaaaaaaaaaaaaaaaaaaaucaaugaauacaggagcugguuuuuugaaaagaucaacaaaauugauagaccgcuagcaagacuaauaaagaagaaaagagagaagaagcaaauagacacaauaaaaaaugauaaaggggauaucaccaccgaucccacagaaauacaaacuaccaucagagaauacuauaaacaccucuaugcaaauaaacuagaaaaucuagaaaaaauugauaaauucuuggacacauacaccaucccgagacuaaaccaggaagaaguugaaucccugaauagaccaauaacaggcucugaaauugaggcaauaauuaauagccuaccaaccaaaaaaaguccaggaccagacggauucacagccgaauucuaccagagguacaaggaggagcugguaccauuccuucugaaacuauuccaaucaauagaaaaagaaggaauccucccuaacucauuuuaugaggccagcaucauccugauaccaaagccgggcagagacacaaccaaaaaagagaauuuuagaccaauauccuugaugaacaucaaugcaaaaauccucaguaaaauacuggcaaaccgaauccagcagcacaucaaaaaguuuauccaccaugaucaagugaucuucaucccugggaugaaaggcugguucaacauacgcaaaucaauaaacguaauccagcauauaaacagaaccaaaaacaaaaaccacaugauuaucucaauggaugcagaaaaggccuuugacaaaauucaacagcccuucaugcuaaaaacucucaauaaauucgguauugaugggacguaucucaaaauaauaagagcuacuuaugacaaacccacagccaauaucauacugaaugggcaaaaucuggaggcauucccuuugaaaacuggcacaagacagggacacccucugucaccacgccuauucaacauaguguuggaaguucuggccagggcaaucaggcaggagaaagaaauaaaggguauucagcuaagaaaagaggaagucaaauugucccuguuugcaggugacaugauugcauauuuagaaaaccccgucaucucagcccaaaaucuccuuaagcucauaggcaacuucagcaaagucucaguauacaaaaucaaugugcaaaaaucacaagcauucuuauacaccaauaacagacaaacagccaaaucaugagagaacucccauucacaauugcuucaaagagaauaaaauaccuaggaauccaacuuacaagggaugugaaggaccucuucaaggagaacuacaaaccacugcucaacaaaauaaaagagguuacaaacaaauggaagaacauuccaugcucauggguaggaagaaucaauauugugaaaauugccauacugcccaagguaauuuauagauucaaugccauccccaucaagcuaccaaugacuuucuucacagaauuggaaaaaacuacuuuaaaguucauauguaaccaaaaaagagcccacauugccaagacaauccuaagccaaaagaacaaagcuggaggcaucaugcuaccugacuucaaacuauacuacaaggcuauaguaaccaaaacagccugguauugauaccaaaacagagauacagaccaauguaacagaacagagcccucagaaauaauaccacacaucuacaaccaucugauuuuugacaaaccugacuaaaacaagaaauggggaaaggauucccuauuuaaugaaugguguugggaaaacuggcuagccauauguagaaagcugaaacuggaucccucccuuacaccuuauacaaaaauuaauucaagauggauuaaagacuuaaauguuagaccuaaaaccauaaaaacccuagaagaaaaccuaggcaauaccauucaggacauaggcaugggcaaggacuucaugacuaaaacaccaaaugcaauggcaacaaaagccaaaauugacaaaugggaucuaauuaaacuaaagagcuucugcacagcaaaagaaacuaccaucagagugaacaggcaaccuacagaaugggagaaaauuuuugcaaucuacuuaucugacaaagggcuaauauccagaaucuacaaagaacucaaacaaauuuacaagaaaaaaccccaucacaaagugggugaaagauaugaacagacacuucucaaaagaagacauuuaugcagucaacagacacaugauaaaaggcucaucaucacuggccaucagagaaaugcaaaucaaaaccacaaugcgauaccaucucauaccaguuagaauggcaaucauuaaaaagucaggaaacaacaggugcuggagagaauguggagaaauaggaauacuuuuacacuguuggugggacuguaaacuaguacaaccauuguggaagacaguguggcgauuccucaaggaucuagaacuagaaauaccauuugacccagccaucucauuacuggguauauacccaaaggauuauauaucaugcugcuguaaagacacaugcacacguauguuuauugcggcauuauucacaauagcaaagacuuggaaccaacccaaauguccaucaaugauagacuguauuaagcaaauguggcauauauacaccauggaauacuaugcugccauaaaaaaggaugaguucauguccuuuguagggacauggaugaagcuggaaaccaucauucucagcaaacuaucacaaggacaaaaaaccaaacacugcauguucucacuuauaagugggaauugaacaaugagaacacuuggacacaggaaggggaacaucacacacuggggccugucgugggguggggggaggggggagggauagcauuaugagauauaccuaauguaaaugacgaguuaaugggugcagcgcaccaacauggcacauauauacauauguaacacaccugcagguugugaacauguacccuagaacuuaaaguauuaaaaaaaaaaaaaaccacggugagacaucaucucuccaaaacauacaaaaauuagauggacgugguagcacauaccucuaaucccagcuaccugggaagcuggggugggaggaucacuugaggugaggagaucgaggcugcaaugagccaggauugugccacugcgcucuagccugggcagcaaagugagauccugucucaaaaaaaaaaccaaaccaaaacaaaacaaaacaaaaaaacccuaaaacaaaaacaagaaacuuucugaguaccaacaugaugcuuaaaggaaaugcucauucgagcauuuuggauuuuggauuuuuggauuugggaugcccaaccugcauaaacuuuaaagaauccuuaaauaaaguuauaugcugcuaaaacuaacugccuccuugccacacuccuaauaagguucuacaucuugcagaaauuuuuaaaagccugauuuagggugucagaccuggguucaaaaucuucgucuucuacucaaaagcaaucugauauuggugagcuucuuauuccauaucuguagaaugggauaggggaugguaauaauaaucccauguaccuugcaggauuuuugugaaacuggauaaggucagguaugugugaacagcaaauggagugucuggcccauuguagcuguuuaguuaauaacauuuccuguugugacuugauaucugguuugagauucuggcauccuguaacuccuccuccucaccagcccugcccuccaucagccugguccccuguacagugugacaccuacucaguaauugcccauagcagaaacagacucaccagcuguucuagagcuggcucucccuggucaaagcuucccaugcagcaaguguuucauaaucagccuguuccugcugccgucugccacuuuucccccgaccuuccuggccaucccuugucccuuccugggcaaaagcaucuaaccaugugguaugguggugucaccugaguguggugucagcaaacccagagcuuuccaagccucccaugaugagucuaugaccuggcguucccuguuccuucugauacuguuuuuucuuucucuggaacuacauuggccaaaacagaaaacagggagucaguaagguuuaucaauauuucacuugcauagccgcagucuuaaguuacugaaaugacagguugauccagugaggaaaaucaaacaacuaucaaaaagaccagucaagucauuguagaccaugacaaaagacccucaguaggaaaggaaaaaaugccuaacaccaagaaacaugaaaguaaaaagcucugaauuugguaaaagugaaguaauuucuauaaaugagucauauuguaucuaggaaauuaggaaaauuucagaaaaguuuuuuuaaaaauucaaaucaacuuuaaaagcugauauccuuuuuucuucuaauaucuuuggcauauauuuguauacacauuucaaguauuuaaaugaaugaaauuggaauuuuuauauauaguucuuuucaaguaaaaaugcuaauguaauauuuauuuuuaaauuuuauaagaaguguuuuauuuuuuacuuaaaauaugagacuuucucaugacaauauauauucuucagaaacacuauaauuaauguccuuguaaugcuuucuuguuuggauaguuaauaaugcauuuugucauacuauagcuacucauuuuggcugucuucauuguuuugcuacuuuaaguaauucuaugaggucaauccuuguacauaaagcucaguucaaaucucugauuauuuccuuaggauaaaauccaagaauuggcauuauuaggucaaagagcauaaacaaguauuuuuuucuauucuuuguuuugaaagugaauuacaaagaaauccucucuuaaaaguugcuccuuucauuugguuuuauucuacagauugcuucuuuaccuccuucuuugugucaagaaccauauuaaacuaugugaauuccucucuguugcaucuuuaagagagaguugaggucucacuuccucccagcuauccucuccaccacccgccaucuccucagacugagacaaguucccuucucugcuaucacccacacccauacaucugggcucucauaguacugucauagcauuuaucaugcugaauucuaagugucuguuugguuuuauuuuggcauuagacaguaagugccuugcggguaaggacuauauuuuauucaucuuuauuucuccagaaaacaccgaguacuuuguacauaguaggcacugaaugagggaacaaggaacacagaaccauuuagucacuacacacacacacacacacacacacacacacaaccauccuguccuauauuauuaaauacaggagauagaagugugagggagaaagagggucaucuucauucaguaauaugcuuguauuuucucagauauagauguauggaugagauaucacuuuuugauauguguccagauaggccagauauaacuaauaucaggauuuuaucaggucauugggaccacagccuuccuggaaacauagcuuuagagucaguuuuauagucugcugagcccaaaacaagcuagauaauuaauaauauuauuggaucaaaauggcccaaaaucugauuagggguuauuuauccuacauguacaugauagcauagucuuuauuuugucccuccaagugaguuuauaagugacuguguucuguuuggauggaaaauaucaucuggaaauaauuuaugaguaacugcagaaccugccaauggcaugcuuuacaagggcuuauuucauucacuuccacguauaucccauaauuuccugauuuucucagguucuuuuguguaaauaccaaauugaccuuauguuuuuguccgccuuuuccccaggggcgaucuaagugucaggaugguguuauugaccuggcaucugcgggggcgacccagaguuuccaugaccugugguuggaaggcccacucauuggggcacugaagcuccugagaguuacuguucucacucaaugggaggccagcgguucucagcaguuuucucugcuucacaccagacuguccaguuagcuucuuauucagccauugccuuuccauacuggagcaaagguuuaugauuuauuaggcuauucccaggaaagcaaguucuaugucuucugugcuuugagcuccacauaauucuuggagauccucacaucaaagacucccucuugguuuuccucuuugucucccuugcaucuuccucuacucacaccccugcugucuggccagccuuacuuaucagggagagcaggaagagaggauucaugggcaggaaaacucacuguuugcuccaucuucguaguccugggguguggcccaaaaccuugguugauagauuuguaaaaagaccuuuaucuugagaauauuguugcuuugugaauuuccacagucuccuugaaauucaaaagcugagcauaacuauuucuuuuucuuugcauuucagccauagcaauccuaauagccccuaggacaaugagugucucaggcugaauggaagagggucauauacaugcaaggggaugggaauuuaauaucucuaaauaucauccuaccaacacauguauauguaaauagauuuauaacuauauggucauuuguauaaggauaaccuaauaauaucaaaggacagguucauuuuaaauuaaaacuauagggaagaguguugauucuacaccaauaacaaaaagguuaaagaaaguguaauucucuuuuaaguaccagaugcuucagacugugccucucauuuucagccuucuucuccccuuuuccugucucugccuuucuccucucugccuuuuauugaaaggcaaaugccccuuguaauaagguucaauuucagaaguuccuguuauaccccacucccauagcauucauaaaaaaagcagagaccguaguuauaauuugcugggaacccuaaaagagaagugagacaacucacugaagaauccucaaauaacacgaagacgugaaaaaauauagcuggugcuucucuggcuuauguaggaagaaucaaagcaaccaugaaauuaauuuuauuuaccauuaaaagauacuggacuuagaauucagguugugauuauguaauuauaaauuaauuucaguagcauuguauaaucugaaaugccagcaauaguuaugagaaguauguuaaugaggaucagaaaagcuugucugcuugaauguaccucaaaauagucaugcccagagaguauauaugaagccuccugcagcaaguggacccacugugguuuccuaagacucuccaaugcaugugaucaguuuacuaggaagcagcucucuuuaauauguucauacuuaacagaaaaggaaggaccagaagguugcccauaggcugcacccaagugugaaauaaacauuauuauuacagcaguugaaaugugaaguugaagaacauuuuaauuucaaaauaguauucaugagaaucagaugacacaucuauacuuuaacucuggugaagugugaaaauuaaaugaacacuccgucagauucugaaaguugaauuaugacccccaccucccucacuaaagagauauuuuuucauauuuaggguggcauaccucauuuguggaaaaggucuuucuggcacucauccccuguuucucaauuuauuguagccaucuuauuaaucacuguguuugcuggggaagagccaaaguauaccuaaaucuagaauuaaacuauauagcacuaggguuuaaaauaauagaauuugucaucaaguugacugccucauauucauccagugucaaacucaauaguugauauguuugcuuaugcaaaaauaucagagaggaaaagaaaauuuuaauuuguaauggaucuauuucucauaaaaugucauuccugccgcucugcucuuuagcacaugaugaggggaagcugaggcagcuucuauuguaaaggaagacccaaggaggugccauuuuaggggaccuucagucuccacccaguucaggggauucacaugagccucccugcauauaugggcgugucccaucacugcuucuucugcuuggaagcccacaaagaugguuugcuauccuaguaccucaggucuugauggaagaaggccuugguguguucuuaauuauauccuuugccucagauguuuuguugucaguguuucacucuucccagucagguuuuagggcugcuaccagucucuccaugaaauagaaacccccuaaugugcuguucugcugaacuuccucauugacugaccuuguacuaugaugucuuucuuccuggggucaguggguacgggauaaagccucuaagcaggguugcccauaugguuguguauguuuggauuaccccacagcucuggacggcaccauucacacuguggucauugucgauuuaaauauguauuauggccauuuuauggagaugguaguaaagggucuugaugaagacauaccuuuuucugguuugcacacaaaaaauuaaacacaagguagcaauggccugcccugauguugaaagcaagacucuggcaacaggcuagguggguucuaccccuuacuagcugugugaccuugggcuagucacauaaucucaguuuuaucaucuguaagaugggaauaauaauaguacaucauaggcuauuaggauuaaagaaauuauguaugccaaggacuaaguacagagccugacgcauggugaaugcucaguauauggcagcugucacaauguggcccauuuguguccuuccauauagauagaucauuuuccaauuuccaauuacuuucuacacauccucucuuaacauaaaaugacuuucaagcccauuacuacaagacuuauuacaggggaccuauggacuugugauuugaaucguaauuaguauuaauuuaauagucucuucacagaguuagacuaauaugucaggugacacagugucuuagcccagccacacacauugauaugacucugaugauggccugccucucagugaagucagagcaggggguacaaggacucaggcaauagacaagagagaaaagaaagauuaaagcuuacuguuuauaguguuuuccacacaagguaucaucccugacaagucuuucuaugccauggcauugauuauuagaagaaagacucguaaaaaccucuaggcaggucagauuuuggcagacuuaaagauuaugcagacaagaguaggggucagggagucuuaucugagagcugccggguacuuuauguguguuucaggacagggcugaccacaguguuggcuguggaaggugggggcuggaaaccucugcugacagugaucuuaucuuucccaugugauaguuucauuaaugacugccuucaccugcucuuuuuccaguauguugcacuccaauguaauuucuguccguuaucaggccuugaugucaucuaugcccugaaauuguguuauugaacuaacacucauugucaaaccuuuacgagauaaaccuauuuuauuucuccucauccuaaaaauguguugauucuccugugcuguguauaaugaauggcccuuuggcuguuguaacaccuucacugaaauccuugaagugugugugugccuaucucucuaugucucgcccccuuucgccuccuccccuuccucaccccuugccaccccuuccuuacccuccccaaucucucucucucuuuccuaaagaacaaaaauggcaguuucccuuauucucauagaaaagacuuuaugucacagaagggagcugcuauuagcauaagcagucuggcauugugugggugaguguccaugugcauuaucaagcaaggcuuauaaaccauguuaauuccacacaacuuucucuacuccauccagcuuccaauccguaccccacaacauaaaaagugacaucacucacuuaagaaaauguugcaguaagguggauuuucauaaaauaaggauucucaggacuccaauuuuuaaaucauaccugugugccuacagaaagguuggaggggggcaagggagugaggaucuuaauuggcacccaaggcagaauguuugcucugaggagaaggauugaguggcacuacuuaagagaugcagcaaggcagugcagggagagccuaaaagcagcugaggcucucaaugucacccagacacugauggacagucauugauauuugaaucugaaucugaauguguacuaucaaaaaggcugcugucaucauugucaccacuauuccucugaguccuuuuccaucucuaccaucuuacucucuguaacgggauuguaaguucuauauuuuguuuuauaucuuguauacuuugcuugaugcaguaaauaugcuacugaaacacugugaauaaguaaaacuucaccugacugcaacauuuaaauaacauuaaauucaucugaauacagaaaaauauaaagaagaaaacaaaaaggucuaaaauccuaucaccaagauagcccuguuaauauuuguuaaaaauauaaguauguguguggacaugauuagagugucuauauuugcauaguauaagggguaaauuauacuaguacaauuaauagguauaaauugaaaagcaccuacauuucuuucgcuccuaccccaauccuuagccccucccucagcauuaugucugugcaguguacaaagcacucuuauaagaauacagcaaugggccggcacguuggcucaccccuguaauccuaguacuuugggaggccgagguggguagaucaccuguggucaggaguucaagaccaaccuggacaauauggugaaaccccgucucuacuaaaaauacaaaaauuagccugggcaugguggcgcacgccuguaaucccagcuacuugggaggcugaggcaggagaaucacuugaaccuaggaggcggagguugcagugagccgagaucgcgccacugcacuccagcccgggcaacaagagugaacuccaucucaaaaaaauaaaaaagaauacagcaaugacuaaggcaucucccuggcccuaaaagggaguuucagccuaaugggucaaagaaucauaaauaaggcauauaaauagcaugauaugugauguacaguaaguuggcagcuggcagccaugagaugugaugccaacauuacccucagcugcuacaggucucuguugucaucccuucccuccuccgccucaccuaacuagccacaugaccuuaaagaaauaccugaacugucuuuacccauuuuaugcauuuauaagguagaugugauaauuccucccugccugaucugaugagcuuugagaaucgagugccagaauggguaagaaaacacuucacgacucauaaaacagaccagaaguguaagguuucauugucaacuuuauuguuauacaaagggguacuaugaagaaucauaguaaucuugggcguuaauuuaauagaaagcccgggagcacagggucaccaacagcccagauuugaccaacagcugccuuucgcuuggcuuguacugcuuuuuaaaagaaaaguugcuaacguuuaaaaaucaggagaguucauacaaaaaagacuucccuugaaaaaucggaggaaacauucacaguggaccugcauuccuacgcggcagccauuuucguugcugaggaacugcuuuccccugagcacguguucucccauuugucacaagcccccccgacucccuuuuguagccccaacacugaaaccugaugucaguuucacuugucaucaugcuugcccuuccuuagagccagaaaauguuuuagaacccagguucccaucaaaaguagcaggguaaauagcuacuccaagaaggccaagauuuuucuuauaccuuaccugaaagcauuggaguuugcaauuucaauuuaagaucugcagaauauucaagcugaaaggggccuggagguuaauuaauccaaacgucuuguuuuugaguuccagagagguuaaguauauaauaaaauguuuagcauuauaauaaaauacuuuaguaggguccaucauuuucuuuccuuuuuuuuuuuuuuuuuuuuuuuugacgcagagucucacucugucagccaggcuggagugcaguggcacgaucuuggcucacugcaaccucugucucgcgggcucaagcaauucuccugccucagccuccggaguaacugggauuacaggcaugugccacuacaccuggcuaauuuuuguauuuuuaguagagaugggguuucaccauguuggccaggcuggucucgaacuccuaaccucagguaaucugccugccucagccuccgaaagugcugggauuacaggcaugagccaccacacccagcccaucauuuucauuauuacuaaaguaacaauuuuggauucccagguuuuuuagucauuuagucauucaguacauaugcauugagcaauguaaucagggauaagacacuugggguuucauggaaaagaaacuuuuuaucauagugcuuuguauacuauacaaacucauaaugcugggggaggggcugaggauuggggugggcgugaaggauaagauauuugagguuucugagucccguuuuccucaucugcuuagagggagaauaccugcccuccccacucugaauguuugaaaaucaauugcaaguauguuugugagccacuuaguagaguuuauaguacugaacaaaucguuauuacaacuuuguuaugaauuuaacugagaaaguuuuaaaaguauuuauaacuaggaaucuaaaagaugucugagauaccccaaguuacauaacccucauuaggauuuacaguuuucucaagcucuacuugucaaaugaauuaauugucuaauauuaucuaagcaaaauacuuaguuaagcuuagaauaacuuuuuuguauacuguuacuuugucugcauuccagaaauuaaaucagaggggagaauguugguuuacaggaauagacugauacauaauuugcauuugugugucuucccuaaggaaaacaauaauuauuaguccaacacaaaaacaugcccauuuugcugaaguacauauugaguucagaaguggacacagauuguccucauaaugaccacuguaauguaccuuuauugcuucacaaggugccauggcuuuggaugguguggugaggauggaagcccuacccauauguuauuugcacuggaccagaaucuuggauggaggaaagaacuuuggacauaucugggccagaaguucucuccaccuaccaggagugagcaugggagcaugagcuauacauguacaggagggucaucguguuuucaucaggguguaaaguguauuuugcuacaucugauagcucuuuuuauggcaauagcuggacaaugguguuguccauuguguacugaacugggcugaccugucagagcaagacuuuagaagcuuagcauuaugucaggucaggacauuaugugugaacgcuuauucauucaucuauuaauuugcuuauuuagccuauguugggugcuuuuaauauucuagacaucagcauuguagugggaaaauccaaaacuucugauacgguuuggaucugugucccuucccaaaucucaugucaaauuguaauccccauuguuggagguggggccuggugggaggcaacuggauccugggggcgguuucucaugaaugauuugucacuguccuucuuggugcuguucuugugauagugaguucuugugagaucugguuguuuaaaaguguauugcaccuccccccacccacuuccuucugcuccagcuaugugaagugccucaugccuccuuugccuccugccaugauuggaagcuucuugaggccuccccagaagcagaagccacuaugcuuccaguacagccuccagaaucaugagccaauuaaaccucuuuucuguauaaauuacccagucucagguauuucuuuauagcaguguaagaauggacuaauauaucuugugaaguuuauauucuaaagggaaagacugacacuaaauaaauaaauagucuaaauaaauaagcaagauaucuacauaauuguguguuguaagggcaauaaacaaagaggaaauacaaucccugucagaaaaggccucucugaagaugucacauuugagcuacaacaucuucauaugggucagucaaccaaugucaaggacaggagaacaagccaggcagagagaacagcgaguacaaaagcccaaagaugacaaaaagguuggcauguaugggcaacaggagggaggccuugagcaaggaagggaguggugugacaugauauuagacaaauuagcuaggggccaggucaugcaggacuugccaccauuguuucucaccuggacuacugaaauagcccgggggcuaaaaugacagugguugggacuggagucaaugcugugagaacaaacuggaaggguuuaagagauauuuuagagguaagaguaacagaacuuaaugauggacugaaugucaggaaagaggaaaagagaaaaauuaaggaugauucuuagguucuggcuugagcaauggaguggauuauggugccauuuucugaggcuuaaaagucaaauaacuugccaaaccucacuuagcuaggacauugaagucugguccaugugaauucgcuuuuuuuuuuuuuuuaagcuuuuuggguuuuuuuuuaaacccaugagauaagguuauuagguuaaauuuccaagaucucuuucagauuugcaauuaaguucucaucuagauuaaauuguuaauauggaaauauccugagguucagaauuaaguaacauugucuggcccugguauuuuugauaaauauagugcuaugauggaauaaauauuuuaucucagaacuaauagccagaauuuugcaaguguuuugucucaagcauaaaaagaaaaugauuuuuucauuuucucuugggcauaaugucuuuucuggaguuucccagcaacaagcaguuuguucugucaaguaagaugagauuguaaacuaucuguuauaauccugagcuaaaacugcaaagcccaaacaguaaguuuuuuuugguguccugguuuguuucagaucauucuuaagccucccaccccagugcucagcauugcuuugcacguauuauuucuccagaaccacacaaaccucacccaggauaggggcagguuuccucuguagagacaggaauggagacauuucaguaauucagaauaccaccuauaacucauaacccugccaucuggggcucacccauuuuggccaggucuaagauucuguugcuaacauaggcaggauaguccugaaaacuucaccaugagguagaucuuaauuuacccauagaaacagugggauuuguuugugacaaaggcgggucaucgaucuuaaguauguucaauagcaugugaguacaguuggcucuucauguccauagguuguacauuuguggauucaaccaaccacagaucaaaaauauuuuuaaagcaauaaaaaacaauauaacaucauacaaauuaaaaaacaauauaacaacuauuuacguagcauuuacauuauagauuauaaguaaucuagagaugacuuaaaguauacaagaggauguacauagguuauaugcaaauacuaagccauuuuauauaagggacuuggccauccguggauuuugcuaucuauagggggucuagaaccaaucaccagcagaucccaagggacaacuguguagcuaaacagccacacucuaaaucucucaucaaauucagauauuacagggaacaacaacaacaaaaaauucaacucaaaaagucucaaacaagaaaggcauuuauugucucauugaacaaggacagggcagcucuaggcuggcucagcaguucccugauauucuccaggacucaggcucuacuguuuaccucugugcucuaccauccugcacuuguugccaugacccuaagggauaucccuucauagcugcaagauggcugccacacuucugggaaacacauaggcuagcacugggccaaauaaacagucauugucuguucugugucucuuuuaguggggggggaaaaaaaaaagccuuucucagaagcccccagcagacuuuuuugaguccucguccauggaaugcccaguuucucccaucuagauauacggguauuauccuaaacuucuccccucauccuuuauucuccucaguuucuaugagugauccauucugguuuuuaaaaaccugucacaggagcugggcacaguggcucacaccuguaaucccagcacuuuaaaaggccagcaggcggaucacuugaggccaggaguucaaaaccagucuaggcaauauagugagaacccaucucuacaaaauaaaaaauaagaaccuaucaccuacccucuaucccuauauuuauuacauuaauucagauccucauuaauuccaccuguucucacugcucccaauuugucuaucuucugcauugccccuggaaucaucuuuuaaaauaugaaucucauugugucacuauccugcuuaaaacccuucagugauucuuaaucaaauaugggacuaaauuuuauuuuauuuuucuagcugcaagaaugccuccuucucccuuuuuuaaaaagaaaucuugcguggcagcugacuuguuagcuguuaacacguggaagcagagcuguccuaguugaaaugcggcuggggaaggggccuuuaacucagccagcuggauuccuccccuucccucucauggaggcccuaaagccuuuccuuggauccccuggaguacaggcaaauggaaacgccuacuaggcaguugguguagaccucaggagugucaaccagccuaacugcauagacuuagaaaguguggaagccaaggucggcgacaugcucaccuagaaagugcagagugagaagagaagagaguccuauagagagaggacuccaagagugaugcugaaguaaugccuacaagccauguaauaucccaugaagcaaucuuucuauuuuaccuuucaaacucuaagacugugccuuauaggagaauuuaugcuaugauuguguaggauaauuuaauucaaucagauguuuggggacaaagugaggauauguugaauaccaaaauuucaguuuccaauauaaaaaaaaaaucaaaaacugguaacaacaauuucuaauuguguggauugugcuuuugcuuaauuuucauucuuauagcuuuuuaaaaauuguuuugauaauccaugaaauuagucuuuuuuuucccccaaggccuuuuguauuagaaauccuguguuaaccaacauuucauguguuuccauaucugaucaaggcauuuuuaguuaaauaagcuuaagaauggaauuucaagcagaacuauaauaacugauuauauuaugauaguuauuuuaauucucucugcucuugauaucaaccuguguuuauucuuuaugucuauuuaagaauucaguguuguuguuuuuuuuucuguuggugggagucuaaauuaguucaaccauuguggaagacaguguggcaauuccucaaggaucuagaaccagaaauaccauuugacucagcaaucccauuacuggguauauacccaaaggauuauaaaccauucuacuauaaagacacauacauacauauguuuauugcagcacuauucacaauagcaaagacuuggaacccauccaaauguccaucaaugauagacuggauaaagaaaauguggcacauauacaccacggaauacuaugcagccauaaaaaaggaugaauucauguccuuugcagggacguggaugaagcuggaagccaucauucucagcaaaguuacacuggaacagaaaaccaaacaccacauguucucacucguaagugggaguugaacaaugagaacauaugggcacagggaggggaacaucacacaccagggucugucaggggguguggggcaaggggagggagagcauuaggacaaauaccuaaugcauguagggcuuaaaacuuagaugacagguugauggguacagcaaaccaccauggcacauguauaccuauguaacaagccugcacauucugcacgugucccagaacuuaaaguaaaauuaaaaaaaaaaaaaaagaauucaguguuuuuuuucaagccagcaccauggcaugcaccuguagucccagcuacuccagaggcugaggugggggaauugcuugagccgaggaauuugagguuucagugaguuaugaucacaacacugcucccuagccuagaugacagagcaagacccuaucucuuaaaaaaagaaaaaaaaaaucggucuuuuuuguuguuccaugaaaacuaaagagccauuuagauacaguugacauucuuguuauagaauaugaccuuaaugaggaaggaaacguuaaugaagacuaauuagugcauaauuuuaacgagggagauauguuugagucaagagcugaauggguugugcauuucagcagguauuugcauauugagugacacugucaaaaaggaagaggugaacagaaaggagcuggacagggcaggcuccaacuagaccagaccguucaacucuguuugcuuuuauccauucccaugucaaaaaggauuugagcagagcuuguccuuugugucuugugugggcuucaggcaagcacgucuucaaucuugcuuucuucugacucgaaccacccucucccuaggccucaguucugucaacaccagagcuuucucugcuucugucuuuauggucugccuccaucacacccuggaguggaccuguuucuggccaccagucuuugcugucagacuuuguauaggcaagcucaaccuguccugacaucagcagcuuccucaugcuccacaugauucagcuguuggcauuucuaggcccuccuagaaaugaggagcccaccgcacacccccauccuucccacuuccaacugggacuucacagaaacucagcaccaagcagaagccaaaaguguguaucaguugacugaaacuucaaacgauuuuguuucucuccuaauccuuuuaaaugugauauguguuuaagaguagcagagacaaagugauuuaggaaaauuauaauguuauccuagccuauuuuagugacacucuaacaugguuaagaaaauugacugucagauuugaucauuguugucgaagugaacagccaucauucucagaguggcuggagucaaauucucacccagcagaagcaauuuuaaugacugaagaauccaguuaccacaagaagcaauggaaccugaaugcacugcugaccucccgcguucucucucucuucuauuuuucaggcacaacguguuugauugcucugcuaucagauaaagaccucacuguggccaacgugggugacucgcgcgggguccugugugacaaagaugggaacgcuauuccuuugucucaugaucacaagccuuaccaguugaaggaaagaaagaggauaaagagagcaggugagcuugugaacaccuccaagaaaugucugcugucuugcuggugaacaaggcggcuugcuuggagagcuccuggauaaaauguccaguuaugcaguauuagagaggcugcuacugagguaacugagauugacuuuguaacauuaccuaucaaauaaauggccacuaaaucugucuuccuucauagccaaagauuccaaaagaacuaaaaagcccauuuccaguuuaaaggcuaauaagaucuuugggccccggguucucacuuuucucuagccuguugcuauaugcugcuucccucggagccacaacuaacuacuaaucauuccuaaaaagaccuuguuucugauaccucugugccuuugcaagugcuguucugggucacaauuacuugucccauaaaacucaguuuaagguguucuuuuggaagcuuuccaugucacacuguggcaagggccuucccauucugggguggaugccccucugccuuuccccagcauccuauguggacgucuugggucaccuuuuacaauacauggacauaccuggcucuccuauuugccuugccuuccugucaccucuuugaagacaggaacuugguuuuguucaucucuaugccuugagcauuuggcuuagugccugguauaaguaaauauuucagagcaagguuggggguagaggggucccuuauucauucauucauugguuuauucaauauuuuaggagcuggggauaaaacaaaaccccauucucaagcuuucaugaaacuuacauucugaaauuggcaugggggugaggaauggaguaaauagacauuaacaaaaaaaaauaguaaaaguaagucauucauauaguauauuagaaguugauaacugcuauggaaagacaugaagcagguaaggggagugucagggaguugcaguuuuaaguaguguggccugugugggccuugcuagagugauguuuggacaaagacucggaggauaauuaucaguugauuauuacauuuucauaauucgauuucagagaauaccuuuauaccuauguaagggaagaauucuguaacuuuucagacugagagcugcaggauguaugcucuucaugaugugccaggcagcaggccagcugucagaggggagcaagcggggugcucauguacccuaguaucugaccaggaugggcccuugcugucuggguuaaucugcacauugacucucgaucucuacaggucagcuucugcccagugaaugaacugaaugaaccuaaucaacauuuuaguuuucacaguagggaaccauacuguuaagucaaaauguguugaauuuuauuacaaucuccugcuucagugacugcuugaguugcaaaauaguuuuuaaugaaagcauuggucagguuuucuguugaugggaugaaacgaaugauauuuuaggagcaucuaucaagcuuugaugaccuccaggcaguaggagcaaaguucucuggcuuccuacuuguaaaacaccaucugccuguaggagucugcugugaaauuaagacacaguuagcucagucuugcaucagcaucaggcaaggauguguacacaauacaccugcaaaugucaucuuaccauucagugcucucuuuugaaauaucauggccauuuuaugcuuccucuucuucccugucauacccacuacccacgccugcacccuauguugauucuuuguagaagcaaauuugcacaccgucuccaaggagguuaaucuaaccucucuguucuuuuacauaauuugaucaauugcauauuuuacacaaggcuuaagaaacagugauugguuuuaccaucuucauguguguuuucucuggccucagccucuuuucaggacaucuuucccccuccugcuuagcaugacaguaagguccagccagucugggccaaauacaugucuuucugucgccacuccuuauacuguuuccaacaacaacauuagcugucauuuauugugugcuuauccugugcuggcagcaaagccuagcacuuuacacauacacuuucucuuugccugucuuaagagguugauaauauuauucucauuuuguagccaacaaacuggaacuucacagaggcuuaugugcccaagcacacacagcuagugaauggugagaccacagcugaaacccaggacuggguuuuaugcucuugccuacuagaccaugcuuccuggaauguccuccuacauauccugcccauagauguuucacccaucgcucaaagcccaccuuuaauguucauucuacccucaugaucagaacuggaaaucaucccucccuucuccaucugccuacagcauuuagcagacacuggucucgcccugaagaauaccacuuugugcuuauuguauuuaauacuuuuuguggcuuaauucuccugccaggcugucuacuuuuuuaaagaaaggucuggaucuuguauaacuucauauccugcacauugccuuccauggaguagguauuuaguaaauaucugacaaauauguggaugaagaaaaaaauaauagauacaauuguuaagugcauauuauguucagggacugugccaaaugacuuauguggaauaagaccuucauuucucaacaacccaauaaaauagauacugucucuauuuuguagccagggagacugaggaucagagaaagaguuucucauccaaagugagacaugguuagaagagacagagccaggaaucacauucaaguagucugaccugagccuuuaaugacuauacuagugugugcuuuuucuuaaucuugauccuauuuggggggacagagcuguuuugagaccuauauaggcacacuuaugaguggccucaggccaaaugauauauacggugccuguucaccugccuuucagcauuccuuugccacucuccucaaaucccuacccucaugcucucuacugucaaucacugagccaccacgguguuaaguuaaaaaccaaugcccucccccauauguauccgccaccuucaguacucuuauugauauauuauugaaauccuucaagaugccaggaugaggguaugaggaucaacugguagaguauaaaaccccaggccaugcagugggucccaggagugaugggguuaaggggagugcccacagcccaguucacaugaaguaggucacccuguugcgcacguaccuagacuaucccagguaagugagauaucagcuggucaaacuaaugggcucauccugucuuucuaggugguuucaucaguuucaauggcuccuggaggguccagggaauccuggccaugucucggucccugggggauuauccgcugaaaaaucucaacguggucaucccagacccagacauccugaccuuugaccuggacaagcuucagccugaguucaugaucuuggcaucagauggucucugggaugcuuucagcaaugaagaagcaguucgauucaucaaggagcgcuuggaugaaccucacuuuggggccaagagcauaguuuuacagucauuuuacagaggcugcccugacaauauaacagucaugguggugaaguucagaaauagcagcaaaacagaagagcagugaacccuucaggggucucagcugccuuagacuaaaggacuuucaacacacuggucucuuuuaauuuagugaaaagugugggaguuguaauuaggaucauccaccccagacauggaauccccccucccugguggucuuaggucuauaaucagugacgaacagagggugcccuuggccaauguaguuaagaaacuggaaaaugguuucuucauguuuucccaacucuuucauccaguguccaaaauauauaaguaaauagcuguagagucacauauaugaagugaauagcauaugugucauuuagucucccugaagauucuuuucaagauccuguucaggguccuccaggcaucagcuguuguguccucucuuuguaacaguggacaggacagaccacccagugcugcaggagacaggccacugcgucaccugugaguggucaggggcugauguggcaacacccucugccaagagacagagcuguccugagaaugcuuuguccuucugagcccauguuuucugcucaguagcagcuuggaagcagauuuggaaugguuuacuauuuuggcugcucuuggggacugcgagaagcagagagaaugagagaccaguggcaacugccugcacagcagagauaacccucuucccuugcuuccuuuaauaguuaaauagacuuuguauaccaccugaccagccuuugugcauuuauccuaaucaugcaugaccguuaaccuuuugcuuaguccuuaccauauguaauaggcagcuguuaaauucaccaacagauacccugauuuuucaucuuacgugaccaagaaaccacguuaggggaaaugaaaaaagcaagccacaauaccaugauuccuuccauuuucaacaguagaugaaggaaaugauacugaaugagucacaguguucccuggcaaguaagcuguuugcauugagaaaggagugagcuggugagguuaccacccugaauugagcuccagcugccaguuuuuguguuuuuccuugccccuuuccaagugguuuucaagugucaggcaguguucugagaagcagcagccuauaacuguauguguguuccuugaagccaggugcagaguucccagcuacugcagcuugggauuuggugggaaacuacugggauaagcuucuccuugacaauggaaaggcagcagucuucaacauuugguugcaaaucuccauccacaucagggagcuuuccccaggcaaauacaaaccgccccguggccugcaggccugcaggggaggcagcaaagggaccuggcaguugcaacacaguaagucaggaauucaagcgugaacccauauugauaagugggccagaauuauuuaggggccuggcuugcugcucuccauuuccuguaucgcuaauuuaucauuuuuccaaccuugguauuuuauauuauuuagagaaaaugcugggucacucucuuugccuaaggugacucaaacagccaaacgaaacuuccguugccucccagcccucuguauccaccugguuuuguucuuucccugugagcauuugugguuauagcuucccauaugccacauucaccggccaccuccucgccguggaacccugcccucuccccuccugcugcuguagaguuuucccaaagcaguguccaggagagaauuugagagagugaagaaauugccuuguagauguggagggcugcaaucugucuugauuucuccaagcacuuaacuuucuuugacugcacugagaauugcuaaugauuucccaugagauuugcuuacuuuuguauacuguauuuuccagcauuacagaaccuugguuauuguuuuuuagccauagaaucuucuaguaaaaaauaucugccaccauuuuagauuuaagcauuugccuauggggagacacugaauauguggauguguguauuaauauuugggguggggacagggaagggaauguggaaaacaaaugcuggcugugagcagugcugagauggccaggccaggcggcugaguuugcuuggaaauucaggacauucugacuccuaagaguugcccccacccaccaucaaacugaaaucagcaccaauggugucagcacuuuacagcccauagccaacuuucuuuauuuuuaacguagcacaaaaauguauaauagcaaggaaaagacauuuuuaaauuccgguuauuuuuauugucuaaaaugaaagcaacaguguuuugauaaagaugaaaaagaaaagcuacuaaauuaguaaaucagugguuacgugcccugcagaauuucuuaacagauggugcugagugcacgaguuacauaacuuucucucuaauugagguucacaaggcgucuucuaaauuuugcuuuguacaauuaauucauuucugauguuaaccaaauag

SEQ ID NO: 21370 - RNA, 2168 nt, Homo sapiens
caacccucucuccucagcgcuucuucuuucuugguuuggugaguuguguuggccugacuggcaugcaaggggugucagaggccagggcuggggaaggagaaggggaggcuggugggggccagaugugcuaaagagauccagaugugagauucugauguggaacucuggguggauugugugcgugggugugcauggcacacacacacaugcacguaagacggaggaaaaaacaaacagaaaagugagcaagugacugaauuugagcucuccaggugcuucugagaugugggcuugcacacgcuguugcuauaguacguguugguauguaugugccuguggguaucugcacuggcucauguuugcuggguugcgcacucgggagcaggaagcaaaggaaaggcagaaggcaacugugggccuuugucugguggugugccccaugagccucugcccugcacgcagcagcccagcucgagaaggugcauggccucugcagcuucucuuccaacccuugccucugccaccucacuuugccccuccccaugcugagagcuaagcggcugugcugguuuuuuccacugcaggccccugggcaggccuccagcagccacacccaguucugggagggaaaagaauggcaagggcggggccuuuguggcugagcugugggaguggauagacugagugagggguggaaaaaaugcuguuguugaggcaaggccugggaggcccugggaguuugcugcccgaaucuccagagcuugcgcagcggaucuugcaaauguucacugcccagagcauguguuccccacugugcacacccucccagccaggugcgggggcccacugcucugggcucccccagggagggagcagagucucgccaagugcuccuggagggaugggaguggagccuggcauucugaacacaucucugaggggugggauuaauaagacggucucugugccuccugcucccagauccugacugcugucauggcgugcccucuggagaaggcccuggaugugaugguguccaccuuccacaaguacucgggcaaagagggugacaaguucaagcucaacaagucagaacuaaaggagcugcugacccgggagcugcccagcuucuugggggugaguggguagugccugagugaguccccacguggggcauuucccacagaggagggcagcagucuugcucuagagcauuagcuacagagggcaucuaucagugggguggcugccugggguggaaacacauugaacaccaccacucacugccuggccccaugcugaaagagggcugagaaugaaugggucagacacugccaggugcuuugcacaacuuaacugaagggaagacuaagcucagagugcuaaguaacuucccaagguggucaguguacacaacugccauccggaccgggacugucugacucuugccaucacuccaacaguggacacuguuugaguuucuauuuggcuuguagaugugaagacacagauguggagaugaucacaggccugcagacguucccuucaaacaauaacaauguauauuuguaucaaacauaacacaguuuauauauuguuuucaugacuauuacuaccucaugggauuauuagaacaaccuugggugaaaauguaguggucccgucauuuuuccauugcaccagguacucagacuuccuuauccaaggagcaccuucuccacccuagcuuagccuugaggguuggaguuccaaacuggaccucccaaaggagccucccugaacucuggucugggaguagaaacugggucugguccuggcuccacccacugggcuucuguuuucuaucuguagccucuucucccuccagaaaaggacagaugaagcugcuuuccagaagcugaugagcaacuuggacagcaacagggacaacgagguggacuuccaagaguacugugucuuccuguccugcaucgccaugauguguaacgaauucuuugaaggcuucccagauaagcagcccaggaagaaaugaaaacuccucugaugugguuggggggucugccagcuggggcccucccugucgccagugggcacuuuuuuuuuuccacccuggcuccuucagacacgugcuugaugcugagcaaguucaauaaagauucuuggaaguu

SEQ ID NO: 21371 - RNA, 4466 nt, Homo sapiens
cacagagcucucagcgccgcucccagccacagccucccgcgccucgcucagcuccaacaugguaagccucacuuuucuucuucuucuucuuacaugaaaagaaaaagaaaagaaaaaaaacccacauacuucccagcagacuuuaucuuugacuuauguguggacguggcaggaaacagcaggaaaaaucagccucgugggagggaacuggggaagaagggauggaaggaugaagcccuaaaaucauccuugggguggccgccuaggguagcagcggagguucuuuagccuucccagucacgacaaggcccagggcuggggaagaggaagugcuggccgcucaccgcgcgggggggggacccgucgugggucacugccuccagccccucgcccgcggucucccgggagcccagagacgccuaggagcaaguuuaaggcagggggcuggaaagcugcgaggggucacuaguuauuucuguacaccagaaaagggacauuuuagaacuuggucgucuagccccagggaaaaucaaaguuucaguaagcacccggcagacggccaagacccaacgggacugaaacuuuagcccgucgccgcccgcagcgccgcggccaagaaugugggaggaacccggucccagcugagcccucuccuccuuccucuuccuuuuaccccaccaucuauuuaggcacucacuccguaacuuauuuuucucuucuuaucuccuuucaucucccaguugaacucauauuuuccauaauuccaccuccaaaaucucuuucuuuaccucuccuuaguggagagucagcaaacuggcccgcgggccaagucggguuuucuguucugcccacaagcuaagaauaaaguuuacauuuguaaaugauugaaagaaaucaaaagaagaaaaauacuuucugacaugugaaaauuauguggaaaucaaacuucagcguccauaaaugaaguauuggaacagagccacgcccauucccuuccauacugucugggguugcaguccugcuacagcagggacagaaagcuccggaggguguugguuaagaaugagaagacaauaguugagguuuuuaaaauugcuacgucuuuuucaucguauuuuuuucuuuccucaaauguugagcgcuuagcaugcauuuuuaaaaauuauuucacaguauccguuuaucauaauguuugcuccuugcuaucgccauccccaccaaguaagacuccaagagugccaugagguguggagagcgccgguucuccucuccuucagccacugcgccacccugggcagagcuuuccgguuucugggcguccucaggacccaucuccaaagugcccuggagcucuacaaauuaugccguuccauuuuaguaauuugauaauugugucucuuucuuucacuuuggagaauuaccucugggaggaaaugcaaagagguuuuaauuuucuccuuguggcugauagcaacagcaacaguuuucaaaagaaaauaaucucuaaauuacaccaagacugauguuaaggagagaaaaaugugaagcagaaaggcacugugaaacuggaaaagcaaaacugucugcauucuggaaggaaaaggggcagggggagaaucuguaguuccagagaaaggugacaaagcccaugcuccucagccugguguggccucccagccagucuccuuccugucaucugauaccuuaguaagacagggagauuuuaggccugauaugaagggcauguuguaacagaacaaacacaucuguuucuaggcugugguauuuuguuucuccccuaaaggccccugaaccuaccaacacuuuucuuaaugaaaaguucaauuuagagcaaaacaaaaacaaucauccuccaacaaugugauucuugggaaaaaguccaccucucuuaggguucagggguucuaacgcuguaagaugcaaugggaggcaagacucagcuaggaucucugcagcauaaaggcuguacaggaaggaggaaucaaucugcagcuguguagcuaagggcucagaucaguucuuagcacguguuaauuacggagugagaaagccucuagcucuggccuccaggaaguccauccuaagaacaaacgaaaggcuaaaugcuaaguugcaaaugucaccauccaaacauaaaucauuguuaacgcuaguagguaaagucucagaggaaggguguggccaggccgguuucccagaaagucuguaauugcggcuucuacccaccagagggaggccaacagcuccucacuuuugggacccuaaguccccuuggggaaccggaugacugggcccuauagaauuuccuugaaaaauucugcugugaggaaagagcccaguacaggauuuaaaucucuuacauuguagaugcuguguaagcagcaaccugagagcuuccugguuuggagugaccuccagagaagcuccaccuucucugucacuauuucccaccaggaaguggaagccugcaaggcuaaggacugcagaaagggacugggaggcccagauuccagggcuggcucugccauauccauucccuucuccuguccguuuccucacaucuaagauuaaugguuccuaacucuuaaauaugaaagccauuuucaaacaucuaaaaaguucuaucucccacugcauacacaaugauagcuaugcuuuuaguuuucucuaaggaaaugugugagucccaggaauucgguauugcuuuaaaaagaacugacauuucauuaaucacaaaagccuccauacacucuuggaaaauaagaaauuauuaaccuauagacaauguuuggugugcauauggauuuguggauauagaguuacacauguauuuauccacacauuuuaaaaauaugaguaaaccuugucaccgucacucucaucuaggcagucuacugcuuuuaaacgugccagcaaugcuccacauuuaccuuccauauauuucaccuggaauaaacauguggcgagggguaggacggaaggucacagagugugacuuuuugugguugucuugaaccccucagccccuugaaaaaaugacucagucuuuuaggaaacugcuuugaccugaaauaagagucccuggaguuuucuccaguauccagccuugacaucuucccuugucugagcccugcaauuuuuuuucuccaaaggcaaaaaucuccagcccuacagagacugagcggugcaucgagucccugauugcugucuuccagaaguaugcuggaaaggaugguuauaacuacacucucuccaagacagaguuccuaagcuucaugaauacagaacuagcugccuucacaaagguacuggucccugucucccccacuuccccaaacuacccacaacaugaaacaagacccuggcagaauggccaggaaugaaggagcagcaacugacaccccacacucuugcuucauuuuaacucacucuaagccaggaguuuuuccauuuaggaagagagauauaugaaaugguauaugacguaauggaauuauuuucaaauuucauuauucuaccccagagguucuauggcagcccuguccaguagaacuuucugcagugguggaaauacauucuauaucugcucuauccaacaugguagccaccagccacaugugucugcugagugcuugaaauguggcuagugugacuaacagacugacuuucuaaauuaguuaauguaaauguaaauguaaauagccauuuguaaccaguggcucuaagucuguaucuguguuggcagcuugggcaaguggaggaugagacugauuaggcagggccuguggccuuuuuccaccugaacccgcuguacuuuuauauaguuuaucuauuggaguugcaugcaacacuugaaagaaguguuccacuggcuuuacaaaacugaauagccccuaauaucauagaaagagcccuggacuaggagugggaaaaccuuugguucaaggcccaggucugccccuuaggcaggucacuucaccucuuuuagucuguuucugcaucuggcaaaugggaauauuaauaaucccuauccuguaccuuauacuccugugagaauaaaauguggcagcauauuugaaagcacauuagaagaugcgauauaaagguguaauuauuauuuucucugcagaaccagaaggacccugguguccuugaccgcaugaugaagaaacuggacaccaacagugauggucagcuagauuucucagaauuucuuaaucugauugguggccuagcuauggcuugccaugacuccuuccucaaggcugucccuucccagaagcggaccugaggaccccuuggcccuggccuucaaacccacccccuuuccuuccagccuuucugucaucaucuccacagcccacccauccccugagcacacuaaccaccucaugcaggccccaccugccaauaguaauaaagcaaugucacuuuuuuaaaacaug

SEQ ID NO: 21372 - RNA, 4466 nt, Homo sapiens
cauguuuuaaaaaagugacauugcuuuauuacuauuggcagguggggccugcaugaggugguuagugugcucaggggaugggugggcuguggagaugaugacagaaaggcuggaaggaaaggggguggguuugaaggccagggccaagggguccucagguccgcuucugggaagggacagccuugaggaaggagucauggcaagccauagcuaggccaccaaucagauuaagaaauucugagaaaucuagcugaccaucacuguugguguccaguuucuucaucaugcggucaaggacaccaggguccuucugguucugcagagaaaauaauaauuacaccuuuauaucgcaucuucuaaugugcuuucaaauaugcugccacauuuuauucucacaggaguauaagguacaggauagggauuauuaauauucccauuugccagaugcagaaacagacuaaaagaggugaagugaccugccuaaggggcagaccugggccuugaaccaaagguuuucccacuccuaguccagggcucuuucuaugauauuaggggcuauucaguuuuguaaagccaguggaacacuucuuucaaguguugcaugcaacuccaauagauaaacuauauaaaaguacagcggguucagguggaaaaaggccacaggcccugccuaaucagucucauccuccacuugcccaagcugccaacacagauacagacuuagagccacugguuacaaauggcuauuuacauuuacauuuacauuaacuaauuuagaaagucagucuguuagucacacuagccacauuucaagcacucagcagacacauguggcugguggcuaccauguuggauagagcagauauagaauguauuuccaccacugcagaaaguucuacuggacagggcugccauagaaccucugggguagaauaaugaaauuugaaaauaauuccauuacgucauauaccauuucauauaucucucuuccuaaauggaaaaacuccuggcuuagagugaguuaaaaugaagcaagaguguggggugucaguugcugcuccuucauuccuggccauucugccagggucuuguuucauguuguggguaguuuggggaagugggggagacagggaccaguaccuuugugaaggcagcuaguucuguauucaugaagcuuaggaacucugucuuggagagaguguaguuauaaccauccuuuccagcauacuucuggaagacagcaaucagggacucgaugcaccgcucagucucuguagggcuggagauuuuugccuuuggagaaaaaaaauugcagggcucagacaagggaagaugucaaggcuggauacuggagaaaacuccagggacucuuauuucaggucaaagcaguuuccuaaaagacugagucauuuuuucaaggggcugagggguucaagacaaccacaaaaagucacacucugugaccuuccguccuaccccucgccacauguuuauuccaggugaaauauauggaagguaaauguggagcauugcuggcacguuuaaaagcaguagacugccuagaugagagugacggugacaagguuuacucauauuuuuaaaauguguggauaaauacauguguaacucuauauccacaaauccauaugcacaccaaacauugucuauagguuaauaauuucuuauuuuccaagaguguauggaggcuuuugugauuaaugaaaugucaguucuuuuuaaagcaauaccgaauuccugggacucacacauuuccuuagagaaaacuaaaagcauagcuaucauuguguaugcagugggagauagaacuuuuuagauguuugaaaauggcuuucauauuuaagaguuaggaaccauuaaucuuagaugugaggaaacggacaggagaagggaauggauauggcagagccagcccuggaaucugggccucccagucccuuucugcaguccuuagccuugcaggcuuccacuuccuggugggaaauagugacagagaagguggagcuucucuggaggucacuccaaaccaggaagcucucagguugcugcuuacacagcaucuacaauguaagagauuuaaauccuguacugggcucuuuccucacagcagaauuuuucaaggaaauucuauagggcccagucauccgguuccccaaggggacuuagggucccaaaagugaggagcuguuggccucccucugguggguagaagccgcaauuacagacuuucugggaaaccggccuggccacacccuuccucugagacuuuaccuacuagcguuaacaaugauuuauguuuggauggugacauuugcaacuuagcauuuagccuuucguuuguucuuaggauggacuuccuggaggccagagcuagaggcuuucucacuccguaauuaacacgugcuaagaacugaucugagcccuuagcuacacagcugcagauugauuccuccuuccuguacagccuuuaugcugcagagauccuagcugagucuugccucccauugcaucuuacagcguuagaaccccugaacccuaagagagguggacuuuuucccaagaaucacauuguuggaggaugauuguuuuuguuuugcucuaaauugaacuuuucauuaagaaaaguguugguagguucaggggccuuuaggggagaaacaaaauaccacagccuagaaacagauguguuuguucuguuacaacaugcccuucauaucaggccuaaaaucucccugucuuacuaagguaucagaugacaggaaggagacuggcugggaggccacaccaggcugaggagcaugggcuuugucaccuuucucuggaacuacagauucucccccugccccuuuuccuuccagaaugcagacaguuuugcuuuuccaguuucacagugccuuucugcuucacauuuuucucuccuuaacaucagucuugguguaauuuagagauuauuuucuuuugaaaacuguugcuguugcuaucagccacaaggagaaaauuaaaaccucuuugcauuuccucccagagguaauucuccaaagugaaagaaagagacacaauuaucaaauuacuaaaauggaacggcauaauuuguagagcuccagggcacuuuggagauggguccugaggacgcccagaaaccggaaagcucugcccaggguggcgcaguggcugaaggagaggagaaccggcgcucuccacaccucauggcacucuuggagucuuacuugguggggauggcgauagcaaggagcaaacauuaugauaaacggauacugugaaauaauuuuuaaaaaugcaugcuaagcgcucaacauuugaggaaagaaaaaaauacgaugaaaaagacguagcaauuuuaaaaaccucaacuauugucuucucauucuuaaccaacacccuccggagcuuucugucccugcuguagcaggacugcaaccccagacaguauggaagggaaugggcguggcucuguuccaauacuucauuuauggacgcugaaguuugauuuccacauaauuuucacaugucagaaaguauuuuucuucuuuugauuucuuucaaucauuuacaaauguaaacuuuauucuuagcuugugggcagaacagaaaacccgacuuggcccgcgggccaguuugcugacucuccacuaaggagagguaaagaaagagauuuuggagguggaauuauggaaaauaugaguucaacugggagaugaaaggagauaagaagagaaaaauaaguuacggagugagugccuaaauagauggugggguaaaaggaagaggaaggaggagagggcucagcugggaccggguuccucccacauucuuggccgcggcgcugcgggcggcgacgggcuaaaguuucagucccguugggucuuggccgucugccgggugcuuacugaaacuuugauuuucccuggggcuagacgaccaaguucuaaaaugucccuuuucugguguacagaaauaacuagugaccccucgcagcuuuccagcccccugccuuaaacuugcuccuaggcgucucugggcucccgggagaccgcgggcgaggggcuggaggcagugacccacgacgggucccccccccgcgcggugagcggccagcacuuccucuuccccagcccugggccuugucgugacugggaaggcuaaagaaccuccgcugcuacccuaggcggccaccccaaggaugauuuuagggcuucauccuuccaucccuucuuccccaguucccucccacgaggcugauuuuuccugcuguuuccugccacguccacacauaagucaaagauaaagucugcugggaaguauguggguuuuuuuucuuuucuuuuucuuuucauguaagaagaagaagaagaaaagugaggcuuaccauguuggagcugagcgaggcgcgggaggcuguggcugggagcggcgcugagagcucugug

SEQ ID NO: 21373 - RNA, 9454 nt, Homo sapiens
aggcgcggggagccaggccucggggccucggagcaaccacccgagcagacggaguacacggagcagcggccccggccccgccaacgcugccgccgggugagucggggcccccgcccggcgcccgagccccgcgcgggggugggaaggggcugcggaaaaguugggagccccgggugccgcuuugucgcggggccgcggaggggucgggcugggaaggccgcggggccggggcgaggagggaggcggcgcuggcggggggcgcugcgggcgcucauggcggcggccgccggguaaggcgggcgcagcgccucaagggagcggccggggccggcgggccuggcgccgcgguguccgcggcagcgccgcccugagccggagaagcuuucccgggcaacagguagggcggaagguggggacgcgggggcugcgggcgacggggccgagccgugggcuucccuuuguuggggaguggaggagcuuggugaccauuggcgcgagagccuccacccuggcagcggcccgcgggguugcccuggccuggacgcguccuguggcuugggugggaggagaggggagggcccugccccguuuucuuccuaccggcccaccgugcccaccucgcaggcgaggucagagcuuccaugugcuuaacgggaaacaggaaggagcggcccggagcgccugccccggcccgguagggcuaaggcauaccguuaugagguguggauggcuggcaagggagcuccugguggaacuggcuuucugggccguagcuuguuaaucacuagaggcccguggcaaguggguugacugcagguguagagcacucaucuuuagccugcaguuggagucucucccucccuaagccuagcuccuggcaucaaaaccugguuucagucaccugaguugccaggcccagguucaggggguucugaggaucguggcgaaugcagugagccccuguuccuggagaagugaguccgagcaggccuccagcaggcagucacccccauaucugugcuggggcagggguggguggcgguugcugccgcauaccggagucgggaugaccgcaccggggugugaguggcugcacauguaaaggggcuccuaaggguaaggacuugccugcaguccugucccugaggaccuggcgcugaccauaccgugaucugcacagucuguuccagagagggauccuuuucuccccuggucccccacuucccucacuggggccucuggccagauuuuccccugggaggaagggccuccuuuuaccccugucacuggccauaggcuggcugaucccucacuguguccuucaacaccgccccagcugucucucaaacccaccggcgucucccugccccuggggccauagucucaugcaguguuuugguccguggaggccuuuggugggacuuugcagacaagcuguaggccagaugaggcugaggacuacuguucugacugccucucacccaccucuuuuuuacaaucuggcuuauuuugaggcccauccugcagccuggagggauaacacaccucucauuggcuccauccauggcuuguagacuucuaguacaugaccugcuucuguugccugaaaguuuucaacaaggaagacuauucaggacuucuucaguggaagcagggagccggugggaccuuugucacuccucccuugucaacaacuccuuucuauuuuccucaguuauucuuccaaacuaugagagccagucagacugaccaccuggagucugagagaauuccuuccucucaggccgaaacuucugccuucucagccguuuggaucuacaaacucccauggggauccucugcuccuuucauccaccuagaggggucuugugggggugucagucagaguuggggcaaagguuggggcuggacagaguccugcucaaguuccugcuaaucuaaugccaguuaaaucccugcucuucuggccccucuccagccugugccucagaaaguggcaucugugccuccaaggcaggugugugugagagagagcguagacagauaccaugucucuucauguguaugggggagugaagucuggguggaaaaguguuucuagaugugauuuucuccauaagaagucaaguaacugcccugaaggcccagggggccuggaaaaacaggguugucuccuuaccguguguacacuucagcuuuucuugccccagccucuuguuuauggggucuugcuuggaucugugugcuggugcuaagaggccuccccaguacugccacagggacccaacucuuugguucuguggggauguguaagugaggccggccaggccccagcuguccuccccucucuucauguugagucagagguccugacccugcugaaucuggggccucccugcuggggagauggggguagugccucucugcuaauggaggugcaggaccaccagggagggcuguggucaugggaagccugcaaccucaguguaaaagcccccauuaaucugcauuucccaagucuuccacucucccugcuuggaguggaagaggacaggcgcuaucucaucuuggggaugaggaaguugcacugcccaggugucuguccuugaccaugcucuagugccuacuuugccugccccccacccccuguuuugcaggcaugagacauuccugggccccaggaguccagcaggggcuccacccucccucugcgacuccagccugccgccugacuagagaaacaucccugccaguuuucacagaccugguuggggaugggaucugaagucuaggacugccagggcaacaugguaccuuuggcuuuacauuucccuggagaaguugggcuccaagagacagcagucaggugacugggucaggcugauuucucgcuuccaaucaggcugagcaaaaaagugggaagagggggccaugugcacacaucaaaguguuccgcauugucccuucucugugcauuuucuacccuugucccuucuuuauucaauuuucuacaacuuuucucuaggaaaaaaguguguguuuguguggggaaaguuccacuguggauaauuacauuuaauuuuguucaguucagaaggcuuccaucuguuuaauuaaauauuuauucuggcugagguggagggggcaggggcagugucuggaaugugugugugugauuugggggaggaggaggggagaagguggagcugaagcuccuuuacuggcagugcugaccucugauuucauccgagagagcagugaccaggaguggggacaaggggguaaaguccuugagcuggaauacugacccgugacaggcugagggauuucgcaagggcuacagugguggguggggguggagcgggagcugucagagcagcagcaggaccagcccagcccagcuguggucucaggcucugucuucagucaguggcaccaacuagucuccaggucacuguggauaacaauuucaccacucucuuuucuuccugucucugcuuucacuuucugggccagccuaaaucccaccgccucaucuccuucccaggagaacaagggguggggagccuggaaaagacugucauggucauccugcugcggcuucuugcugaguccuaggauugccagguguuugcuggacccagcaucccuggcucuccuggaccaucuugccauuccucucagcuucaagcagcugcucuucccucaugagccacacacgucugaccguucccucccuccucuggguauccaaguggucacucccaccauguuguucgucuuucaguugggggaggagguuuacauagcggcucuuuccuagacugagaggguauggguguuccccugcagacuaggauucuguuuucuggaugagcauuuauacgaaauagcucugaccaggcaccguggcucaugccuguaaucccagcacuuugggaggccaaggcuggcagguugcuugagcccaggaguucaagaccagucugggcaacauggcaaaacccuguuucuaccaaaaaaaaaauucaaaaauuagccagauguggugugugcuacuugguagugcaugcuacucauagccccaggcacucgggaggcugaggcaggaggggaggauggcuugaaccugggagguggagguugcagugagcugugauuguaccacugcacuccagcuugggugacagaggaagacccugucucaaaagaaaauaaaagaauagcucuuaauuccaucagauguauugguccgcucucuugguucccugccccacaaucccugacucuuugcagcccuaccuucacuuuucuuucugaagaguuauacauaggguccuucugccuuguguguagggacuagauggcuuggcauggagugucaaccuugugugcaguaguucgauguccagugauuguggagcucagugucauuuggggacauaauuuugcuuuaccuuggcuuuuuuuuuuuuuuuuuuuuuuuugagacagagucucacuguguuacccaggcuggagugcaguggcaagagcauggcucacugcaaccuucaccucccaggcucaagugauccucccaccucagccuccugaguagcugggauuacaggcaugugccaccacauccagcuaauuuuuguauuuuuuguagagaugggguuucaccguguugcccaggcuggucucaaacuccugagcucaagugaucagccugccuuggucucccaaagugcugggauuucaggcgugagcuacugcccagccuacccugucucuuaauuuuucuuuagggacuugcuacucagauggguuguagguuguagggaaggggaagaaggguuugccucagcccugcaauguuuuggggcacccccuggaagcuuucagcugaguuggcuuggaggcucgaggaaguggccagaguguagggggauaagggagggacuuuacucagauuguuggcuacagcuucuagggccagguccugccugucuugcagguuaagauagcaaaaugacaagacccccaagguucuucccccacuccccgaaaucagagguuguaaggaccccaaguuucuuaauuccagggaaucacgucugcagguugcuguagacaauaaaugcuuuuuuuuuuuuuuugagacagucucgcugucaccuaggcuagagugcaauggcgugauuccggcucacugcaaccucugccuccuggguucaagcgauucuccugccucagccuccugaguagcugggacuauaggcgcccgccaccacacccagcuaguuuuuuguauuuuuaguagagaugagguuucgccauguuggccaggcuggucucgaacuccugaccucgugaucugccagccucggccucccaaagugcugggaccacaggcaugagccaucacggccggccuaacaguaaauguuaaaacuggaaagccaccguauuacagaugaggaaacugauuugcccaaggcuacauagccaggauagggaucuagaguucgacucucugcccccuucuccuuuugauacauccugaaaacuuuuauucaucuaucucuuccuccauagcuacucccucuugaugcccuccccuuugccccucacucaggaugcuccagaccuuguaugauuacuucuggugggaacgucuguggcugccugugaacuugaccugggccgaucuagaagaccgagauggacgugucuacgccaaagccucagaucucuauaucacgcugccccuggccuugcucuuccucaucguucgauacuucuuugagcuguaagcaugccagccuacccucaugccuuccccuguugccaguugcaguuucuuggacuucaaguuuguuccuugcuguuuaauuagcccuugacccugauguucuggcuacucagguuccugcccacugugcacccccuccccugaaggcaccauugucuuccugaaggcucagcacccccaggcccuuuccaucaaugguuauuuguucucacccucuacccgccgcccgccuggccacuagugaacacacaggcagcuuugucagcugugggcagcccuggaggcuagagaaaaggggguugccaggaagcuggggaaacugaggccaggguaaaguugccuuagcuugcagcccuuucccuucccagcaagcuagauaccuuacucauaucccuuccccagguacguggcuacaccacuggcugcccucuugaacauaaaggagaaaacucggcugcgggcaccucccaacgccaccuuggaacauuucuaccugaccaguggcaagcagcccaagcagguaugagccgcaugcugcucuggcucugggaaucacugaguuuggugguggggggacaggguuugaauguuagcucuggcaggugaagagauggggaagcaguggugcugacugagguuguuacugggagaggcuggggaugcugcugaguuccgaagguaaacauaacaaugggcuucuucacugugcccagguggaaguagagcuuuugucccggcagagcgggcucucuggccgccagguagagcguugguuccgucgccgccgcaaccaggaccggcccagucuccucaagaaguuccgagaagccaggugggggaggcuggggcagaagcugggugacaaggaauauccugaugugucuugcugggagggauaggcgguggcuauacgcagggagaugugaggaggugaauucaguuauuaaugguaucuugugaggguaucugcagguauuugggggcugcugggggacugugcuauccucugaccuagccauuucugcuuccucugccagcuggagauucacauuuuaccugauugccuucauugccggcauggccgucauuguggaugugaguggggauuacugggaggugggaguagguucucuggcaaggucaggugaggccauggaauuuggguuccuccucuuuuaacuucucaccaucucucugcagaaacccugguucuaugacaugaagaaaguuugggagggauaucccauacagguaugaguucugcuuccucauguggggguggacuaagacacacccuagugaagagacgguuuguggaauccauggcagagggauuagagugauggaaugaagaaccucaggggcuaggggguuuguggaguggggacacccuugcggcugguugcucuuaccucucucuccucucccagagcacuaucccuucccaguauugguacuacaugauugaacuuuccuucuacuggucccugcucuucagcauugccucugaugucaagcgaaaggugggugaagggguugugcaauuaagccucagagccaaaaugaggcccugggaugaacacccucuccuuugacuucuggguacucugaauggagcuguugguauauggggaaccaaaggcaagggguaagaaggcauagugagagcuggggaauaaaaaaaggcccuggggccugcaucaucucugcaggauuucaaggaacagaucauccaccauguggccaccaucauucucaucagcuuuuccugguuugccaauuacauccgagcugggacucuaaucauggcucugcaugacucuuccgauuaccugcuggaggucaggcuuccucaaaucuagagacccuggugcagguucuucugucccuuugguuuucuuugggagggaggugcggggugggaauuuggaggaugacauuccugggaccaaggaggagggcacagagucagugcuccuaacuggaguguacauaugaauguacucgagggagucaggagcccaugaugauggaugggggcucucuaugcagucagccaagauguuuaacuacgcgggauggaagaacaccugcaacaacaucuucaucgucuucgccauuguuuuuaucaucacccgacuggucauccugcccuucuggugaguaggcagcuaggcuacacuccuguucugaagaaaucaggagccuugccuuucuuccccuccuguaucuccccggugucugaccugcucuuguccacguucucucucuccuugaauccucaggauccugcauugcacccugguguacccacuggagcucuauccugccuucuuuggcuauuacuucuucaauuccaugaugggaguucuacagcugcugcauaucuucugggccuaccucauuuugcgcauggcccacaaguucauaacuggaaaggugaagcccuguucccauuguguaggccuuacuacucucuacaacuuccugaacucccaucuugccaguaacucucuaaaaaacuaguguggagcccuggguauaacaggaacaagcccucagagagaagcaguacuuagggguuugaggaucucauguaauaacccuucuugucccuuuuccacagcugguagaagaugaacgcagugaccgggaagaaacagagagcucagagggggaggaggcugcagcugggggaggagcaaagagccggccccuagccaauggccaccccauccucaauaacaaccaucguaagaaugacugaaccauuacuccagcugccucccagauuaaugcauaaagccaaggaacuaccccgcucccugcgcuauagggucacuuuaagcucuggggaaaaaggagaaagugagaggagaguucucugcauccucccuccuugcuugucacccaguugccuuuaaaccaaauucuaaccagccuauccccagguagggggacguugguuauauucuguuagagggggacggucguauuuuccucccuacccgccaagucauccuuucuacugcuuuugaggcccucccucagcucucuguggguagggguuacaauucacauuccuuauucugagaauuuggccccagcuguuugccuuugacucccugaccuccagagccaggguugugccuuauugucccaucugugggccucauucugccaaagcuggaccaaggcuaaccuuucuaagcucccuaacuugggccagaaaccaaagcugagcuuuuaacuuucucccucuaugacacaaaugaauugaggguaggaggagggugcacauaacccuuacccuaccucugccaaaaagugggggcuguacuggggacugcucggaugaucuuucuuagugcuacuucuuucagcugucccuguagcgacaggucuaagaucugacugccuccuccuuucucuggccucuucccccuucccucuucucuucagcuaggcuagcugguuuggaguagaauggcaacuaauucuaauuuuuauuuauuaaauauuugggguuuugguuuuaaagccagaauuacggcuagcaccuagcauuucagcagagggaccauuuuagaccaaaauguacuguuaauggguuuuuuuuaaaaauuaaaagauuaaauaaaaaauauuaaauaa

SEQ ID NO: 21374 - RNA, 9454 nt, Homo sapiens
uuauuuaauauuuuuuauuuaaucuuuuaauuuuuaaaaaaaacccauuaacaguacauuuuggucuaaaauggucccucugcugaaaugcuaggugcuagccguaauucuggcuuuaaaaccaaaaccccaaauauuuaauaaauaaaaauuagaauuaguugccauucuacuccaaaccagcuagccuagcugaagagaagagggaagggggaagaggccagagaaaggaggaggcagucagaucuuagaccugucgcuacagggacagcugaaagaaguagcacuaagaaagaucauccgagcaguccccaguacagcccccacuuuuuggcagagguaggguaaggguuaugugcacccuccuccuacccucaauucauuugugucauagagggagaaaguuaaaagcucagcuuugguuucuggcccaaguuagggagcuuagaaagguuagccuugguccagcuuuggcagaaugaggcccacagaugggacaauaaggcacaacccuggcucuggaggucagggagucaaaggcaaacagcuggggccaaauucucagaauaaggaaugugaauuguaaccccuacccacagagagcugagggagggccucaaaagcaguagaaaggaugacuuggcggguagggaggaaaauacgaccgucccccucuaacagaauauaaccaacgucccccuaccuggggauaggcugguuagaauuugguuuaaaggcaacugggugacaagcaaggagggaggaugcagagaacucuccucucacuuucuccuuuuuccccagagcuuaaagugacccuauagcgcagggagcgggguaguuccuuggcuuuaugcauuaaucugggaggcagcuggaguaaugguucagucauucuuacgaugguuguuauugaggaugggguggccauuggcuaggggccggcucuuugcuccucccccagcugcagccuccucccccucugagcucucuguuucuucccggucacugcguucaucuucuaccagcuguggaaaagggacaagaaggguuauuacaugagauccucaaaccccuaaguacugcuucucucugagggcuuguuccuguuauacccagggcuccacacuaguuuuuuagagaguuacuggcaagaugggaguucaggaaguuguagagaguaguaaggccuacacaaugggaacagggcuucaccuuuccaguuaugaacuugugggccaugcgcaaaaugagguaggcccagaagauaugcagcagcuguagaacucccaucauggaauugaagaaguaauagccaaagaaggcaggauagagcuccaguggguacaccagggugcaaugcaggauccugaggauucaaggagagagagaacguggacaagagcaggucagacaccggggagauacaggaggggaagaaaggcaaggcuccugauuucuucagaacaggaguguagccuagcugccuacucaccagaagggcaggaugaccagucgggugaugauaaaaacaauggcgaagacgaugaagauguuguugcagguguucuuccaucccgcguaguuaaacaucuuggcugacugcauagagagcccccauccaucaucaugggcuccugacucccucgaguacauucauauguacacuccaguuaggagcacugacucugugcccuccuccuuggucccaggaaugucauccuccaaauucccaccccgcaccucccucccaaagaaaaccaaagggacagaagaaccugcaccagggucucuagauuugaggaagccugaccuccagcagguaaucggaagagucaugcagagccaugauuagagucccagcucggauguaauuggcaaaccaggaaaagcugaugagaaugaugguggccacaugguggaugaucuguuccuugaaauccugcagagaugaugcaggccccagggccuuuuuuuauuccccagcucucacuaugccuucuuaccccuugccuuugguuccccauauaccaacagcuccauucagaguacccagaagucaaaggagaggguguucaucccagggccucauuuuggcucugaggcuuaauugcacaaccccuucacccaccuuucgcuugacaucagaggcaaugcugaagagcagggaccaguagaaggaaaguucaaucauguaguaccaauacugggaagggauagugcucugggagaggagagagagguaagagcaaccagccgcaaggguguccccacuccacaaacccccuagccccugagguucuucauuccaucacucuaaucccucugccauggauuccacaaaccgucucuucacuagggugugucuuaguccacccccacaugaggaagcagaacucauaccuguaugggauaucccucccaaacuuucuucaugucauagaaccaggguuucugcagagagauggugagaaguuaaaagaggaggaacccaaauuccauggccucaccugaccuugccagagaaccuacucccaccucccaguaauccccacucacauccacaaugacggccaugccggcaaugaaggcaaucagguaaaaugugaaucuccagcuggcagaggaagcagaaauggcuaggucagaggauagcacagucccccagcagcccccaaauaccugcagauacccucacaagauaccauuaauaacugaauucaccuccucacaucucccugcguauagccaccgccuaucccucccagcaagacacaucaggauauuccuugucacccagcuucugccccagccucccccaccuggcuucucggaacuucuugaggagacugggccgguccugguugcggcggcgacggaaccaacgcucuaccuggcggccagagagcccgcucugccgggacaaaagcucuacuuccaccugggcacagugaagaagcccauuguuauguuuaccuucggaacucagcagcauccccagccucucccaguaacaaccucagucagcaccacugcuuccccaucucuucaccugccagagcuaacauucaaacccuguccccccaccaccaaacucagugauucccagagccagagcagcaugcggcucauaccugcuugggcugcuugccacuggucagguagaaauguuccaagguggcguugggaggugcccgcagccgaguuuucuccuuuauguucaagagggcagccagugguguagccacguaccuggggaagggauaugaguaagguaucuagcuugcugggaagggaaagggcugcaagcuaaggcaacuuuacccuggccucaguuuccccagcuuccuggcaacccccuuuucucuagccuccagggcugcccacagcugacaaagcugccuguguguucacuaguggccaggcgggcggcggguagagggugagaacaaauaaccauugauggaaagggccugggggugcugagccuucaggaagacaauggugccuucaggggagggggugcacagugggcaggaaccugaguagccagaacaucagggucaagggcuaauuaaacagcaaggaacaaacuugaaguccaagaaacugcaacuggcaacaggggaaggcaugaggguaggcuggcaugcuuacagcucaaagaaguaucgaacgaugaggaagagcaaggccaggggcagcgugauauagagaucugaggcuuuggcguagacacguccaucucggucuucuagaucggcccaggucaaguucacaggcagccacagacguucccaccagaaguaaucauacaaggucuggagcauccugagugaggggcaaaggggagggcaucaagagggaguagcuauggaggaagagauagaugaauaaaaguuuucaggauguaucaaaaggagaagggggcagagagucgaacucuagaucccuauccuggcuauguagccuugggcaaaucaguuuccucaucuguaauacgguggcuuuccaguuuuaacauuuacuguuaggccggccgugauggcucaugccuguggucccagcacuuugggaggccgaggcuggcagaucacgaggucaggaguucgagaccagccuggccaacauggcgaaaccucaucucuacuaaaaauacaaaaaacuagcugggugugguggcgggcgccuauagucccagcuacucaggaggcugaggcaggagaaucgcuugaacccaggaggcagagguugcagugagccggaaucacgccauugcacucuagccuaggugacagcgagacugucucaaaaaaaaaaaaaaagcauuuauugucuacagcaaccugcagacgugauucccuggaauuaagaaacuugggguccuuacaaccucugauuucggggagugggggaagaaccuugggggucuugucauuuugcuaucuuaaccugcaagacaggcaggaccuggcccuagaagcuguagccaacaaucugaguaaagucccucccuuaucccccuacacucuggccacuuccucgagccuccaagccaacucagcugaaagcuuccagggggugccccaaaacauugcagggcugaggcaaacccuucuuccccuucccuacaaccuacaacccaucugaguagcaagucccuaaagaaaaauuaagagacaggguaggcugggcaguagcucacgccugaaaucccagcacuuugggagaccaaggcaggcugaucacuugagcucaggaguuugagaccagccugggcaacacggugaaaccccaucucuacaaaaaauacaaaaauuagcuggaugugguggcacaugccuguaaucccagcuacucaggaggcugaggugggaggaucacuugagccugggaggugaagguugcagugagccaugcucuugccacugcacuccagccuggguaacacagugagacucugucucaaaaaaaaaaaaaaaaaaaaaaaagccaagguaaagcaaaauuauguccccaaaugacacugagcuccacaaucacuggacaucgaacuacugcacacaagguugacacuccaugccaagccaucuagucccuacacacaaggcagaaggacccuauguauaacucuucagaaagaaaagugaagguagggcugcaaagagucagggauuguggggcagggaaccaagagagcggaccaauacaucugauggaauuaagagcuauucuuuuauuuucuuuugagacagggucuuccucugucacccaagcuggagugcagugguacaaucacagcucacugcaaccuccaccucccagguucaagccauccuccccuccugccucagccucccgagugccuggggcuaugaguagcaugcacuaccaaguagcacacaccacaucuggcuaauuuuugaauuuuuuuuuugguagaaacaggguuuugccauguugcccagacuggucuugaacuccugggcucaagcaaccugccagccuuggccucccaaagugcugggauuacaggcaugagccacggugccuggucagagcuauuucguauaaaugcucauccagaaaacagaauccuagucugcaggggaacacccauacccucucagucuaggaaagagccgcuauguaaaccuccucccccaacugaaagacgaacaacauggugggagugaccacuuggauacccagaggagggagggaacggucagacguguguggcucaugagggaagagcagcugcuugaagcugagaggaauggcaagaugguccaggagagccagggaugcuggguccagcaaacaccuggcaauccuaggacucagcaagaagccgcagcaggaugaccaugacagucuuuuccaggcuccccaccccuuguucuccugggaaggagaugaggcggugggauuuaggcuggcccagaaagugaaagcagagacaggaagaaaagagaguggugaaauuguuauccacagugaccuggagacuaguuggugccacugacugaagacagagccugagaccacagcugggcugggcugguccugcugcugcucugacagcucccgcuccacccccacccaccacuguagcccuugcgaaaucccucagccugucacgggucaguauuccagcucaaggacuuuacccccuuguccccacuccuggucacugcucucucggaugaaaucagaggucagcacugccaguaaaggagcuucagcuccaccuucuccccuccuccucccccaaaucacacacacacauuccagacacugccccugcccccuccaccucagccagaauaaauauuuaauuaaacagauggaagccuucugaacugaacaaaauuaaauguaauuauccacaguggaacuuuccccacacaaacacacacuuuuuuccuagagaaaaguuguagaaaauugaauaaagaagggacaaggguagaaaaugcacagagaagggacaaugcggaacacuuugaugugugcacauggcccccucuucccacuuuuuugcucagccugauuggaagcgagaaaucagccugacccagucaccugacugcugucucuuggagcccaacuucuccagggaaauguaaagccaaagguaccauguugcccuggcaguccuagacuucagaucccauccccaaccaggucugugaaaacuggcagggauguuucucuagucaggcggcaggcuggagucgcagagggaggguggagccccugcuggacuccuggggcccaggaaugucucaugccugcaaaacaggggguggggggcaggcaaaguaggcacuagagcauggucaaggacagacaccugggcagugcaacuuccucauccccaagaugagauagcgccuguccucuuccacuccaagcagggagaguggaagacuugggaaaugcagauuaaugggggcuuuuacacugagguugcaggcuucccaugaccacagcccucccuggugguccugcaccuccauuagcagagaggcacuacccccaucuccccagcagggaggccccagauucagcagggucaggaccucugacucaacaugaagagaggggaggacagcuggggccuggccggccucacuuacacauccccacagaaccaaagaguugggucccuguggcaguacuggggaggccucuuagcaccagcacacagauccaagcaagaccccauaaacaagaggcuggggcaagaaaagcugaaguguacacacgguaaggagacaacccuguuuuuccaggcccccugggccuucagggcaguuacuugacuucuuauggagaaaaucacaucuagaaacacuuuuccacccagacuucacucccccauacacaugaagagacaugguaucugucuacgcucucucucacacacaccugccuuggaggcacagaugccacuuucugaggcacaggcuggagaggggccagaagagcagggauuuaacuggcauuagauuagcaggaacuugagcaggacucuguccagccccaaccuuugccccaacucugacugacacccccacaagaccccucuagguggaugaaaggagcagaggauccccaugggaguuuguagauccaaacggcugagaaggcagaaguuucggccugagaggaaggaauucucucagacuccagguggucagucugacuggcucucauaguuuggaagaauaacugaggaaaauagaaaggaguuguugacaagggaggagugacaaaggucccaccggcucccugcuuccacugaagaaguccugaauagucuuccuuguugaaaacuuucaggcaacagaagcaggucauguacuagaagucuacaagccauggauggagccaaugagagguguguuaucccuccaggcugcaggaugggccucaaaauaagccagauuguaaaaaagaggugggugagaggcagucagaacaguaguccucagccucaucuggccuacagcuugucugcaaagucccaccaaaggccuccacggaccaaaacacugcaugagacuauggccccaggggcagggagacgccgguggguuugagagacagcuggggcgguguugaaggacacagugagggaucagccagccuauggccagugacagggguaaaaggaggcccuuccucccaggggaaaaucuggccagaggccccagugagggaagugggggaccaggggagaaaaggaucccucucuggaacagacugugcagaucacgguauggucagcgccagguccucagggacaggacugcaggcaaguccuuacccuuaggagccccuuuacaugugcagccacucacaccccggugcggucaucccgacuccgguaugcggcagcaaccgccacccaccccugccccagcacagauaugggggugacugccugcuggaggccugcucggacucacuucuccaggaacaggggcucacugcauucgccacgauccucagaacccccugaaccugggccuggcaacucaggugacugaaaccagguuuugaugccaggagcuaggcuuagggagggagagacuccaacugcaggcuaaagaugagugcucuacaccugcagucaacccacuugccacgggccucuagugauuaacaagcuacggcccagaaagccaguuccaccaggagcucccuugccagccauccacaccucauaacgguaugccuuagcccuaccgggccggggcaggcgcuccgggccgcuccuuccuguuucccguuaagcacauggaagcucugaccucgccugcgaggugggcacggugggccgguaggaagaaaacggggcagggcccuccccucuccucccacccaagccacaggacgcguccaggccagggcaaccccgcgggccgcugccaggguggaggcucucgcgccaauggucaccaagcuccuccacuccccaacaaagggaagcccacggcucggccccgucgcccgcagcccccgcguccccaccuuccgcccuaccuguugcccgggaaagcuucuccggcucagggcggcgcugccgcggacaccgcggcgccaggcccgccggccccggccgcucccuugaggcgcugcgcccgccuuacccggcggccgccgccaugagcgcccgcagcgccccccgccagcgccgccucccuccucgccccggccccgcggccuucccagcccgaccccuccgcggccccgcgacaaagcggcacccggggcucccaacuuuuccgcagccccuucccacccccgcgcggggcucgggcgccgggcgggggccccgacucacccggcggcagcguuggcggggccggggccgcugcuccguguacuccgucugcucgggugguugcuccgaggccccgaggccuggcuccccgcgccu

SEQ ID NO: 21375 - RNA, 8849 nt, Homo sapiens
uuuugauugagguaaauaaaaaagcuuuauccagcaacacggagauaagagucuguccaacccgacaaguuccagaccccacccugcccucacaucaggcucuuccgguacugacugugcgggguggucugucugaggugggaguccggggucugcagguccaucugucuguacaggucucucagcucccugaccuccugcagcacccucuuugccuggcuccaauucgaugaugccucucccagcagccguuccgucuccagcagcagcugcucugacucagaauccggcggagaccgagggggguccuuggccuuucgcuucccaucucccagucccugaaccucugccagaagcuccugagucuccuccaguuuccuugcuaccagguccuggauccgggacagcugccccggguuggggagggcagggguuggggguuccucagcccgcagcuggagggugcgggcagaggcagcaucccgcugagauaggaucuccuccagggaggcgcagcggccuuucucugugggcgucaacuucuugggugccugggggguguagguggccccuuugucuguuuuuucccaaggucgggagagacugcuugcccggucugcggagggcuggaugcggucugaguccgcucuccgccggcucccugccagcugggccacagacuuguccaggucaacccgaaagcucucagcacaagagguugguuccucaggggaagggucuuccucuuggaucaaguccaaggucagcaucccauccgagguagagguggaagccuguggaggaaggggggaaugaguggggaaccugucaucaggagggauuuucggaaugacugccuaaaagaugcaagcuguggucauuuuccucuacaagccuuccuugaaugagaaguacuuuuuuuuagagacagagucuugcucugucacccaggcuggagugcaguggcacgaucugagcucacugcaagcuccgccucccggguucacgccauucuccugccucagccucccgaguagcugggauuacaugcgugcaccaccacgcccagcucuuuuuuuuuuguauuuuuagcagaggcaggguuucaccauguuggccauggcuggucucaaacuccugaccucaagugauacaccgucucagccucccaaaguacugggauuacaggugugagccccccugccuggcaaagcccucugcucuugacugaacccuccuacugaaugugcuguuucuuauuccuuugauagugacuugaauguuucuucuucugugauuuaguuuguuacuuguuuccuguauucuccacucuaccauaagcuuccugaggggcgcccucuuccuugguauuguggacucucagcaauuaaacugcaucugaugcacacaggaugcuccccauggcacgacuguccuccuccaucugcauccucugagucccacacuucagcccccuugccuuauaauaaaauuuguucucuuauuuccagaauacuaaaaaugaugaguauucaauaccaaauauguuguuuuagucauuccucacagcagcccuucaaggcaggcaugauuacugccucauuuuacaguuggagacaugcaacuucagggaaccacacagguagcugauuacagugagguuccaacucagguucuaacuccaaagccuguguucucugcauuauaccugccugccucucucucugaagacuuaagagcucagaggcaugaaagaaacuagcacguuguauguuucaggaguucauugugauccuuucuccuccaaacacccgcgguacuacauguuguuacccaucaagacagccaccauacaguagcuaauuuuucauuuuccuguggguauaacucauuuucuccgaaagaggguaacauuacugggagcugggacuuuugaacuccuaaugggcgcugaauaaaaccuuuugauuuagaucuggcagaggcauuggguggaaggacuucccucgccuuugaucuuggcaucaaggaggccucccgcaaaugccucugguggcauacaguucugucugagauggacugacacagaauuggcccuuuggcaauguuuauuacagucuuacauaccacagccauuagguguccccuuguuggggggcggcgggagugcuggauuuuugcccugucucgagugggaugggcaagauagcuguccuccucaacggugaccugaagagauguacugugaaucaugagugcucuucagcgacucgcugucccaacccagcaucccgaggccugaacaugugcccacuccauucacugcuucugaaugggcaaggggauuuacuggacacgaagggggcucuuuaagcugacccaaggcuggcucccccaucaugaagcggggaagaggaggugucagaugagacuuggagagaagguagaaagagaucagggcuuuuaaaagggcgguaaagaaguagagcugguggaggagcgaguaaacggggccugcacaauccucccccuucagugggccacagcuguucccucugccccagcguuccucccucuccccacagugagcccccugaccucauccaagauacgguucuuggcucgggugauggcagaguugagggcauugauccacgauuccuucucuucuggacucacugccaggaagaucagguugggugccugugaggggaagauuccuguuucagccaggguuuuagagguggugccucaccuugacaaugaagaaauaagagauuauaaucucacuuucuuagaccuagcuccaggaaggagagauauucugcuuccagagucauccauaacuuaaggaaacccagcuucuauuccugcaaaaugcauagcuaggagguuguuuuagaaaugaccaaggaggagcuaagaaggauacugaauauuaguaugguauuagagauaauuagaggaagucugaugaaggauagguauuaaaauacaaaucuuucaauguuugaagaaauagaaugugacaggaauaacuucccuggguucccucagacaagaugaauuagauucagaacuucaaccaccuaucaggguacaaggacagggauuuucuucuaagggauguaaauaugcacauguguggauguguguguauaagacagagaaaaauaaagagauauauagagagaugaucuuuguggcugaacagguuaaaggguggccugccuggaaagaaggaaauggcuacaauauucucaggugaaaugauaaaagccagcaggagagcaauucagggaaucugaaccaagauugcugagagagaaacugaggggaaggaguucuccccugcccccuccaacccuguccauguuccagcggccaagguggcaggagaaacauaccguguuaccgggcuguuuggagugggcaagaguaaacuugcuaugauuuuucuugcuccugcucuuggacuuccggagcucuucacacuucucauagucacucaggucaaauaccucuugaauauuuuucucaucuuuuaccuaggggaggguuggggugaggugaggaggauaaaauuauuuagccccuccacccagacuguuaguuuagaucaucuugggaaacagaggaagccugaggagagggaggcacgccaggagaggagagggccgucugcccaaagccuacaagguccucacaucgaggaggacgcuagggcagcuccaagucuugaauguuaagguguguuucuguuuaaaccccuucucuucacucuccuuagccaggcugccacuuccagagucccacuaugccucucuucaccaaccgccccacucuuuuccuuaaggacacagcuuacauguucuaaaaaggcucacguccuuaaagggacaugguagaugguugauccauugcccucaguaagacagaccuguauggcccuugaugguccacagaaagaagaucaaggcagggccaguuaucggggugucuggagggaacgaggggcggucucuggccuccccacucacaugugugcaguauagcucucccaccccaccucgcuuccuucucugguauguacaauuauagagacucaucuuccuuguucauuucaggagcaucgccaccacaggacggcagccccguguucaguuugcugaauuuguccagagaagcugaaaacuacaauuacaguuccuacccuuuccuccucccucuaagguacugugacaauccaaacuaacuccuccagacccccuaucucuaggcaagaaugcacuuagacucucccugggagacuacacuuuagacuuggaaaaaagugacuucugugacuucuugccauuauuccaguuugagugccugggcccccuuuacugccaggaagcucuuccuccuaucuaaacuuagcccucccugcuauagucuccgucccgcacucugguuccaccuuuagcagguuuuaagcaacauuuagcucuuagcacuccugcugaacgucucaucgaggccgcauuccuagugacauucuccaaccccaacuagccuuuucugagcacugcaaagcagcucuaggaacauuucuucgcagguucaucugaaacugaccacaauguuuucucuuuuccccuaaggugguguuccuacaacucugggacucugaagcaguggcuuauggauuuguuuuggcuugcaaggaccaaaguuacagagaggagacuuaguuacaaguccagaccgugcagucuguccacccuccguggcuugagcccaggguuggaacaccucaggaaaaaccuggucacguuuuccuggaaugagaauuaaaagcaccagcacuugucucauuaaaacuaaacaaacagauaaaaguagccucacgucuuccuuggaugacaucuacccacccugacugaaauuauuuuccaaaacaguccccaacuucccaaguucugaaauaggacucgugugcauggaggugaacucaucuauccuccugguuccuggaaaccuggaaguggggaagugguucucccuuccauuacccagaccaucuacagucuuguaucugcccauccuucugaacugcugcuggaccuggaggcugaugacagaugaggacagaugucaacauggccccauucaggugagugacgccucauacaucuaccuccauuuguuucagcaaggcuuggcuccuccagggccucccacuuuccaggguucccuggcuuugggcuggaaaguggccagaggccuugaaugauuacggguggaaguaggacaaggugcuggcaagggguguccaagagcaauucccagaaacacgggacagggauacaagaugaugcaucaucccuccucucccccuccuucuccagagcugagacuaucagcagagcccagaaaccguggagaggaaaguguugggugugugaauguagccaggggaagagaguuaacuuacuauguuuuccuuaggggaagggaaggaaagggaguuauucuaccuugcauacagacugauuaggagcucuggggagcaggagacacugauagagguuagcccuugguggagagggugggagauggggugaggcaagcaguaggacaaguauauuccagugccugggaagauggacaaagccaagcagccuuguucuccaccauauuguuuuuuuuuuuccccacauaucuaauucccagagucucauuuauaacuacccaucuuccaaauuaacccuuccuuuccccugauucuucguccuugacuauagaaagggauuuuucccacgccuguccaaagaguugcccugaauccaauuuccuccaccaugaggucuuccuaaggucuagcuucuguucuuacacaucagccugugaucauaaggugcuccagcccucuuugagagaggaugcccuuugagaaggaagaaaaugauuacuaucgaacacagaagaaauucuacggcagaggugguugugggagacccugccuuuaagagaggaaauaacaaaagagacuggugaaaauucugggagauaggguuagaaauuuucuugcauuaacaguaaaugauauagauuauacucugccuuaaaaaaaaaaaaucuuggucagggacuguggcucacgccuauaaucccagaauuucaggagguugaggcaggaggaucacuugaagccaggaauuugagaccagccugggaaacauagugagaccccaugucuacaaaaaauaaaaaaaauuagcugggugugguggugcaugccuguagucccagcuacuccggaggcugaggugggaggauugcuuaagcccgggaggucaaggcagcagugagcuacgauugugacacugcacuccagcgugggcgacagagugagacccugucucuaaaaaacaaaacaaaacagaacaccgugucuugauucuauuggcccuggagcuuuucacaagugggcaaaauaaagcccagaguacucugucaauuucacuuuuuaaccaggcccacuguagcauugaaacuggcucuaaaaaagcauaguaucaauaugccuagucccucuuuccugugcccuucccagcaggagacagcuggcuccaugaccagucagaugguccugacucauaggacaccagauauccuaggcugaggucauuccauccuuuccucugucucuguaccuaaaagcaaggaucaacuacgcuuuugcccccagacucugcucuuugggcaaauacaaacaagcaauggaugucuuauuccucuuacccuuucacuauuauguuuuucucuuugauguguaggaaguucucccugauucguaacuagaguuuccugcaauuaagaaguucggggaagacaggagauacacuuugacacuuguuuuuuuuuuuuuuuuuuuuuuuuuuuuaauuagaaagccagaaaauuguggagaaaacuuucuggaggauuugugauugggcagagguaacucuuaaaaauaaauccuccuggccaggcacgguggcucacaccuguaaucccagcacuuugggaggcugaggcgggugguucacuugaggccaggaguuuugagagcagccuggucaacaacgcgaaacacugucucuacaaaaaauacaaaaacuagccagacaugguggcacccaccuguagucccagcuacuccaaggaugaggugggaggaucacuugagccugggagguggaagcugaagugagcugugauugagccacugcauuccugccuggaugacagaccaagaaaagugcccucaccucacuccuaagacuuuccaucaccaacuugcuaguuuuguguaaacagcuagguuucaauacccuuaagagggaucucuuuggcuguggcacagcuuaguucuucccuagaugccucaguagauguucuuuuagaugaguacuuugucucaggguguguguguguauguuucaauaccauaaaagguuuuauuuaccuaaauauaaucuacugaauaaggaugucuacugcagaaagcagaagagguuagaacucagggaggacuucccaguuagcccugggugagggaacacagaauaccucccgugagggcgggaggaagggccacucuaaccgguacacaggacagucuuccaggcuauacugacugccuuuggacagucacagaggcagggaauggaaugacuucuaaccacuguaggggcaauucugauuucuccacauuaguacacguuauugaucccaagacuuagggaaaaaagggagaugggucuggauucaauuaucauagcucaggucuugacacaguguagacugugguuuucaugguuaacuacacagccaaagcuauccaaagacauacagggguucuuaacuccauuucucucccuucugauacaaauggaggggugggcaggaaguggguagaaaauggguuccuugccuuuuuuaaaugggguggggguggggaacagagagcauacugguuagggacacuggcuucaacgaaaauaacugccacucacacacccgaggucacaggggccugacggcggggugcguguuuucugugauucagggcggaugcgccacggacaggaccugugcacgcuccugccacagacaggaaaggggaggcuggcuggguuaagguggggggacaggaagggguggcgaauaggcuaaacuguuucagcagaaauagaaaagaaauccuauaugcaggaggccagguuagggugggaggcagcaagggacacuuagaacuucuggggcaucuugggaggggcuuaucguuguuagaaagguauuugcaaacaaaaaaacacugaguaagcggccaacucaacuucuaauucucacucuggucuucucauuaaaggguggccuuucucugcagaugagauggggguagagaggagaccacugaacuugccuuuggaacaaaacggggguggaguaagcuaggcgagcccuuggggagugacaaagugggggcuaugagaaaacggagaguuagaggcaagaggcacccaccuccuucucagagauguagagcugguccccuuucagcaccacauagcgguuuuuccaaaucucccugaaaaucccuuucccgcagaauuuccggacccagccgaccuucucgggcggugcaggcugcugguuuccauccugaggucccugccccaggacaagaugagaagcgggcgguuaggagauuccagccggcgcuuccucuccguccgucucucacgaccgccucggcggcccagucuccuccgaaggcugcggccggggggcggggggccgccccagguucgcuc

SEQ ID NO: 21376 - RNA, 2946 nt, Homo sapiens
auuagguaaauauuucuuuauuaaaugguuaauuccauaaauaaaaucuuuucacugaauauaaaauuaaaaucauuuacaaauuauuccaguauuacauuuccccucccuccccaaaagcuacauuuugauaaauaaaacauucagucuuaaaacaccugauuucuguuugcaguuuagagugcagauagcugccucucacagacacucauggagugucccccuucaggaagggauggaaugcccucccauuuacuuuugucaaaggacgaauaaaagcuuuaaacuguccaacuaaucuuauuaucucuuuuacgacuguagaaccccaaaaggaaaaaagccuagagaaaauaugcuuagcaaauaauuuacaaacagaaaacagaaagucaucaacuccacaagcuccaaaaugaagcaguaacaugugcuccaauacuaugaagcaaaguauucuccaaucguggcugcauuaguguccauccgcaccagcacccuuggcaguuucgaaauaccuuaaugcuccucaagaaugagcaaggcuuccuuucuacaaugagucccaucacccacaccacccccgcccauuuucuccaugauucugauucugacacucuucucccuuguuugucuaggugugcccuggaaacccagguagcauuuagucccuaaauuugugaaugucauugaacagccuguagaagggaaacgcugcuucauuggcaugcgggcaguuguaguugcauuugcaggacuggaucaucaugacguucuuggaaaaugucuccccaucuucgcagcggaaccgcaucuucacaguccuggucagcuggggcgugcagcaucggccguccacgcaggaaccgcaguacuugggccgguauuucuucacacucaaacauccagcguaaguaaaccugacugguucgggggauuucuuggucuugcugcauuucuugcccuucuguaagagaaaggagagaaggaaaguuaggggugauauuucucuuucuucaaaaagauguucacaucccacccaccugccaggcaacagucuacacgucccugaaggaacuuacuuucaggcugcuguacacuggcuguccacaaggccgcaccucacaaauccggguuucuuucacaaggcggcacucaggguugucauugguaacucguguggagauaccaguuccacaggucuuugagcacugggaccaugaaguuguuugaacaauacauuucuggccuuguaaaggguuguauaggaugcgaggcuccauuccaaaaacuagagacauauaagagggaagacuucucagaggcauaccgacacaaacaggcucaagcacucauuucuacaaagauuuagaccagaaaugcaucucaguacagugucugaagugcucagucuccacuuaccagggagccgcuucagugagcugccuuuuccaacugcaaucaauucauuguuucucgucaacuccaccucggaggcaucgaaucccagcuccuugccaaggaggccguccugguccuccaugggguccuugauacuauccucgucacagacccacuccucgcagcacugcccgguaacuuugaccagccgaggguugggacagcccaaguuggggagagauaguucuuggggacacagaggaaugcagcccacggcgccaucaauacaugugcacugauguuuacaguugggcuggaaacuuuccccguuuugguagauucuggaguuauauucacagggucugcccucugacugagcugcaaagaucaccaaaagagaaagguagaaggggauaaaguuaagauuccaaaccaccgccugaaacucauacauauuuucugcuguuaaauucaauuuaugguaaaguucccuacaauuccccggagacuccagaccagaacaauaaguuagucaggaaucacuuuuccguaugcgcuuucguugggcccagacacacugaauugcauuccagacugcugaaaucaugugccuuucugccaagcuaccaacaacaaagcaucaccauacauggucucagaauuacuaaacuucuggacuauggggacuaguauuuuuuuuaaaggggccaaaccacaagcaucuuaccucugcagauccccuucagagcgguggagcuggcgccgaaguugcauuccagccccuugguguggucgcagggcugcguuuugcugcaguccucguugagcugcuuggcgcagaccuuacagcagccgcagccgucccggaccagcccgacucccggcgcgcacuugggcgccuccagggggcaguggcaggcagcggggcagguggagagcgccuggaagggggagaagauacgcgugagacucggcgcggugcgcaggaggggcgccgcggcugccgcagugagggacgggggucuccgacccuaucgacggggagccucugaucucguccagcccggccaccucggaaggcugcucccaccaagaggucccgacacgucuucggggggagggggagagugcuuaaagaaacggcuacccgcaaacgaucgcgaacuuuuuaacuuuuccugccgugggcaaucugggaccaggggaaggggcuggagagcggacggggaauagguggcaaaaggagaguccaacucaccagccuggucaaguggagaagggugacgacuaaggcgagcgcccuggcgaugcgggagcucauuguggcgcgcaggaguagcccggggcgagcgcggcgacgaagacgccaacaagcuggugugcagcggacaggccgugcgcagcggggucgggguggcggcgcggugggcccggugggcagggaggcgagggcugggcggcgggcgggcgucuuucgcucgaggucccggcggagaaggcgcggagggcgcgggcgcugcucgggggcgcucucgcucgcggucu

SEQ ID NO: 21377 - RNA, 2946 nt, Homo sapiens
agaccgcgagcgagagcgcccccgagcagcgcccgcgcccuccgcgccuucuccgccgggaccucgagcgaaagacgcccgcccgccgcccagcccucgccucccugcccaccgggcccaccgcgccgccaccccgaccccgcugcgcacggccuguccgcugcacaccagcuuguuggcgucuucgucgccgcgcucgccccgggcuacuccugcgcgccacaaugagcucccgcaucgccagggcgcucgccuuagucgucacccuucuccacuugaccaggcuggugaguuggacucuccuuuugccaccuauuccccguccgcucuccagccccuuccccuggucccagauugcccacggcaggaaaaguuaaaaaguucgcgaucguuugcggguagccguuucuuuaagcacucucccccuccccccgaagacgugucgggaccucuuggugggagcagccuuccgagguggccgggcuggacgagaucagaggcuccccgucgauagggucggagacccccgucccucacugcggcagccgcggcgccccuccugcgcaccgcgccgagucucacgcguaucuucucccccuuccaggcgcucuccaccugccccgcugccugccacugcccccuggaggcgcccaagugcgcgccgggagucgggcugguccgggacggcugcggcugcuguaaggucugcgccaagcagcucaacgaggacugcagcaaaacgcagcccugcgaccacaccaaggggcuggaaugcaacuucggcgccagcuccaccgcucugaaggggaucugcagagguaagaugcuugugguuuggccccuuuaaaaaaaauacuaguccccauaguccagaaguuuaguaauucugagaccauguauggugaugcuuuguuguugguagcuuggcagaaaggcacaugauuucagcagucuggaaugcaauucagugugucugggcccaacgaaagcgcauacggaaaagugauuccugacuaacuuauuguucuggucuggagucuccggggaauuguagggaacuuuaccauaaauugaauuuaacagcagaaaauauguaugaguuucaggcggugguuuggaaucuuaacuuuauccccuucuaccuuucucuuuuggugaucuuugcagcucagucagagggcagacccugugaauauaacuccagaaucuaccaaaacggggaaaguuuccagcccaacuguaaacaucagugcacauguauugauggcgccgugggcugcauuccucuguguccccaagaacuaucucuccccaacuugggcugucccaacccucggcuggucaaaguuaccgggcagugcugcgaggagugggucugugacgaggauaguaucaaggaccccauggaggaccaggacggccuccuuggcaaggagcugggauucgaugccuccgagguggaguugacgagaaacaaugaauugauugcaguuggaaaaggcagcucacugaagcggcucccugguaaguggagacugagcacuucagacacuguacugagaugcauuucuggucuaaaucuuuguagaaaugagugcuugagccuguuugugucgguaugccucugagaagucuucccucuuauaugucucuaguuuuuggaauggagccucgcauccuauacaacccuuuacaaggccagaaauguauuguucaaacaacuucauggucccagugcucaaagaccuguggaacugguaucuccacacgaguuaccaaugacaacccugagugccgccuugugaaagaaacccggauuugugaggugcggccuuguggacagccaguguacagcagccugaaaguaaguuccuucagggacguguagacuguugccuggcaggugggugggaugugaacaucuuuuugaagaaagagaaauaucaccccuaacuuuccuucucuccuuucucuuacagaagggcaagaaaugcagcaagaccaagaaaucccccgaaccagucagguuuacuuacgcuggauguuugagugugaagaaauaccggcccaaguacugcgguuccugcguggacggccgaugcugcacgccccagcugaccaggacugugaagaugcgguuccgcugcgaagauggggagacauuuuccaagaacgucaugaugauccaguccugcaaaugcaacuacaacugcccgcaugccaaugaagcagcguuucccuucuacaggcuguucaaugacauucacaaauuuagggacuaaaugcuaccuggguuuccagggcacaccuagacaaacaagggagaagagugucagaaucagaaucauggagaaaaugggcggggguggugugggugaugggacucauuguagaaaggaagccuugcucauucuugaggagcauuaagguauuucgaaacugccaagggugcuggugcggauggacacuaaugcagccacgauuggagaauacuuugcuucauaguauuggagcacauguuacugcuucauuuuggagcuuguggaguugaugacuuucuguuuucuguuuguaaauuauuugcuaagcauauuuucucuaggcuuuuuuccuuuugggguucuacagucguaaaagagauaauaagauuaguuggacaguuuaaagcuuuuauucguccuuugacaaaaguaaaugggagggcauuccaucccuuccugaagggggacacuccaugagugucugugagaggcagcuaucugcacucuaaacugcaaacagaaaucagguguuuuaagacugaauguuuuauuuaucaaaauguagcuuuuggggagggaggggaaauguaauacuggaauaauuuguaaaugauuuuaauuuuauauucagugaaaagauuuuauuuauggaauuaaccauuuaauaaagaaauauuuaccuaau

SEQ ID NO: 21378 - RNA, 38167 nt, Homo sapiens
ucauauucuacuaaaaggcgauaggauccaguauauauauauauaauccugaaaacuauuuuauaaccaaaaauuuugcuucaaaacaucauucucacuauaguuauaaaacagaaaacaaaacuaaauuuuuaaaacauaaauauauuuaaaaaauuaaaacaccuaagaaaugcaaucuauacaugugaaaaaguaaaauauuuauaugcauaacaaguaguugcaacauuauccauaagcagcaguuaguguuuauuuucccuauauuuugguuuaacaccauaguguagugguaguucauucuuuuuagggaaauuacauaaaguacauauagaauauuauuaguaaguuauagaagacuguauaacuggaaaauuaauuccaaguaacagcauuuccucuaaaaacacaucuauuauuaaacgaauuacuuuaaacuagcagagaacaaaaugagccuauaauuuauuaaguacaagauauauagucaacuugcauaaaauuacauauggcauuuuaaaaagucuauucuaaaauaucaguaauucaagcaauugggauuuccacaggagagaaauugccauuacuuuccuuuuuaugaagaaagaucugccuuaagaacaucacaacgauguuauuaagaaaugcuacagcauacuuuaaaaaucaaaauggugaaacagaugcaucaggauauucuuuuacagauaccagcccuauagcagcauuucagaaggugauuuaaaucuaauaacugacuuggguuuuuauucucuucuagaaauacauauuacauguauaguuuaguuaagaauuuucauuuccauuauaaaugggaacuuuucauacugauuaucuaaagguauaagaaauuaaguaauuggauagucuagcacuucauuagaaauauauccacugacuccacaaaaacaacuuuuacauauaagcaaauuacuaaaaauaucugaaucaggagaaaugaaauaaaauacagugaaugguuuucucuuuuaucucuaacuguaaaaaucccuuuugccuauuuauuugacccgucucuauucaugcaauuuaaugaacccucaaaagaauuuacacaucuuuauacagaauucacaucuacaucaguaaacuaccaguccuuuuauauuuucagugccuuaucaaaauauguguaacaaaguucuucauucuaugaggcaggaagauguuuccuaaguacuucuuuggaugaagaagauauaguaucugggaaggacaccucaaauucuauuagaaggucaccacguuggucaggauuuuuuggaaauggcagcccauauccaauaauucuucuccucauuccggguuucacaauaucauuuacugacauagguauguuucuuccauccaguguugguacauuaauugagcagccacacaaugccuaaaauggaccaaauaaaauaaaaugaaaacacuucaaaacucaaaaaucuaagcacaaauuuuaccagaugguaaaggauaauaccacuaagguaaaacuuuaaccuccaaaagaauaacaauaguuauaaauuuuuuuuccucauuagaaaauuccuucagaggucaggcacgguggcucacaccuguaaucucaacauuuugggaggccaaggcgggcagaucaccugaggucaggaguucaagaccagccucaccaacauggagaaaucuugucucuacuaaaaauacaaaauuaggcgagcgugguggcacaugccuguaaucccagcuacucgggaagcugaggcaggagaaucacuugaacucagcaggcggagguugcagugagccgagaucgugccauugcacuccagccugggcaacaagagcaaaacugucucaaaaaaaaaaaaaaaaaagaagaaagaaagaaagaaaaagaaaaagaaaagaaaagaaaaaaaggaaaauuccuucaggacaugcauuauuagauauguuacaaaaaaaaaaaaaaaagaagaagaaaagaaaagguaaaagagaaguaaaggauauauuccacauugcccuggaaugacaugguuauuuugaagcugcuauuaauauauucaagaugcagggauuggaaugggagaagagggagaaauucaggacuagaaagaacuggauaggagcaacuauuucucuggaaaguauuaggacaagaaauauauuuguuuuagauaacaaauguuuacugagcauuuacuauaugccacacauucuggcuagauggugagccuuauagggaccaugaacacagaccccagcucaaggaaugcacaaggaacucacagaaacauagaagcaaacuagccauuauaauacuguauaguguaagaacagagguaagcauggaggucuuuuguaagagaaagagcacccaacuuaaccccuuagauuccgggaguagaggaugcuugaacuaagcauugggcaguagcagguagguauuagagcaggguaagaaacaauaguguuccauagaguacagcucaaguauacaagauaauaauagagcaaacugggccaggugcgguggcucaugccuauagucccagcacuuugggaggccgaggugggcggauuacuugaggucaagaguucaagacgagccuggccaacauggugaaaaccuaucgcuacuaaaaauaugaaaaucagcugggcaugguggcgggcaccuguaaucccagcuacucaggaaccugaggcaggagaauuacuugaaccugggagguggaggcugcaguacuagcugagauugugccacugcacuccagcaugggugacagagcgagacuccaucucaaaaaaauaauaauaauaauaauagagcaaacuuggggaagugcauauacauuuuauggguagacaucagauuuaaaaugacuuauuuuaagcuaaagaguuuggacuuuaugguagagguuauauagagcaauuuaagaauuugaagcagggaacugcuaugaccauauuugcaaaguuacaauccaauuugagaaauaguacaaauaggccaggcgugguggcucaugccuguaauccuagcacuuugggaggccaaggcaaguggaucaccugaggucaggaauucaagaccagccuggccaacaugguaaaacccugugucuacuaaaaauacaaaaauuagccaggugugguggggggcgccuguaaucccagcuacuuaggaggccgaggcaagagaaucacuugaacccggaggcagagguugcagugagccgagauugcgcugugggugacagagcaagacucugucucaaaaaaaaaaaagaaauagugcaaauaagaacucaaauaauaauuguauuaacauaguagcauuauaauuuauaaauguauauauuuauaugcacuuauaaauguauuuuuuauuaauauaaauguauacaaauuuguagugaauuauaaauuauuuucuucuaaucuuuuuugguaugcaauuauuacuccauauuaacaaauuuagaacaaacccuauauacaaagacuaauguguugagauuaccaaugcagaucucauaaaccacauuuguaaaagcagccucauaguacauaauccaguuaacacuugacacuuuaauuauaaguaacuaaaguuagaaaauauaaucacauccauaaaagagguauaauacuaguacuaucuuagaggauuuuuauaguaauuauuuuuaacguauaauaggcauuaaauaaauguuagcuauuaucuagauacacucccuaugaucaacuacauaauuauuuggucuuaggauuuuagguccuaccaacuuaccucucguaaacuaauuuuagcaguauaaauuauauuugauccaucccuuuuaaauuuuggaugaucuuugucuuuaaugauaaaaacaaugucugcuggaauacuauuugguguuucaucuccuucucuuggaaaaguaauuuuggugccuucuuuccacccuuuuuuaaucucaaugguaagaauuuuguccucagaucuguaacuccuuccaucagcguuuagccuuuuucgagaaaucuucauccguuugguacaaccacuauauaucucuucaagugauacucuaaguucaugaauaacuggaggaucuuguuugaggcgggauggccccacagaauuccugucucuuggauauccauucaugcugaaaccaaaggcacuaaaaggaucaccaucuauuuccauuucuucagaaucucuaccaccacccauucgucuuccaaagaaaauuucaaagggguuggacccuccgaaaaaugcagcaaauguagcaugaggaucgccaugaaagguguaccggaagguaccuccuuguccaucaguaccuccugcuccuccuuucaacccuaauugaagagauaagcaugauuagaaaaaagcuugcaacucuuaaaaguuaaacuuucaaaaacuguauugcuaauaaauuuuggcuaacuuacauuaaaauguauuaauauuggccagaaaugccacuuuacuaaauacagaacagcuauaaaacucuugaugauuacauccuaaguuaaauuguuaaguuuucaaauucuuccuccaaaucagcauuuuuguuuguuuguguuuuugagacagaguuucgcucuuguuugcccaggcuggagugcaauggcgcaaucuuggcucaccgcaaccuccgccucccagguucaaacaauucuccugccucagccucccgaguagcugggauuacaggcaugugccaccacgcccggcuaauuuuguauuuuuaguagagacgagguuucuucauguuggucaggcuggucucgaacucccaaccucaggugaucugccugccuuggccucccaaagugcugaaauuacaagugugagccacugcuuccggccaaaucagcaucucuaauauuuauuccugauucuuuguuccacggguaaguaagaaaaauaaaauaaggccgggcgcagaggcucaugccuguaaucccaacacuuugggaggccgaggcaagcagaucaugaggucaggaguuugagaccagccuggccaacacagugaaaccccgccuccacuaaaaauacaaaaaauuagccaggugugguggcaggugccuguaauacuagcuacucaggaggcugaggcaggagaaucacuugaaccugggaggcagaaguugcagcgagcugagaucgcaccacugcacaccagcccgggcaacagugugagacucugucucaaaaaaaaaaaaaaaaaaaaagaaaagaaaagaaaaagaaaauaaaacugggaacuccuuauaaacuacugaucuggcaugcugaaguauauaaauuauauaaguaucuacuuauaaauauauaaguuuuuaaaagaugucaguuggaaggucuucagcaaucaacacaaagugcagaacuuaaaucuuuaauuuuuauuacaaucaaacaauauauauaacauuuaaaaauauaaauauauuaauaaaauauauagcaaaauauaaaauaccauauucauacuguuuauauauaaauaaaauagaaauauguaaaaauauaauguaauaaaaauaccauauucauucuaacuaguuuuauuucagaucaucuuuuacuguuuaggaauuaaaauagggccaggugcaguggcucacaccuguaaucccagcacuuugggaggccgagucggguggaucacuugagaucaggaguucgagaccagccuggucuacauggugaaaccccgucucuacuauaaauacaaaauuagcugggcaugguggcacaugccuauaaucccagcuacuugggaggcugaggcaggagaaucgcuugaaccugggaggcagagguuacagugagccaagacugcaccauugcacuccggccugggcaacaggagcaaaacuccaucucaaaaaaaaaaaaaaaagaauuaaaauagaacucugugucagagagugaaaaaaauucuaauaaugaggacauucuaugaaaaaugguuuuuuagacacuacgauugucauuccuacucuagauaccaaauuuuuuaggcauaucacaucuuagcauuaauuucaaugcuuguaagaagacugaaaucaagagcuguaaacuuugacacguaaggccucuauauggguuauuucugucucuugugaacaguccaccucaggcaacaauauagugacuuuuugacccuuugcuuaaggguuccacuaaguaauauuuaacccacaaaagauuauauuugaaacaacauuuuccacuaugaaagaaauguucuacuaaaacucaaaaaacaacaguauggugaucuuuuaaggggucaauacagaucaagaaacaagcaggaaaagaaucuaaaaaucauaaaacuaugaaaaauccaacagauuaagcuaggagauucuaauaucuccaaacagugagugauuugaaggcaggaaauauauuuauuuugcacugcucaugcauacagggcugaaaaugguagguauucaugcuuagugaaugaagggaaugaacuaauuccuaaaguccuucuaaaucaaaacuaaaaaaggugucuugaguaucgguacagagaaaaaggcagaagcaaaaacaauguaaaauauaaucacacauauacauauaugagagauuuaacaauuuaaaaugccacuaacacacagcauacuuuaaagaaacuuaguuuugcuuacgucuuauucugcauuuggcuucuuccauuaaaagguauauaucuacucuauuucaucuaacagggucucaagugauaucuaaaauuuuuaccuucauccaugaauagaaaucuggagagaucaagagagaccuaauaaucugaaaauugccaaaauauguauugaacaauauauccaaauagcaguuagggaaauuccuuguagaaugacaaguauaagcaggacaagaucuuuucauaagcagcucauccaaauuucccuuuuauaaauuuuaguaguauaauuauaacuccaaauguuaaaaagguaauggcagauuuuuuuuuuaaugauagaauaauauguagcucaaggucaugaccaaagugacucaaccaaugcuuaaauuauuuaaauaauuuuauccuucaucccauagacuuaagggaguauaauuauuuaacugaguuaaguaaacuggguaaaucagccugcccaaucuagccucuuauaagacaaaauuuaaauacuugcacccauaaugaauucaugaaaagaaagaauaauguuuuaauuuauuacaucauggguuuggcuuucuggaaaaccucuuccuccucugccaaaaagggcaauucggucauaauuacaaagucucugagaagauucauacaaagucugaaguaacuuaccaaagcugauaaaaagacuccaaugcagcuuugagguuuuccuagacacuauuaaacagucaacuaugcagcucagacaaagaacgaagcuacucuaaugaaugaaaaaaauccuaggcugggcacaguggcucacaccuauaaucccagaacuuugggaggccaagguggguggagcaugaggucuggaguucgagaucagccugaccaacauggugaaaccucgucucuacuaaaaauacaaaaauuagccaggcgugguggcgcacgccuguaaucccagcuacucaggagacugauucugucucaaaaacaacaaaaaaaagaaaaaaauccuaccaaaauucaugccacuuuaauauacauuauuaugcaaguaucacuugcauugucuagcacauaaaauuauaaguaaugucacauuaacuauauggucaguucuuaaucauguacauuuugaacgcuaauggaaauguuuaauauccaauuggauucccucugcuauucaaaauguuuucuagacaucgucaucacuuugugugaucaaaaaacgcaccagagaagcaacauuugccuaugauuuagcaagacugcuauuauuuuacaacuaaccagucaaccaguuugcagucccaaaccaaauauguguuuggaauacuaucuauaacaaugauucccacuaauuaguuaagguugacuaaaaguuuccaaaagaagaaacacuggagaaaaauucagauugcaaagaaaaaaacaugauaauacuuuaauaacucuuacuccauccaaggagaucuaauauguaaaaauccagauuuacagcaagacuucaguuaucaaauaaugagauucugagauuuuuuaaacaguuuuaauucacaaaaaucaaauuuacuuacauguuuuuagaacacacagugaauuaaaaaaaauccagcuagcuaaauauauaaguuaaagaacagaagagaacuaguauaaagauuaauaaauacaaguuuuaucauuuaaacacuaccuuuuaauauuugaaguuacugaauaaaucauaugcaauaacaaaauaaggaaagcauaaaaaaagaaaaauuagaaaacuagaauaaaugaggauguguuauugaaaaucuuuucuuuuaaaucucuuaacacaaauuuuuguugacauccacuaaacuauucaagacuaaaccuaaaacuuuagagagugguucagaauccaauuuuaaauuucuguaguucugugguuuuuguuuucaaaugauucaacuauagagaaauuuuauuuuuaaaaagauuuauuacauauauaaaauuaaccuauuguacaaauacaauucaauugauuauaguaaauugauagagcuguauaaccaucaucacaauccaguuauagaacauuuccaucauuccaaagaauucucuaguucuuauuuguagcuaauccccgcucccaccucaaguccuaggcaagaaagaucugcuuucuuuuucuauauacuggccuuuuccagacauuucacauaaauaaaaucauacaauauauagucuuuuacaucuggcuucuuuaauuuagcauaguuucugagguucaucaaugguguagcauguuucacaaauugguccuuuuauugcuaaauaguuccucauugaauguauauagcacauuuuguuuaauucaccaauuuauggugcuuucagauuguuuccaguuuggggcuauuauaaauaaugcugcuauaagcauucagguacaugucuuuguguggacauguuuuuguuucccuuuuauagauuccuaaaaguaaauuugaguuauccguauuuuuuuucuuuccuuugcuuuuucuagagguagggucuugcuauguugcaaaggcuggacucaaacucuugggcucaagcaauccuucagccucagccucccuauuagcugagacuacaggcauaugccaccucacccagcuagccaacuguuuuuaaaacaaagcauuuuaaauugugaauauucagaacacaaauauacuguguucuggauuacugguucuuucacuccuaaauacauaaauuuagcauaugcaacuuacauacuuuucaguuuaugguuccuuauucccaccaucccagcucuaagucccaagacuguaauaacuuggggggagcgggaagaaggauaccagguaaauuaauaguguuuccauaguccuaaaguucaguguuuuguuacuacuggagacaccuauggaaccacgucuggagauaaauaaaaggcaaagagaaaaaauguuuuccccuacuuucacaguguaucuaaaugggauuuuuuaauagaauaaaugagauauucugaauaaacggcaaacaaauauaauacuuuccugugaaggaagaauaauucuaaaaaauaauucaaauaacuuucauucaauuguauuuucuuuuuuuccuuuucuuuuuuugagaugaggucucgcucugucgcccaggcugaagugcaguggcucgaucucggcucacugcaaccucugccucuuggguucaagugauucuccuaccucacccuuccaaguagcugggauuagaggugucugccaccacaccuagcuaauuuuuguauuuuuaguagagacaggguuucaccauguuggccaggcuggucucgaacuccugaccucaggugaucgccugucucggccucccaaaguguuggaauuacaggcaugagccacggcgccuggcccauucaauuguauuuucaaguaaccuauaacuagagaaugguauuucugcauaauauauuucuauguuuuaaaaaaggcauucucuccucacucuuuccuucuaucacuuauaucaauuauguaaguuaaaaaaaaaaacccaggguauacagauucagggugauuuaguuuuuaaaaaauucacucauuguguaaugaccaauaaaaauuaaaugagaaaaaucacucuagaaaagcacuauuaagagauaauguuaaaucaagaaaaauguaucauuuggugacuugaaaauucugaagacaaauauccuuacuaaacccuggauccaauggcuuagccacaaacuugagcuaucagugaauuguugcaaaauauuuuaaauacaaagcaguggauaucugcuuuuucacaggaauucacagugucauuccauguuugugaauuucuuuacaaaauuacaaaauuacuccuuuagaaauaguaguacauuauugguaguaucucagaauccugcuuagcuuuugagauaaaccaagucaugauauuuuggguaauauggccauagguaucaugcaagauugaacugcccaguauuugccuuuuucaauauuuacuuuguaagaaccugacacuguagguccucaccacaccaaaaccugcaacauaaacuucaauuuugggcaacucauagaccaaaaaagcuaaacaaaacaaaaaggaaaaaacccucuauauacaaucacccugcuugucuacauuuaauuuguuucauucaaaauaagcagucacugcuugacuauauuuuaaggauauauuucuaauuaggaaaauuugauguuaaauguaauaaaggaaucaaagggauaacaaguuuucauagcuacagugauuugaaagccaguauuuugggagaaaaacuaauaauaaaauaacuuaguccugauguuaaaaguugaaaauccccaaaacaguacaaguuaaaguuuuuuguguuaucaauuagcaauuuaaaauagucuuacuucauagccccguuuauauggaagugauggacaaaccugauuuaaaaugcagaaugagaaaaggauaaucugaaauuauccuccuuuacugugcucacuaguuuuugaucucacaaugcaaaaaacaaaaguauggcagggagaggaaagggaaguugucauguuuuucucuauaccuagauaguaaaauuucuaaauaaauaauguuaucuaaaaguaaaucaguaauuauucuaacuagguggccauuuuaggucaaaaauuguauuucugagauuucauuuucuuggcacaaaauuauuguuuacaauuaagcuaaaaacuuguucugguauuuuaugacaucaggaaaauucuuuccucuccaggcagaaugccaaaaacaacuagaagcuaaaugccugcgccuucugcuucugagagucacaacucugucuuguucagucuaaacuagccuugcuauaagaaaggcaaaaaacuacuuuuuguuuuugugaauaagcuauaaacuacucagaaucugaaaugccaaucuuaagguuuuaaaugacuaaagacucuuuauugguucuggcagaaaauucauuagaaaacgaaacagguuucauaagacuuuugacacaauuuacuaauagguaugggaauucaagguuuauuuuaaaauauacauuguuaacauuguaagucuaaugauaaaauauguauaauacaaaaugcuaaaauaaaaaaggcaaacaaggacauuucauucauggcucugcaauacucauucauaugaucagagaugaaaccuuguuauuauacauuuguccuucuacuuuugauaugacugagaauccaauuuaaggauaaccuuaacaagcugagagagaggggaaaaaggcuggcagagagagagaaaaaaaaaaaagagacagagcugaagagacagaaagauauacagagaauacuuaccuuccuccccaaacugaucauauauuucucucuuuuuaggaucacucaauacuucauaagcuucugcgaccucuuuaaauuuuuccucugccugaggagauuuguucuuguccggaugaaauuugagggcuuguuuucgguaagccuuuuuaauaucuucaucugaagcuccuuucucaauucccaaaaugcaauaauagucuuuccccauuucgaaugccuugaaauuaacuuagauuucccuuuguaaaagaaaacagcguccccagucuuagcaacagauucuaagaaaaauaaaccaagcuggguauuuuaaaaguuaaucagcaauucagcuagcugucuuaaggcagcaagcagacagcgucucuguauucaauccuuccccaacggcucacuuacagauaaauauacacuacacaggagacagccuccuucuagauccucccauuuucacuacgugucucuguacuuucuagaacagcaaaugcuacaggacgucacuuucccagcugccucuagucaaaguacugagcuauguuuucuccuccuccacgauuaacuauucauuuuccgacuagcucuaccgucuuuauuuccuaauuaaacaggacaaauggguuaacaugccaauauuucaacacagaaugucacaacuauauauuuauguacuccauacuaggugaaaaucaucacagucauuaaacacccuauguuaaaagaaguuaaaguuaauauacagauaaaaggaacgacaauucuacuuuagggauuuuuuaauuuuaagcuauuugucuguuaaguauauaauaccaaaacgcagguuguuuaaauuaggauuuccaaguaauuuaugucgucuucaaaauuccuggggucuaucaaucagaaacgccagaaaguuuguguacuaguuucacauuguuaagggaguaucuauaauaaaauucaaaugcguuauuuuaaaauaaguaaaggacuuaaacaugauuuuagcuaacuaguuauuucuaguauacaugaguucauaguucuggcaaacaaauacuuauuuuugaaauuuuaguaucugaacuuaguuacuucaacuaaacuaaaacugaaugaggucccugccaccccucaacccccguccccugcagccgccccacaggaucccuauuuaaagaacuguggugcugcaggaaagcuagaacaaaguaucagguuacagacaguacauacucauguuccuuacaagacuuaacugcaacugcaucaauguaaaauuuggauaugccacuuaaggggcaguaauaugagaaauauuuuuucuuucaaaaacacauuucccuaauuauaaauauauauucauuguuggagauuuuggaaaacgcagaaaaaaguuuuuaaaaaucucccuauaauaucauuuuagguaaucccuguuaaauauuacuguauuuacuucuaauucuguuuucuauaaaucuucaugguuauuugcuguaguuuuauaauuuuuuguuaacaaaguuagaucauagcauuuauauacccuuuugaugccugcuuuugaaaguauaacauauuucagguauuuaugagacauuuucuauguauauaacucaucuuuuaucuccuguaugguuuucucaucuuuucaaaaauguucccauuucuauuagagagauaaauaagaaaagucagaagaauugcacacaguccaaauaaaauguuagaaaaccuuuaugaggaaaagaaaauguacauauauguuuagaauauaauaaaggguaauaaucauguguuaaccuuuaaagaaaugagaacgccuacucuauaugccaagcaaugaugauucagcaauucuuucugaauguucaucuuugugcauuuugacagcuacgauuuucuacucuucaaaauucucuacuuuaacaacaccaugacauuagaaauguauaacauugaucuagccuaccuguagguuacagagguuugucagcuauuuaucaauuuuuuuagccucaccaagaaauaauaucaaaagguacuuucaaauccaaaaaacuuagugaaaaaugcuaauauccagucaccuuaagacucccaguuuuaaaaagcauauugccaaacugaaauccagugcaaggaucaguaucacauagaguaaaaacagaauaaaaaucaccuauuacaaaauucauuuccaagggaguuccuuuaaauauuccuuaccaaaggaacggugacuuuacuauuuaacaaccggaaauuguucuggcggguaguguuugcagaaaaaaaaaauagacacuuauuugauucaaucauuuucagagagcuaggaauauuaucaaaacuugacacaguaaauuauuuuagagaaccugaagaccgggucuuucauauuugugagaaauuguauuauauauuaacagacggaaagaaaucuggcucccuagacacugaaaagggugaaaagggauuuucacauuucuuuaaauaucacacacacauaagaaucguaauuguaaaguugaaaagcaagaauucaccucaacuuugacauuucaaguuaauaagaaagcaaauauaaucgugauuuacgcgauuguuguauuacgugauuguuguauuaauacaacaaucuggcuagcuuuugguaaaaugaacagauacuugcacacuuauagcuuuguaaagcuuuguaaauaauucaaacauuuggcaauaguaaaagccacuaaauauuauuuuaauagcucuauaaauaccacaccuggaauuuauccuuagaaaauaauuuaaagacaauaauuauauguacaaauauacccauugcaaauagaugaaauaggguaaagcaucaagaugaucaucuuuaaaaguacauagcauuuuggagauauuuuacccuuacauucaccuuuucagacugagaugucuucucuacuaccuaggaguugaaaauccauuauacaauacgaucacuuuacauuaaaucuuggucauccaaguuuguaugauaugaaugcggcaauuugggggagggguugggauugucauuccugcaaauaauuaugacaaaaacaggaagaguauguaaaagggagaguagugguagccuguaggggaaauggaacagagaagagcugagaucaaagcuuauuuaauaaaaguaaaauaaauaaaagcuuuuuuaaagguuaaaauaaaaccaaaaaaauacauagaaauagucuauauggaauauuuagauaucacauaaaugcugcuuauaugauguuauagcuuacauguaugugugacggaaaguuugaagagaacaaaaacuagcuugaguuaguaacugacauacauuuuuucccuuaaaacuaaagaaugcugcauuuuuaacaaagauauaaaaauuagcacuugcauuuuuaaauuuuuacuuugcuacucaaacauugguaagauuauuccaugaaaacacaauuaucuucccuuuauuauaagaaaaguacagucaggugagguggcucaugccuguaaucccagcacuuugggaggccaaggcaguaggaucacuugagcucaggaguucaagaccagccugggcaacauaaugagaccuuaucucuacuaaaaacuaauuuuuuuaaaaaauggaaauuaagauagcauuuuaaccacaaaaaacuaaaaguauaauuuguuauucaguugaugucaucuucaucuucuacuuugacuuuauucauauauaauaaaaaacaaguuuucuuuuuccaacucacaaaucauuucucaguuuauaauaaaauaguacagaagaagauaaaaugccaugagucucagaagaaauuacaucaaaauucagaucaucacuuaaaugcuggaggacaaaugacuucucauauuuuaccaucgcaccugugaauaacuuuuccuggcaauauuuaauucuuaaaugggucauauuuaguccuaaauuuuuuuuuuuuuucuuuuuugagauggggcuugcucugucacccaggcugcagugaaguggcacaaucauagcucacugcacccuugaacuccuaggcucaagugauccugcugccucagccucucgaguagcugggacuacaggccaaugcaacaucuggcuuauuuuaauuucuuauagagaccaggucucacuauguugcccaggcuagucuccaacuccugagcucaaacaauccuccuuccuugaccucccaagauccugggauuacaggcauaaaccagggugcuugguacuugaaauuucgauccuggaauuacaggcauaaaccagggugcuuggacccugaaauuucuuuuuuuuuugagacagggucucgcucugucgcccaggcugguccagaauagagugcaguggcacaaucucggcucacugcaaccuccgccucccggguuuuaagaaaucucugcuucagccucccgaauagcugggauuacaggugcgugccaccacgcccagcuaauuuuuuuguauuuuuaguagagacgagguuuugccaccuuggccaggcuggucuugaacucuugaccucgugauucacccgccuuggccucccaaagugcuggauuacaggcaugagccaccacgccuggccaugaaauuucuuagucauucauauuagaaaauuaugaccuccauuccccaauaauuccuguccaagaauaagcaaauaaacugaggcucuuuuaaacucuguuaacagugcuuuagauauuugaauauauaaccucagaguauguaaaagugauuauauuugccgaggugacacccagggaauauucauaauauagugguuaaaagcauagauuuuggagcuggagugccuggguuagaauccugguaauacuacuuacagcuguaagaccuuggacuuaaaucucucugaccucagcuuccucaucugucaaacagaguuaacucuguuaacuguuaagcugguaacauuaauaccaauuuaggauuguugugaggauuaaaugcaaucaaugugugauacuuaaaugugauuggcacguagugaggaauaccaaagugcuggcuacucuuaucaugaugaugaucucauaugaacuugaaaauuuuuuuuccaggaaaauuacuauaccauaugcauaacaaaauguucuuauuuauaagcauacaugcacacacacucacacauacacacacagcuguccaauugguauuucuaaauauuccaguuaauauuugcuacucauucauguugauuuuguuaaaauuuaaaaucauuaaaacuucccauagguagcauucauuguauuucaguuccaauauuuauauucuuaaaguauauauauuugauuuuggaaucagaagaucuguccagccuuaauaucuguugaugccucacauaucucagucguaccaaauuacuugaaaauuaucuaggggaaaccauuauuuaucaauuccucuuagagggcuaguacaaaagaauaaagacuuaaaaaucugaauacuugguuucuaaucucaguucucccacuuaacaggugaguaacuuagaugaaucauuuaaauuaucugaauaccuaacucacaaagauuauugugagagucagaugagauaguacaugugucagcacuacaauuuauaugacaucuacauauacauuauuuucaguauuuuaagcuauauaaacuauuuugcuaccacuuggauguuuauugacaaauagucuccuuugacucaggaaguuuuacuuggcauaaagcauuaaaguaacuaccagauucacccccaaaggagucuggcaucccccaagaucuugccucuugccaaguucccuuuucagaccuuuaucucugaauuuuacuaucuucucaguguuaaaaaaaaaaaaaaccuguucuaugccuuccccauaauaacauuuauauaauacuuuacaguuuauaaaauacuuccauaugcuuucucacauacaucugauacucaagugauaagauuucaaagagcuuuucuauagcuacagucuaauaaugagcuaagauauucuugacaauucuuaaacauacacuguuccaauauuuacauaaaacuagaggguacuaggcugugucuauccuaauguuucaccuguuuuuaagauaauaucuaaauaguuauauaaaaucaaauuauuggccauuuaauaacggacuauaucuuaccucuacauacuauaauuuccuaaaaaaccaguaagcacuaagagguaucauuaccauagauugcuauagagcaaaugcuugauguaaguuugcaacucagacccucaauucucauuccugugaaaagguuccagagcauaauacuuacaguaccuuuuaauuuugugauggcuacaaaugcaacuuugucuuuaggggaaaaauagggaaauuuuuauuuauuguguauguguugccaagauacagacccauaaaaucuauuuauuuauuuauuuauuuagagacaggaucucacucuguugcccaggcugauuguguuccugaucucacaaucucagcucacugcagccucgaccuccugagcucaagccauuuucccaccucagcccccagaguagcuaggaccacaggcaugccaccaugccuggcuaauuuuucuauuuuuaguacagaugagguuucgccauguugcccaggcuggucuagaacuccugggcuuaagcgauccacccauuuuggucucccaaagugcugagauuacaggucugagccaccgcacucagcugagaaauuuuaaagagauucacuucuuaccuuaucuacguuacaagcugaaauacauaaacuuaaggcaagugucuuuaagacauuaagcccuauccauuuaagcuuaaauuguuuuagaaauccuacucucccacgccccuuaccuguaaauguccuuuuuuaggcaaugacaguaguuuggauucauuauauuuggaauuugucaacaguaucugacuguccauuuuauaguauuugauggguacacaaacuguuuaaaaaggugguuaucauagugcacauuuuccacaaauaaaguauuucaaucacucagcaaauauuuauggaguguuuauuuugugucacacacuauuuuaggugcuguuaacuagauagacauuauccuugcucucauucaacucauucuagagggggaagacaaacaauaaaaaguuaauaacgaaaugagaucguuuuaagagcuuuaaagauagucaaacagaggccggugcgguggcucacgccuguaaucccagcacuuugggaagcuaaggacugcagaucacuugaggccaggaguucaagaccagccaacacgguaaaaccccgugaaaauacaaaauuagcugggcaugguggcgugcaccuguggucucagcuacucaggaggcugaggugaaaggaucauuugggccugggagguggagguugcagugggccaagaucaugccacuauacuccaaacugggugacagagggagacugucucaaaaagaaaagaagaaaaaaaaaguuaauuauuauccucaacuugggcuggagugguggggauaggaaagacuucagaacagaaaauugugagcaaagucaugaaagacugauagauuuugacagagaaagggagaauuugcaauuuggaucaggaacacuaagucaagaagcaaaagagcauaaaauguauuugauacagcaaaaauacuggugagauuaaugcaugcaaauuaggaaggcuugcccugggaagcuggcagaaaauaaguuacggucagauuguucgaaguuuuuuuuauggagacaggguuuuacugucaccgaggcuggagugcaguggcauugucacagaucgcugcagccaugaucucuccugggcucagccucccaaguaacugguauuacaggcucacaccaccaccacaucuugcuaauauauauauagauauauagauauagauauagauauagauuuuuuuuuuuuuuuuuuuguagagacagguucucacuaugucucccaggcuggucucaaacuccugggcucaagcaauccucccgucucaaccucccaguguugggauuacaggcaugugcaacugcacccagcugaaaguuuuuaaugucacacuugaugacugcucuuuuaugcucuucaaaaagcacuaauucaauaguuuggucuuugaaaaaaaauuacuugaagagguugcuucauuucuuaaguguccauuuauucccaaaccagugaaauuacuuuucugguugucaguaagguaaaggguucuuaacaaaguuucauuaauaaucuguaagcuuccuggccaggcgcuguggcucacgccugugguucuggcuacucuagaggaucacuugagaccaggagcucaagguugcagugagccgugaucgcaguccacccgggugacagagggagauccugucucaaauaauaauaauuuguaagccuccaagagcaccaacauaagauggcaaacuaacuuaaaaugguugguaggaagaauaauuuuagucauaauucucuguggacuauugucuguaucaucaaaauuuccauuuuaucgcuacaguaauauuaguaauuccccaaguuuucaaauguugauacugugucauggcuugguuuuauaauacuuuccccgaagcacuauaauauauacauuuaauuuuuuugucuaguggucuuuaaaacaagauuuuaaauuguuuaaaaaauuaaaaaguaccuaccuuucaaaaaacaagaaaauaaaauugcuuuaaauguauagaaauuacuagauuuggagacacccaggggaucagacauauuuuauacuuaaaaaaauaaaucagccaggugcaguagcuuacaccuguaaucccagcacuuuagaagcacgaggugagaggaucacuugagcccaggaguuugagacuagccuggguaacaaagugagaauuccaucccuacaaaaaauuuacaaaucagccaggcaugguggcaugugccuguagucccagcuacucaggaggcucaggcagggggauggcuuggguccaggaggucaaggcugcaggugagccgugaucaugccacuguauucaaaccugagugacacaauaagacccuguauccaaaaaauauauauaucauuuccuuuuuuggggaguauagaacuaacuuauucuaacugggaugaauaaaauauucaagcaacaacuagcccuucuuuguuacccucuuuuacaauaaguccuugaaagcuugcuaaugacuagugaauguauggcgagcuaauauacuuuucuggcauuuugaaauaauuuaaagaguucuuuuuuuguuuuguuuuguuuuuugagacagaaucucacucuguugcccaggcuggagugcaauggcacagucugggcucacuguaaccuccgccucccggguucaagugauucuccuauuucagccucccaaguagcugggacuacaggcaugugccaccacacccagcuaauuuaaaauaaaguguucuuuacacugauuuuaaacacugaguuaggcccagggugauagcucacacuuguaaucccaguacuuuaggaagccaaggcaaaaggaucacuugagucuaggaguucaagaccagcugagcaacauagugagaccucguaucuacaaaaaauaaaacagauuagccagauguaguggcaugcaccuguaguccuagcuacuugggaggcugaggcaggaggaucacuugagcccagggagaugaggcugcaauaagccaugaucacgacaccacugcacuucaagccugggcaacagagcaagacugucucaaaaccaaaaacacuguauuagccaaaaaauuuuaaaaagagcuagaguuucuacaucauuuuaaaugggucuugauaaacuaauauuucauuauaacauuuugccuguguugaaagaucacacuauuuagaccagugcuguccaacagaaauauaaagcaagcuacaaaugcaagccacauuuccagaaaccauauuuuuuuaaaguaaaaacaaacgugaaauuaauuuuaauaauguauuuuauuuaaccuaguaaauccaaaauauuaucauugcagcauauaaucaaaauacaaauuaucaaugaaauacuuuacauucuuuauuuuuuguacuaaauauuugaaauacagcauguauuuuacacuuugaccucaauucagauagguacauuucaguagcuuaagagucucauguggcuaguggcuacuguguuggacagugcagaucuagugguuccuucuagucggcaguacuauaauccaauuuuucagaaaucucagccugugaaucucagcccaaguauaccacacauacauaccucucacaugcacauuuaggguaaauaaagucuuaacaggugaacucuauuuuacuuauaaaauaguacuacauuguucauccauauaaacaauaugauaauuuuuuucaaaauaauacuuuacacuuaagguaguaggaauguauuuacacaugcucaguugacauacacuuucacaauguuuaauuguaaaagcaacacuuggaaaugaggaaucuacgugauuuucacuuuuaucuuuucuaaaaugucucuucucauacucuuuucuuauauguggccugagaugucaucuuaauuggcucauuagaaaaaugagaguaguuaaaaaaaaaaaaaaagagagagaguaguuuaaggaguacacagaaaaaaaaugucuguagcccaagaggaggagaggauaugcagcuguuucauugaauuauuaggcucuuagccaagacugcaacaaacugauuauuuagcaaguuuguuuagcuaauuguuuacaauucucaaauaauuuuuuucuuuuuuuuuuuuuuuugagacagucuugcucugucacccaggcuagagugcagugguuucauuauggcucacugcagucucagccuccggggcucaaguaguccucccaacucagccucccaaauagcugggacuacaggcaugugccaccaugucuagcuauuuuuucuuuuguagagauagggucucccuauuuugcuuaggcuagucuugaacuccugggcucaagcuaucuucccaccuccgccucccaaagugcuaggauuacaggugugagccauugugccuggccucucaaaugauuuaauuuaaaucaguaccaaacuuuaacuaugaauuaacuuuaucguauacugcauccauuaaaacauaaucacgaaaccacugcuaccauggagacuuaacuaugauucgaagacuuuaauaauggcuaccaaauauaaguauuagaacauuuauauaaauaagcccguauguccuauaguauuuaccaacuacuauaaaauucagccauugacuaccuaauuccaaaugcauaagcuugaacuauuauaauugucuaaagaaggauauuuagagaaaaauauaucucuaaaauaaauuaacuguaaauggauggguuuuaauguucaaguuauuaauauuucaaaaauauaaacuuuuuguuaucuaggucaaaucagcauaucaagccaaccauuacugagaccccacugugcuauacuguuacauguaacaugaaggauaaaacaguauaauacauagucccuacccuuaaggaguuuauacuauaaauaagucaggcacgguggcucaugccuauaucccagcaccuuagaaggccaaggagggcggaucaauugaggucaggaguucgagaccagccuggccaacguggugaaacccuaucucuacuaaaaauacaaaaaaauuagccagaugugguggcacacacuuguagucccagcuacuugggaggcugaggcaggagaauuguuuaaacccgggagguggagguucagugagccaagauuguuccacugcacuccagccugggugacagagcgagacucgaucucaaaaaagaaaaaaaauaaaagaaaaaggaguuuauacuauaacuauauaaaguaauaccuaaugucuauuguugcuuuugccagacagcgguagaguugaguagcugcagcagagacuguauggcccacaaggccuaaaauaguuaccgucuggcccuuaccaggaaauguuugccaacuucugcuuuauacaaauuauucuucgcuggagggagagcaaagucuaaauaaagcacuaaacaugauaaaauuuuauugcaucuggcaaacuuuaaaaacuauaguuuuuacaauaaacacucagaaauaggccgggcgcgguggcucaagccuauaauccuagcacuuugggaggcugaggcggacagaucaccucaggucaggaguucgagaccagccuggccaacaugguuaaacccugucucuacuaaaaauacaaaaauuagccaggugugguagcacaugccuguaauuccagcuacucgggaggcugaagcaggauaaucgcuugaacccgggaggcagagguuguagugacugagaucgcaccauugcauuccagccugggcaacagagacucugucucaaaaaaaaagaauaaaggucaaccuguuuuugcuugucugaugguaaaauaaaacuuauacgcugauucucaaccuggacaugacugcuaaagggaauauauuagaauauuuaaagugugaggugagaugcuuaucaaaaaggguggcauguguuuuaaaaggcagagaaagacuguuuaauaaucauaccucuguauuguuccccuugaccauucccaucuaauucaucgguccuggucauaaaugauaauggcuauuucccaaaaugaaauuuacccugaaguaguugauucucauuuguuauguucuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggugcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccucauuuguuauguucuauaaaacccauaguuauguucuauaaaacauuugccaugguuauguucuauaaaaucaucccaaaugcuaaauuagagaauagugaaucacugccccuaagggaaauacaguguuagguuccugccaggcucuggucacauuuucaucaacuggucaauacauaaccucuucuauguguauuucuguuaaagauaccuuaauaauauauauuguugauucacugacauugaacucauagccaacagaacuaugacucaugccugaaugaagcuuaccuaacaccugaauuuucucuguaaggcacaucacagccuucuugugcuuagcaacacuagacagcacuuuagcacuaugcuuagaggccauuuuaaauaguaaagucaccaauaaaaaaaaagcacaaaaauacaaaaauguggcacuaaauggaccaugaaaaggagacuuguuuaaaaguaugagagcugaaacaugagggcagaccacugacuuguucaaccucagcuaguucauuuuuuguguguguagagauggugggagggguugcacuauguugcccaggcuggucuugaacuccuggccucaagcaauccuucugccucagccucccaagguggugggauuacagaugugagccucugugcaaagcucagcuaguucuuaaauauuuugccacucugaacaugcguaugucuaaaaaugaccuugaaagcauuucaaguauugcuuuugggguuacaaauacauuucggugaguaggcaaauucauaaauacagaacugacaaauaaugagaaucaacuguauaauaauaucauuacugagaaucuucugcauuaaccauaaucaguuaaaaaauuguuuuugaacaacgguaacauuaaugaguacacaggcaccaaaguuaauaccuuugaagggauauuuguuauauauaaagcaaauagggcauguguguagguguauuucccucuucccuacuccaggagcccuucaccuagcuuacuucugcuuugagacucacccuguagaugggcuucugugaagcccaaacuuggguuagauuccccggaccuugagcuccuacacuuccccccauaucuccacuguauuacacaucaccuuacauaaccaucuguguguuuaugccucauccacuggauuguaaccagcgggguccuguuuuauuucuagaacaaggcguuuacaauauauugcuguucaauaaacuuuuacugaaugaaugaaucacaaagagaugagaaauaacaagaaccuaaaguaggaugacuaugauauaaccagaccaacagguaggauuaaguaguaagaaauagcaucuguauaauuugcccaucagcuggauguagagaagaggaaggauuucagacugcccauuucuggauugacaaaggugugcacaguugugcuacuaaugaaaguauagaauauaagaagaguacuuuuuaaguguaaagacaaguucuacugugaacauuccuguaaccuuauuaauaaccccuucaucuaugcuacuucaauaguugguaaguuuugcugcauaagacugcauuccuaguuaucuauuucucuggcuaacuaccucauuaaaauguaagauaauauaagguaaauuuuauuuaauuuuugacucaccaaaaaccaacacaacaauauucauuugaauugaacguggaugaagacauccaggagauauucugaacuggagcuuagaaauauuaguuggagacaaauauuuagaaaggauccuaaugcaagugauauuuuauagugugaaggaggaacaauuuuuggaaagaaucaaagacagaacuuugggaugaccagcauuuaaggggcacaucaaucaacaggagacaauaaaaaagacagaaggaaccaucagagaucaaccaggugagaaugcuacggcagacacugcugguuacauaccaaagaaccauucauaucuucuuucuagcuaacagauaucuucucccagaaauagaguaaugaacucaaggaaggugagagcaucccccagucucuuggggauggcucaggguugauuuaaaucaaucacaguaguauuuccuuugccagugauuguuuaagggcagacaugugacaugguucuagccaaugagauguaagagagauguucuggggauuuuccucccuauaaggagauauccaccaaggagaaaccccagcacugcauccuguuuuugaauaaugaaauucuuacaauccuaaagguagacgucuaugacacagugaaaacggcagaauacaaagacaguaagagccuaacuugacaguguugcaucucuaaaucaaucuuggaacuaccuaucauuggacuuaagagauucucuuacuuggagcugaaggcauccugacaccacuaguguccaaaaaccaaaagacagaagcuauuucaugagggauacagaaaaguaaauaaagaugauagaaaaguaucuguaagagugagaaugauuuuggcuucaguaguaauaguuaauccuggugagcccucaaaaaaauauuaaccuaaaaacacauguauccucauuuagucucucagaauucuaugagguagauagaauugugaccaauaaaagcuagaaugugguaaauugaacauuaagagggaaaugaaaaugaaaugguaaauuuaaauauuucuaacaaguugucugaaggagauagacuuguaauaaggaaaggauaaaagagguuuuaagauaguccagagaagaagaaaacaauauagaggaggauauuuaaaaacauguaagacauauaauaaaagaaauaauugcuuaaaugacaucucaaagaagauaaaauuugauacgauuugauaccaagaguaccaguagaugagacgugaauaaaauuagaggugggcucugagagcaaaaggaaguagacgacgacaauuuauaaauuugaaaguaaaaggacuaggaagaccaagaaguucauacacaguaucaauacucuguuuaaaaagagaggaguggggggacauccacugcuaaggauucagaguaaaguaggguguuugauaagaauggugguaguucaguaugucaauuauggaaaauagggaagcagcugaucagaaacaaacaauuacuaaaucccacuaaggacccagcugaaaccagaaugaaugaacauucauuuacucacaaauuuuuauuaaggaccuuucauaugccaaggcaccuuucuaggugcuagggauacaguaugaacaaaaaucccugccucauucucuguacauucuaguagggggagauacaauaaaaauuuuuaaauacuguaaguuguguuagacggugauaaaagcuaagaaaaauaaagcagaaaauguaaauaaggagauucaaaauuuagauaggguagccagaaaugauuucagagaaaaugauauuagcacuacaaucugaaaggaaaggaggaaagcuaugcauccauaugguagaacuuauuggauagagggaaauaucaaacaccaaagccuagaagugagggaaugcaaggcaucuuugaggaaccgcaagguggcugagucagaaugauagagauggugaagggguugaaagauggucagagaaauaacagaugcaauacagaggcuuguaggccacuaaagacuuugacuuacauucugagggaagauacaaugccauuggagaguuuuacgcgaaugauaggucacuuugauucuuaacagcgugggaaagacggugggcaaggguggaagaccaauaagaacugaugggcacaguggcucagaccuguaaucccagcacuuuggaaugcugaggcaggaggauagcuugaggccacgaguuucagacuagccuggacaauauaacaauacucugccucuacaaaagauaaaaaaugucagccagauaugguggcacaugccuguaacccuagcuacucagaaggccgaggcaagauugcuugagcacaggaguuugagguuacagugagcucugauuauacacugcacucaagccugagugaccaagugagacacugucuggggggggggggaaauacacacacacacauauauauauaauguaugcauauauauuauguauauauauaauguaugcauauauauuauguauauauauaaaaucuuuauguauauauauguacauauauaaaauauauauacauauauacauauggcuuagggugccaaagacuaaacaaacucaaaaaagguuaaagaauuuggcaaggucacugaaguagcaauauacauauauauucaggugguuuggaccaugauguagcaguggaggugaugagaaguggugaacuucuggauauaucuuaaagguagagucaacaggauuuccuggugaaucaaacagggaaugugaggaaaaaccaauaaggacaccaagguuuuucaacuucagcaaacacagaacagacuugcuacuuacuaaaauagagaggggagaagggagaaacugaggaguucaauauuggacauauaaaauaaagaugcauggggccaggcacaguggcucaaacucagcacuuugggaggccaaggcagaaggacugcuugaggccaggaguuugagaccagccuaggcaacauagcgagacccccaucucuacaaaaaauuuaaaaauuagccaggugugcugaugcaugccuguaguccuagcuacucaggaggcugaggcagggggaucacuugagcccaagagcucaaggcugcagugagcuaagauugcaccacugcacuucaguuugggcgacagagauccugucucuuaaaagagaaaaauuugggaagaguguaggugauauuugaaaccaugagacuagaggaaauuacuagaaucauagauaggguaaaagggcacaaggauugaguccuagcacucacaaaugcaguaguaagaauaacuauuacuaggaaaguggggccucucccucaccccugagaugaauccuaauuauucuaagccaguaugacacuugauagaguaagccugugacucaacucuggucaggacaagguuaauaagauuggcaguuguggcagggguggaggguagggacacugguagcagaaacuuuccccuuccauuuaacaaucaugacugcaugacaccuggaacuguggcaaccauuaugcaaucauuaggggaguaaagucaagaagcugagggugguagaaggcaaagaugaaaaaaacauggguaccucauaaauuguugagcugcucaucaaccagccuuagagccacucuaccccuggauuuuuuauuauuuaagccauuuaauaaggguuuucauuacuuguggucaaaaguaucuggauacaauaaucucauuuaauuuucaaaacaaugcuuagggugacaaggaguaaacaaacucaaaaaagguuaaagaauuuggcaaggucacugaaguagcaaauggugauuugaaguucauccgacuccaaagucaauuugaacugauuaagaguuguugauuuaaagaauggacacaacuaaaagacaaaggggagugggaguugagaauuacugacgugaauggcaaagaaggaaagccagcaaguaagagauggaaagaaaagagaagugucaagagacuagaggaacggaagaaguacauuaggaaacaaacugacaagaggucaucuugaggagaauaucagacuugaagauuuuuauuguuugaguugucuggaugaagacuagaugcaggcuguggccauaaguagugaggaaauugcauuucgaguaguuaaggauuaauguaguaauauuuacuacauggcacacauuauuuuaugcacuuaggauucagugguaugugaucugagaugaaguucccgggcuguaaccuggccagaagcuugaagucuuuaccccaagauauaaacagagcacaagaaucaggcugacaauugggaugacaaugacucacauucacuagcuuguuucaaauaauuuaacauacacuaggaaauuaaauguuuaaugaaugaaugaucuaucugaucauucagcuucucccauucugacucuucaaaccauugcuuaauuagcuacaggauauuauugguuagacugauacaaauaauugucugaaaacaauagggagucucugcaaagugauccaugguuucaauccaccuucacucacuagcaugcucaagacaagacggugagauauaugucuauuuuguuuacuacuguaucucuagcacuuagaacaaugcccagaauuuuuguugaauugaauaaaugaauagauuaauuaggaccuacuagaugccaggcauuauugucaucucaaagguaaauaagauagcuccugcccuugaccguuuaccacuuaaaagcucuaacuaaaaccucucaaucuucauuuauaucaaagugcauaguuaaggagcaagguuguuaagaaucuaaagguaauaucuguccuggauaaaaggugucuaaagcuuaauaugcacauaaauuuuuuaaaacuaacauucuugcuugaaaaaauaguauuuauauuauugcuacaauuagauaaccuggcauaaacaaugauuaugauaaaccauagaaaaauaguaccuccagauauuucuuauaaaaaaauuaauuccuuuuucuuaaguacaugucccuucaaauuuuuuuuaaaugaagugagaauaucaguuaauaugaagcaacauaaaggaacaaauggaaucagaaggcaaauuccaaagagaucacuacuauaaauagagacauggaaaugucagaacagagaagcaagguuccacuaaaaaacaacaaaauuguuauaccaaaugaguuuucuaucuuguacccacccacuuccaguuaaggauuucacuggcaaagauccuugaucuuucaauaaccuauuuucagaaggaaauguugucaguaaauguugucaguaaagguagacauccugauuacaaaaauuaagauguuuuugguucuguacagauucuucuuccucuuguaccuaagaagcagaaaaccuccaacccaaacaccgaugcuucauauagaagacaguucacaaaauaaagagcacuggauuagaaaucuagucuuggcucugcaauuaaucuuggcacuuuguagaaggcacucagcaaucuguguuaugguuuccuccaauauaaaaugaaacaaaugggcgagauuaccuucaaggucuuuccaagacugauauucuaagaaaaguuugugugaaacuacccuucagugccaucuggccucaaaggcccuccacauucauaaucauauguagcuuuguaggaaaaugauaaguggaauaaagaauucaacuugauauuuauuaaacuuuuaccaacauaaaagcauacugggcaaaccaaagaauaagacgcgguccuugacaagcccucuuuuauacagaggaggggaaaagggagaagacaaaauuucuguauucauaacauuuacuacaaucuagccagggaaacaaaauuuaauucacuuuaauuccucaaauauuaaauauguuuuguguaaaaggguaguuuucaaaucuugaugaguagaaucaacuaugaugcuuucuggaaaaaaaaagaaagaaagaaagaaagaaauauagauuccccaaaacaugauucaguagguccacguacggcuaaaaagcacucuugaugaugcuggugaccuuuuguuaagaaacucugccuuagucuagcuaacaaaaaguuugaguuaguccaguuaaaagaaaaacuuucaauugauucaugaauaggacagaccccaauugaaaguaguucaaugacuuagggcugaagggauaaggaggauuuucacaggaugaaugcagaaacaaggcaaagaaaacauuugauuaaaguggagcaacagccugauuuggaccauuccagugaaaagucccuaguuaaagguuaauuggcaguuucugauugguuaagacaguuuacauugaauuagguuucaguuugcuuauguaggaacacagggcacuggagguaccccagucuaaucacuucccauuuaauuauuuuaacaguuuaaaaaaagcuguuucuagacccugaauucaucucaagacuauauacccauaacuagaaacaaacugcaagccauuaaaaauaagcaaaagucggccagagcuuguacacuuguguauuucagugguucucaagugugucugcacuuuaggauuaaccuguggggaaaagcaagagagaucagauuguuacugugucuguguagaaagaaguagacauaggagacuccauuuuguucuguacuaagaaaaauucuucugccuugagauucuguuaaucuauaaccuuacccccaacccugugcucucugaaacaugugcugugucaacucagaguuaaauggauuaagggcggugcaagaugagcuuuguuaaacagaugcuugaaggcagcacucuccuuaagagucaucaccacucccuaaucucaaguacccagggacacaaaaacuguggaaggccgcagggaccucugccuacgaaagccagguauuguccaagguuucuccccaugugauagucugaaauauggccucgugggaagggaaagaccugaccgcccccaagcccgacacccguaaagggucugugcugaggaggauuaguauaagaggaaggcaugccucuugcaguugagacaagaggaaggcaucugucuccugcccaucccugggcaauggaaugucucgguauaaaacccgauuguauguuccaucuacugagauagggaaaaaccgccuuagggcuggaggugggaccugcgggcagcaauacugcuuuguaaagcauugagauguuuauguguaugcauaucuaaaugcacagcacuuaauccuuuaccuugucuaugaugcaaagaccuuuguucacgugucugcugacccucuccccacaauugucuugugacccugacacaucccccucuucgagaaacacccacgaaugaucaauaaauacuaagggaacucagaggcuggcgggauccuccauaugcugaacgcugguucagcauacuuugucuuugugucuuuuucuuuccuaagucucucguuccaccuuacgagaaacacccacagguguggaggggcaacccaccccuacauuaacccaggaagcuuuuacggauucacauauaguccaauuaaaucaguuucugggaguaggaguuagggcuaaccuuucuuucuuucuuucguuuuugagacagaaucucgcugugucacccaggauggaguacaguggugcgaucucagcucacugcaaccuccccgucccggguucaggcaauucuccugccucagccucccgaguagcugggauuacaggcguccgcuaccaugcccagcuaauuuuuguauuuuuaguagagccgauguuucacuauguuggccaggcuggucuugaacuucugaccuuaggugauccacccgccucggcaugaggcaccucgcccagccuaccuuucauauuuuuuaaaagcucccuguagccaauguggguaaccacugaauaaauaaaaggucacugcaauugguuagucagguuaaguuucaugagaaaagacuauuuuuaaucuggauuuauuuagcuaaagguuaaugaaaaagauaaauguaauagaagaacugauuaucuaaauauaugauccaauaggaaaagaaacaauaaauguuuugaccacaaaaaaagggagaauaagaacaguaaauauaugaauuuuagacauuuuguuuuugaggcaacauguaaaaccaaaguuuuguagguagcuguuuggaaacaucuaggaaacaaguauaggaucaauuuacaggaaauuacaaguauauuagugcauauuuguauauagcagcuuuauuauaaauuauuguaauguaugcuauggaauaagcuaaacucacuuaagaaccggaugauaaggccaguuauuuaagacagaugcuuucaggagucccaaacuuucaaucuaacauuauuaccuaaaguaauggaaagcugggaguguugucuuacaagaagagguggagagcuccaaauuuuucucuaaaaauuaauaaucuauuuccuauauauccuaugaugcccuguuauaucucccaugaucauaaucaaaggacagauccuggcaaugaauguguggagugaccaaacaaauacuccauuaauauucaaagaggccuuuuguauaauacacuaaagauguuuguucuuuuauuagauuugaagaacacugaaaaguuuggaaugacaccuuagcaaccccccaaauauuccucccagcuucacugaagagauccuaaaaagcaguuuauuuauauuuucacaaagaaccuuugucucaagcauuaauuuuuccaaaagauuaagcuaucaagaauuuuauuguggcugggcgcgguggcucaugccuguaaucccagcacuuugggaggccaaagaggguggaucaugaggucaggaguucgagaccagccuggccaacauggugaaacacugucucuacuaaaaauacaaaaaucagcugggcguaguggugggugccugucaucccagcuacucgggaggcugaggcagaacugcuugaagccaguaggcagagguuacagugagccgagaucaugccacugcacuccagucugggugacagggugaguccgucucaaaaaaaaaaaaaauuaggcauaguggugcacaccugugaucccagcuacuccagaggcugaggugggagaaucucuugaaccugggaggcugagguuucagugagccaagaucgugccacugcacuccagccugggcaacagagcgaguauguaaaaaaaaaaaaaaaaaaaauugagguccuuacauauuuucaauauucagugauaacuaaaauaaauugagauauacauaaauuuguuuugaggguaaauuauagcacugugguaaauuacauugaucaaaagaucugauuguauugccuaauuaauaaaauaugaaaaaaucaagacauuuucaaaauacaacuggaaaauuucuaccuagccgcacacccaacacugcuuuuacuguuuuucuauacauuaugauuaaaucuguagucccauacgugcacugauuuuucaaaugcaaauuccaccaaaauuuauagggauggccaugaacacugaaaaagaucaucagagcuauaaauggauacuacugccuuaaaagcugauuaaagggaaaugauggcucaccuguaucuacauucauauuaacugcuauuuuggugcuuaagcaaaugaacacauuacuuuuagguuuucagaaagaaugcagcauauauauauuucucacaauuacucuuaagagcugcugaaaaaguauuuuuuuagaccuaaccaaguaagacaaaaugccacaaagucgagaaaguucauuuuaccucauuguuuguuauuuaaacaaauaauuuuggaaaaaaaaagucacugugauauacucaauaauaaagaguaagacuucuaaaguauccucacgauuccuggagcuuacuacuauuaacacaguaaauuacaugccacgauauguuggagaaggucugaagaaaugucuggcauuacuugguaacugaaguacauaacauaaaauaccaauuuacacacacacacacacacacacacacacacacacauauauauauauauauaccuaguccugugaugacaauucagaauaugaucuuacauuugaguacccacaggauggggugggagaaacuacgccuaagaagcuacaaaaucuauuuuggucaagaaacaaugcuguucuuaacuuaagagaccuuaacaggccgggcgcagugccucgcgccuauaauccuagcauucugggaggccgaggcggguggaucacgaggucacgagaucgagaccauccuggcuaacacggugaaaccccgucucuacuacaaacgcaaaaaauuagcccagacgugguggcaggcgccuguugucccagcuacucgggaggcugaggcaggagaaucgcuugaacccaggaggcggaggaugcagugagccgagaccgcgccacugcacuccagccuggguaacagagcgagacucucaaaacaaacaaacaaacaaaaaaaaacccuuaauaaaaauggccauggacacauacauauacuagguuauuaaaucuggcuaacacugaacuuuaagaacaaucacguuuuuggauaaagaaaagggcagucauacuuuuagagccucauccacauuauuuuaaacaaaaaacuuaaaauauggucgagaacuaacaggcuuccagccugaauucaacacccacccucgugauaaaacuaaaaaaucggacagucuguaaguaaaauacagggacacuuuacuacccugaaaaucaugcuggguucccgcuacgccgggcagacguuuucaggagcaucaccgcgcggcgucucggacgcacuucuccuggcgcccuccgggcggcagcgcucucgagacacuguugcuucgccgucacgcccgucguugucacgcccuuccccgcggacaccgagaaugacccauagcggaaaauucuaccgcacuaccucccugaggcagcgaccgguaagaaacaaccuuuucuucaggcuucccaccacccaaacacagucgcagucaacuggccacuaucacccaccacccugcaggaacaauuacccagccucaccccaagaacgcgcggaga

SEQ ID NO: 21379 - RNA, 38167 nt, Homo sapiens
ucuccgcgcguucuuggggugaggcuggguaauuguuccugcaggguggugggugauaguggccaguugacugcgacuguguuuggguggugggaagccugaagaaaagguuguuucuuaccggucgcugccucagggagguagugcgguagaauuuuccgcuaugggucauucucgguguccgcggggaagggcgugacaacgacgggcgugacggcgaagcaacagugucucgagagcgcugccgcccggagggcgccaggagaagugcguccgagacgccgcgcggugaugcuccugaaaacgucugcccggcguagcgggaacccagcaugauuuucaggguaguaaagugucccuguauuuuacuuacagacuguccgauuuuuuaguuuuaucacgaggguggguguugaauucaggcuggaagccuguuaguucucgaccauauuuuaaguuuuuuguuuaaaauaauguggaugaggcucuaaaaguaugacugcccuuuucuuuauccaaaaacgugauuguucuuaaaguucaguguuagccagauuuaauaaccuaguauauguauguguccauggccauuuuuauuaaggguuuuuuuuuguuuguuuguuuguuuugagagucucgcucuguuacccaggcuggagugcaguggcgcggucucggcucacugcauccuccgccuccuggguucaagcgauucuccugccucagccucccgaguagcugggacaacaggcgccugccaccacgucugggcuaauuuuuugcguuuguaguagagacgggguuucaccguguuagccaggauggucucgaucucgugaccucgugauccacccgccucggccucccagaaugcuaggauuauaggcgcgaggcacugcgcccggccuguuaaggucucuuaaguuaagaacagcauuguuucuugaccaaaauagauuuuguagcuucuuaggcguaguuucucccaccccauccuguggguacucaaauguaagaucauauucugaauugucaucacaggacuagguauauauauauauauauguguguguguguguguguguguguguguguguguaaauugguauuuuauguuauguacuucaguuaccaaguaaugccagacauuucuucagaccuucuccaacauaucguggcauguaauuuacuguguuaauaguaguaagcuccaggaaucgugaggauacuuuagaagucuuacucuuuauuauugaguauaucacagugacuuuuuuuuuccaaaauuauuuguuuaaauaacaaacaaugagguaaaaugaacuuucucgacuuuguggcauuuugucuuacuugguuaggucuaaaaaaauacuuuuucagcagcucuuaagaguaauugugagaaauauauauaugcugcauucuuucugaaaaccuaaaaguaauguguucauuugcuuaagcaccaaaauagcaguuaauaugaauguagauacaggugagccaucauuucccuuuaaucagcuuuuaaggcaguaguauccauuuauagcucugaugaucuuuuucaguguucauggccaucccuauaaauuuugguggaauuugcauuugaaaaaucagugcacguaugggacuacagauuuaaucauaauguauagaaaaacaguaaaagcaguguugggugugcggcuagguagaaauuuuccaguuguauuuugaaaaugucuugauuuuuucauauuuuauuaauuaggcaauacaaucagaucuuuugaucaauguaauuuaccacagugcuauaauuuacccucaaaacaaauuuauguauaucucaauuuauuuuaguuaucacugaauauugaaaauauguaaggaccucaauuuuuuuuuuuuuuuuuuuuacauacucgcucuguugcccaggcuggagugcaguggcacgaucuuggcucacugaaaccucagccucccagguucaagagauucucccaccucagccucuggaguagcugggaucacaggugugcaccacuaugccuaauuuuuuuuuuuuuugagacggacucacccugucacccagacuggagugcaguggcaugaucucggcucacuguaaccucugccuacuggcuucaagcaguucugccucagccucccgaguagcugggaugacaggcacccaccacuacgcccagcugauuuuuguauuuuuaguagagacaguguuucaccauguuggccaggcuggucucgaacuccugaccucaugauccacccucuuuggccucccaaagugcugggauuacaggcaugagccaccgcgcccagccacaauaaaauucuugauagcuuaaucuuuuggaaaaauuaaugcuugagacaaagguucuuugugaaaauauaaauaaacugcuuuuuaggaucucuucagugaagcugggaggaauauuugggggguugcuaaggugucauuccaaacuuuucaguguucuucaaaucuaauaaaagaacaaacaucuuuaguguauuauacaaaaggccucuuugaauauuaauggaguauuuguuuggucacuccacacauucauugccaggaucuguccuuugauuaugaucaugggagauauaacagggcaucauaggauauauaggaaauagauuauuaauuuuuagagaaaaauuuggagcucuccaccucuucuuguaagacaacacucccagcuuuccauuacuuuagguaauaauguuagauugaaaguuugggacuccugaaagcaucugucuuaaauaacuggccuuaucauccgguucuuaagugaguuuagcuuauuccauagcauacauuacaauaauuuauaauaaagcugcuauauacaaauaugcacuaauauacuuguaauuuccuguaaauugauccuauacuuguuuccuagauguuuccaaacagcuaccuacaaaacuuugguuuuacauguugccucaaaaacaaaaugucuaaaauucauauauuuacuguucuuauucucccuuuuuuuguggucaaaacauuuauuguuucuuuuccuauuggaucauauauuuagauaaucaguucuucuauuacauuuaucuuuuucauuaaccuuuagcuaaauaaauccagauuaaaaauagucuuuucucaugaaacuuaaccugacuaaccaauugcagugaccuuuuauuuauucagugguuacccacauuggcuacagggagcuuuuaaaaaauaugaaagguaggcugggcgaggugccucaugccgaggcggguggaucaccuaaggucagaaguucaagaccagccuggccaacauagugaaacaucggcucuacuaaaaauacaaaaauuagcugggcaugguagcggacgccuguaaucccagcuacucgggaggcugaggcaggagaauugccugaacccgggacggggagguugcagugagcugagaucgcaccacuguacuccauccugggugacacagcgagauucugucucaaaaacgaaagaaagaaagaaagguuagcccuaacuccuacucccagaaacugauuuaauuggacuauaugugaauccguaaaagcuuccuggguuaauguagggguggguugccccuccacaccuguggguguuucucguaagguggaacgagagacuuaggaaagaaaaagacacaaagacaaaguaugcugaaccagcguucagcauauggaggaucccgccagccucugaguucccuuaguauuuauugaucauucguggguguuucucgaagagggggaugugucagggucacaagacaauuguggggagagggucagcagacacgugaacaaaggucuuugcaucauagacaagguaaaggauuaagugcugugcauuuagauaugcauacacauaaacaucucaaugcuuuacaaagcaguauugcugcccgcaggucccaccuccagcccuaaggcgguuuuucccuaucucaguagauggaacauacaaucggguuuuauaccgagacauuccauugcccagggaugggcaggagacagaugccuuccucuugucucaacugcaagaggcaugccuuccucuuauacuaauccuccucagcacagacccuuuacgggugucgggcuugggggcggucaggucuuucccuucccacgaggccauauuucagacuaucacauggggagaaaccuuggacaauaccuggcuuucguaggcagaggucccugcggccuuccacaguuuuugugucccuggguacuugagauuagggaguggugaugacucuuaaggagagugcugccuucaagcaucuguuuaacaaagcucaucuugcaccgcccuuaauccauuuaacucugaguugacacagcacauguuucagagagcacaggguuggggguaagguuauagauuaacagaaucucaaggcagaagaauuuuucuuaguacagaacaaaauggagucuccuaugucuacuucuuucuacacagacacaguaacaaucugaucucucuugcuuuuccccacagguuaauccuaaagugcagacacacuugagaaccacugaaauacacaaguguacaagcucuggccgacuuuugcuuauuuuuaauggcuugcaguuuguuucuaguuauggguauauagucuugagaugaauucagggucuagaaacagcuuuuuuuaaacuguuaaaauaauuaaaugggaagugauuagacugggguaccuccagugcccuguguuccuacauaagcaaacugaaaccuaauucaauguaaacugucuuaaccaaucagaaacugccaauuaaccuuuaacuagggacuuuucacuggaaugguccaaaucaggcuguugcuccacuuuaaucaaauguuuucuuugccuuguuucugcauucauccugugaaaauccuccuuaucccuucagcccuaagucauugaacuacuuucaauuggggucuguccuauucaugaaucaauugaaaguuuuucuuuuaacuggacuaacucaaacuuuuuguuagcuagacuaaggcagaguuucuuaacaaaaggucaccagcaucaucaagagugcuuuuuagccguacguggaccuacugaaucauguuuuggggaaucuauauuucuuucuuucuuucuuucuuuuuuuuuccagaaagcaucauaguugauucuacucaucaagauuugaaaacuacccuuuuacacaaaacauauuuaauauuugaggaauuaaagugaauuaaauuuuguuucccuggcuagauuguaguaaauguuaugaauacagaaauuuugucuucucccuuuuccccuccucuguauaaaagagggcuugucaaggaccgcgucuuauucuuugguuugcccaguaugcuuuuauguugguaaaaguuuaauaaauaucaaguugaauucuuuauuccacuuaucauuuuccuacaaagcuacauaugauuaugaauguggagggccuuugaggccagauggcacugaaggguaguuucacacaaacuuuucuuagaauaucagucuuggaaagaccuugaagguaaucucgcccauuuguuucauuuuauauuggaggaaaccauaacacagauugcugagugccuucuacaaagugccaagauuaauugcagagccaagacuagauuucuaauccagugcucuuuauuuugugaacugucuucuauaugaagcaucgguguuuggguuggagguuuucugcuucuuagguacaagaggaagaagaaucuguacagaaccaaaaacaucuuaauuuuuguaaucaggaugucuaccuuuacugacaacauuuacugacaacauuuccuucugaaaauagguuauugaaagaucaaggaucuuugccagugaaauccuuaacuggaaguggguggguacaagauagaaaacucauuugguauaacaauuuuguuguuuuuuaguggaaccuugcuucucuguucugacauuuccaugucucuauuuauaguagugaucucuuuggaauuugccuucugauuccauuuguuccuuuauguugcuucauauuaacugauauucucacuucauuuaaaaaaaauuugaagggacauguacuuaagaaaaaggaauuaauuuuuuuauaagaaauaucuggagguacuauuuuucuaugguuuaucauaaucauuguuuaugccagguuaucuaauuguagcaauaauauaaauacuauuuuuucaagcaagaauguuaguuuuaaaaaauuuaugugcauauuaagcuuuagacaccuuuuauccaggacagauauuaccuuuagauucuuaacaaccuugcuccuuaacuaugcacuuugauauaaaugaagauugagagguuuuaguuagagcuuuuaagugguaaacggucaagggcaggagcuaucuuauuuaccuuugagaugacaauaaugccuggcaucuaguagguccuaauuaaucuauucauuuauucaauucaacaaaaauucugggcauuguucuaagugcuagagauacaguaguaaacaaaauagacauauaucucaccgucuugucuugagcaugcuagugagugaagguggauugaaaccauggaucacuuugcagagacucccuauuguuuucagacaauuauuuguaucagucuaaccaauaauauccuguagcuaauuaagcaaugguuugaagagucagaaugggagaagcugaaugaucagauagaucauucauucauuaaacauuuaauuuccuaguguauguuaaauuauuugaaacaagcuagugaaugugagucauugucaucccaauugucagccugauucuugugcucuguuuauaucuugggguaaagacuucaagcuucuggccagguuacagcccgggaacuucaucucagaucacauaccacugaauccuaagugcauaaaauaaugugugccauguaguaaauauuacuacauuaauccuuaacuacucgaaaugcaauuuccucacuacuuauggccacagccugcaucuagucuucauccagacaacucaaacaauaaaaaucuucaagucugauauucuccucaagaugaccucuugucaguuuguuuccuaauguacuucuuccguuccucuagucucuugacacuucucuuuucuuuccaucucuuacuugcuggcuuuccuucuuugccauucacgucaguaauucucaacucccacuccccuuugucuuuuaguuguguccauucuuuaaaucaacaacucuuaaucaguucaaauugacuuuggagucggaugaacuucaaaucaccauuugcuacuucagugaccuugccaaauucuuuaaccuuuuuugaguuuguuuacuccuugucacccuaagcauuguuuugaaaauuaaaugagauuauuguauccagauacuuuugaccacaaguaaugaaaacccuuauuaaauggcuuaaauaauaaaaaauccagggguagaguggcucuaaggcugguugaugagcagcucaacaauuuaugagguacccauguuuuuuucaucuuugccuucuaccacccucagcuucuugacuuuacuccccuaaugauugcauaaugguugccacaguuccaggugucaugcagucaugauuguuaaauggaaggggaaaguuucugcuaccagugucccuacccuccaccccugccacaacugccaaucuuauuaaccuuguccugaccagaguugagucacaggcuuacucuaucaagugucauacuggcuuagaauaauuaggauucaucucaggggugagggagaggccccacuuuccuaguaauaguuauucuuacuacugcauuugugagugcuaggacucaauccuugugcccuuuuacccuaucuaugauucuaguaauuuccucuagucucaugguuucaaauaucaccuacacucuucccaaauuuuucucuuuuaagagacaggaucucugucgcccaaacugaagugcaguggugcaaucuuagcucacugcagccuugagcucuugggcucaagugaucccccugccucagccuccugaguagcuaggacuacaggcaugcaucagcacaccuggcuaauuuuuaaauuuuuuguagagaugggggucucgcuauguugccuaggcuggucucaaacuccuggccucaagcaguccuucugccuuggccucccaaagugcugaguuugagccacugugccuggccccaugcaucuuuauuuuauauguccaauauugaacuccucaguuucucccuucuccccucucuauuuuaguaaguagcaagucuguucuguguuugcugaaguugaaaaaccuugguguccuuauugguuuuuccucacauucccuguuugauucaccaggaaauccuguugacucuaccuuuaagauauauccagaaguucaccacuucucaucaccuccacugcuacaucaugguccaaaccaccugaauauauauguauauugcuacuucagugaccuugccaaauucuuuaaccuuuuuugaguuuguuuagucuuuggcacccuaagccauauguauauauguauauauauuuuauauauguacauauauauacauaaagauuuuauauauauacauaauauauaugcauacauuauauauauacauaauauauaugcauacauuauauauauauguguguguguguauuuccccccccccccagacagugucucacuuggucacucaggcuugagugcaguguauaaucagagcucacuguaaccucaaacuccugugcucaagcaaucuugccucggccuucugaguagcuaggguuacaggcaugugccaccauaucuggcugacauuuuuuaucuuuuguagaggcagaguauuguuauauuguccaggcuagucugaaacucguggccucaagcuauccuccugccucagcauuccaaagugcugggauuacaggucugagccacugugcccaucaguucuuauuggucuuccacccuugcccaccgucuuucccacgcuguuaagaaucaaagugaccuaucauucgcguaaaacucuccaauggcauuguaucuucccucagaauguaagucaaagucuuuaguggccuacaagccucuguauugcaucuguuauuucucugaccaucuuucaaccccuucaccaucucuaucauucugacucagccaccuugcgguuccucaaagaugccuugcauucccucacuucuaggcuuugguguuugauauuucccucuauccaauaaguucuaccauauggaugcauagcuuuccuccuuuccuuucagauuguagugcuaauaucauuuucucugaaaucauuucuggcuacccuaucuaaauuuugaaucuccuuauuuacauuuucugcuuuauuuuucuuagcuuuuaucaccgucuaacacaacuuacaguauuuaaaaauuuuuauuguaucucccccuacuagaauguacagagaaugaggcagggauuuuuguucauacuguaucccuagcaccuagaaaggugccuuggcauaugaaagguccuuaauaaaaauuugugaguaaaugaauguucauucauucugguuucagcuggguccuuagugggauuuaguaauuguuuguuucugaucagcugcuucccuauuuuccauaauugacauacugaacuaccaccauucuuaucaaacacccuacuuuacucugaauccuuagcaguggauguccccccacuccucucuuuuuaaacagaguauugauacuguguaugaacuucuuggucuuccuaguccuuuuacuuucaaauuuauaaauugucgucgucuacuuccuuuugcucucagagcccaccucuaauuuuauucacgucucaucuacugguacucuugguaucaaaucguaucaaauuuuaucuucuuugagaugucauuuaagcaauuauuucuuuuauuauaugucuuacauguuuuuaaauauccuccucuauauuguuuucuucuucucuggacuaucuuaaaaccucuuuuauccuuuccuuauuacaagucuaucuccuucagacaacuuguuagaaauauuuaaauuuaccauuucauuuucauuucccucuuaauguucaauuuaccacauucuagcuuuuauuggucacaauucuaucuaccucauagaauucugagagacuaaaugaggauacauguguuuuuagguuaauauuuuuuugagggcucaccaggauuaacuauuacuacugaagccaaaaucauucucacucuuacagauacuuuucuaucaucuuuauuuacuuuucuguaucccucaugaaauagcuucugucuuuugguuuuuggacacuaguggugucaggaugccuucagcuccaaguaagagaaucucuuaaguccaaugauagguaguuccaagauugauuuagagaugcaacacugucaaguuaggcucuuacugucuuuguauucugccguuuucacugugucauagacgucuaccuuuaggauuguaagaauuucauuauucaaaaacaggaugcagugcugggguuucuccuugguggauaucuccuuauagggaggaaaauccccagaacaucucucuuacaucucauuggcuagaaccaugucacaugucugcccuuaaacaaucacuggcaaaggaaauacuacugugauugauuuaaaucaacccugagccauccccaagagacugggggaugcucucaccuuccuugaguucauuacucuauuucugggagaagauaucuguuagcuagaaagaagauaugaaugguucuuugguauguaaccagcagugucugccguagcauucucaccugguugaucucugaugguuccuucugucuuuuuuauugucuccuguugauugaugugccccuuaaaugcuggucaucccaaaguucugucuuugauucuuuccaaaaauuguuccuccuucacacuauaaaauaucacuugcauuaggauccuuucuaaauauuugucuccaacuaauauuucuaagcuccaguucagaauaucuccuggaugucuucauccacguucaauucaaaugaauauuguuguguugguuuuuggugagucaaaaauuaaauaaaauuuaccuuauauuaucuuacauuuuaaugagguaguuagccagagaaauagauaacuaggaaugcagucuuaugcagcaaaacuuaccaacuauugaaguagcauagaugaagggguuauuaauaagguuacaggaauguucacaguagaacuugucuuuacacuuaaaaaguacucuucuuauauucuauacuuucauuaguagcacaacugugcacaccuuugucaauccagaaaugggcagucugaaauccuuccucuucucuacauccagcugaugggcaaauuauacagaugcuauuucuuacuacuuaauccuaccuguuggucugguuauaucauagucauccuacuuuagguucuuguuauuucucaucucuuugugauucauucauucaguaaaaguuuauugaacagcaauauauuguaaacgccuuguucuagaaauaaaacaggaccccgcugguuacaauccaguggaugaggcauaaacacacagaugguuauguaaggugauguguaauacaguggagauauggggggaaguguaggagcucaagguccggggaaucuaacccaaguuugggcuucacagaagcccaucuacagggugagucucaaagcagaaguaagcuaggugaagggcuccuggaguagggaagagggaaauacaccuacacacaugcccuauuugcuuuauauauaacaaauaucccuucaaagguauuaacuuuggugccuguguacucauuaauguuaccguuguucaaaaacaauuuuuuaacugauuaugguuaaugcagaagauucucaguaaugauauuauuauacaguugauucucauuauuugucaguucuguauuuaugaauuugccuacucaccgaaauguauuuguaaccccaaaagcaauacuugaaaugcuuucaaggucauuuuuagacauacgcauguucagaguggcaaaauauuuaagaacuagcugagcuuugcacagaggcucacaucuguaaucccaccaccuugggaggcugaggcagaaggauugcuugaggccaggaguucaagaccagccugggcaacauagugcaaccccucccaccaucucuacacacacaaaaaaugaacuagcugagguugaacaagucaguggucugcccucauguuucagcucucauacuuuuaaacaagucuccuuuucaugguccauuuagugccacauuuuuguauuuuugugcuuuuuuuuuauuggugacuuuacuauuuaaaauggccucuaagcauagugcuaaagugcugucuaguguugcuaagcacaagaaggcugugaugugccuuacagagaaaauucagguguuagguaagcuucauucaggcaugagucauaguucuguuggcuaugaguucaaugucagugaaucaacaauauauauuauuaagguaucuuuaacagaaauacacauagaagagguuauguauugaccaguugaugaaaaugugaccagagccuggcaggaaccuaacacuguauuucccuuaggggcagugauucacuauucucuaauuuagcauuugggaugauuuuauagaacauaaccauggcaaauguuuuauagaacauaacuauggguuuuauagaacauaacaaaugaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagaacauaacaaaugagaaucaacuacuucaggguaaauuucauuuugggaaauagccauuaucauuuaugaccaggaccgaugaauuagaugggaauggucaaggggaacaauacagagguaugauuauuaaacagucuuucucugccuuuuaaaacacaugccacccuuuuugauaagcaucucaccucacacuuuaaauauucuaauauauucccuuuagcagucauguccagguugagaaucagcguauaaguuuuauuuuaccaucagacaagcaaaaacagguugaccuuuauucuuuuuuuuugagacagagucucuguugcccaggcuggaaugcaauggugcgaucucagucacuacaaccucugccucccggguucaagcgauuauccugcuucagccucccgaguagcuggaauuacaggcaugugcuaccacaccuggcuaauuuuuguauuuuuaguagagacaggguuuaaccauguuggccaggcuggucucgaacuccugaccugaggugaucuguccgccucagccucccaaagugcuaggauuauaggcuugagccaccgcgcccggccuauuucugaguguuuauuguaaaaacuauaguuuuuaaaguuugccagaugcaauaaaauuuuaucauguuuagugcuuuauuuagacuuugcucucccuccagcgaagaauaauuuguauaaagcagaaguuggcaaacauuuccugguaagggccagacgguaacuauuuuaggccuugugggccauacagucucugcugcagcuacucaacucuaccgcugucuggcaaaagcaacaauagacauuagguauuacuuuauauaguuauaguauaaacuccuuuuucuuuuauuuuuuuucuuuuuugagaucgagucucgcucugucacccaggcuggagugcaguggaacaaucuuggcucacugaaccuccaccucccggguuuaaacaauucuccugccucagccucccaaguagcugggacuacaagugugugccaccacaucuggcuaauuuuuuuguauuuuuaguagagauaggguuucaccacguuggccaggcuggucucgaacuccugaccucaauugauccgcccuccuuggccuucuaaggugcugggauauaggcaugagccaccgugccugacuuauuuauaguauaaacuccuuaaggguagggacuauguauuauacuguuuuauccuucauguuacauguaacaguauagcacaguggggucucaguaaugguuggcuugauaugcugauuugaccuagauaacaaaaaguuuauauuuuugaaauauuaauaacuugaacauuaaaacccauccauuuacaguuaauuuauuuuagagauauauuuuucucuaaauauccuucuuuagacaauuauaauaguucaagcuuaugcauuuggaauuagguagucaauggcugaauuuuauaguaguugguaaauacuauaggacauacgggcuuauuuauauaaauguucuaauacuuauauuugguagccauuauuaaagucuucgaaucauaguuaagucuccaugguagcagugguuucgugauuauguuuuaauggaugcaguauacgauaaaguuaauucauaguuaaaguuugguacugauuuaaauuaaaucauuugagaggccaggcacaauggcucacaccuguaauccuagcacuuugggaggcggaggugggaagauagcuugagcccaggaguucaagacuagccuaagcaaaauagggagacccuaucucuacaaaagaaaaaauagcuagacaugguggcacaugccuguagucccagcuauuugggaggcugaguugggaggacuacuugagccccggaggcugagacugcagugagccauaaugaaaccacugcacucuagccugggugacagagcaagacugucucaaaaaaaaaaaaaaaagaaaaaaauuauuugagaauuguaaacaauuagcuaaacaaacuugcuaaauaaucaguuuguugcagucuuggcuaagagccuaauaauucaaugaaacagcugcauauccucuccuccucuugggcuacagacauuuuuuuucuguguacuccuuaaacuacucucucucuuuuuuuuuuuuuuuaacuacucucauuuuucuaaugagccaauuaagaugacaucucaggccacauauaagaaaagaguaugagaagagacauuuuagaaaagauaaaagugaaaaucacguagauuccucauuuccaaguguugcuuuuacaauuaaacauugugaaaguguaugucaacugagcauguguaaauacauuccuacuaccuuaaguguaaaguauuauuuugaaaaaaauuaucauauuguuuauauggaugaacaauguaguacuauuuuauaaguaaaauagaguucaccuguuaagacuuuauuuacccuaaaugugcaugugagagguauguaugugugguauacuugggcugagauucacaggcugagauuucugaaaaauuggauuauaguacugccgacuagaaggaaccacuagaucugcacuguccaacacaguagccacuagccacaugagacucuuaagcuacugaaauguaccuaucugaauugaggucaaaguguaaaauacaugcuguauuucaaauauuuaguacaaaaaauaaagaauguaaaguauuucauugauaauuuguauuuugauuauaugcugcaaugauaauauuuuggauuuacuagguuaaauaaaauacauuauuaaaauuaauuucacguuuguuuuuacuuuaaaaaaauaugguuucuggaaauguggcuugcauuuguagcuugcuuuauauuucuguuggacagcacuggucuaaauagugugaucuuucaacacaggcaaaauguuauaaugaaauauuaguuuaucaagacccauuuaaaaugauguagaaacucuagcucuuuuuaaaauuuuuuggcuaauacaguguuuuugguuuugagacagucuugcucuguugcccaggcuugaagugcaguggugucgugaucauggcuuauugcagccucaucucccugggcucaagugauccuccugccucagccucccaaguagcuaggacuacaggugcaugccacuacaucuggcuaaucuguuuuauuuuuuguagauacgaggucucacuauguugcucagcuggucuugaacuccuagacucaagugauccuuuugccuuggcuuccuaaaguacugggauuacaagugugagcuaucacccugggccuaacucaguguuuaaaaucaguguaaagaacacuuuauuuuaaauuagcugggugugguggcacaugccuguagucccagcuacuugggaggcugaaauaggagaaucacuugaacccgggaggcggagguuacagugagcccagacugugccauugcacuccagccugggcaacagagugagauucugucucaaaaaacaaaacaaaacaaaaaaagaacucuuuaaauuauuucaaaaugccagaaaaguauauuagcucgccauacauucacuagucauuagcaagcuuucaaggacuuauuguaaaagaggguaacaaagaagggcuaguuguugcuugaauauuuuauucaucccaguuagaauaaguuaguucuauacuccccaaaaaaggaaaugauauauauauuuuuuggauacagggucuuauugugucacucagguuugaauacaguggcaugaucacggcucaccugcagccuugaccuccuggacccaagccaucccccugccugagccuccugaguagcugggacuacaggcacaugccaccaugccuggcugauuuguaaauuuuuuguagggauggaauucucacuuuguuacccaggcuagucucaaacuccugggcucaagugauccucucaccucgugcuucuaaagugcugggauuacagguguaagcuacugcaccuggcugauuuauuuuuuuaaguauaaaauaugucugauccccugggugucuccaaaucuaguaauuucuauacauuuaaagcaauuuuauuuucuuguuuuuugaaagguagguacuuuuuaauuuuuuaaacaauuuaaaaucuuguuuuaaagaccacuagacaaaaaaauuaaauguauauauuauagugcuucggggaaaguauuauaaaaccaagccaugacacaguaucaacauuugaaaacuuggggaauuacuaauauuacuguagcgauaaaauggaaauuuugaugauacagacaauaguccacagagaauuaugacuaaaauuauucuuccuaccaaccauuuuaaguuaguuugccaucuuauguuggugcucuuggaggcuuacaaauuauuauuauuugagacaggaucucccucugucacccggguggacugcgaucacggcucacugcaaccuugagcuccuggucucaagugauccucuagaguagccagaaccacaggcgugagccacagcgccuggccaggaagcuuacagauuauuaaugaaacuuuguuaagaacccuuuaccuuacugacaaccagaaaaguaauuucacugguuugggaauaaauggacacuuaagaaaugaagcaaccucuucaaguaauuuuuuuucaaagaccaaacuauugaauuagugcuuuuugaagagcauaaaagagcagucaucaagugugacauuaaaaacuuucagcugggugcaguugcacaugccuguaaucccaacacugggagguugagacgggaggauugcuugagcccaggaguuugagaccagccugggagacauagugagaaccugucucuacaaaaaaaaaaaaaaaaaaaucuauaucuauaucuauaucuauauaucuauauauauauuagcaagauguggugguggugugagccuguaauaccaguuacuugggaggcugagcccaggagagaucauggcugcagcgaucugugacaaugccacugcacuccagccucggugacaguaaaacccugucuccauaaaaaaaacuucgaacaaucugaccguaacuuauuuucugccagcuucccagggcaagccuuccuaauuugcaugcauuaaucucaccaguauuuuugcuguaucaaauacauuuuaugcucuuuugcuucuugacuuaguguuccugauccaaauugcaaauucucccuuucucugucaaaaucuaucagucuuucaugacuuugcucacaauuuucuguucugaagucuuuccuauccccaccacuccagcccaaguugaggauaauaauuaacuuuuuuuuucuucuuuucuuuuugagacagucucccucugucacccaguuuggaguauaguggcaugaucuuggcccacugcaaccuccaccucccaggcccaaaugauccuuucaccucagccuccugaguagcugagaccacaggugcacgccaccaugcccagcuaauuuuguauuuucacgggguuuuaccguguuggcuggucuugaacuccuggccucaagugaucugcaguccuuagcuucccaaagugcugggauuacaggcgugagccaccgcaccggccucuguuugacuaucuuuaaagcucuuaaaacgaucucauuucguuauuaacuuuuuauuguuugucuucccccucuagaaugaguugaaugagagcaaggauaaugucuaucuaguuaacagcaccuaaaauagugugugacacaaaauaaacacuccauaaauauuugcugagugauugaaauacuuuauuuguggaaaaugugcacuaugauaaccaccuuuuuaaacaguuuguguacccaucaaauacuauaaaauggacagucagauacuguugacaaauuccaaauauaaugaauccaaacuacugucauugccuaaaaaaggacauuuacagguaaggggcgugggagaguaggauuucuaaaacaauuuaagcuuaaauggauagggcuuaaugucuuaaagacacuugccuuaaguuuauguauuucagcuuguaacguagauaagguaagaagugaaucucuuuaaaauuucucagcugagugcgguggcucagaccuguaaucucagcacuuugggagaccaaaauggguggaucgcuuaagcccaggaguucuagaccagccugggcaacauggcgaaaccucaucuguacuaaaaauagaaaaauuagccaggcaugguggcaugccugugguccuagcuacucugggggcugaggugggaaaauggcuugagcucaggaggucgaggcugcagugagcugagauugugagaucaggaacacaaucagccugggcaacagagugagauccugucucuaaauaaauaaauaaauaaauagauuuuaugggucuguaucuuggcaacacauacacaauaaauaaaaauuucccuauuuuuccccuaaagacaaaguugcauuuguagccaucacaaaauuaaaagguacuguaaguauuaugcucuggaaccuuuucacaggaaugagaauugagggucugaguugcaaacuuacaucaagcauuugcucuauagcaaucuaugguaaugauaccucuuagugcuuacugguuuuuuaggaaauuauaguauguagagguaagauauaguccguuauuaaauggccaauaauuugauuuuauauaacuauuuagauauuaucuuaaaaacaggugaaacauuaggauagacacagccuaguacccucuaguuuuauguaaauauuggaacaguguauguuuaagaauugucaagaauaucuuagcucauuauuagacuguagcuauagaaaagcucuuugaaaucuuaucacuugaguaucagauguaugugagaaagcauauggaaguauuuuauaaacuguaaaguauuauauaaauguuauuauggggaaggcauagaacagguuuuuuuuuuuuuuaacacugagaagauaguaaaauucagagauaaaggucugaaaagggaacuuggcaagaggcaagaucuugggggaugccagacuccuuugggggugaaucugguaguuacuuuaaugcuuuaugccaaguaaaacuuccugagucaaaggagacuauuugucaauaaacauccaagugguagcaaaauaguuuauauagcuuaaaauacugaaaauaauguauauguagaugucauauaaauuguagugcugacacauguacuaucucaucugacucucacaauaaucuuugugaguuagguauucagauaauuuaaaugauucaucuaaguuacucaccuguuaagugggagaacugagauuagaaaccaaguauucagauuuuuaagucuuuauucuuuuguacuagcccucuaagaggaauugauaaauaaugguuuccccuagauaauuuucaaguaauuugguacgacugagauaugugaggcaucaacagauauuaaggcuggacagaucuucugauuccaaaaucaaauauauauacuuuaagaauauaaauauuggaacugaaauacaaugaaugcuaccuaugggaaguuuuaaugauuuuaaauuuuaacaaaaucaacaugaaugaguagcaaauauuaacuggaauauuuagaaauaccaauuggacagcuguguguguaugugugagugugugugcauguaugcuuauaaauaagaacauuuuguuaugcauaugguauaguaauuuuccuggaaaaaaaauuuucaaguucauaugagaucaucaucaugauaagaguagccagcacuuugguauuccucacuacgugccaaucacauuuaaguaucacacauugauugcauuuaauccucacaacaauccuaaauugguauuaauguuaccagcuuaacaguuaacagaguuaacucuguuugacagaugaggaagcugaggucagagagauuuaaguccaaggucuuacagcuguaaguaguauuaccaggauucuaacccaggcacuccagcuccaaaaucuaugcuuuuaaccacuauauuaugaauauucccugggugucaccucggcaaauauaaucacuuuuacauacucugagguuauauauucaaauaucuaaagcacuguuaacagaguuuaaaagagccucaguuuauuugcuuauucuuggacaggaauuauuggggaauggaggucauaauuuucuaauaugaaugacuaagaaauuucauggccaggcgugguggcucaugccuguaauccagcacuuugggaggccaaggcgggugaaucacgaggucaagaguucaagaccagccuggccaagguggcaaaaccucgucucuacuaaaaauacaaaaaaauuagcugggcgugguggcacgcaccuguaaucccagcuauucgggaggcugaagcagagauuucuuaaaacccgggaggcggagguugcagugagccgagauugugccacugcacucuauucuggaccagccugggcgacagagcgagacccugucucaaaaaaaaaagaaauuucaggguccaagcacccugguuuaugccuguaauuccaggaucgaaauuucaaguaccaagcacccugguuuaugccuguaaucccaggaucuugggaggucaaggaaggaggauuguuugagcucaggaguuggagacuagccugggcaacauagugagaccuggucucuauaagaaauuaaaauaagccagauguugcauuggccuguagucccagcuacucgagaggcugaggcagcaggaucacuugagccuaggaguucaagggugcagugagcuaugauugugccacuucacugcagccugggugacagagcaagccccaucucaaaaaagaaaaaaaaaaaaaauuuaggacuaaauaugacccauuuaagaauuaaauauugccaggaaaaguuauucacaggugcgaugguaaaauaugagaagucauuuguccuccagcauuuaagugaugaucugaauuuugauguaauuucuucugagacucauggcauuuuaucuucuucuguacuauuuuauuauaaacugagaaaugauuugugaguuggaaaaagaaaacuuguuuuuuauuauauaugaauaaagucaaaguagaagaugaagaugacaucaacugaauaacaaauuauacuuuuaguuuuuugugguuaaaaugcuaucuuaauuuccauuuuuuaaaaaaauuaguuuuuaguagagauaaggucucauuauguugcccaggcuggucuugaacuccugagcucaagugauccuacugccuuggccucccaaagugcugggauuacaggcaugagccaccucaccugacuguacuuuucuuauaauaaagggaagauaauuguguuuucauggaauaaucuuaccaauguuugaguagcaaaguaaaaauuuaaaaaugcaagugcuaauuuuuauaucuuuguuaaaaaugcagcauucuuuaguuuuaagggaaaaaauguaugucaguuacuaacucaagcuaguuuuuguucucuucaaacuuuccgucacacauacauguaagcuauaacaucauauaagcagcauuuaugugauaucuaaauauuccauauagacuauuucuauguauuuuuuugguuuuauuuuaaccuuuaaaaaagcuuuuauuuauuuuacuuuuauuaaauaagcuuugaucucagcucuucucuguuccauuuccccuacaggcuaccacuacucucccuuuuacauacucuuccuguuuuugucauaauuauuugcaggaaugacaaucccaaccccucccccaaauugccgcauucauaucauacaaacuuggaugaccaagauuuaauguaaagugaucguauuguauaauggauuuucaacuccuagguaguagagaagacaucucagucugaaaaggugaauguaaggguaaaauaucuccaaaaugcuauguacuuuuaaagaugaucaucuugaugcuuuacccuauuucaucuauuugcaauggguauauuuguacauauaauuauugucuuuaaauuauuuucuaaggauaaauuccaggugugguauuuauagagcuauuaaaauaauauuuaguggcuuuuacuauugccaaauguuugaauuauuuacaaagcuuuacaaagcuauaagugugcaaguaucuguucauuuuaccaaaagcuagccagauuguuguauuaauacaacaaucacguaauacaacaaucgcguaaaucacgauuauauuugcuuucuuauuaacuugaaaugucaaaguugaggugaauucuugcuuuucaacuuuacaauuacgauucuuaugugugugugauauuuaaagaaaugugaaaaucccuuuucacccuuuucagugucuagggagccagauuucuuuccgucuguuaauauauaauacaauuucucacaaauaugaaagacccggucuucagguucucuaaaauaauuuacugugucaaguuuugauaauauuccuagcucucugaaaaugauugaaucaaauaagugucuauuuuuuuuuucugcaaacacuacccgccagaacaauuuccgguuguuaaauaguaaagucaccguuccuuugguaaggaauauuuaaaggaacucccuuggaaaugaauuuuguaauaggugauuuuuauucuguuuuuacucuaugugauacugauccuugcacuggauuucaguuuggcaauaugcuuuuuaaaacugggagucuuaaggugacuggauauuagcauuuuucacuaaguuuuuuggauuugaaaguaccuuuugauauuauuucuuggugaggcuaaaaaaauugauaaauagcugacaaaccucuguaaccuacagguaggcuagaucaauguuauacauuucuaaugucaugguguuguuaaaguagagaauuuugaagaguagaaaaucguagcugucaaaaugcacaaagaugaacauucagaaagaauugcugaaucaucauugcuuggcauauagaguaggcguucucauuucuuuaaagguuaacacaugauuauuacccuuuauuauauucuaaacauauauguacauuuucuuuuccucauaaagguuuucuaacauuuuauuuggacugugugcaauucuucugacuuuucuuauuuaucucucuaauagaaaugggaacauuuuugaaaagaugagaaaaccauacaggagauaaaagaugaguuauauacauagaaaaugucucauaaauaccugaaauauguuauacuuucaaaagcaggcaucaaaaggguauauaaaugcuaugaucuaacuuuguuaacaaaaaauuauaaaacuacagcaaauaaccaugaagauuuauagaaaacagaauuagaaguaaauacaguaauauuuaacagggauuaccuaaaaugauauuauagggagauuuuuaaaaacuuuuuucugcguuuuccaaaaucuccaacaaugaauauauauuuauaauuagggaaauguguuuuugaaagaaaaaauauuucucauauuacugccccuuaaguggcauauccaaauuuuacauugaugcaguugcaguuaagucuuguaaggaacaugaguauguacugucuguaaccugauacuuuguucuagcuuuccugcagcaccacaguucuuuaaauagggauccuguggggcggcugcaggggacggggguugagggguggcagggaccucauucaguuuuaguuuaguugaaguaacuaaguucagauacuaaaauuucaaaaauaaguauuuguuugccagaacuaugaacucauguauacuagaaauaacuaguuagcuaaaaucauguuuaaguccuuuacuuauuuuaaaauaacgcauuugaauuuuauuauagauacucccuuaacaaugugaaacuaguacacaaacuuucuggcguuucugauugauagaccccaggaauuuugaagacgacauaaauuacuuggaaauccuaauuuaaacaaccugcguuuugguauuauauacuuaacagacaaauagcuuaaaauuaaaaaaucccuaaaguagaauugucguuccuuuuaucuguauauuaacuuuaacuucuuuuaacauaggguguuuaaugacugugaugauuuucaccuaguauggaguacauaaauauauaguugugacauucuguguugaaauauuggcauguuaacccauuuguccuguuuaauuaggaaauaaagacgguagagcuagucggaaaaugaauaguuaaucguggaggaggagaaaacauagcucaguacuuugacuagaggcagcugggaaagugacguccuguagcauuugcuguucuagaaaguacagagacacguagugaaaaugggaggaucuagaaggaggcugucuccuguguaguguauauuuaucuguaagugagccguuggggaaggauugaauacagagacgcugucugcuugcugccuuaagacagcuagcugaauugcugauuaacuuuuaaaauacccagcuugguuuauuuuucuuagaaucuguugcuaagacuggggacgcuguuuucuuuuacaaagggaaaucuaaguuaauuucaaggcauucgaaauggggaaagacuauuauugcauuuugggaauugagaaaggagcuucagaugaagauauuaaaaaggcuuaccgaaaacaagcccucaaauuucauccggacaagaacaaaucuccucaggcagaggaaaaauuuaaagaggucgcagaagcuuaugaaguauugagugauccuaaaaagagagaaauauaugaucaguuuggggaggaagguaaguauucucuguauaucuuucugucucuucagcucugucucuuuuuuuuuuuucucucucucugccagccuuuuuccccucucucucagcuuguuaagguuauccuuaaauuggauucucagucauaucaaaaguagaaggacaaauguauaauaacaagguuucaucucugaucauaugaaugaguauugcagagccaugaaugaaauguccuuguuugccuuuuuuauuuuagcauuuuguauuauacauauuuuaucauuagacuuacaauguuaacaauguauauuuuaaaauaaaccuugaauucccauaccuauuaguaaauugugucaaaagucuuaugaaaccuguuucguuuucuaaugaauuuucugccagaaccaauaaagagucuuuagucauuuaaaaccuuaagauuggcauuucagauucugaguaguuuauagcuuauucacaaaaacaaaaaguaguuuuuugccuuucuuauagcaaggcuaguuuagacugaacaagacagaguugugacucucagaagcagaaggcgcaggcauuuagcuucuaguuguuuuuggcauucugccuggagaggaaagaauuuuccugaugucauaaaauaccagaacaaguuuuuagcuuaauuguaaacaauaauuuugugccaagaaaaugaaaucucagaaauacaauuuuugaccuaaaauggccaccuaguuagaauaauuacugauuuacuuuuagauaacauuauuuauuuagaaauuuuacuaucuagguauagagaaaaacaugacaacuucccuuuccucucccugccauacuuuuguuuuuugcauugugagaucaaaaacuagugagcacaguaaaggaggauaauuucagauuauccuuuucucauucugcauuuuaaaucagguuuguccaucacuuccauauaaacggggcuaugaaguaagacuauuuuaaauugcuaauugauaacacaaaaaacuuuaacuuguacuguuuuggggauuuucaacuuuuaacaucaggacuaaguuauuuuauuauuaguuuuucucccaaaauacuggcuuucaaaucacuguagcuaugaaaacuuguuaucccuuugauuccuuuauuacauuuaacaucaaauuuuccuaauuagaaauauauccuuaaaauauagucaagcagugacugcuuauuuugaaugaaacaaauuaaauguagacaagcagggugauuguauauagaggguuuuuuccuuuuuguuuuguuuagcuuuuuuggucuaugaguugcccaaaauugaaguuuauguugcagguuuugguguggugaggaccuacagugucagguucuuacaaaguaaauauugaaaaaggcaaauacugggcaguucaaucuugcaugauaccuauggccauauuacccaaaauaucaugacuugguuuaucucaaaagcuaagcaggauucugagauacuaccaauaauguacuacuauuucuaaaggaguaauuuuguaauuuuguaaagaaauucacaaacauggaaugacacugugaauuccugugaaaaagcagauauccacugcuuuguauuuaaaauauuuugcaacaauucacugauagcucaaguuuguggcuaagccauuggauccaggguuuaguaaggauauuugucuucagaauuuucaagucaccaaaugauacauuuuucuugauuuaacauuaucucuuaauagugcuuuucuagagugauuuuucucauuuaauuuuuauuggucauuacacaaugagugaauuuuuuaaaaacuaaaucacccugaaucuguauacccuggguuuuuuuuuuuaacuuacauaauugauauaagugauagaaggaaagagugaggagagaaugccuuuuuuaaaacauagaaauauauuaugcagaaauaccauucucuaguuauagguuacuugaaaauacaauugaaugggccaggcgccguggcucaugccuguaauuccaacacuuugggaggccgagacaggcgaucaccugaggucaggaguucgagaccagccuggccaacauggugaaacccugucucuacuaaaaauacaaaaauuagcuaggugugguggcagacaccucuaaucccagcuacuuggaagggugagguaggagaaucacuugaacccaagaggcagagguugcagugagccgagaucgagccacugcacuucagccugggcgacagagcgagaccucaucucaaaaaaagaaaaggaaaaaaagaaaauacaauugaaugaaaguuauuugaauuauuuuuuagaauuauucuuccuucacaggaaaguauuauauuuguuugccguuuauucagaauaucucauuuauucuauuaaaaaaucccauuuagauacacugugaaaguaggggaaaacauuuuuucucuuugccuuuuauuuaucuccagacgugguuccauaggugucuccaguaguaacaaaacacugaacuuuaggacuauggaaacacuauuaauuuaccugguauccuucuucccgcuccccccaaguuauuacagucuugggacuuagagcugggauggugggaauaaggaaccauaaacugaaaaguauguaaguugcauaugcuaaauuuauguauuuaggagugaaagaaccaguaauccagaacacaguauauuuguguucugaauauucacaauuuaaaaugcuuuguuuuaaaaacaguuggcuagcugggugagguggcauaugccuguagucucagcuaauagggaggcugaggcugaaggauugcuugagcccaagaguuugaguccagccuuugcaacauagcaagacccuaccucuagaaaaagcaaaggaaagaaaaaaaauacggauaacucaaauuuacuuuuaggaaucuauaaaagggaaacaaaaacauguccacacaaagacauguaccugaaugcuuauagcagcauuauuuauaauagccccaaacuggaaacaaucugaaagcaccauaaauuggugaauuaaacaaaaugugcuauauacauucaaugaggaacuauuuagcaauaaaaggaccaauuugugaaacaugcuacaccauugaugaaccucagaaacuaugcuaaauuaaagaagccagauguaaaagacuauauauuguaugauuuuauuuaugugaaaugucuggaaaaggccaguauauagaaaaagaaagcagaucuuucuugccuaggacuugaggugggagcggggauuagcuacaaauaagaacuagagaauucuuuggaaugauggaaauguucuauaacuggauugugaugaugguuauacagcucuaucaauuuacuauaaucaauugaauuguauuuguacaauagguuaauuuuauauauguaauaaaucuuuuuaaaaauaaaauuucucuauaguugaaucauuugaaaacaaaaaccacagaacuacagaaauuuaaaauuggauucugaaccacucucuaaaguuuuagguuuagucuugaauaguuuaguggaugucaacaaaaauuuguguuaagagauuuaaaagaaaagauuuucaauaacacauccucauuuauucuaguuuucuaauuuuucuuuuuuuaugcuuuccuuauuuuguuauugcauaugauuuauucaguaacuucaaauauuaaaagguaguguuuaaaugauaaaacuuguauuuauuaaucuuuauacuaguucucuucuguucuuuaacuuauauauuuagcuagcuggauuuuuuuuaauucacuguguguucuaaaaacauguaaguaaauuugauuuuugugaauuaaaacuguuuaaaaaaucucagaaucucauuauuugauaacugaagucuugcuguaaaucuggauuuuuacauauuagaucuccuuggauggaguaagaguuauuaaaguauuaucauguuuuuuucuuugcaaucugaauuuuucuccaguguuucuucuuuuggaaacuuuuagucaaccuuaacuaauuagugggaaucauuguuauagauaguauuccaaacacauauuugguuugggacugcaaacugguugacugguuaguuguaaaauaauagcagucuugcuaaaucauaggcaaauguugcuucucuggugcguuuuuugaucacacaaagugaugacgaugucuagaaaacauuuugaauagcagagggaauccaauuggauauuaaacauuuccauuagcguucaaaauguacaugauuaagaacugaccauauaguuaaugugacauuacuuauaauuuuaugugcuagacaaugcaagugauacuugcauaauaauguauauuaaaguggcaugaauuuugguaggauuuuuuucuuuuuuuuguuguuuuugagacagaaucagucuccugaguagcugggauuacaggcgugcgccaccacgccuggcuaauuuuuguauuuuuaguagagacgagguuucaccauguuggucaggcugaucucgaacuccagaccucaugcuccacccaccuuggccucccaaaguucugggauuauaggugugagccacugugcccagccuaggauuuuuuucauucauuagaguagcuucguucuuugucugagcugcauaguugacuguuuaauagugucuaggaaaaccucaaagcugcauuggagucuuuuuaucagcuuugguaaguuacuucagacuuuguaugaaucuucucagagacuuuguaauuaugaccgaauugcccuuuuuggcagaggaggaagagguuuuccagaaagccaaacccaugauguaauaaauuaaaacauuauucuuucuuuucaugaauucauuaugggugcaaguauuuaaauuuugucuuauaagaggcuagauugggcaggcugauuuacccaguuuacuuaacucaguuaaauaauuauacucccuuaagucuaugggaugaaggauaaaauuauuuaaauaauuuaagcauugguugagucacuuuggucaugaccuugagcuacauauuauucuaucauuaaaaaaaaaaucugccauuaccuuuuuaacauuuggaguuauaauuauacuacuaaaauuuauaaaagggaaauuuggaugagcugcuuaugaaaagaucuuguccugcuuauacuugucauucuacaaggaauuucccuaacugcuauuuggauauauuguucaauacauauuuuggcaauuuucagauuauuaggucucucuugaucucuccagauuucuauucauggaugaagguaaaaauuuuagauaucacuugagacccuguuagaugaaauagaguagauauauaccuuuuaauggaagaagccaaaugcagaauaagacguaagcaaaacuaaguuucuuuaaaguaugcuguguguuaguggcauuuuaaauuguuaaaucucucauauauguauaugugugauuauauuuuacauuguuuuugcuucugccuuuuucucuguaccgauacucaagacaccuuuuuuaguuuugauuuagaaggacuuuaggaauuaguucauucccuucauucacuaagcaugaauaccuaccauuuucagcccuguaugcaugagcagugcaaaauaaauauauuuccugccuucaaaucacucacuguuuggagauauuagaaucuccuagcuuaaucuguuggauuuuucauaguuuuaugauuuuuagauucuuuuccugcuuguuucuugaucuguauugaccccuuaaaagaucaccauacuguuguuuuuugaguuuuaguagaacauuucuuucauaguggaaaauguuguuucaaauauaaucuuuuguggguuaaauauuacuuaguggaacccuuaagcaaagggucaaaaagucacuauauuguugccugagguggacuguucacaagagacagaaauaacccauauagaggccuuacgugucaaaguuuacagcucuugauuucagucuucuuacaagcauugaaauuaaugcuaagaugugauaugccuaaaaaauuugguaucuagaguaggaaugacaaucguagugucuaaaaaaccauuuuucauagaauguccucauuauuagaauuuuuuucacucucugacacagaguucuauuuuaauucuuuuuuuuuuuuuuuugagauggaguuuugcuccuguugcccaggccggagugcaauggugcagucuuggcucacuguaaccucugccucccagguucaagcgauucuccugccucagccucccaaguagcugggauuauaggcaugugccaccaugcccagcuaauuuuguauuuauaguagagacgggguuucaccauguagaccaggcuggucucgaacuccugaucucaagugauccacccgacucggccucccaaagugcugggauuacaggugugagccacugcaccuggcccuauuuuaauuccuaaacaguaaaagaugaucugaaauaaaacuaguuagaaugaauaugguauuuuuauuacauuauauuuuuacauauuucuauuuuauuuauauauaaacaguaugaauaugguauuuuauauuuugcuauauauuuuauuaauauauuuauauuuuuaaauguuauauauauuguuugauuguaauaaaaauuaaagauuuaaguucugcacuuuguguugauugcugaagaccuuccaacugacaucuuuuaaaaacuuauauauuuauaaguagauacuuauauaauuuauauacuucagcaugccagaucaguaguuuauaaggaguucccaguuuuauuuucuuuuucuuuucuuuucuuuuuuuuuuuuuuuuuuuuugagacagagucucacacuguugcccgggcuggugugcaguggugcgaucucagcucgcugcaacuucugccucccagguucaagugauucuccugccucagccuccugaguagcuaguauuacaggcaccugccaccacaccuggcuaauuuuuuguauuuuuaguggaggcgggguuucacuguguuggccaggcuggucucaaacuccugaccucaugaucugcuugccucggccucccaaaguguugggauuacaggcaugagccucugcgcccggccuuauuuuauuuuucuuacuuacccguggaacaaagaaucaggaauaaauauuagagaugcugauuuggccggaagcaguggcucacacuuguaauuucagcacuuugggaggccaaggcaggcagaucaccugagguugggaguucgagaccagccugaccaacaugaagaaaccucgucucuacuaaaaauacaaaauuagccgggcgugguggcacaugccuguaaucccagcuacucgggaggcugaggcaggagaauuguuugaaccugggaggcggagguugcggugagccaagauugcgccauugcacuccagccugggcaaacaagagcgaaacucugucucaaaaacacaaacaaacaaaaaugcugauuuggaggaagaauuugaaaacuuaacaauuuaacuuaggauguaaucaucaagaguuuuauagcuguucuguauuuaguaaaguggcauuucuggccaauauuaauacauuuuaauguaaguuagccaaaauuuauuagcaauacaguuuuugaaaguuuaacuuuuaagaguugcaagcuuuuuucuaaucaugcuuaucucuucaauuaggguugaaaggaggagcaggagguacugauggacaaggagguaccuuccgguacaccuuucauggcgauccucaugcuacauuugcugcauuuuucggaggguccaaccccuuugaaauuuucuuuggaagacgaauggguggugguagagauucugaagaaauggaaauagauggugauccuuuuagugccuuugguuucagcaugaauggauauccaagagacaggaauucuguggggccaucccgccucaaacaagauccuccaguuauucaugaacuuagaguaucacuugaagagauauauagugguuguaccaaacggaugaagauuucucgaaaaaggcuaaacgcugauggaaggaguuacagaucugaggacaaaauucuuaccauugagauuaaaaaaggguggaaagaaggcaccaaaauuacuuuuccaagagaaggagaugaaacaccaaauaguauuccagcagacauuguuuuuaucauuaaagacaaagaucauccaaaauuuaaaagggauggaucaaauauaauuuauacugcuaaaauuaguuuacgagagguaaguugguaggaccuaaaauccuaagaccaaauaauuauguaguugaucauagggaguguaucuagauaauagcuaacauuuauuuaaugccuauuauacguuaaaaauaauuacuauaaaaauccucuaagauaguacuaguauuauaccucuuuuauggaugugauuauauuuucuaacuuuaguuacuuauaauuaaagugucaaguguuaacuggauuauguacuaugaggcugcuuuuacaaaugugguuuaugagaucugcauugguaaucucaacacauuagucuuuguauauaggguuuguucuaaauuuguuaauauggaguaauaauugcauaccaaaaaagauuagaagaaaauaauuuauaauucacuacaaauuuguauacauuuauauuaauaaaaaauacauuuauaagugcauauaaauauauacauuuauaaauuauaaugcuacuauguuaauacaauuauuauuugaguucuuauuugcacuauuucuuuuuuuuuuuugagacagagucuugcucugucacccacagcgcaaucucggcucacugcaaccucugccuccggguucaagugauucucuugccucggccuccuaaguagcugggauuacaggcgccccccaccacaccuggcuaauuuuuguauuuuuaguagacacaggguuuuaccauguuggccaggcuggucuugaauuccugaccucaggugauccacuugccuuggccucccaaagugcuaggauuacaggcaugagccaccacgccuggccuauuuguacuauuucucaaauuggauuguaacuuugcaaauauggucauagcaguucccugcuucaaauucuuaaauugcucuauauaaccucuaccauaaaguccaaacucuuuagcuuaaaauaagucauuuuaaaucugaugucuacccauaaaauguauaugcacuuccccaaguuugcucuauuauuauuauuauuauuuuuuugagauggagucucgcucugucacccaugcuggagugcaguggcacaaucucagcuaguacugcagccuccaccucccagguucaaguaauucuccugccucagguuccugaguagcugggauuacaggugcccgccaccaugcccagcugauuuucauauuuuuaguagcgauagguuuucaccauguuggccaggcucgucuugaacucuugaccucaaguaauccgcccaccucggccucccaaagugcugggacuauaggcaugagccaccgcaccuggcccaguuugcucuauuauuaucuuguauacuugagcuguacucuauggaacacuauuguuucuuacccugcucuaauaccuaccugcuacugcccaaugcuuaguucaagcauccucuacucccggaaucuaagggguuaaguugggugcucuuucucuuacaaaagaccuccaugcuuaccucuguucuuacacuauacaguauuauaauggcuaguuugcuucuauguuucugugaguuccuugugcauuccuugagcuggggucuguguucauggucccuauaaggcucaccaucuagccagaauguguggcauauaguaaaugcucaguaaacauuuguuaucuaaaacaaauauauuucuuguccuaauacuuuccagagaaauaguugcuccuauccaguucuuucuaguccugaauuucucccucuucucccauuccaaucccugcaucuugaauauauuaauagcagcuucaaaauaaccaugucauuccagggcaauguggaauauauccuuuacuucucuuuuaccuuuucuuuucuucuucuuuuuuuuuuuuuuuuguaacauaucuaauaaugcauguccugaaggaauuuuccuuuuuuucuuuucuuuucuuuuucuuuuucuuucuuucuuucuucuuuuuuuuuuuuuuuuuugagacaguuuugcucuuguugcccaggcuggagugcaauggcacgaucucggcucacugcaaccuccgccugcugaguucaagugauucuccugccucagcuucccgaguagcugggauuacaggcaugugccaccacgcucgccuaauuuuguauuuuuaguagagacaagauuucuccauguuggugaggcuggucuugaacuccugaccucaggugaucugcccgccuuggccucccaaaauguugagauuacaggugugagccaccgugccugaccucugaaggaauuuucuaaugaggaaaaaaaauuuauaacuauuguuauucuuuuggagguuaaaguuuuaccuuagugguauuauccuuuaccaucugguaaaauuugugcuuagauuuuugaguuuugaaguguuuucauuuuauuuuauuugguccauuuuaggcauuguguggcugcucaauuaauguaccaacacuggauggaagaaacauaccuaugucaguaaaugauauugugaaacccggaaugaggagaagaauuauuggauaugggcugccauuuccaaaaaauccugaccaacguggugaccuucuaauagaauuugagguguccuucccagauacuauaucuucuucauccaaagaaguacuuaggaaacaucuuccugccucauagaaugaagaacuuuguuacacauauuuugauaaggcacugaaaauauaaaaggacugguaguuuacugauguagaugugaauucuguauaaagauguguaaauucuuuugaggguucauuaaauugcaugaauagagacgggucaaauaaauaggcaaaagggauuuuuacaguuagagauaaaagagaaaaccauucacuguauuuuauuucauuucuccugauucagauauuuuuaguaauuugcuuauauguaaaaguuguuuuuguggagucaguggauauauuucuaaugaagugcuagacuauccaauuacuuaauuucuuauaccuuuagauaaucaguaugaaaaguucccauuuauaauggaaaugaaaauucuuaacuaaacuauacauguaauauguauuucuagaagagaauaaaaacccaagucaguuauuagauuuaaaucaccuucugaaaugcugcuauagggcugguaucuguaaaagaauauccugaugcaucuguuucaccauuuugauuuuuaaaguaugcuguagcauuucuuaauaacaucguugugauguucuuaaggcagaucuuucuucauaaaaaggaaaguaauggcaauuucucuccuguggaaaucccaauugcuugaauuacugauauuuuagaauagacuuuuuaaaaugccauauguaauuuuaugcaaguugacuauauaucuuguacuuaauaaauuauaggcucauuuuguucucugcuaguuuaaaguaauucguuuaauaauagauguguuuuuagaggaaaugcuguuacuuggaauuaauuuuccaguuauacagucuucuauaacuuacuaauaauauucuauauguacuuuauguaauuucccuaaaaagaaugaacuaccacuacacuaugguguuaaaccaaaauauagggaaaauaaacacuaacugcugcuuauggauaauguugcaacuacuuguuaugcauauaaauauuuuacuuuuucacauguauagauugcauuucuuagguguuuuaauuuuuuaaauauauuuauguuuuaaaaauuuaguuuuguuuucuguuuuauaacuauagugagaaugauguuuugaagcaaaauuuuugguuauaaaauaguuuucaggauuauauauauauauacuggauccuaucgccuuuuaguagaauauga

SEQ ID NO: 21380 - RNA, 11836 nt, Homo sapiens
cugauucuuguuuuaaaguguuacuguuuuauuuuuuuucuuuuguugaauacacauuuguuuuacuggcaguccagauaaacaaguauauaaaggaaauaguaaauuuuuauuuuggcagaagauaaacugugcagauuaaaaugccucaauuuaaccugaagaaaugguuuugaaucauauaaauuuuuaagaagaaaaauaaagacuguccaaagggauucuccuagcuuauaacacauuuccagaauaacucucaaaaaaaaaaaauucaaaaauacucauugacuaccuuaaaaauaugucaauaccguauggcuuuaugaaauaacuucuaaaauuuauauaauuuuucuuauuuaaaaaggaccccaaguuuuaaauaagcugcuagcaguaucauuuucuucacuuaaaagugcauaucuuugagggugggacauacauuuugaacaaauaaugauuuuuacaaauuaacaccaaaaaaaaaaucauuuaaaauauuguaaggaggaagagaguuuucaccaaaugucaucuuuaaauagacugcaguagacgacauucuuccuuuuuccuuuuuauaacaucauaauucucaaugaaaugcuuuggcaguuuuaagacauaucacagucucuaccaagacauacugacauuaaugauguccguggcgauggcaauugccuugauggcucaguuugaagagacacaauguuacugggcugguucuccaaaucagaaacaaaggugcucucuucucuuacaucgagaguuuguucaacugaagcugccagagguggaauauuaucuacaguuuuguuggcauuauucaaguuguuacuaaguguggcaauaucacauuccuuguccagcacaccaaauucagcuucuauuguaacuacaucuuuaguuucaaaugguuccaaggaaggagccaaaaacucauuuuguagagggucuugaggaccacuauugucacauucuguauccuccuuuacuucagaauccuuaucacugucacugucaaugguaauuacaacuggggaacgugaagcauuaucuccaugguguuucuuaugcuucuucuuauguuucuucuuuuucuuuuuaugguguuuaguuguaucaguagcuuuuccuucauaaacuaucucuacacuuaggcuccgggucuuccuuuuucuccuuuuguguuuugucucucugucugaugaucggcugucugaaaagguaucacucucauuuuuguaguuuccauccaauuuugaugaagauuuuugguaaugacuguccuuugcuuuagaagcaaauucacgagauggcugagccacuucguuaguacccuccaaaugccguguuuuguauuuucguuucccuccaggcuuuucauuucucacccggucagucccgguagaugcaguccuugaucuguuacuagacaggcuccuugaucugugccuuucauaguaguaauacuuccucucacugugauuauuuuuuuuccuagcauuuguucuuucagaaaaggacugaacucuaaauucuggacuugaagacugucuagaauaaugagcucuggacagaguccuccuccuguaagaugauucguacccaucccuguccuuguuucuacuguaauaaguauacucccauuuguaucugcuuccauaauuauuucuuaaauaauaacgaucucuauuucugcuccgugaucuucuuuuaccaugaucacugcuacgagaccuugaucugcuugugcuuucacuacuuagagacagaguuuggcuucuucuggaccaacugcuaucucuaguucuugaucucuuuuugucucuucucccucuaggucugcuacuuucccugcuucuggaucguuuacuuuucauucuuuucuucccaugaugcuuucuaugauucuucugaucaugcccacuucuacucugagaacgugaaucugaacuucuugaucuuccccucuuucugugucuaugguuauauggagaauauacucugucuccucuuacagaugaguucagguuucugggagaugacaaugauguagaucguuucucuuccuucuuugauuugauucuuguacuagaaucacaaugaccuuuauuuauuuguucauccuuuccaaggacagaguguggagaugagcaucuacuaacaucgcuaucaccagaacuguaagauugcuccuguucuugugucuucacugucuccauuuucucauaagaaccuaaguccucagaaucagaggacaguucaacaaguucugggguccucucagcuagugguuuaacaaacccaacaaugacacaauuaucugaagaaucaucacugucauuauuuaggucgucauugguuuguacuccuuguaucugagacguggcuccuccugugacaaguucuucaucugaacugucagaaguauuuaaaagagaagacauaguaacguguaccugcucugagcuugaguaagaugguccuggaguuucaucaucccauggugccugacuaacaguggcuacauuaauauccagcucuugggucucagccucaucuggagauauuguuaugacugaagaaucagaauggcugccuucuucguaugaaggagcagggcaaucauaauuggcaugcuggucaaaggcugccauguuaaaaggagaucgggcaaaacugauaaauucauguauaaaaugcucaguucgauuaaguaaaaauggucuuaaaucagacacaaaugccugacucuccaagucauagcgaguaacauuacucaugauaauaugcuggacaauauucacuaaagauccaugagcuccaaaaagaacuguaaguucacguuuuaaccaggggacuaaucugugaaggcaagcuggauuucuacggaaaaauucagcugaaauaucccuguagcggccaccaucuucaauauuucuaacucgagcaccagcacgauaaagaguucgucuaaaauuaauaauaucuuguucuugaauuuuccgcaaagaucuuucaucugccguaguuggccuccuuacugcaaucugucucauaaacugaggaauuucaacaucucuaggucuuguugaaaugccuaacccuucaaacaguacuccacuauccgguggaguuguuguucuucuguucacaggaccacuaggugaauacacagaagcauuucguucccuugucagaguuguacgguagcgaaaucgucgaucaggggugacaaaagaaccauuauacgaaggccuuaggacauacuccuugaagucaucuucugcccucacagaauggaaaauagaaucaaagggcuguuuacauagugggcauucagcuuuguuuuuugaccacuccuguacacagcgaaaacagaacuuauguaagcagcgaucuaaguaagacacauuaucaaaucuauccaagcauauaggacacuuagaaucaggagaugcaucagcugguacugucuguugcaauuugcuagugccagcuuuaggugaaaaguuguccauuuuaaauuccuuagcagcugaugccauuaucuguaaaagggaaagaaauauaucaguaaccugauaauagaggaaugacuaaauagucucaacaaaaaugcaaauaaagaccuugaaacuuauuuuggugaaaauacuuaagugacccauuacuuuuguuuuauuuuauaaaggggcacuguagcauaguaauauagugcuuaaagcauaagcucugaagucagauuuccuaagacugaauccugguuccacacuaccagcgugacuaugugccaguuaguaucucugugcuuuaauuucaucugcaggucagugauaacagaaucugccuuacaggguuugugaagauguaaaaagcccuuagaaaaggcaccugcuacauaguaaagcucucaaauauuauguaacauucuauuauucuuuuuaaaaauaauuugagaaauaucugacauauaaaaaaaaaaaguaccaaauacccauguauccaccacuuauguuaugccccuuaucuuccccuccuaucacucucuagaaaacaaaaaacaaaaacaccacacuccucaguugauguuauuucuaugcauggcuuuauaccuuucauauacauaugccacuaacaauacagacuacugauuuaucugugauauuuuguauguacuuuucuaaaacaacuuuggugacauaacuuacauaccagaaaguucaccuguuuaaaccaauccuaugauuuuuagugaaagauucuuuuuucaaccuuagaaagcuaauuuuaaaaagggagaggaaacuuuuagugaagauuaaauaauaaaugaaaaagcagccaagaggcagugccuggcucacaguaggugcugaguaaaugucagcuguuauuauuacuacacuauuauauucaguuaaucacucauuccauucagcauuccuaauaagccuuccuuuagcuuuuuucuuuaauccaaaagucaggccacagaauaucuugaaaucauguuuuugguccccuucccuauuauccuuucccauaaggaugacuagaauauuaaagauuaguuuguuuuaucaguuuacauuggcucaaaacuuugcuagagcuugaaaucuaguaugcguuuugacuuuaucucauaaacuccaaagcugcauuuuauacuaaucauuuugaguauauugacuauuggggagucaggcgcgguggcucaugccuguaauccagcacuuugggaggccaaggcaggcagaucaccugaggucaggaguucaagaccagccuggccaacguugugaaaccuugucucuacuaagaauacaaaaauuagccgggcaugguggcaggcaccuguaaucccagcuacuugggaggcugagacaggagaaucgcuugaacccaggaggcagagguugcagugagcugagacugcaccauugcagugggugacaagagugaaacucugucucaaaacaaauaaacaaacaacaacaaaaaacuacuaggcccuugguuucccagggccuaauauucaucuuccuccaccuccuuuaucacaggagguuccaucacuagucaacuggggucaaguuaaucaaauaacagaauuguaauuuucuaaauagacucauuggccuuaacaaacuauaagaaaaaccaauaaacaaaacccacaacaaaaacucaugacugaaauacaaguauuccaccauagcuuucauauuaaaccugcucacuuuagggcaucuuggcuuucucagaaccauaacuuaauagagaaucaauuaaugcuaaauaagcguuucuucagggguccagguaugucuagucuucuauuuacuggacugaaaaugcaaaaacaucaucacuguccuggaaggucuggaaaagcaggauuauaaauacauaauacugcuuuuuuguucauaaacagucuaaaacccuaauacugcacaaccuucucagcauuucccucuacuuuuaacauuuuuuaaucugccuacucaagaaauuuaaagaaacacacacauaaaaauaaaaaccuuucaguucagagacugugugugugguagagggaaggaacagagaaaaguugggagggaaucaaagagguuaucaaaagaucuggacugaagaccaggcuucaccuagaacuagcucuaguuaaugugaagaaaaccacauuacucuagacuuuaguuuucuccucuauauaaugaagggauuacuggacuuggaaaaaagacccgugaauuccaaguuaauacauuuuaucuucacuuaguucucugaaauagaauuuuaguguuuucugaacacuuccaguucacauaaaaauuacagcugaaaaugaauuuauuaaagggaauuauuagguaguaaacuugaaguucaaauaaaauaaaaucucaacaaaguaugauuuuuuuaaaaaaaugaaaccuuacccuucccuucucuaguuuuauaagccuguuaaccacuuugacaguaaaaggugaaugaaugacugguaauguccuccauaacagguuaaaaaauaauaauaaauuagaauucauucuuguauuucuacacaggaaucauuagcugaaaagaauaaucuuagccgggcaugaugggcacaccuguagucccagcuacucaggaggcugaggcaggaggauuaacugagccugggagguccaggcugcagugagccauaauugcaccaccucacuccagccugggugacagaaugagacccuguuucaaaacaaacaaacaaacaaacaaacagucuucaucagaaacaucaaagaggcggggcacgguggcucacgccuguaaucccaucacuuugggaagccaaggcaggagacccuugaggccaggaauuugaaacagccuaggcaacaaagcgagauccagucucuauuuuaaaaaagaaaaagaaacaucaaacaauuggaaugcauguagaucaaauaaguuauuagcucuucaaaaucaucacuaaauacuaaauuaaaauguuuuuuaaaacgcaaaugaagucgaacauaugacccggcaauuacacaccuagauauacccaagggaaacgaaaacuuguccacacaaaaaaacuguauaugaauauucacagcaacuuuagucauaauaccucaaaaggagaaacucaaauacccaucaauugauuaacagacuaauaaaauguggucuauccacacuauggaauuuuauuuggcaauaaaaaggaacaaaguacugguaccauguuguaacauggaugaaacuuuuuauuaugcuaaaugaaugaaaaaaaaaauucacaagaacccacauauuguaugauaccuuuuauaugaaauguccagaauaggcaaaucuagagagaugaaaugaggcugguggcugcugcuggggcaguaaagagguuuauuucuggggugaugaaaacguucuacaauuaauuauugugaugguuguacaacucuguaaauauacuaaaaaaucauugaccuacaaacuuuaaacgggugaacuuuauggauggaauguaaucuuuuauuuuauuuuuuugagacagagucuugcugugucgcccaggcuggaaugcaguggcgcgaucguggcucacugcaagcuccgccucccggguucacaccauucuccugccucagccuucccaguaguagcugggauuacaggcgcccgccaccacgcucggcauuuuuuuuuuuuuuuuuuuuuuuuguauuuuuaguagagacgggguuucaccguguuagccaggauggucucgaucuccugaccuugagauccgcccgucucggccucccaaagugcugggauuacaggcguaagccaccgcgcccagcccggaauguaaucuuaacaaagcuguuuaaaaauacaaauuaaggcauaaaaacugggaugacuagauacagauuaagagugguugauuugcuggccgggcgcgguggcucacgccuguaaucucaacacuuugggaggcugaggcgggcagaucaccugaggucgggaguucgagaccagccugaccaacauggagaaacccggucucuacuaaaaacacaaaaauucgccgggcgugguggcgcaugccuggaaucccagcuacucgggaggcugaagcaggagaaucacuugaacccccgggaggcggagguugcagugagccgagauuacgccacugcacuccaaccugggcaacaagagcgaaacucugccucacacacaaacacacacacacacacaaaagaguggcugaucugcaagagacguucugaauuuaaguagcaaagguagacccgaugaaaaacacagugcuucagguucuguaagaagccuguguuacggguuuuccauccuagcacucuaggaauuaggacauuuccucacaggagacaaucaguucuuccagucacacuuccuaaacugucucccaaauccuaaaugaaguucaccaucuuuaguauaaacugauuaagccaaaacuucccuuucccgaaaaauccucaaaucuggcuuuaacaaggauaauaacaauucggggaaauuucagcuaauuaauauggacacacgucuagggaaaauggaugggggagauaaagaaucaggaagcucgaaucuacauuucaggagacuggauauuugaaaaacugcacaaugauauaaacgaaguauaacugcucuguagaauuaaaguuagacuuacuacaaaagucaucuauggccgggcgugguggcucaugccuguaaucccagcacuuugggaggccgaggugagcggaucacaaggucaggagaucgagaccauccuggcuaacacggugaaaccgucucuacuaaaaauacaaaaaauuagcugggcguagcgacgggcgccuguagucccagcuagucgggagacugaggcaggggaauggcgugaaccuggcaggcggagcuugcagugagccgagacugcgccacugcacuccagccugggcgaaagagcaagacuccgucucaaaaaaaauaaaucaauaaaaaucaaaagucaucuauggcauacacuguauauaaaauuuaaucaucugcugauuacauuugcgggagugauguuaauuuugcugcagagccaaggcugagaaucgccaccacuuaguagguguguaaccuggaggaaguuuuuucucaaaaucucacguuuucucaauucuaaaauggaauugaaaaggugguugugugacgggacauauuucauaaaaacccuuagcacagugcuugaugcacaguaagaacucaacaauguucucuauguuacgugaacacgaagugaauuucgguagcucaucacccauaacugauuauauggguccagacagaggauaguuuauaacaacaaaauaaucaucauacuuaauauaauuauuauacuuaauauuucuaggcaaagugacuaaaaaggguucacgaauagaugaaauagaaagaucacccaaguauuaaaaauaaacugguuccuaccucuugccaccuuaaagaaaucacuguaccucucugaacugcauuuaaucaacuccaaaagaagauacaaaagucacaggaucucaguagauccuaucaaauuuauccagauccuaucaaauuuaauccaauuccagcaaaaagaauuggcugggaaccguucgccucuaaaaccacucauuccagacaaguaugauugauuuuagcugauuguauagcuuucuuugcauuucauggacaaaacccagaaagcucucaccacuauuaacuuaaaucuugggcagcuguuucuuaauuuaucuuaaauaaucuugaaaauuaccuaucaaaaggucuacuccguuuuccucuuaaaucacuauguggcucaucucagcacugcccccuuccagccuacaaucagcaacccaugaggaaagcugcaguaaauggauggaugaacaagucacgggcaauuucugcucagaauguuuaacacaacacagacaagucccaacucccaaagccacggugauagucguuuacuuugguucagaacugccacuagacuaagauaagcaccaugagcauuacauaaccacaacgaacuuaaauauuguuauucccauuuuacagacaggcucagggauuuaagggaccuaggcaaggucacauauccuguaaguggugacgccacgauucagucucauugcuuuuuugcuuuucccugagaccaagcucuuuccaguacacggccaggcucgcgccccucgggagcgcuugugggaagcgcaacccucgccugcccgcaccaauccacaggugcgcgcaggagccgcucgggggcccuggcccuggcccgccgaggcccggacagccccgcaggccaugaccgcaacccucgggucccgaggcgccgcuccaggcgggagcgccaacucccacggcccuuccgacccccgcgucccauuguuccgaaucucacucaccucggaggaugccggcgcaggccuggcuggggcgcucgccgcgagcucccggcagcccagaaagcuaggucggugucggcaggauccgcgaaggcguacccggcgacuucuccgccuacccuccgaagcgggagcaggcgggggcgcuucacccuccucgcgagacagcggagaccccagcggcggcugcgaccccugugacgcaaagggcucaucaccaauggcagcucggaagcagggcagagagcgagacccaccccccagcucccgcgcaucaaaacacaacacccgccuuccucacgcaugcgcagcagauggacgccggccucgggggcggggcucagcgcaccggcccaaaugcggccccucccccgccgcuccagaccccggaggagggcagcgcgacccuccccaucuuguuacugguacucagccacuggggacacugacugaauguucgccccuaacuuacccggaaaacacgagaacuaguucgaugucguuucaaccuuaccaaacucugcggaaacuuaggaaauuaucuuuagugucuagauaggggaauuguuagauggacuugaagucucucaccuccuguuguacgccucccggaagcaacaccaggaguccaacgggaucccaaaccagagcccaaccaguauccuauaaagucuucagagagggauccccuccaggcuggggagaaacaggacaaccuaacaaaacagggccuggacuccucccuaaacagaccacguuuuucuccgcucuuccccuucccacucccugaaaucuagacuaaaacucuuuuaagauaacugcgagguauaaagaacgucuagagccuaagcggcccguugccagauucuacuccucaggccucaaaugugagcgccccaaacauucuagagcugaaccugguacgcucgcccaccaaacugccgugcucggggcuuaguaucucacgcgcggcaguucaagaacaucagacacgcucaacaaacacuuguugcuugacugauacauuauggcggguaacgcgucccacguauuucuucuuagagauauacauuacgcuauacguuucugaagaauggcucgauuuacagggguucccacaacgauuugucacauauaaaagagugggugguauuuuuacgucaaagaugaacaggcgaacguccaucuaaaucgugugguaucagaugcggggaggcgugggggagggagcgggggagaaagcguuaauucuuccagcuuuagagccagacguaauauuuaaaacguggauuguuuuucaaauuaacuuuuaaauggacacgacagcaccuuauccugcauuaauauugcauugcaacuagaaagaaaaccaguggagguacgccuaucuccuuaguuggcaaaaaaaaaaaaaaaaaagcaauuuuuaacauuuucucguuuauuccccucucuaaaaggcgggcaaggcccccgaucacgugauaccgccccccaacuccgggcggaagaggccagcgacagcgcugcacgaagcgagugggcgggcgcucgugcccggcuaaaagauggcugcuggcgccuggcagccaccgccugggagguuacuguaaggcccgcagcucccgccagcucccgcggacugcugccgccuccuuaccaugaagccaguaagucgucgcacgcuggacuggauuuauucagugguaagucccggggaucgcgggcccccaccgugucgacucacugggcccgcaggcggaaaggcccuauuucuucagcacccagaaacuccaaaauccauuccugaauuaagcauuucacucccu

SEQ ID NO: 21381 - RNA, 11836 nt, Homo sapiens
agggagugaaaugcuuaauucaggaauggauuuuggaguuucugggugcugaagaaauagggccuuuccgccugcgggcccagugagucgacacggugggggcccgcgauccccgggacuuaccacugaauaaauccaguccagcgugcgacgacuuacuggcuucaugguaaggaggcggcagcaguccgcgggagcuggcgggagcugcgggccuuacaguaaccucccaggcgguggcugccaggcgccagcagccaucuuuuagccgggcacgagcgcccgcccacucgcuucgugcagcgcugucgcuggccucuuccgcccggaguuggggggcgguaucacgugaucgggggccuugcccgccuuuuagagaggggaauaaacgagaaaauguuaaaaauugcuuuuuuuuuuuuuuuuuugccaacuaaggagauaggcguaccuccacugguuuucuuucuaguugcaaugcaauauuaaugcaggauaaggugcugucguguccauuuaaaaguuaauuugaaaaacaauccacguuuuaaauauuacgucuggcucuaaagcuggaagaauuaacgcuuucucccccgcucccucccccacgccuccccgcaucugauaccacacgauuuagauggacguucgccuguucaucuuugacguaaaaauaccacccacucuuuuauaugugacaaaucguugugggaaccccuguaaaucgagccauucuucagaaacguauagcguaauguauaucucuaagaagaaauacgugggacgcguuacccgccauaauguaucagucaagcaacaaguguuuguugagcgugucugauguucuugaacugccgcgcgugagauacuaagccccgagcacggcaguuuggugggcgagcguaccagguucagcucuagaauguuuggggcgcucacauuugaggccugaggaguagaaucuggcaacgggccgcuuaggcucuagacguucuuuauaccucgcaguuaucuuaaaagaguuuuagucuagauuucagggagugggaaggggaagagcggagaaaaacguggucuguuuagggaggaguccaggcccuguuuuguuagguuguccuguuucuccccagccuggaggggaucccucucugaagacuuuauaggauacugguugggcucugguuugggaucccguuggacuccugguguugcuuccgggaggcguacaacaggaggugagagacuucaaguccaucuaacaauuccccuaucuagacacuaaagauaauuuccuaaguuuccgcagaguuugguaagguugaaacgacaucgaacuaguucucguguuuuccggguaaguuaggggcgaacauucagucaguguccccaguggcugaguaccaguaacaagauggggagggucgcgcugcccuccuccggggucuggagcggcgggggaggggccgcauuugggccggugcgcugagccccgcccccgaggccggcguccaucugcugcgcaugcgugaggaaggcggguguuguguuuugaugcgcgggagcuggggggugggucucgcucucugcccugcuuccgagcugccauuggugaugagcccuuugcgucacaggggucgcagccgccgcuggggucuccgcugucucgcgaggagggugaagcgcccccgccugcucccgcuucggaggguaggcggagaagucgccggguacgccuucgcggauccugccgacaccgaccuagcuuucugggcugccgggagcucgcggcgagcgccccagccaggccugcgccggcauccuccgaggugagugagauucggaacaaugggacgcgggggucggaagggccgugggaguuggcgcucccgccuggagcggcgccucgggacccgaggguugcggucauggccugcggggcuguccgggccucggcgggccagggccagggcccccgagcggcuccugcgcgcaccuguggauuggugcgggcaggcgaggguugcgcuucccacaagcgcucccgaggggcgcgagccuggccguguacuggaaagagcuuggucucagggaaaagcaaaaaagcaaugagacugaaucguggcgucaccacuuacaggauaugugaccuugccuaggucccuuaaaucccugagccugucuguaaaaugggaauaacaauauuuaaguucguugugguuauguaaugcucauggugcuuaucuuagucuaguggcaguucugaaccaaaguaaacgacuaucaccguggcuuugggaguugggacuugucuguguuguguuaaacauucugagcagaaauugcccgugacuuguucauccauccauuuacugcagcuuuccucauggguugcugauuguaggcuggaagggggcagugcugagaugagccacauagugauuuaagaggaaaacggaguagaccuuuugauagguaauuuucaagauuauuuaagauaaauuaagaaacagcugcccaagauuuaaguuaauaguggugagagcuuucuggguuuuguccaugaaaugcaaagaaagcuauacaaucagcuaaaaucaaucauacuugucuggaaugagugguuuuagaggcgaacgguucccagccaauucuuuuugcuggaauuggauuaaauuugauaggaucuggauaaauuugauaggaucuacugagauccugugacuuuuguaucuucuuuuggaguugauuaaaugcaguucagagagguacagugauuucuuuaagguggcaagagguaggaaccaguuuauuuuuaauacuugggugaucuuucuauuucaucuauucgugaacccuuuuuagucacuuugccuagaaauauuaaguauaauaauuauauuaaguaugaugauuauuuuguuguuauaaacuauccucugucuggacccauauaaucaguuaugggugaugagcuaccgaaauucacuucguguucacguaacauagagaacauuguugaguucuuacugugcaucaagcacugugcuaaggguuuuuaugaaauaugucccgucacacaaccaccuuuucaauuccauuuuagaauugagaaaacgugagauuuugagaaaaaacuuccuccagguuacacaccuacuaagugguggcgauucucagccuuggcucugcagcaaaauuaacaucacucccgcaaauguaaucagcagaugauuaaauuuuauauacaguguaugccauagaugacuuuugauuuuuauugauuuauuuuuuuugagacggagucuugcucuuucgcccaggcuggagugcaguggcgcagucucggcucacugcaagcuccgccugccagguucacgccauuccccugccucagucucccgacuagcugggacuacaggcgcccgucgcuacgcccagcuaauuuuuuguauuuuuaguagagacgguuucaccguguuagccaggauggucucgaucuccugaccuugugauccgcucaccucggccucccaaagugcugggauuacaggcaugagccaccacgcccggccauagaugacuuuuguaguaagucuaacuuuaauucuacagagcaguuauacuucguuuauaucauugugcaguuuuucaaauauccagucuccugaaauguagauucgagcuuccugauucuuuaucucccccauccauuuucccuagacguguguccauauuaauuagcugaaauuuccccgaauuguuauuauccuuguuaaagccagauuugaggauuuuucgggaaagggaaguuuuggcuuaaucaguuuauacuaaagauggugaacuucauuuaggauuugggagacaguuuaggaagugugacuggaagaacugauugucuccugugaggaaauguccuaauuccuagagugcuaggauggaaaacccguaacacaggcuucuuacagaaccugaagcacuguguuuuucaucgggucuaccuuugcuacuuaaauucagaacgucucuugcagaucagccacucuuuuguguguguguguguguuugugugugaggcagaguuucgcucuuguugcccagguuggagugcaguggcguaaucucggcucacugcaaccuccgccucccggggguucaagugauucuccugcuucagccucccgaguagcugggauuccaggcaugcgccaccacgcccggcgaauuuuuguguuuuuaguagagaccggguuucuccauguuggucaggcuggucucgaacucccgaccucaggugaucugcccgccucagccucccaaaguguugagauuacaggcgugagccaccgcgcccggccagcaaaucaaccacucuuaaucuguaucuagucaucccaguuuuuaugccuuaauuuguauuuuuaaacagcuuuguuaagauuacauuccgggcugggcgcgguggcuuacgccuguaaucccagcacuuugggaggccgagacgggcggaucucaaggucaggagaucgagaccauccuggcuaacacggugaaaccccgucucuacuaaaaauacaaaaaaaaaaaaaaaaaaaaaaaaugccgagcgugguggcgggcgccuguaaucccagcuacuacugggaaggcugaggcaggagaauggugugaacccgggaggcggagcuugcagugagccacgaucgcgccacugcauuccagccugggcgacacagcaagacucugucucaaaaaaauaaaauaaaagauuacauuccauccauaaaguucacccguuuaaaguuuguaggucaaugauuuuuuaguauauuuacagaguuguacaaccaucacaauaauuaauuguagaacguuuucaucaccccagaaauaaaccucuuuacugccccagcagcagccaccagccucauuucaucucucuagauuugccuauucuggacauuucauauaaaagguaucauacaauauguggguucuugugaauuuuuuuuuucauucauuuagcauaauaaaaaguuucauccauguuacaacaugguaccaguacuuuguuccuuuuuauugccaaauaaaauuccauaguguggauagaccacauuuuauuagucuguuaaucaauugauggguauuugaguuucuccuuuugagguauuaugacuaaaguugcugugaauauucauauacaguuuuuuuguguggacaaguuuucguuucccuuggguauaucuagguguguaauugccgggucauauguucgacuucauuugcguuuuaaaaaacauuuuaauuuaguauuuagugaugauuuugaagagcuaauaacuuauuugaucuacaugcauuccaauuguuugauguuucuuuuucuuuuuuaaaauagagacuggaucucgcuuuguugccuaggcuguuucaaauuccuggccucaagggucuccugccuuggcuucccaaagugaugggauuacaggcgugagccaccgugccccgccucuuugauguuucugaugaagacuguuuguuuguuuguuuguuuguuuugaaacagggucucauucugucacccaggcuggagugagguggugcaauuauggcucacugcagccuggaccucccaggcucaguuaauccuccugccucagccuccugaguagcugggacuacaggugugcccaucaugcccggcuaagauuauucuuuucagcuaaugauuccuguguagaaauacaagaaugaauucuaauuuauuauuauuuuuuaaccuguuauggaggacauuaccagucauucauucaccuuuuacugucaaagugguuaacaggcuuauaaaacuagagaagggaaggguaagguuucauuuuuuuaaaaaaaucauacuuuguugagauuuuauuuuauuugaacuucaaguuuacuaccuaauaauucccuuuaauaaauucauuuucagcuguaauuuuuaugugaacuggaaguguucagaaaacacuaaaauucuauuucagagaacuaagugaagauaaaauguauuaacuuggaauucacgggucuuuuuuccaaguccaguaaucccuucauuauauagaggagaaaacuaaagucuagaguaaugugguuuucuucacauuaacuagagcuaguucuaggugaagccuggucuucaguccagaucuuuugauaaccucuuugauucccucccaacuuuucucuguuccuucccucuaccacacacacagucucugaacugaaagguuuuuauuuuuauguguguguuucuuuaaauuucuugaguaggcagauuaaaaaauguuaaaaguagagggaaaugcugagaagguugugcaguauuaggguuuuagacuguuuaugaacaaaaaagcaguauuauguauuuauaauccugcuuuuccagaccuuccaggacagugaugauguuuuugcauuuucaguccaguaaauagaagacuagacauaccuggaccccugaagaaacgcuuauuuagcauuaauugauucucuauuaaguuaugguucugagaaagccaagaugcccuaaagugagcagguuuaauaugaaagcuaugguggaauacuuguauuucagucaugaguuuuuguuguggguuuuguuuauugguuuuucuuauaguuuguuaaggccaaugagucuauuuagaaaauuacaauucuguuauuugauuaacuugaccccaguugacuagugauggaaccuccugugauaaaggagguggaggaagaugaauauuaggcccugggaaaccaagggccuaguaguuuuuuguuguuguuuguuuauuuguuuugagacagaguuucacucuugucacccacugcaauggugcagucucagcucacugcaaccucugccuccuggguucaagcgauucuccugucucagccucccaaguagcugggauuacaggugccugccaccaugcccggcuaauuuuuguauucuuaguagagacaagguuucacaacguuggccaggcuggucuugaacuccugaccucaggugaucugccugccuuggccucccaaagugcuggauuacaggcaugagccaccgcgccugacuccccaauagucaauauacucaaaaugauuaguauaaaaugcagcuuuggaguuuaugagauaaagucaaaacgcauacuagauuucaagcucuagcaaaguuuugagccaauguaaacugauaaaacaaacuaaucuuuaauauucuagucauccuuaugggaaaggauaauagggaaggggaccaaaaacaugauuucaagauauucuguggccugacuuuuggauuaaagaaaaaagcuaaaggaaggcuuauuaggaaugcugaauggaaugagugauuaacugaauauaauaguguaguaauaauaacagcugacauuuacucagcaccuacugugagccaggcacugccucuuggcugcuuuuucauuuauuauuuaaucuucacuaaaaguuuccucucccuuuuuaaaauuagcuuucuaagguugaaaaaagaaucuuucacuaaaaaucauaggauugguuuaaacaggugaacuuucugguauguaaguuaugucaccaaaguuguuuuagaaaaguacauacaaaauaucacagauaaaucaguagucuguauuguuaguggcauauguauaugaaagguauaaagccaugcauagaaauaacaucaacugaggagugugguguuuuuguuuuuuguuuucuagagagugauaggaggggaagauaaggggcauaacauaagugguggauacauggguauuugguacuuuuuuuuuuuauaugucagauauuucucaaauuauuuuuaaaaagaauaauagaauguuacauaauauuugagagcuuuacuauguagcaggugccuuuucuaagggcuuuuuacaucuucacaaacccuguaaggcagauucuguuaucacugaccugcagaugaaauuaaagcacagagauacuaacuggcacauagucacgcugguaguguggaaccaggauucagucuuaggaaaucugacuucagagcuuaugcuuuaagcacuauauuacuaugcuacagugccccuuuauaaaauaaaacaaaaguaaugggucacuuaaguauuuucaccaaaauaaguuucaaggucuuuauuugcauuuuuguugagacuauuuagucauuccucuauuaucagguuacugauauauuucuuucccuuuuacagauaauggcaucagcugcuaaggaauuuaaaauggacaacuuuucaccuaaagcuggcacuagcaaauugcaacagacaguaccagcugaugcaucuccugauucuaaguguccuauaugcuuggauagauuugauaaugugucuuacuuagaucgcugcuuacauaaguucuguuuucgcuguguacaggaguggucaaaaaacaaagcugaaugcccacuauguaaacagcccuuugauucuauuuuccauucugugagggcagaagaugacuucaaggaguauguccuaaggccuucguauaaugguucuuuugucaccccugaucgacgauuucgcuaccguacaacucugacaagggaacgaaaugcuucuguguauucaccuagugguccugugaacagaagaacaacaacuccaccggauaguggaguacuguuugaaggguuaggcauuucaacaagaccuagagauguugaaauuccucaguuuaugagacagauugcaguaaggaggccaacuacggcagaugaaagaucuuugcggaaaauucaagaacaagauauuauuaauuuuagacgaacucuuuaucgugcuggugcucgaguuagaaauauugaagaugguggccgcuacagggauauuucagcugaauuuuuccguagaaauccagcuugccuucacagauuaguccccugguuaaaacgugaacuuacaguucuuuuuggagcucauggaucuuuagugaauauuguccagcauauuaucaugaguaauguuacucgcuaugacuuggagagucaggcauuugugucugauuuaagaccauuuuuacuuaaucgaacugagcauuuuauacaugaauuuaucaguuuugcccgaucuccuuuuaacauggcagccuuugaccagcaugccaauuaugauugcccugcuccuucauacgaagaaggcagccauucugauucuucagucauaacaauaucuccagaugaggcugagacccaagagcuggauauuaauguagccacuguuagucaggcaccaugggaugaugaaacuccaggaccaucuuacucaagcucagagcagguacacguuacuaugucuucucuuuuaaauacuucugacaguucagaugaagaacuugucacaggaggagccacgucucagauacaaggaguacaaaccaaugacgaccuaaauaaugacagugaugauucuucagauaauugugucauuguuggguuuguuaaaccacuagcugagaggaccccagaacuuguugaacuguccucugauucugaggacuuagguucuuaugagaaaauggagacagugaagacacaagaacaggagcaaucuuacaguucuggugauagcgauguuaguagaugcucaucuccacacucuguccuuggaaaggaugaacaaauaaauaaaggucauugugauucuaguacaagaaucaaaucaaagaaggaagagaaacgaucuacaucauugucaucucccagaaaccugaacucaucuguaagaggagacagaguauauucuccauauaaccauagacacagaaagaggggaagaucaagaaguucagauucacguucucagaguagaagugggcaugaucagaagaaucauagaaagcaucaugggaagaaaagaaugaaaaguaaacgauccagaagcagggaaaguagcagaccuagagggagaagagacaaaaagagaucaagaacuagagauagcaguugguccagaagaagccaaacucugucucuaaguagugaaagcacaagcagaucaaggucucguagcagugaucaugguaaaagaagaucacggagcagaaauagagaucguuauuauuuaagaaauaauuauggaagcagauacaaaugggaguauacuuauuacaguagaaacaaggacagggauggguacgaaucaucuuacaggaggaggacucuguccagagcucauuauucuagacagucuucaaguccagaauuuagaguucaguccuuuucugaaagaacaaaugcuaggaaaaaaaauaaucacagugagaggaaguauuacuacuaugaaaggcacagaucaaggagccugucuaguaacagaucaaggacugcaucuaccgggacugaccgggugagaaaugaaaagccuggagggaaacgaaaauacaaaacacggcauuuggaggguacuaacgaaguggcucagccaucucgugaauuugcuucuaaagcaaaggacagucauuaccaaaaaucuucaucaaaauuggauggaaacuacaaaaaugagagugauaccuuuucagacagccgaucaucagacagagagacaaaacacaaaaggagaaaaaggaagacccggagccuaaguguagagauaguuuaugaaggaaaagcuacugauacaacuaaacaccauaaaaagaaaaagaagaaacauaagaagaagcauaagaaacaccauggagauaaugcuucacguuccccaguuguaauuaccauugacagugacagugauaaggauucugaaguaaaggaggauacagaaugugacaauagugguccucaagacccucuacaaaaugaguuuuuggcuccuuccuuggaaccauuugaaacuaaagauguaguuacaauagaagcugaauuuggugugcuggacaaggaaugugauauugccacacuuaguaacaacuugaauaaugccaacaaaacuguagauaauauuccaccucuggcagcuucaguugaacaaacucucgauguaagagaagagagcaccuuuguuucugauuuggagaaccagcccaguaacauugugucucuucaaacugagccaucaaggcaauugccaucgccacggacaucauuaaugucaguaugucuugguagagacugugauaugucuuaaaacugccaaagcauuucauugagaauuaugauguuauaaaaaggaaaaaggaagaaugucgucuacugcagucuauuuaaagaugacauuuggugaaaacucucuuccuccuuacaauauuuuaaaugauuuuuuuuuugguguuaauuuguaaaaaucauuauuuguucaaaauguaugucccacccucaaagauaugcacuuuuaagugaagaaaaugauacugcuagcagcuuauuuaaaacuugggguccuuuuuaaauaagaaaaauuauauaaauuuuagaaguuauuucauaaagccauacgguauugacauauuuuuaagguagucaaugaguauuuuugaauuuuuuuuuuuugagaguuauucuggaaauguguuauaagcuaggagaaucccuuuggacagucuuuauuuuucuucuuaaaaauuuauaugauucaaaaccauuucuucagguuaaauugaggcauuuuaaucugcacaguuuaucuucugccaaaauaaaaauuuacuauuuccuuuauauacuuguuuaucuggacugccaguaaaacaaauguguauucaacaaaagaaaaaaaauaaaacaguaacacuuuaaaacaagaaucag

SEQ ID NO: 21382 - RNA, 4920 nt, Homo sapiens
cauuauucagauaaaauauuauagguuuauuuaaaacuuaauucucaccuugaguaugcaaaauacaaacuccacaaaauguucauuuuacuuuguaguuuacaaauauacaaaauagacguuugcuuaaauuuauauuacauauuuauuaaggcaaggaacuauauagaaaaacacauuuguucugcuuaaggcauacuugggaauaaaccauuguacaaauuauugcacaucugaaaccacagugcauaacagacugucugcauaaaaaugcuaaagaaguaaaccagguauauuaccugacuuaggucauaaauguugaucggaagacaaauauagauuuuccuugucaaaguaugcagcaguuugaaaacuuuggcuuccuuguuugguaccuuuagaaccaagacucaccaagcaccaucauuuaggcuauuuaaacauguuuucuguaccugaauuucuuccucuucuucuaacaucauaauaauggcuuuuagaagguaaagagaauacaaggugaucuuuuaugcuuauauugcaucaauacacaauucaagggaauucuggucuucccucccccaacucacggauauaauuuauacccugauauccacaacuuccagucacccccuuggcauuuuguaaguccaggaauauucaagucggauuuagaauuggaaugauagaagauccagucacagaccccaucuguucuuugauuuuugucuuuuggauuccucauuuuuccugauuauccacucacaagaugacucaguugggaacuugaccaugauuguagugcuuucuggcugggcuccuucccucaucgggaagacagugugaaaaguaaaaaauacugaauucucuucuggcagugugggucauauccacugucugggauuuaaaaaugccucuucauguguaaggcgaggugguccgaccuggaaaaugcucggucgcauuuuuggcacuggaacgggcggugccccguguguuuacgguagugccuggucaguucaucugagcgggcgaauuuccauccacagccgucccagucacagugguaagguuucucaccuguaaagguaaaagaaaaaaaaaauugacgcuauugcuauaucaaagaaucgccccuuuuaaaaacugaaggccagauaguaaaccaacucugacccuauccuaaagaaauccaggaaugucuuuauaccacugaagggguguauugaauuccauaucauaaacagaaauacauuccgugcuuaaguauuuggucuuguuuuuagggggucaguuaagcacacaaccaccaccuacaccuauacuaauguuucaccaaaaacacacaaacaccaccuaaaccuauacuaauguuucauuugagucaaggcaucucagugguggaaaugaaauuuggaaauugugauugguagugugcccaaaccaugcaaucuuauuccuacuacgacuggggauaaaaagccacagguggcuacuuuuuuuuucuuuaccuuuacguuacugaaugcugcaccuaaacgacuuuggguaccuacuuacauugacauggaaaugcucugcagugacaacccuaaaucagaaucuucccagcaauuuugaccaucauauucuuggaauuuaaaauaaaaccuucugcuugugggggaaaaaaaauaaaaauguaaaucaaaacgaacaaaaaauaaaaaauaaaaaaguaagaccgaauuguuacgaccagaauucaaaauaacaaaaagggagggugaaccugggaagggaacauuaaaaaacgauuuuuuuaaaaaagccaucaugcuuuugcauagcaaaguauaauuucuugauuauaaugccaagcuaggagaggcccacagaccgcggggaaucuccugccuuuuaaaagccuaacaaaauugcacauucaaacacagauaccauccaucaagcaaaaggcuccugggcagaaaaguaggcgccgguuugcuguucucuccagugaucccggagaucaaggcgauagacugcccugggaagccaaggaggcacugaggaguguccacugguagccuauggggcuggaagcuaaccugggaagucaaggaggcacugaggaguguccacugguagccuauggggcuggaagcuaaccccccucccuucugcaguuugucccccuaccuguguggguucgcaggugugccuugagaugggaacucuuuguguagguuuugccgcagcccgcguaaucacaaguguggguggcgguccuuuuccggggccacgaucgucuuccccucuuuggcuugggcuccucuggcaugcaggaaccggguggcaugagcucuaggggugaagaagguggggugagcaucaucccgugugucccgaaguggggccagcacacacagggcuccccagcccgagcuacaaauccccgggacugaccuugguaauggagcggcgggacuugcggcugcaucugaucgggcaggaaggauggguaauugggccccggguggggauggaagccgggaggaagcggcagggcagggugacagucccugcugcucagcacuuccucaagacccagggucgggguaguccugcuggggagcugccgccccagggggaagucgugugcagccggccgguggccauugcugagaggggguccagcgcccaagugggugcacgaagagaccgccuccugcuugaucuuggggcacgugcgcggcggcccgccguuguagggcgccaccaccaccggguggcugccgucagggcugccuuugcugacgcugaugaccgacgggcugccguacucgcugccaggggcgcucagcgacgccuucagcacgaacuugcccaucagcccgccaccuggcggcugcggcugcugcggcggaauguacaccggguccaauucuggccgcaggagcucggccacgaagccgcccgaggggcucacgucguugauguccgccagguugaagggagccgucggagggggagcggacucccugccauagaggaggccuccgcccgugccgcccggcgccacgcccgggucguucccggcccggaucggauaggugaagcugcagguggagggcgcgcuggcagggccgcugcucgacggcgacgacgaagaggaggcugacgcugacgaggacacgguggcggccacugacuccggaggaugggucagcgaauuggagagaauaaaguccagguccaggagaucguugaacuccucggucucucuccgagguaggggcgccagguugcuaccgccgcaagccgcaccggcuccgccgcucuccaggucuguggccacggucgccgccgccaggucauaggggcggccgggaagcacugggggaagucgcuucaugugggagagcuccucccgccagcgcugcggggacagggcgggagagaccugucaguggugguccccuguugccacccgacauacugacgugcuggcgggccacgcgcgacugcaccgcccagacauggggacuggucaggcaggaagcacccgggaacccagggcgccagcgcugcaaucucggcccacucccgggucgaagaagaggugaugcgucuguauugcggguguuauguccugucugcccaauugcgugugagcgagcgccgcggcuggucccucccccuccaggucccguggacguccccggaauuggcacaccgaggcucucucggugcgcucucgccacggggccgccuacgcgcuaaacucacucuggcccagccagugucuggggacgcggccaccucccgcccgguggcccgagagcgcccgcccuaccgacagcgcgcccggggacuggugaagacccggcuugcgccccaggcggcuccgcagugcucgcaccacgggcauacacagcugagccaaggacacggaagcuaucccgggaagguugcggaguccgcgcgguggccgcuccuuacccucguucaguggcucuuggugaccccaaggcuccgcccgcccccaccacacccacgaaaacccaccgggcguucccggcggcccggagcgauacucacguuauucggggcaccugcuugacgcagugucuucucccuucccgccgggccagacgcgaacguggagaaagaugggagcagcgcgucgcugacagccaugucagacucgccagguggcugccugcgagcaaggcagggagcggagacaggagagucaggggcggcuuucggccgucguuccggcgcgucccaccgguccucaccccucccugcucccagcgccgcgcgccucaccuaccucauuaaugugggggcccagaagguccucggcagcccgaagcagcuggggcaccugaaccccaaagucaacgaagagaagaaacgaagccaaaacccaaaaccccaaauuggccgagauccuucuucuuuggauuaaauauaacuuggaagcgucuuuuuuaaaaaguuccuuuguauacaaaaguucuuagaaaaguuguaaacgcaaaaauagacaaucagcaaggcgaguaaguagguccgguggccgggcugcgcucucuuccacucagcagcgucccccaccacugucgcggucgccucgagugcugccgugggcgcaggggcuguggccggggcggugggcgggcggugccgccaggugagacuggcugccguggcgcggagcugcgaacuggucggcggcgcaaggcgcggacuccggugaguuguguggagcgcgcgcggccaugggcgcgggccacgggcgggugggaggguggggggccagaggggcgggggagggucacucggcggcucccggugccgccgccgcccgccaccgccucugcuccccgcgcgcccgcagacacguucguucucucuggucgggaaacu

SEQ ID NO: 21383 - RNA, 4371 nt, Homo sapiens
aaggggguggggagacgccggccccuuggcccagcugaaaacggaauucuuugccggcuggcuccccacucugccagagcgaggcggggcagugaggacuccgcgacgcguccgcacccugcggccagagcggcuuugagcucggcugcguccgcgcuaggcgcuuuuucccagaagcaauccaggcgcgcccgcugguucuugagcgccaggaaaagcccggagcuaacgaccggccgcucggccacugcacggggccccaagccgcagaaggacgacgggaggguaaugaagcugagcccaggucuccuaggaaggagagagugcgccggagcagcgugggaaagaagggaagagugucguuaaguuuacggccaacgguggauuauccgggccgcugcgcgucugggggcugcggaaugcgcgaggagaacaagggcaugcccagugggggcggcagcgaugagggucuggccagcgccgcggcgcggggacuaguggagaaggugcgacagcuccuggaagccggcgcggaucccaacggagucaaccguuucgggaggcgcgcgauccagguagcuggggccccagggccucgccggcagggggcgcgcgaacgcggggcgcggccucggcggaucggggcuggaaccuagaucgccgauguagauuuguacaggagucuccguuggccggaggugugcauuccacgcguaaaacaggcuuuuacccagcaaaaauccuaaagagagacauugaaaaacccacuguuuaagcuuuuuuuagugguuuuuguucugccaucucaugaucagagaugcaaggaauagacugaauuggggagaaaaggagaaaaggaaagcuuauuuagggaagaagauuaucuugucugucugcuuucaacgauaaagauaaguaaaguauaaguuacgcauucuagauuggauuuaaggaauucuacaaaaucauaguacauggaaaaaaucaauguaaacuucuaagcuacuauaugaaaucuguuguauuguuuucucauagagguuaauugagaaugagacgggauuccucaaccacaguacuuaguuccuuuuauguuagcagugucuuaugagugaugcauaagagaaaaaauauauaguucuauagguuucucauucuuuaauuaucauacucagugcccagauuacaaaaauauuccugcagcaacuguuagguccuuuuugaauggcaaaggaucuucauaaauaaugcaucuuuaucuucauuguuaaaauacacuuauucaauguuuaaguacgaauccugcuuuaauuaguacugauauuuuuuauuucuuuuacaaucucggacaacucuuuuguacuuuaccguuggcuaguggucauauucaguacucaccucacuaucacccucuaaaacuaagcuaauauuaagggaucuuguuaauaguauagauuuuaaagaaguguucauuucuuuugaauucuuagaauaaugguauaacaaaugagggauuuuuaaaggagcaaaaauauuguaaagugcaucuuaaaaacuuaaaauuuuauuaauaauuauaaaaacaaguuauauauguaauucaccauuuucugaaauacuaacagcagcuauuuuccccuuuuuuucuauguaaaauauccuuacaucacuaguagauauaacuuaucacgguuuuuaagagaugaaaugaacauuucuaauauuaaugaaacaagccaacaaaacaugagaaguauacugccuuucaauuaaaugguauauuuuaaagugcauaaacccauaacaaauaacucgauuuuagacauuuaguuaccaaaaauugucuuauaauugacuuuaaauaugacagcaaauguuuucauaauguucauguacacaaauggcugcuacaggauuacuccugcaaaacaucauuuuuucuaaguuaugcaucauccugauugacugcuaacauccaagcucuauuuauuuauuuauuuauuuuauuuuuuuugagaugaggccucacucugucggacaggcuggagugcaguggcacaaucucagcucacugcaaccucuuccaggaugcaagcgauucuccugccucagccuccugaguugcugggacuacaggcacgccccaccaugcccagcuaauuuuuuauuuuuuguaguagagacgggauuucaccauguuggccaggcuggucucgaacuccugaccucaggugaucugccugcuauggccucccaaagugcugggauuacaggcauaagccacugggccuggcccaagcucuuuuuauauagcaaaauauuuacuguuuaacauuuuuaaaucuuagcuauuauaaaauccuguaguauacaaauauaguuaguuuuauauuacauuaaaaauauuauagucuaaauuuaaaaugaugaacuguuaaggaaaaaucauuuauuauaauuuuauaagauuuugcaugauuuaauuuacuuuucccuucuaaucuccaacuuuggcucaaauuaucacacuacaagccaguuaugagcucagacacaugacaaacaaaagccuuccgcacgggauuugcuaugagaacuaaauaaauuaaaaaaaaaagaaagaaaaaaacuuaguuguuuauuuucuccccuaaaccauuacucccaacuucuaacaaacaguaguugacuaccuaauaaauauuuguagaccuggauuauggaggaggggucagcaaggcaaauaauuuaaaacuuuaaaagccgaauaaauuuaacucugccccuaaaucauuuaacaaaauagauucccauguuccaauggaaaucaagauuuguuuuuccauaaugaugaucaucacuuuaccaucaacuuucuugucucugcacguuuagagaauaaaauggcauuuaauuuguacugaguauaaccugaagguggggugggaaaguggauugcaucagcaaaugaagaaacaccagacaucagagaccugaacaccucugcacugggugaaaacuuugcaauuagguguuucuuuaaauggcuccaccugccuugccccggccggcaucucccauaccugcccccacccuggcucugaccacucugcucucucuggcaggucaugaugaugggcagcgcccgcguggcggagcugcugcugcuccacggcgcggagcccaacugcgcagacccugccacucucacccgaccggugcaugaugcugcccgggagggcuuccuggacacgcugguggugcugcaccgggccggggcgcggcuggacgugcgcgaugccuggggucgucugcccguggacuuggccgaggagcggggccaccgcgacguugcaggguaccugcgcacagccacgggggacugacgccagguuccccagccgcccacaacgacuuuauuuucuuacccaauuucccacccccacccaccuaauucgaugaaggcugccaacggggagcggcggaaagccuguaagccugcaagccugucugagacucacaggaaggaggagccgaccgggaauaaccuuccauacauuuuuuucuuugucuuaucuggcccucgacacucaccaugaagcgaaacacagagaagcggauuuccagggauauuuaggagugugugacauuccaggggucguuugcuuuucaggguuuucugagggaaagugcauaugaaauccuugacuggaccugguggcuacgaaucuuccgauggaugaaucucccacuccagcgcugagugggagaaggcagugauuagcacuugggugacggcagucgaugcguucacuccaaugucugcugaggaguuauggugaacccacaacuuaggcccuagcggcagaaaggaaaaccugaagacugaggacaaaguggaggagggccgaggugggcuucaguaaguccccggcggcgcuuuaguuugagcgcauggcaagucacaugcguaaacgacacucucuggaagcccuggagacccucgcccaacuccaccagauagcagagggguaagagaggaugugcaagcgacgacagaugcuaaaaucccuggaucacgacgcugcagagcaccuuugcacaggaugcuggccuuugcucuuacuacacugaggagagauucccgcggguuccgcaggcagacuacacaggaugaggugguggaguggagugagagcaauuguaacgguuaacuguaacguuuucuuucacacacacacacacacacacacacacacaugcuaggaugcggaaauccccuuaugacuugcuacuuuuugauuuugugauauuuuguacuuuuuaguuguucagcaacugucuuauuuaauggggagauuuuaaguaaca

SEQ ID NO: 21384 - RNA, 1435 nt, Homo sapiens
uuaaugcaccagauuuauuuaccauuucaaaagaucacgauauaggcagauaccuuaaaaauucucugggggcaaacaaaucaguauauauuagauguacagggacugcagccaagacaggcaugaguuccuagguuauaaauaucaucuuuauaaaaaguggguauuuuauaggacauccaaguaacaccgacuuauaaaagcaaacacuguacuuaaaauguuggccacauaugaaagaauagcugaaggcuuuaggggauugaagaauggauaaacucaaccaacuaaaaacacauuacucaucccucagaaccaaaauacaggaaaaaaaaaaauacaacagguucgcacaacauccagaaaaguucagggaauaugaaguguuucuuggcacccaguucucgcuguuuuaaaauccgucccuucguuguuggcuaggccucucuccagggaaacuagccggggcaagaggcaggggaacuguacaugugggagguccugagggcccuugcacccacucgaccuccaccaagcggauggccaagcgccacccggaaguguccacuggugggggcgggaaggcaccguaguccaagguauccgcgggcagggagcgggccagggcgugcgcgaggucggggguagcugggaacggaggaggaggggcccgcucgaggcuccgccucucaccggcugcggccucggcuacagccagggcccagagggcuccgagucccgggagcggaggccggagucggguuccuguagaggcugcuccuccuuguccccgcucggacgugguccccgcugcucgaggugcagcugcagcagggcccggcgguacauggcuuccagcuucucaagucgggcccucagggcccuggggcugcccggcucguccucucggccgcugucucuagcccuccgguucgugcuggccucuucagggacccggcgugccuccgcgggcgucccguugccgccuucgccggggagccgcaaagccugacggaagaggcugcgguucucgcgcuucagccgccgguucucgagccgcagccgggcguucuccugacgcagccgcgcguucugccggucccacucgucccgcgcacggauggccuccaaguggcucgccgccaggucggcaaaccgcuccuccagcugcugucgggcgccguccgcgcggccucgccagcccacgccgccgccgccgccgcuggggcugcccccaccacgagcccggccggagcggccuggcccucggccguccgcagcaccguccccgccgcagcaacucccgcgccuaguggcgccaccacgcaugcgccacaucggucccaucccaaccgcgccgccagccccgugggcugaggggccgcgcggccaggcgcgggcaaguucggggcuggcagggcggccggggugacga

SEQ ID NO: 21385 - RNA, 20456 nt, Homo sapiens
caugacucgaucgccgccccucagagagcugcccccgaguuacacacccccagcucgaaccgcagcaccccaggugaguagagggggagcuggaagaaggaagagagcggagccaggucugucacucgggccucugcaagguuugugaugucuugaagugccgagugucauuagaugucugaaggcaagugagagccagcaccgcaagcaaguugugcgugugugucggugugucugugccggugucuccucaucgucuggccagugagaaugaaugucuguggguucaccucuguguccacccgacgacagguguguguacauauguauccugcucucagaaaaugggccuaugccggccgggcgcggugacucacgccuguaaucccaacacugggaggcugaggcaggcagauuaccugaggucaggaguucgagaccagccaggccaacauggggaaacucugucucuacuaaaaauaaaaaauuagcagggcgugguggcgggcgccuguagucccaacuacucgggaggcugaggcaggagaaucucuugaaccugggaggcggagguugcagucagccgagaucacaccacugcacuccagccagggcaacagagcgagacugcgucucaaaaaaaaaaaaaaaaaaaaaaaggagagaaaacaaaaagaaaagaaaggaaaauaggccuaugccuuccucaggugugugcuggggaugguggguguuacaucuuccaagucugggccugugucuguguuggugcucccugucccacauccagaaaucaagaagcgagggcugggcagcagauauacagggugagaagggaaggauuucaugcauuguugcagugaugccuggcugacccuucucuuuccaucccagauccuagcugggagccugaaggcuccacucuggcuucgugcuuacuuccagggccugcucuucucucugggaugcgggauccagagacauuguggcaaagugcucuuucugggacuguuggccuuuggggcccuggcauuaggucuccgcauggccauuauugagacaaacuuggaacagcucuggguagaagguaaguuguggacacuggccauagcugcucagguauggugagcccaagacaagaacggggugaggagcuggcuacugagcucuagcaggccuggcccuggggcuggagggucaccugcuggccagaguccuacaccugggcaucuaggaacaccguucccucccacaaccauaaauggacaucugcagauguuagaccuugugaauuggguguauagaauauuugucugugauuuuguacguuagcauuuauugcuaacuuucuaugugugucuuugacaaugcaucaggguuuuacaaaggcagcuaaaacaagauucaucuuucaguagcaaagaaaguaaaauaugugcuggaauaacuaaaauacaauacagagcauccugugauuaugugguauaagauaggguagggagaaaucacuucugaccagcagaaucagaaaaguuagaacuagaaggcuggggaaacugaguaaauaaucuggccaagccugcagggagaggacucaggcacccaggcccauuuaauggaaaagcaauacagaauccacacuuugaggcaauagccagggucagauggaaucaaauccucacuuucuuaaggaagcauaaaagaagaaugauuuucuugggguuuuuuuuugggggggguuguuuuuuuguuuguuuguuuguuugagacagagucuuucucugucacccaggcuggagugcaguggugcgauccuggaucacuacaaccucacuucccggguucaagugauucucgugccucagccuccaaguagcugggaucacaggugcccaccaacacacccggcuaauuuuuguauuuuuaguagagacagccuagaccuccagggcucagguccucccaccucagccucccaaguagcugggauuacaggcgugcgccaccacacccagcuaauuuuuguuuuguuuuguuuuggagacagaaucucacucugucacccaggcuggagugcaguggugugaucucagcucagugcaaccuccaccucccagggucaagugauucuugugccucagccaccuaaguagcugggacuacaggcauaagccaccacacccugauaauuuuuggguuuuugguuuuuuguuuuuuuuuugagacagagucucacucugucucauccaagcuggaguuuaguggcuugauaucgucucacugcaaccucugccucccagguucaaacgauucuccugccucagccuccaaaguagcugagauuacaggugggcgacaccaugccuggcuaauuuuuguauuauuaguagagaccagguuucaccauguuggccaggcuggucucgaacuccuggcuucaaguaauccgcucaccucagccucccaaagugcugggauuacaggugugagccaccgugccuggccagaaugauuucucauuaauaauuucagcaggccaggcacgguggcucacgccuguaaucccagcacuuugggaggccggggcgggcggaucaaaggucaggaguucaagaccaaccuggccaacauaauaaaaccccaucucuacuaaaaauacaaaaauuagccaggcgugguggcgggcgccuguagucccagcuacuugggaagcggagacaggagaauugcuugaaccugggaggcggagguugcagugagccaagaucgccgcacugcacuccagccugggcagcagagggagauuccaucucaaaaaaaaaaaaaaaaaaauuucagcaugacucucuucuuuccugagggcugguuucauauggcagcccuuugauaggagucaaacuccagucuguuuuucccugggaaauuugcauuuuguagacucccucagcccuggcccauacccaaaggcagaacccagguuggagucucacacccucgaguuauuucaaauacuggcaaguccuaggauccacagcagauguuucucagagcuugccugccuguugagcucccacacgccauccccacccuaccuacccccagcccugcagacucucacauccauauacacucuaggccagcccugggguccagagcagaugucucgcucugccugccugcccccagccccaggacacagaugugcauacacgcacauacacauauccccacccacaccacugcugccuggguggucccagaugacucuuggauuuccugccccaacagaggcagucucccuucccuuccucccucuccauuccccacauucuccccaucuaaacacugcuugagccuccauguuuccucauccucucuccuauacuccagcauaggauaggcuagaccccagcaguuuuuugcuguuguuugggggaggguuuuauaagaggaugguagccaauuccuaggcuuuuuuccuuuauuucagaauaucacucuuguccuauauuggcugggggugagguaaaaaucuuuuuuuuucuuucuguuuuuuuuuuuuuuuuuuuuuugagaguaagucuugcucuguugcccaggcuguagugcagugacgcaaucucggcucacugcaaccuccgccucccggguucaagcgauucuccagaguagcugacacuauaggcaugcgccaccaugcccggcuaauuuuuuuguauuuuuaguagaaacagggugucaccauguuggccaugcuggccucgaucuccugaccuugugauccgcccgccuuggccucccaaagugcugggauuacaggccugagccagacgcuaggccaaucuuuuuuuucauagagauggagucucacugugagacccagucucaaagaaaaaguguaagaaggcagggugcaguggcucacgccuguaaucccagcacuucgggaggccgaaguagguggaucuccugaggucaggaguucaacaccagccuggcuagccuggcuaacuuggugaaacuccaucucuacuaaaaauacaaaaauuagccaagugcggugguucgcgccuguagucccagcuacuccagaggcugaggcaggagaaucgcuugagcccaggaggcagagguugcagugggccaagaucgugccacugcacucuagccuggcgacagagcgagacucaaaaaaaaaaaaaaagaaaagaaaaagaaagauuaagccgaggaagaaaccgaacauuggcuaucacaguguuccagaccagaguucaggguccuccuuaacuuugccucagugagacuuggaauuugacuuguuugucuuuccuggccaacuguaaagucaagcguucagaggcagauuguucucuaaaaugaaaauuacaaaggccuggcacgguggcucacgccuguaauccuagcacuuugggaggccgaagcggguggaucacuugaggucaagaguuugagaccagccugaccaacauggugaaacacugucucuacuccaaauacaaaauuagccaggcgugguggugcaugccuguaaucccagcuacuggggaggcuguggcaggagaaucgcuugaacccgggaggcagaguuugcagugagccgagaucgcgucuuuguacuccagccugcgcaacaagagcugccauuccauguagaagacagaggauggccuuauaucaguugguagaaucaccauccacuuaaauaccuaaagcuaaaaccuuaggagucagccucaguucuuguucacccaauuguuuacuaaacuauuaaauccuugcuucuuaaccucucucauaacaaacccauccuuucuuuuuuuuuuuuuuugagacggagucuugauguguugcccacacuggagugcagaggugcgaucuuagcucacugcaagcuccaucucccggguucacgccauucuccugccucagccuucugaguagcugggacuacaggcacccgccaccaugcccagcuaauuuuuuuguauuuuuuuuaguagagacaggguuccaccauguuagccaggauggugucgaucuccugaccucgugauccgcccgccucggccucccaaagugcugggauuacaggcuugagccaccgggcccggcacaaacccauccuuucuaccuuguggucacugcucuaguugaggccuuguucuaucucuggcaauacacuucugauuguaucauuuagaaugcuuuuaggccaggcgugguggcucaugcuuguaauccuagcauuuugggaggccaaggugggaggcuugacugagcccaggaauucaagaccagccugggcaacauggcaaaaacccaucucuauuucuaaaaaauuaaaaaauaaaauaaggccaggcacaguggcucacaccuguaaucccagcauuuugggaguccagggugggguggaucaccugaggucaggaguucgagaccagccuggccaacauggcaaaaccuugucucuacuaaaaauacaaaauuuggccacacaugauggcauguaccuguaaucgcagcuacuccggaggcugaggcaggagaucacuugaacccaggaggcggagguugcagugagcugagaucgugccauugcacuccagccuggguaacagcaagacucugucucaaaaaaauauauaaauaaauaaauuaaauuaaauaauagaaugcuuuuagccacaugaaaagagaagaaaaggaaaggaagaagggaagaaggaagaaagaagauugauuuauuauucucuguaacaggaagccugguuaauucaguuaauucggcagcccaaggacauuagcaaggacccaguuucuuucuaucuuucuccucugccaucuucaacauucuggacuuuuguccucagacuuaucucaaaguggcugcugcagugucaggaaaaagaaaucauucuugucuugcauuucuuuuuguuuuuguuuuguuuuauagagacagggucucacucuuucacccaggcuggagugcagugacacaaucacagcucacugcagccuggaacuccuaggcucacacaguacuccugccucuuucucuguaguaucugggacuacaggcacaugccaccaugcacagcuaauuuuuuuguuuguuuguuuguuuguuuguagagacgcagucccacuauguugcccaggcugaucuuuuuuccuuuuuucuuuuucuuuuccaucccccgagacagagucuugcucucuagcccaggcuggagugcaguggauugaccucagcucacugcaaccuccgccuccuggguucaagcgauucuucugccucagccuccucaguagcugggauuacaggugcgcaccacgccuggcuaauuuuuguauuuuuaguaaagacaggguuucaccacguuggccaagcuagucucaaccucuugacuucgugauccgcccaccucggccucccaaagugcugggauugcagguaugagccaucgcgccuggccggcccccaggcuggucuugaacuccuggucucaagcgauccuccugccuuggccuccugaagugcugggguuacaggcaugagccaccaugccugaucuugcaucucuuuuaaaaagugaggaaaaauguauuaguagccucccagccaacuucucauuugcucucuuuggcaagaacuauguagcauccuaugccgaaauccuucacuuggcaaaggcaauggaauuacugauuggcuucuuaaacuaaucaaguuucaccuccugaugcuggggaggagcccagcugucccuaaucacugggccuuuccgaugacggccacggaaaucagggucuguuagaaaggaggaaggugcugacagccucaccuucaaaucugccuccacagcaccacccuguggccaaucuccaucuggccaagucaguccccuucuuagugcccuuccaccgauuuccaccagauucuguaaaaucaaauauaaacuccauagcacacacucuaggcccuccauaauuggacuugauugcuucuccagcauugccgcuggcuccucccuggcucacucuuagcaguaccgaaacacggagucuuugacaguucccugcgcacaccugguccaggacacguuuccugacuucuucucgugggcaccucaucauucacaacucacaauaguguauucacaaaaauacauuguuaggugaugaaaacgucagauccccucugcccaaaaucuaccaugacucccauuucaccuagagaaagcuuaagucccuacaauaguauauaggccuuuacacgugaaacuucuggaccaaagauuauggagcauauauauugcaauguugcuuucccccgaagaguguaccauauuacacucucaugguggguuagaguguacucuuguaaaccagcaacgagugccaucaauuuuaaaauuuuugcuaaauuguuagauaguaacuuauugauguuuguauuugcauuuacauuauuauuuauaagguagagucuuuuuccauauugguuaaccaguuauauuuucccguugguaaagacauaaaaguuuggccgagcacagugacucaugccuguaaucccagcacuuucagaggcugaggugggaggaucacuugagcccaggaguucgagaccagccugggcaacauagggagacccugucucuacaaaaaauacaaacauuaacugggcaugguggcacacaccuguaguuccagcuacuugagaggauugcuugagccgggaggucaaggcugcggugagcugugauugcaccacugcacuccagccugggugacaaagcgagacccugucucaaaaaaaagagacaaguuguuuuuucauguaucaaucuugauauucucccuccucuguccuauuuccuccccugucaccugcagucuuuccuucaguuccuucucauuuuucugucacuucauuucucuaccagcaacuauugaaaaauaacuccacaucuguaccuacugugugccaugcaauuuccuaaguacuuugccugcauuuauucuaauucuaccaagguagucacuguuucuguuugacagaugaggagcuggagacccagagagaauaacuaaugagcccaaggcacagacuaagcauuaucgacucuuccuuucugcaccacaaugcaucccaguucaccuguccauaucuaucuuugucaacuaagguuuaucuuuuucucugccccauuuucuccccugaggagucuuuauucucuuugaugcuccauuuuaaauuauccguguuucuuucucuugcuuucuuaucagaucucucuggguuccuuccuccucccaugccuccuuccucucagcaaacccacuuacuauggagagcuuaucucuguccucuucuucccuuccaugcggcagccuucggccuaaucuuggugaaauaaacacugcaguacaggccuggcaaaagaguggggaguaggggagagucggagaaggagaggcugggcacgguggcucacaccuguaaucccagcacuuugugaggccgaggcuggcagaucaccugaggucagcaguucaagaucagccuggcgaacagggugaaaccccaucucuacuacuaauaauauaaaaauuagccaggcguaguggcaggcaccuguaaucccaacuacucgggaggcugaggcaggagaaucgcuugaacccgggaggcagagguugcagugagccgagauugcaccauugcacuccagccugggcaauaagagcgaaacucagucucaaaaaaaaaaaaaagggaaggaacuggcaguguggggagcaggacaggaagacuguuuucaugaggugaaggccaggaaugugacuuuuggggcacgaggggacaugugagcauauggguaaguauguguugggggcuaccaaggauuuggggcuuuugugagugagaagauuacauggguuugaaaaagagauuggagggccaggugcagugacucacaccuguaaucccagcacuuuaggaggcuggggugggaggaucgcuugagcccaggaauuuaagaccaacuuggggccgggugcgguggcucacuccuguaaucccagcacuuugggaggccgugaaaccccaccuguacuaaaaaugcaaaaaauuagcuggccaugguggcaggugcuuguaaucccagcuacucggaaggcugaggcacgagaaucgcuugaaccugggagacagacguugcagugagccacaaaaaagaccagcuugggcaacauagugaugagaccucgucucuacaaaaaauuuaaaaauuagccaggccugguggcgggugccuguggucccagccacuugggaggcugaggugggaggaucaccugagcccaggaagucgaagcuauagugagcuaugaucaggccacugcacuccagccugggcaauagagcaagacucugucucaaaaaaaaaaaaaaaaggaaaagagauugggaaacaugacgaucucagauggggcuugagucucagagaagcaguacguuugggucccagcaggcagcaaagacuaacaggaggagacccccagacagguggaaacagcgcagggucugagaucagaccaaauccgcaaagccuccagagguagauuuggcccucacucuuccccacaucauaguuaggugauagccccucacaauguccccaccucccccaggucccaguuacagagcaggagccuguggccagcauaacgcaggacuggaggggcgcuaagauccaggacacuauggcaggccuggcgccgggaaucccuguggucuggacagugagggcggugaaaaggaucuggacaccucccuccccuuggcccacuuugauuucaccccugccaggguucgugagcugauuccaugcacuuucugccugagugggagcagcacacugaaugacugucccauccucccucucccccacaccaacacagggcccauuauuaucacccauuauuaucagacacuccuaucccugcccucuccuuaggacacuuugcagaaagguguguggauauaaaucacugcccagagcaaccugaacuaagaaccagcccuagcccuacaccuguucuuuuaggaaacccuccuagcagcagccucccuauuggccccuauuggcccuccuuguccuccccaccagaacagagagggacugagcgaggguucccuuaccaagaugccccuacaacccccacagcccacggccagcucaugcugauugucauuuuuaaguuuacacccaaaacccagccaaccugguucaugcuuaagcccuagaccacacaagaaauccgcagagccacacaaccgaggcuucuccacuucccuggcagagcuccaggacccagaagccuggggagucggccugggccaugaccaggcccucagggauaaggcagggacuccucucugccgcaccucucccacuugucuggggaggccucagaguuagaagcccccuucccaaguucugacccgccuaggcccuuucccccccagcuuucucuguuugcucuggcagugggcagccgggugagccaggagcugcauuacaccaaggagaagcugggggaggaggcugcauacaccucucagaugcugauacagaccgcacgccaggagggagagaacauccucacacccgaagcacuuggccuccaccuccaggcagcccucacugccaguaaaguccaaguaucacucuaugggaagugagucuggcugagccccugagcagcugggggcgaggcgugcuguggggguucuggagugggaauccccuucuucugcugaucuccuaugccccuggcuauugcagguccugggauuugaacaaaaucugcuacaagucaggaguuccccuuauugaaaauggaaugauugagcggguaaguguccugagagggaguagaggcagaacuuuuucuguagcgugggaggacucagagaccgagcaagccccacagccugcaaucugcccccuuaaaacuaaggagggggauugcagagggcauccuacaaagguuguggggcaggacugacguggcccgggguaucccuggcagaugauugagaagcuguuuccgugcgugauccucaccccccucgacugcuucugggagggagccaaacuccaagggggcuccgccuaccugccgugagugccacuccuggggcccugcuucaucucccgcuggggacucucccagcagaaaggaggggucuggggaaugaggaugaucaaaaccuuaccaagguccuaauuaccucccaggccaggaacagagagcaugggcuuccccaaggcucucuccacauccuccuucucuuucccucucaaggaaggaagaccugacuuauuuacacaaaacuaaacacaaagaucuguaagaucugagcaaaggagaaaaagauccccacaaagaggcuuugcugggggaaauuaccuagguguuugcuaagccauugcccaggccagaaagaaaaccugcuacaggcaugugccugcugguuguauauuagaaccaagcacacagcuugguaaggaacucaguggggccuuucugggcccuuucuauguauuagguaacccugcccugauauucgucucagccccuuguacucuucuacagcucacuguagcacccuggugggcccaugcagccuggcaguucugagaagcugaggcuugcacacccuccauauggaaggacaaaucggcagauaagaggagggugggguacagcauggcgccccagcagcaguuuggagccuggguuuucgucccugacccucaccaacuauaggcuuuucccucagcggccgcccggauauccaguggaccaaccuggauccagagcagcugcuggaggagcugggucccuuugccucccuugagggcuuccgggagcugcuagacaaggcacaggugggccaggccuacguggggcggcccugucugcacccugaugaccuccacugcccaccuagugcccccaaccaucacagcaggcagguggguuccaaccaggucugccagggaaaggcuguuuuccuucccuuucccuuccucauacuccuguguucugggggagcugacugcucugugcccugaccccccacuuccuggccauuauuacccugcucccacagugccaggcccccaauguuccauucccauucaguuauccuacggagcccucaagugguauauaugaaucccuuuuuccuuuucuaagccuagauaaggcuggacuucuuuuuuuuuuuuuuuuugagucucacucugucacccaggcuggagugcaguaguucgaucuuggcucacugcaaccucggcucaagcaauucuccugccuuagccuccugaguagcugggauuacaggugcccaccaccaugcccggcuaauuuuuauuagccucccaaagugcugggauuacaggcgugagccacugcgccuggccaaggcuggacuuuuuaucaaaauagacuaauacagggaaacuaagaacacagcagguaagcaugaauaucauaccugguuucccagguuucuuuguggcccugcaaaugugguacuuuuuucagaauccgccaguuacaccagcuccucccagaagcccuuccaggccucugcuuccccuuggggcuuccugucugcgggauacuagcuguucacuccugcagagcagucaagaggcucagaauaguuaccuacacuccagcccuacugagcuucauggcagcgugguuccuggagguggaagcccagggacacucaguuauccacggccagggccuugagcauuaaccccuccuguuccccuccaggcucccaauguggcucacgagcugagugggggcugccauggcuucucccacaaauucaugcacuggcaggaggaauugcugcugggaggcauggccagagacccccaaggagagcugcugagguagggucuccucugggaguuggugaggggacucuguucaugagaacccauacuguaaugccaggcagcucuggcaaaaggcccuucacaucccucaccagguguuugggccagcucugaccccugguucucccacacccccaccagggcagaggcccugcagagcaccuucuugcugaugaguccccgccagcuguacgagcauuuccggggugacuaucagacacaugacauuggcuggagugaggagcaggccagcacagugcuacaagccuggcagcggcgcuuugugcaggucgguauggacaaggacaaggggggugcccugaggccauucccuccuccugcccccuccuauccacccuguuucuccagcuggcccaggaggcccugccugagaacgcuucccagcagauccaugccuucuccuccaccacccuggaugacauccugcaugcguucucugaagucagugcugcccguguggugggaggcuaucugcucauggugggucuugcaccuggcaccuugcccccaccccaccuccaaccagugcccacccugggagccccugagacugcccuuuccccccacagcuggccuaugccugugugaccaugcugcggugggacugcgcccagucccaggguuccgugggccuugccgggguacugcugguggcccuggcgguggccucaggccuugggcucugugcccugcucggcaucaccuucaaugcugccacuacccagguacgccaggacugcagggcagacucagugccagucaccaggcuucacggguccucagcugcccgcuccucugccccuccaggugcugcccuucuuggcucugggaaucggcguggaugacguauuccugcuggcgcaugccuucacagaggcucugccuggcaccccucuccagguggggccuugucccccagggcucaucugaggcagcucagcuuacugguuaagagccucuugguucaagugaccuugggcugcuaaugaaccucggugccucuuguccccaucuguaaacaggggaaauaauagugcuguguccuaaggguuauuguuuggaucagugagguaacucaaguugaaugcuuagaacagcccaucauacguacaugguacccaauaaaugcuagccacuguguuaugacugccccaccucugcaccccaaguuccugagccuccccuucacuccacuuugacacggccccucccuugugaccugagggcagguccccacucuguccuggcaggagcgcaugggcgagugucugcagcgcacgggcaccagugucguacucacauccaucaacaacauggccgccuuccucauggcugcccucguucccaucccugcgcugcgagccuucucccuacaggugaggccucucacacggggcagcucaggguggguguggggcugaggccaagcuucauccagccuucauuccccuccuguccgucccccaggcggccauagugguuggcugcaccuuuguagccgugaugcuugucuucccagccauccucagccuggaccuacggcggcgccacugccagcgccuugaugugcucugcugcuucuccagguacugccugcgccccagccccuuccucccgugacccacgccagccuguccccucaccagcauuucaaggcacagaccugucauccacucucuaccucuuccagucccugcucugcucaggugauucagauccugccccaggagcugggggacgggacaguaccagugggcauugcccaccucacugccacaguucaagccuuuacccacugugaagccagcagccagcauguggucaccauccugccuccccaagcccaccuggugcccccaccuucugacccacugggcucugagcucuucagcccuggaggguccacacgggaccuucuaggccaggaggaggagacaaggcagaaggcagccugcaagucccugcccugugcccgcuggaaucuugcccauuucgcccgcuaucaguuugccccguugcugcuccagucacaugcuaagguaagacugggcagagcagggcagagacuuagcaucucugggcccagaagggcagagagggcuuaguccacugccugaggggcugggggcagcccuggggucuccagcuuaguugcuacaucccgcaggccaucgugcuggugcucuuuggugcucuucugggccugagccucuacggagccaccuuggugcaagacggccuggcccugacggauguggugccucggggcaccaaggagcaugccuuccugagcgcccagcucagguacuucucccuguacgagguggcccuggugacccaggguggcuuugacuacgcccacucccaacgcgcccucuuugaucugcaccagcgcuucaguucccucaaggcggugcugcccccaccggccacccaggcaccccgcaccuggcugcacuauuaccgcaacuggcuacagggugagaggcgaggagacgggcagggaggggugcugcagggagaaacgcccuggggccaccagcuaauagaacccuauccuggucucccccaggaauccaggcugccuuugaccaggacugggcuucugggcgcaucacccgccacucguaccgcaauggcucugaggauggggcccuggccuacaagcugcucauccagacuggagacgcccaggagccucuggauuucagccagguugggagagggcuggagggguccacuaguacaggggcugcaggccuccugggcccaggccuucagcccucucugccucugcagcugaccacaaggaagcugguggacagagagggacugauuccacccgagcucuucuacauggggcugaccgugugggugagcagugacccccugggucuggcagccucacaggccaacuucuaccccccaccuccugaauggcugcacgacaaauacgacaccacgggggagaaccuucgcagugagucuuggggggagcucggcaagagccucagccucgcccacacaagcccugagccugaggcccugcccacucugccccgugcucaccgcccugucccucucccucuucucccuuccccuccccuccacagucccgccagcucagcccuuggaguuugcccaguuccccuuccugcugcguggccuccagaagacugcagacuuuguggaggccaucgagggggcccgggcagcaugcgcagaggccggccaggcuggggugcacgccuaccccagcggcucccccuuccucuucugggaacaguaucugggccugcggcgcugcuuccugcuggccgucugcauccugcuggugugcacuuuccucgucugugcucugcugcuccucaaccccuggacggcuggccucauagugagugcuugcaggaguggggacagagacaccccacccuucccugcccagccugucaucccuccugccaggagcccucugugagcccugucucccucaggugcugguccuggcgaugaugacaguggaacucuuugguaucauggguuuccugggcaucaagcugagugccauccccguggugauccuuguggccucuguaggcauuggcguugaguucacaguccacguggcucuggugagcacgggcaccccggggagggaccaaucagcugauucaguauucaacacauauuguucaagccccuacuaugugcuagguacuauuuaagaauuugggcuggguggacgugguagcucauuccuguaaucccagcacuuugggaggccgaggcagguggaucaccugaggucaggaguucgaaaccagccuggccaacauggugaaacccugucuuuacuaaaaauacaaaaaauuagccaggcgugguggcacaugccaguaaucccagcuacuuuggaggcugaggcagaauugcuugaaccugggaggcgaagguugcagugagcugagaucgugccauugcacuccagccugggcaacaagagugaaacucuccgucucaaaaaaaaaaaaaaaaaagaauuugggcugggcacaguggcucaugccuguaauugggaugaugcuggggcauuuugggaggccaaggcaggcggauccccugaagucaggaguucaagaccagccuggccaacauugcaaaaccccgucucuacugaaaauacaaaaauuagcugggcgugguggcucaugccuguaaucccagcuacucaggaggcugaggcaggagaauuacuugaacccaggaggcggagguuacagugagcugagaucacaucacuguacuccagccugggcaaaagagcaagauucaaucucaaaaaagaauuuggaaaauaaaaauaaaaaagaauacgggauauaauagcaauacaguuuuuuaccuccaaggaacuuauauucuagggauagagauagacaauaagggcugggugagguggcuuacgccuguaaucccagcacuuugggaagccgaggugggcacaucacuugaggucaggaguucaagaccagccuggccgacauggugaaaccccaucucuacuaaaaauaugaaaauuagcugggugugggggugcaugccuguaaucccagcuacuuggaaggcugaggcaggagaaucacuugaacccgggaggguggagguugccaugagccgagaccaugccacugcacuccagccugggagaccgagcaaaacuccaucucaaaaaaagaaaaaaaagaagagagagauagacaguaaauaaguagacaaauaaauaagcagccauuucaguagagaggaguagacaagauccugucuggaauguguuaaagacagaauggaagaugagaaaaugggaaucaaugauucuuuugaaugguuuuacugugaaccauugugggaugggccaggcauggugacucacaccuguaaucccagcacuuugggaggcuaaagcugguggauugcuugagccaggaguucaagaccagccugggcaacauggugaaaccccgucucuaauaaaaauacaaaaauuagccaggcguaguggcaggugccuguaaucccagcuacucaggaugcugaggcaggagaauugcuugaaccugggaggcagaggcugcaguaagccaagauugcgccacugcacuccaaccugggcaacagagcaagacuccgucucaaagaaaaaaaauuuuuuuuaaauaauuagcugggcaugguggugcgugccuguagucucagccacucaggagguugaggcgggaggaucacuugaaccucagaguuugaggcugcagugagccaugauuacaccacugcacugcagccugggcaacacaguaagauccugucucaaaaaaaaaaaaaaaugggaugguagcgggauggcaaugugggcuuaauggagggguucuacaaagauaccagagauacagagaugccagaaccaaggagggccucgcccagggcugcauauucucuggcagaggaaaggggggacccacagaccagccagacuccacaaacagcucccuuccuuuccccccaccaaauaucucuauuauuauucugauuauaaaaacaauauaugauccuugaaaacaaacaaagccagcaugcagaaagguacaaaagaagaauuagaaauccucugaaacgcuacucugagaaguaacuguuaucacuuugaugucccucuucuagauggacuagugguuggccaacuucuucuauuuauaggaccaaauaauaacuauuucaggcuugguaggccauagagucucugcugcaacucugccaucaaagcacaaaauugucuagacaauacauuaaccaauggguauggcuguuucaacaaaauuucauuuacaaaacaagugacaggcuguaguuugcccaaccuauguuuguuuguuuguuuguuuguuuguuugaaacagggucucacucugucgcccaggcuggaguguagcagugcaaucucgguucacugcaaccuccaccuccugggccaagcgauccucccaccucagccucccaaguagcugagacuacaggcacacacaaccacacccagcuaauuuuuguauuuguuauagagacaggguuuugccauguuucccaggcuggucuggaacucccaaccucaggugauccacccaccucagccucccaaagugcugggauuacaggcaugagccaccgugcccgggcuuguuuguuuuaagagacagggucucacucugucacccaggcuguacccuauuuucuacgugucucugugucuaagcucaccaaacccauccauacaguguuaccuaaaaggacucacgcaugcucccuguacaguucccaugaacuuaguucacccagccuuuggugggccaagguaucguugagcucugaagacagauacagcucgggacauggcugagcuggccaugacuggcagaggagcagcuccaggaccacucuguuuuccuagggcuuccugaccacccagggcagccggaaccugcgggccgcccaugcccuugagcacacauuugcccccgugaccgauggggccaucuccacauugcugggucugcucaugcuugcugguucccacuuugacuucauuguaagguagggagggcucggggcagggaggcagggcucaggacaggccugggcugacuccccccacacccuaccccuagguacuucuuugcggcgcugacagugcucacgcuccugggccuccuccauggacucgugcugcugccugugcugcuguccauccugggcccgccgccagaggugaccacacccucggcaccaucccucuacucccagcccaagggacgggguagggagaggcaagggaagggacagagcccuguggcccacagacagguaccuccccaacaggugccaccagcugaagguggcagccuccuccuuuccccagacaccauguuccugccccucagcccuccuggcuucuucaugggacccaccuuagacuuuuaggauccagaacaaggugcaggguuugccccaggccucaacauccugucgccugccagcucucauauccugcuggagaccaacaagggccccagcuucccaacagucaugguaauccccagcgagaugcuaaaggggacgggagccccaggggcccgugggcuuacuggggcuggugucuccccacaggugauacagauguacaaggaaagcccagagauccugaguccaccagcuccacagggaggcgggcuuagguggggggcauccuccucccugccccagagcuuugccagagugacuaccuccaugaccguggccauccacccacccccccugccuggugccuacauccauccagccccugaugagcccccuugg

SEQ ID NO: 21386 - RNA, 7364 nt, Homo sapiens
uaugguggacgcuuuccugggcaccuggaagcuaguggacagcaagaauuucgaugacuacaugaagucacucggugagcaagccgcggggcucaggauguuggcuuggggacuggcugguggcgugccuagccccacgcagcacuccugccgcaucccuccugguuaagacuggggaauaggggagcgcggagauggcagccuggccuagagcagguggggccuguucagagggggcuuuggugguccaaaucugguuagagaccacgguagggaggugguggaaggaggcagcugugugggaggcucuuuccaggaagagggauaugugauuuggagguaggaggaggguuuggauaaagaacacugaucacaggaaagggaguguagccaggggagaaaaagaacaggggcauggguaguuuagaaauuggaggagacugaacccagaaagggaauggggcagccagggaguguacaaugauguaaacaaguaggaaauaccuaggaggaaaaagauuaguggggaaaaaacuguggaucagugaaucagauaugagaaggacguaagacaggaaccugcaguaagcagcaauccccaucucugcuugguuagggaagagaauucuugcuggagaaugcccuuucucaccagccagucugaccuuguccugcagucuauguauccaggccuucaucacugucugugagccucgugguaggguggggcaagaggcccaugaucagcugggccuuuccugcaacccaaggcucaccuaucugugcgagggguaggcagagaaagccauuggacuucugaugugcaguagagggucccaaggcaaggucaagaccugggagggaggaucacugguuuaggaggauguggagaacugcugugguguugggauggagaagaaucaggauucaaagaaucucacaggugaggaacuuggagauucccauaccaucuaguucaacagggaaacugaaaccaggagaguagaaauguauuauaacaauuccacagcagagccaauaugaaaaucuaagguuucuagaucuguaacccagagcucuucccacuacccuacaggcccugcgagugggaagaaaaguagaaacugcuuagcuaaugauugaccucagcccuucuucuacugcuuugggcuuagauggagaggucaaagcucucaacggccucuacccuaucuugggcgcuaugcccaguaauucuaggcaggcagucauucuuagaggagcagcccccagcccccacgaacacagcccagcagcuauugggaaguuggaaugcccagauuuaguuccuccuuccaaagcugggccagagcugagucuugaauugagcugcaacaacuuuaccauucuuguucccuuauucugccccgaguugggucagcgggcuggucucccugaaguccuguuaucuuucagcagcuuauguuaaggcagccagcauucucaucguaggaauggaaagccugggaaaauacccuccucagcucucaguaaguagugcuggcuucauuucuaaguagaacccagaucucccugagucuccuaaauucugucagcucaauauucuuaguuucucuugguucagacccucacucaucccgcagugguuuccuuuucaaacacuccauaccucuggguagauccuaagugaacagagcucccagugccgugacaagguccugcucugugcaagggagugugauuggccugacucauccugauaccaaggggcaaugccaaguuccucacuggccaagcaagggugggcugacagcauaacagcagaggcagccccugccccuccugcuguagaccuagggcucucaaggggcaaagaggucccgucuaguaccagugaccacaggcacaacugcuggccuggauugaguaugugcuggacagaaucgcccagugaaaauagucaacaguuuuggagccgagguucaaaucuaugucaguaguuuauucucuuugaauuucgacaagacacuucgcacucuucauuguaaacuggggauaaucuacgcuucgaggcuguuacaagcauuaaguaaaacaacccauguagggcaugugcagaguaccuagcuuccagcaagcacuauguagccagguacauuuggagacuuuacacacaccaccucacuacacugggcugccuccugccucaccuuugccuuggaagacaguucaauguuaagcugcuggggggagagggggcagucaugauuaguucuuuguucuuuacuugguugcaggacacuuaggacuuugcccaguacccaaggaagccaugcuugggucaggaagagagucucuguaaagccuuagacugggagucaggagacggguuugagucuaacucauuguugcuaccgcuuuaggcuccuccugaaucugcacaauaggacaaauacuuccuuuguaccuaacuccuagaucauagauaacaggcuuugaaaaugauggguugccauguauaagggacaagagcacuaacacuucuuaguuucaggguaaaaacuuccaaaguuggaaaacuccuaugccuaaggcuuuggaagggaaagucuauguuucucuucuuuccucagccuuauuccuaaggcuuugagagcuuuucaggugcccuggaaggcagccuuaugcuccagccuugggagguaguauagcugagcacuuaagcaagcucuggacucagacaauucugggcuucaaucucagauuugugacccugggcuuuaccucuguuuuuguaucuguaacguggaaacagucuucagaagaacaggaagaacuaaaugagauaacauguacaguucuuacuacacaaaaagcucauaguacuuaauaguagcuuuuuuuuuuuuuuugagguggaaucucacucuguuggcuaggcuggagugcaguggcacaaucucgacucacugcaaccuccaccuccuagguucaagcaauucucagccucagccuccugaguagcugggauuacaggcacauaccaccacaucuggcuaauuuuuuguauuuuuaguagagacggguuucaccauauuggccaggcuggucuuaaacuccuggccucaugugauccgccugccuuggccucccaaagugugauuacaggcgugagccaccacacuuggcccaauaguagcuuauucuaaucccagcucugccacugacuugcuauggcacugcuguuccuuaaguaucucucaucuaaugggaucaguuaucuguguucaccaaacagaacuaagcgcaagacugaauuuuaaaauucccaugcaaaggcuuugaaagauacaguccuccacuuccccauacccaggccugagaguuauucauugaguuucuuguacacugcuucucuaccccagcucauauacucauaaccuucccccuacccucagguguggguuuugcuaccaggcagguggccagcaugaccaagccuaccacaaucaucgaaaagaauggggacauucucacccuaaaaacacacagcaccuucaagaacacagagaucagcuuuaaguuggggguggaguucgaugagacaacagcagaugacaggaaggucaagguaagucagggaaacagggguggggaauggagagugcugagacucuaaaagagaauaggcugguagucuuggcucccugguauugcacccugaggggcagacuaucauggggaauuuaaaugaaacaagauucauaaagccuguguagugcuggaaugccacugaugcuaaauacaugucaguucuguccucuuguuuucuucccucccuucuugggauucaucuauugucugccucggaaugggcagcacagagccaggauguucuucugaccucaguaucuacuccagcuccagcugggugacccugugcaagguaugcaguagcucuagguuucuuuccccuuccauagauggcagaguuauguggccauggcugugaccugaagugcuuuaggaaugaugcccagaagucagggcccuccacugagugaggucauugugaccuccagcagcaaaaaaggcagccaggaacuagaagcaccuacucagaugccgcuucaacuucuaacucccagacauggccaaugacccugacaaacuauuuccaguguugccagcugacaggcaggaagagcuauguuccgugauagggcauucaccuugucaugaauguguuugcagugucuucccaccaagccuuagccccuccucccaggguucuaucacccugcaguggcugucuuggcagcuugccucagccuuccaggccaggcaugggagcgagagaacuuaagggcuuugaccucuauagggugucccuauagcaguguucuaucaugacacuaucauucagccccaucagcuguuuccucuuccucauagcuguccccagaaagaacaggaucacacagguggcuggcagcagagcuggggauggugcccaaagauggcagucuaccuuggauaaagguggcugccccaccaccugcucauaccuccuuggacuugccuacuuucucaaggggcaagaaccccaauuaaacacaauagcccuguggaaugccuagggcaaaaauaucuacucugaguaggcaaaaaaaacuaggggaaugagaacaaggaguaagguaaggauaaaaaagagcacacuaagagacaggccucauaccccuuaucaccuaaacaauacacagaaccuucucagauucuccuacugaaccaccuugcucaucaggaucccuuagccuggccuuguggcccccaaacuccuaggaaagagagcuggaagagcugccaaaugagaaccagcugauguauguaugcuggcagcacccagagcugaggaaccacuucaagggcauccagucacaggacuuugugguugcugcccucuuguuggcuaaagaggucacaugauguggaccaagaaaagguguaggaauacagggcaggaagucuaauuauccaauacuuccuaucacuaagggucuuuuagacauuauguggacuaaccacaaggcuggauaaagauucucaggacuacuccuccuccucagucagucuuucccagggauagacuaguaaaucccaccuguaucugaggggaccaggcuacgggaaucaccuagaguacagauaagugucugucuugaaggcuugugguacuucucagagccaggcucucuggcuccaccauacugccugccucucccuccuugccuaauaucugaaggccucuuccccagaaaggcaguaguggagcagaggcuggaggugaacuagaugucuugcagggauagcugggaggcggauugccugagcucuuguccucacaccaucacuaguuugggucaaaggcugugugcucuguggcccaguguccagaccccacccugccccucaauuccugacuaagaucacagcucaggccucuacccucuuuccacaguccauugugacacuggauggagggaaacuuguucaccugcagaaaugggacgggcaagagaccacacuugugcgggagcuaauugauggaaaacucauccugguaagaugggcaacuuuggagcuauaucugauugguuauuacuacugcucuuucagccaagccuguucuaaaaagccaaguccuccccugagagcuguagaagcugggacaagagagugguugugggucagggugguaucaggugggaauuuucuguguaguggcuuuggacucacacaggccggaacucaaaucuuaccuuauaggcuacaugacugugggcaaaucaccuuuuccaagugcaacuguaaaacggguauuaauaauaccaaccuuguagggcugcugggaagccuguaagagacaguguaugcacagcacaaagcaucacugauugaggaacacagcaggugcuccauguccuuuguuugcucuuccuguguuucuaccuugccucaccucaggaagaaguagaaaacagggccaaaucugaucccaggcccucuaggaggggcucccauugccuaucucagcauucccuuuccucuccucccuaggacugcauugucacuugcagggacaggcucgugacugguggggacacugaaugacaguacaguccuuucuuccccauucuaguccuaccccauuuucaugcuuucuaugucuggccuacugaaacuacuugacuacugcuuggguaggaaguaccacagccaggcuggcagaucuguucaagcuuggggacuucacuuggagaaucuagccuugacugaauuccccccagacccagggagagcagccaacuguggauucugccuaaccacagggccucagguuuucaccuaggcaucuucacugcacaccuucuugggucagcauaaccuguuaacugcauucuuguacucaugugggacagggguccccuugaaguuuggaaugaggugccuagcuuugguggggaugugauaugcaggaccaaauucucaguggcagcugaacuauggugaggccaugggucuggcucuaugaugccagaccggauagugggagguacagggcucuggcccuggcacuacucuaaguuagggaaggauuggaguuaguagccaaacacaguccuuuccugagucucuggauauuuuuccuauuugucaacuauaugccaggcaccaucuuagacacuaaggaugaaggaagccaaaugguauaagggaaggaaaaacacucaggaucuugaccaaauuacuuccucucuaaaggcucguuuuuuccaaaucucuaaaauaagaauuacaaugccuaucuuaaggauuugcugugcauaucagaaaaaaaaaauuauguauguauacacacacacacacacacacacacacacacacacacauacauacauauagccggcacauaguagguacucaagugacaauuaucaggaggaagggaggguagaaugcucgcaaugguguuccuggcuccaccccccaucucacucugucuuuccuuccagacacucacccacggcacugcaguuugcacucgcacuuaugagaaagaggcaugaccugacugcacuguugcugacuacuacucugccaaucggcuaccccucgacucagcaccacauugccucauuucuuccucugcauuuuguacaaauccacgaauucuucuggggucaggugccacugaccgggauccaguuccaguucccaugguguaugugguuuuuuuuuuuuuuuuuuaacugcacucauagggugcucugaggucaauaaagcagagccaaggccaccca

SEQ ID NO: 21387 - RNA, 7364 nt, Homo sapiens
uggguggccuuggcucugcuuuauugaccucagagcacccuaugagugcaguuaaaaaaaaaaaaaaaaaaccacauacaccaugggaacuggaacuggaucccggucaguggcaccugaccccagaagaauucguggauuuguacaaaaugcagaggaagaaaugaggcaauguggugcugagucgagggguagccgauuggcagaguaguagucagcaacagugcagucaggucaugccucuuucucauaagugcgagugcaaacugcagugccgugggugagugucuggaaggaaagacagagugagaugggggguggagccaggaacaccauugcgagcauucuacccucccuuccuccugauaauugucacuugaguaccuacuaugugccggcuauauguauguauguguguguguguguguguguguguguguguguguguauacauacauaauuuuuuuuuucugauaugcacagcaaauccuuaagauaggcauuguaauucuuauuuuagagauuuggaaaaaacgagccuuuagagaggaaguaauuuggucaagauccugaguguuuuuccuucccuuauaccauuuggcuuccuucauccuuagugucuaagauggugccuggcauauaguugacaaauaggaaaaauauccagagacucaggaaaggacuguguuuggcuacuaacuccaauccuucccuaacuuagaguagugccagggccagagcccuguaccucccacuauccggucuggcaucauagagccagacccauggccucaccauaguucagcugccacugagaauuugguccugcauaucacauccccaccaaagcuaggcaccucauuccaaacuucaaggggaccccugucccacaugaguacaagaaugcaguuaacagguuaugcugacccaagaaggugugcagugaagaugccuaggugaaaaccugaggcccugugguuaggcagaauccacaguuggcugcucucccugggucuggggggaauucagucaaggcuagauucuccaagugaaguccccaagcuugaacagaucugccagccuggcugugguacuuccuacccaagcaguagucaaguaguuucaguaggccagacauagaaagcaugaaaaugggguaggacuagaauggggaagaaaggacuguacugucauucaguguccccaccagucacgagccugucccugcaagugacaaugcaguccuagggaggagaggaaagggaaugcugagauaggcaaugggagccccuccuagagggccugggaucagauuuggcccuguuuucuacuucuuccugaggugaggcaagguagaaacacaggaagagcaaacaaaggacauggagcaccugcuguguuccucaaucagugaugcuuugugcugugcauacacugucucuuacaggcuucccagcagcccuacaagguugguauuauuaauacccguuuuacaguugcacuuggaaaaggugauuugcccacagucauguagccuauaagguaagauuugaguuccggccugugugaguccaaagccacuacacagaaaauucccaccugauaccacccugacccacaaccacucucuugucccagcuucuacagcucucaggggaggacuuggcuuuuuagaacaggcuuggcugaaagagcaguaguaauaaccaaucagauauagcuccaaaguugcccaucuuaccaggaugaguuuuccaucaauuagcucccgcacaaguguggucucuugcccgucccauuucugcaggugaacaaguuucccuccauccagugucacaauggacuguggaaagaggguagaggccugagcugugaucuuagucaggaauugaggggcaggguggggucuggacacugggccacagagcacacagccuuugacccaaacuagugauggugugaggacaagagcucaggcaauccgccucccagcuaucccugcaagacaucuaguucaccuccagccucugcuccacuacugccuuucuggggaagaggccuucagauauuaggcaaggagggagaggcaggcaguaugguggagccagagagccuggcucugagaaguaccacaagccuucaagacagacacuuaucuguacucuaggugauucccguagccugguccccucagauacaggugggauuuacuagucuaucccugggaaagacugacugaggaggaggaguaguccugagaaucuuuauccagccuugugguuaguccacauaaugucuaaaagacccuuagugauaggaaguauuggauaauuagacuuccugcccuguauuccuacaccuuuucuugguccacaucaugugaccucuuuagccaacaagagggcagcaaccacaaaguccugugacuggaugcccuugaagugguuccucagcucugggugcugccagcauacauacaucagcugguucucauuuggcagcucuuccagcucucuuuccuaggaguuugggggccacaaggccaggcuaagggauccugaugagcaaggugguucaguaggagaaucugagaagguucuguguauuguuuaggugauaagggguaugaggccugucucuuagugugcucuuuuuuauccuuaccuuacuccuuguucucauuccccuaguuuuuuuugccuacucagaguagauauuuuugcccuaggcauuccacagggcuauuguguuuaauugggguucuugccccuugagaaaguaggcaaguccaaggagguaugagcaggugguggggcagccaccuuuauccaagguagacugccaucuuugggcaccauccccagcucugcugccagccaccugugugauccuguucuuucuggggacagcuaugaggaagaggaaacagcugauggggcugaaugauagugucaugauagaacacugcuauagggacacccuauagaggucaaagcccuuaaguucucucgcucccaugccuggccuggaaggcugaggcaagcugccaagacagccacugcagggugauagaacccugggaggaggggcuaaggcuuggugggaagacacugcaaacacauucaugacaaggugaaugcccuaucacggaacauagcucuuccugccugucagcuggcaacacuggaaauaguuugucagggucauuggccaugucugggaguuagaaguugaagcggcaucugaguaggugcuucuaguuccuggcugccuuuuuugcugcuggaggucacaaugaccucacucaguggagggcccugacuucugggcaucauuccuaaagcacuucaggucacagccauggccacauaacucugccaucuauggaaggggaaagaaaccuagagcuacugcauaccuugcacagggucacccagcuggagcuggaguagauacugaggucagaagaacauccuggcucugugcugcccauuccgaggcagacaauagaugaaucccaagaagggagggaagaaaacaagaggacagaacugacauguauuuagcaucaguggcauuccagcacuacacaggcuuuaugaaucuuguuucauuuaaauuccccaugauagucugccccucagggugcaauaccagggagccaagacuaccagccuauucucuuuuagagucucagcacucuccauuccccaccccuguuucccugacuuaccuugaccuuccugucaucugcuguugucucaucgaacuccacccccaacuuaaagcugaucucuguguucuugaaggugcuguguguuuuuagggugagaauguccccauucuuuucgaugauugugguaggcuuggucaugcuggccaccugccugguagcaaaacccacaccugaggguagggggaagguuaugaguauaugagcugggguagagaagcaguguacaagaaacucaaugaauaacucucaggccuggguauggggaaguggaggacuguaucuuucaaagccuuugcaugggaauuuuaaaauucagucuugcgcuuaguucuguuuggugaacacagauaacugaucccauuagaugagagauacuuaaggaacagcagugccauagcaagucaguggcagagcugggauuagaauaagcuacuauugggccaagugugguggcucacgccuguaaucacacuuugggaggccaaggcaggcggaucacaugaggccaggaguuuaagaccagccuggccaauauggugaaacccgucucuacuaaaaauacaaaaaauuagccagauguggugguaugugccuguaaucccagcuacucaggaggcugaggcugagaauugcuugaaccuaggagguggagguugcagugagucgagauugugccacugcacuccagccuagccaacagagugagauuccaccucaaaaaaaaaaaaaaagcuacuauuaaguacuaugagcuuuuuguguaguaagaacuguacauguuaucucauuuaguucuuccuguucuucugaagacuguuuccacguuacagauacaaaaacagagguaaagcccagggucacaaaucugagauugaagcccagaauugucugaguccagagcuugcuuaagugcucagcuauacuaccucccaaggcuggagcauaaggcugccuuccagggcaccugaaaagcucucaaagccuuaggaauaaggcugaggaaagaagagaaacauagacuuucccuuccaaagccuuaggcauaggaguuuuccaacuuuggaaguuuuuacccugaaacuaagaaguguuagugcucuugucccuuauacauggcaacccaucauuuucaaagccuguuaucuaugaucuaggaguuagguacaaaggaaguauuuguccuauugugcagauucaggaggagccuaaagcgguagcaacaaugaguuagacucaaacccgucuccugacucccagucuaaggcuuuacagagacucucuuccugacccaagcauggcuuccuuggguacugggcaaaguccuaaguguccugcaaccaaguaaagaacaaagaacuaaucaugacugcccccucuccccccagcagcuuaacauugaacugucuuccaaggcaaaggugaggcaggaggcagcccaguguagugaggugguguguguaaagucuccaaauguaccuggcuacauagugcuugcuggaagcuagguacucugcacaugcccuacauggguuguuuuacuuaaugcuuguaacagccucgaagcguagauuauccccaguuuacaaugaagagugcgaagugucuugucgaaauucaaagagaauaaacuacugacauagauuugaaccucggcuccaaaacuguugacuauuuucacugggcgauucuguccagcacauacucaauccaggccagcaguugugccuguggucacugguacuagacgggaccucuuugccccuugagagcccuaggucuacagcaggaggggcaggggcugccucugcuguuaugcugucagcccacccuugcuuggccagugaggaacuuggcauugccccuugguaucaggaugagucaggccaaucacacucccuugcacagagcaggaccuugucacggcacugggagcucuguucacuuaggaucuacccagagguauggaguguuugaaaaggaaaccacugcgggaugagugagggucugaaccaagagaaacuaagaauauugagcugacagaauuuaggagacucagggagaucuggguucuacuuagaaaugaagccagcacuacuuacugagagcugaggaggguauuuucccaggcuuuccauuccuacgaugagaaugcuggcugccuuaacauaagcugcugaaagauaacaggacuucagggagaccagcccgcugacccaacucggggcagaauaagggaacaagaaugguaaaguuguugcagcucaauucaagacucagcucuggcccagcuuuggaaggaggaacuaaaucugggcauuccaacuucccaauagcugcugggcuguguucgugggggcugggggcugcuccucuaagaaugacugccugccuagaauuacugggcauagcgcccaagauaggguagaggccguugagagcuuugaccucuccaucuaagcccaaagcaguagaagaagggcugaggucaaucauuagcuaagcaguuucuacuuuucuucccacucgcagggccuguaggguagugggaagagcucuggguuacagaucuagaaaccuuagauuuucauauuggcucugcuguggaauuguuauaauacauuucuacucuccugguuucaguuucccuguugaacuagaugguaugggaaucuccaaguuccucaccugugagauucuuugaauccugauucuucuccaucccaacaccacagcaguucuccacauccuccuaaaccagugauccucccucccaggucuugaccuugccuugggacccucuacugcacaucagaaguccaauggcuuucucugccuaccccucgcacagauaggugagccuuggguugcaggaaaggcccagcugaucaugggccucuugccccacccuaccacgaggcucacagacagugaugaaggccuggauacauagacugcaggacaaggucagacuggcuggugagaaagggcauucuccagcaagaauucucuucccuaaccaagcagagauggggauugcugcuuacugcagguuccugucuuacguccuucucauaucugauucacugauccacaguuuuuuccccacuaaucuuuuuccuccuagguauuuccuacuuguuuacaucauuguacacucccuggcugccccauucccuuucuggguucagucuccuccaauuucuaaacuacccaugccccuguucuuuuucuccccuggcuacacucccuuuccugugaucaguguucuuuauccaaacccuccuccuaccuccaaaucacauaucccucuuccuggaaagagccucccacacagcugccuccuuccaccaccucccuaccguggucucuaaccagauuuggaccaccaaagcccccucugaacaggccccaccugcucuaggccaggcugccaucuccgcgcuccccuauuccccagucuuaaccaggagggaugcggcaggagugcugcguggggcuaggcacgccaccagccaguccccaagccaacauccugagccccgcggcuugcucaccgagugacuucauguagucaucgaaauucuugcuguccacuagcuuccaggugcccaggaaagcguccaccaua

SEQ ID NO: 21388 - RNA, 5848 nt, Homo sapiens
ugccaccaacagcacugugcaguuuuauuaaccauucaaguccaguagcaucugguaagauugggacagaauugggauugaaaagugaacagauauucagcaucuaacaguucaaaagaagccacuacauacucuuuucacaaauauguuuucacagagccaauacaguacuagccauuaacccaguacaccaaguguacugaaguagaaaagaugcaacaagaaaaauagcuacauuagaaagaccaacacuuuagaaaaagaguaaaacacuuucaguuucuccccuuuagccccuaaaacaacaucuuacagucuggaucuggaucuaccuauacaguccuacauuagcuucuaaaauauuugucaggagggaaaaaauaaaaugacacuggccaguacagucuuuggauauuuaggaaggggauggggagaaagucaguucucagaacaaauuagucagcuucagucucgucagcagggucuuuggauucuuuguucuuccgcacuucuucaaugugcuuauccuguaaaggaaggguaaggugucaucagucaaaaaaaaaaaaaaaaaaaaaagccugucaagucacgacccccagcccccaccucaaagaggcccaacacaaccucagugcauauauuacagccugugggaaccacacaauuuaaguucugagacaucaucaucaaaucuccugggucccuuguagaaccuaacaagcugccuacuggacuuccaaggacugugcaauuaugcugggaauuacugaauauuccaucuuaaaauauaccuuucauuuaauauguuaagccccaaaauggaugacaaaaagacaccaaacaccuuuuaucaaagcacuuaguucaagccaacucauuggugcaucaaacuccaagcucaacccuuuuacaaaguaagaaaccaaccuucucucgcaaacguuccaguuuggcagccauuugugccucucgguucucuuuauuagcuuccauuuugugggucaguuucucuucugccauuuuacugaaguuguuguucucuucuauugccuucugaagcacuucuuucucgugcucucguuucucagccagcugcuucaagaccucagcuucaugggacuggaaaaaaaaguuuaauaggcuaggcacucuaaaauguauucaggcugggugugguggcucacgccuguaaucccagcacuuugggaggccaagguggguggaucauuugaggucaggaguucaagaccagccuggccaacauggugaaauccuaccuauacuaaaaauacaaaaauuagccgggcgugguggcgggugccuguagucuaaguuacuugggaggcugaggcagaagaauugcuugaacccgggagguggagguugcagugaacugagaucgugccacugcacuccacccugggugacagagacucugccucaaaaaauaaaauguauucagcauaaguuaaaauuacaauaaaaauaauuuacuaaggggauugaaaaggggcagaaaauaaggucccuuuaaauaacaccaaaauuaggaccugaauuaucccuaucauaaaauacugugaaaaugauauucuuuuucuaguauuuguauuuaacuuuggaaaagugcuuaucuguucagaaaucuuacccaauuaguccuuaaggaaauccuuguaagauuuacugcuuaaugguaucuggaugacuugaggaauauguacuugcgaguggcacuuuuauuguaaagaauuucacuauuuaacuucaaaagcuacccaaagaaaacuagcucauuguaaaaauuuuaaccauaacugauaaaacaaugauaggaaauucaagacuaagucuguagauuacuauuuaagacagaaaaauuuguuucaaggaaaaggcuuauuagcuuuugucucaggaaacugcauuaauuaccagaccauaccuugguaugaccccuucaacagaacagcuuguucucaaaacacauuggaaccacugacuugcaggauaaccacagagcaucugacacugguucuauugauucucuucugccaaauccuagucaugaugggaguuucauuauauuuagccaguuacuauguaaagcacaggcuaaugacuacagggccaggguugaugucuaaaaagcuuuccacuguccaaccuuugguuguauugcuuccuccuacuccaugaacucacacuauugcauagaagacgacuccuuaguguaagcacugaggcucuucgggcggguguguguguauacuacaaaucacuaugcuggucuggggaagguuauuaccuuaccuuuugugccucacuugccccagcuuuaaaaucaauccuaucaggguuguugagaaagggaguuaaaugaaaaguuauguacaguuguuaaugaguaacauugaauggaaagaaacacaccaaaauguuaacacugguugcuucucggaagcgggauaaugaauacuuuuaauuuccauuuauaaauuucuguauuucccaaauuuucuacaacuagcauauuaauauuuauugauucuucugauuagcuuuuaaagauaguuacuuuauaauagaauuguuuagauaagagaaaagcuaccaugauaccagcugagcaacacaaucacacuagcaauuuaaaauguuauuguacagcucucaaaaaacaaaaccaaagugccaaagaaucaucuggcaacaaaucuuuucaaagaggaagcaugagagaagcaugagcuuugguuuaagauagaccagggcuugaauucugaccccaacacuuacuaguuguaugacugcagaaaaacgacuuaacauuccugaaacuguuucuaauuuccauuauuugaggcaacaccauguauuaaaggagaaaaauauaaacaaaggagcgggcauguaacaggaguucaauaaaugaggacugguauuuccuuccagucacuggcauauguaauaaucacaguguagcuacaauucuguuuucuuccuguuauagaaauaaaauugaucugcccauuacauaaauuaauauccugcuuucugugaauugcuucguuuaccuugcgucuuucuucugcagcuucuaauuucuucugaauuuccuccagggaaagauccuucuucuuuggaggggaaagggggaauucuggaacagauucuuuugaccgagggcugagaaucagcucaaaagccuggccugaggcacgcuucuccaguucuuucaccuggauaucuagaauugauuauauuuauaauucagaaaaccaggauucuccuguucuaauaaacuguacuauaauuuucuaaaacccaaaucaauuuaauguauuaaacuagggcugaugaggaaaguuguguuuuuuuuccccuuuuuauuccuaucagucuacugacacuaggggaagauguauuugcaggcaagauauuauuaucuaaauaccauuucccaaggccagguaccauggcucaugccuauaaucccagcaccgugggaggccaacaugggaagaucccuugagcccugaaguuugagaccagccugggcaacaaagggaaagcccaucucuacaaaaaaaauuuuuuuugauuaggugggugugguggcccaugucgauagucccagaugcuauggaggcugaggugggagaaucgcuugagcccacuugagcuccagaagucaaggcugcaaugagcuauaauuaagccacugcacuccagccugggcaacaaggugagacccugucucaaaaaaaauaaaaaccaucucccagaaaaacaaagcucaacauuuuuggauuaauaaauacuguuuugagacaucaguaucugacaaucgcuuucauaaacaaaagacuugugcaaacuccacaauuuugcuucagacuaagccaaacuguccaauaaacaauuacgagcucucggcacauucaagugauaaucauuuuuaaauucuucuccuauucauaaaauagguuuugguaagaccaaaacauaagugccaaaucaaaggcgaagaccugagccaucucaaucuaaaaucauaagcccauuacaauuucagauuuuccaaauagauuaccuaccagaagaagccauggugaauagaagacaagcgacaggcaguguauucugcacaaucaacugggauaaggaaaguccugaaaaugauuuucaaaaacaugcaaucacuuucuuugccuuucuauaugucaucaacccaaaaaaaucucacaucacaucuacauacaucgucagaaaaauacguggaauaaagacgucuaaauuaaccacgaaaaaaauuaucaaaaucuacuaaauaaacauugggaaauaugaccugaauaugauauugguuccagaaaaucaaguuaacugagcuuucucggucauaaaacucuuggauuuuuaaaaucagacaaagucacaagggugaagaauuuuucccccauaaacucuuuaacauuucaccgaaacuguaagaagauauuccagauucaacucaacagugcccccggagccaucuuaauacugccuacaacucauugugcaaaugaaauacccaccccugcuuugucugugucugacgugguggauaagaaaacgcccaagcuaauaguaaccaauaauguugaacuccuauugucccucagguuuaagcuuccuugcccaacagcaagcaaaauguuuaugaaccucuagauuuugacuuauauuugcugccguuaugucaugaaaaaugcuguaucucuuguugaucuuuuuaacauuaugacuuuuguagacgccagcuaguaccaaaaacguaggaugacagguucccaaaagcuaggaauuaaaaucagaggcagcgacaagauuuaagaaaagcagagaauuagacgcagcaccggacccaggaugggcguggcccugguccgggcgaggaaaagaggaccggucgcccccggccaaucagagcacgccuugcgcuccggccccuggccccgcccccuuccuccccgcgccuuuucgaaucuccccgaacucaacaccccggagcccgcgcgcgugggaaggggaggggugggcggggcuaacgguccaauccggguaacuccgccccugccugacucccccugcgcggacgccccccccaacucccgccaaaaacaccuccaggccgccgccaccacccccuucacaguucagcggguggggcaggccccgggaacaggcccccggguggucccgcggugagcucgccaccgccucccgccguccccaugcccaaccugccgccacccacgcuguccgcgcguccggccgcgaagacagaagaacccucguggggcccgggagcgccgccccucaaucaccagcugcggucgccaggggacggucgcagggagggucgcggcccuggcugcccgcaguuugguccuaaagccgcuggucccuggggcaccgccccgucccuucagacaauggggaacccggcggggcccgcagggaagggagggagggagggagguaaacgagggcccacgcccccuauugucuccucgacggcaccccggagcggacgcccggugaucgcccagcccccugcccacgaacagccgcgcccccggagagcggggacaaaggcgaggcuccgcccgagccacacacaaagcggagcgacccccgcccaccaaccccuccgaggcccgcagccccgcccgccgcccugcagcagggggucgcugccacggcccagccccucccgccgaccgcgucccucuugcuggccucagccagccgccgccuccuccgagccccgcacccaccugcucaguccgagccgccu

SEQ ID NO: 21389 - RNA, 18579 nt, Homo sapiens
gaggaggccgcgccagugacagcgauggcggcggagucggcgcuccaaguuguggagaagcugcaggcgcgccuggccgcgaacccggacccuaagaagguaagcgagggggcggcgcguagcgggaugggcguugggucggugagggccccguaacggucgcggcccgagcguggcgggguucgggggcugggacccugagccaggccccgcggggcuggggucgugaaguucgcggccauugaccgcugcccgcgcguugggaccccgugcgucgggcgucgggacgcggggccccggccgcucccccucccucacgggcccgggaugggggcgcgcccggugcggacaccgcgugccuagcgcuuccucccagaggcgcuccguggcgucccgagccagcuguuuccugcgggagagcgugcccggggcgggagggcgcuggccgccgccucguuggccucccggugccugcgcuggugcccggcuccccgcggagcggcgcggacuccccagcgggugcguguucgcugggaggagaagacgggcgcccgaacgcugcggagccuggacucgcggucugguccgcgccucucggagacgcgguuacuacucuccggcuggauaucagagcguggaccuuucgcuuucucagugaaucccuuucaaaacagaauaaagccucgcgucaccuaagcauacuccugaaaacuuagguuggaauugaaaaagaggcgggggcccgggguuggaagucgcagcuagguuuccuuuuggccauuaauaggaagguaagagcuaccguuucucguuguucgagugauggacaaccauuuuuaauuguaguuaacuaguuuuuguuguuuauuguacaaacugaauauuaaguuaaacgcguucuuguaccuuuucaucuuucugucacucacuucucuggucuccaggagacagucuggugguugucaggauuuuuuuuuuucuuuuuuuuuuuugaggcgagucuugcucuggucgcccaggcuggaguacaguggcgcgaucucggcucacugcaaccuccgucucccggguucaggcaauugucugccucagccucccgaguagcugguauuguaggcgcccgccaccacgccuggcuaauuuuuguauuuuuaguagagacaggguuucaccaucuuggccaggcuggucuugaacucaguugucaggauuuuuuaaguggaaguacaacgaugaaaaagcacuuauguguuuggcauucuccgucaucauucuggccggggcgggcaguucuaggaguuggaacucaguccugguggaaaaggaagucguggagggagggcuagggccgugggggaacugcucugcugagccucuuccucaccugcugcuuccuaggacuaaccugaaaggcuaagguaccaggcugaaagucagugcucagaaaaccaaucgucauucuuugggguuuuuuuucuugaagagccacuuucucuuuaccuuguucuagccuguuggagguaggguuucugcaauuccaaaggccguacacagccucucaccaucagaccacuuuuuaaggcucuucguucauaccuagcucgaagauucacuuccucaggaagccauuuuaguuacaaaucugggaaaacuuaaaaugcuuucauugugccauguuuucuguugcagcuucaguaccguaccuaguggucaggcauacuuacaaguuucuuuuuacaguaaccccuuguggacaucuaauaaauggucauuauuuuuuaguacuaguuuguuuuccugaacacuguaagaucugugacugacguuugauaccuuaaagcagugccauauaauaacuacccacuauuuguucuuuauuucugucagauaaaaauguucuauguagugucuacagucauuuuuuuuuuaacuagaauuuagauuuggaaguaguuuuucuauuaguugauuugcaugaaauacaaaauuaggaaaaggcuuauuccaccucaaccuaguugaacuauuaaugauuuuuuuuuuuuuuugaggauuugggcucuuucuagauagaaaaucacccugaacuucuagcuuugcauugugaagugagcaucaugaagaugagaaaauguugggagaucauuuuugcaaagggcauaauagucggcauucagauaugaguuaacugcagagggaaaauugcaagcugucauguuggccuuguuccucucaaccuucugguaaccuaacaagcuccuacagguuguaugugaaauugcaagaugauuauauagcccuguugaauuuacaaccagaucuugcuuucaaaccauuauuagccaaggguuugauuccacaccuguguucauggauuuuuugguacuagacauugcuguaacucuguuuucacuuuuucaucuguuaucuuggcucacuuaagggagaagguaucagcagccuaggaccacuugguuucuguuuuuauguuucauaguucauggcugauaaaaauuaccuguccuuaggccgagugcagugccucacaccuguaaucccagcacuuugggaggccgaggugaguagaucaccugagaucaggaguucgagaccagccuggccaacauggugaaaccccuucucuacuaaaaguacgaaaauuagccaggugugguggcaggcgccuguaaucccagcugcucgggaggcugaggcaggagaacacucgaacccgggaggcagagguugcagcgagcugagaucgcgccauugcacuccagccugggcaacaagagcgaaacuccgucucaaaaaaaaaaaaacaaaaaaaacacacacacacaguuggccgggcgcaguggcucacgcuuguaaucacagcacuuugggaggccaagaggggcggaucaucugaggucaagaguucgagaccagccuggccaacaugaugaaaccccaucucuacuaaaaauaaaaaaauuaguuggucauggugguggugccuguaaucccagcuacucgggaggcugagacaggagaaucucuugaacccaggaggcggagguugcagugagccgagauggcaccauugcacuccagccuggacaacaagagcaaaacuccaucuccaaaaaaaaaaaaaaaaaaaaaaaggauccucguccuguguuacauuuucacugugaaagcuaccaagaacauuuugauggcaggugacauuaaaaauauuuuuugcuuuuuuggguugaaggauuguacaggggacaacugagaugccucaacauguaccuugcaaauguuugauauuucucaguugccuguuaccaguucuuacaagcucuauaguugguaucuuguuugauaacagcaaguuucgauccaccugaggaugcccaaugugccuuugccuuguuauugcuuuguucuuucuugaaauuuacugaaaauagagggguugugaaguccuuuuuucucuuguguuagacuaaaugagucugaaaaucuugaggguuuuaguuuugucugcuuuuaaaucaccccuaauaacccaaaguaaagcagaaagacaggauuuguucuuccaguuagugcuaggcuuugagauaaacacacccacagugacuuccagccucauccuuauauguuggcuuuguagagguccugggacaccuuuguucccuuggugaccuccuuuacuauguggguucugaacugucuaaugacaucacaggaggaguuuuucugcuuucuugcaaguaugcuaagaaguauaugugcugccgcucuauuuucauuuccuaaggacaguguucugauguuggaugcuucuccuggcuuuacuuaacuguaguagacacauuugacuuuccagcuuguuaagcaaguuaccuaaccugauuggguucaguugcaauaucugucaaauggggagaauaacauccacuuuauagaguugguuagugggaaugaaaugagguaacguguaagagcuuaguguaguagcugacacacaauagaugguaugugaauauucccaaccuaccccuuccaaggaauggcauuaugagagaaccacuuguuuuugaccuuuucagugauuuaaaauuuuccuuuaagugaaggaauuggcauuagucuuugcacccauagcuuggguggcaagaaacacaaaauuuuuccugaguuggaugaugguggugauaggauuugaagugggggauaauuuucacucaucuaugaaggugagacucccuagauaugccacuuggccucuuacuugaucucaagauuaucacuugugauccaauugcucugucuggugaccauguuaaguaaugauugaaguagaaugaccagaaaaacagacuuguuacuccaccuaauagcaauauggcauaccaauuauagucugggccacacaugguaaaagcagaucuuguuauauaauauuuaaaugcaaagguaaccacaguuaucuauuuuaaacuacuuguauuuugaagcacuccuuguaugguaaguauguuuagauacacguagacauuuccuagagaaagguuuggccagucauaacuuuuguuagagcaaguaggaauuggcugaggaauaucugguugaagaucaagggcagaacgcugaaagcugucagucgaugaaugaaaugauaaguauuuagugagcuuucauaguguucuagacacuaugacuaaggacugcacaugguuugucucugaauccucauaguuugugaaguagagacaggaccaaguuccuauuuugcagaugaaguaacugaaguuuggggagguuuuugacuuauucaagaucacucaucgagugacaaagccagauugucaagccugucucugacuccagaacuccaucuuaacagcucugcuguacugauuuugaccuaguuuuaggaacuauaggaaggaaaugugaucaaacccagaucacuuuucuaaucuacccaggcauuuuguguccaccguuaacauccaagcucugauucuggcaacuugaaauuacucuuggcuuuacacuuauguagaagaaaacaauucuguuaaacacuguggcccuucuggaaacaugauggucuuuuccuguagaggccuuuucuuccuuuuacuuccucugugccagguccauggguaauuccccuaaaauugguaccuuucucauaaauucuaucaaaacuagggcaaaaaugauaguuguugauggcuuuuaucagaguugguaaguuuugauucucuucucuacaucuuauuuccccuugguguagcacagugguugaaagcagggaaucuaaagccacagaccugagugaaucuugccccacuugcaucuugggacaagaaacauaacuuuuaugagccuauuuucauacuuguaaaauagggauauuacuuacuacuguaaauaggcauaauacuuauacucauuacuguaaaugguuagcacuaagcacuuaauaaucagauauucuuguuaaagugaauuugacuauugaaauuaauguuuucuucucugcagcuauugaaauauuugaagaaacucuccacccugccuauuacaguagacauucuugcgguaagaacugugugacuuuaaauauuauauaaugauaucccauucccuucucacuggagaguguguagaauaagguuacaaguaugggcuuuggaagugaaagaaaccagacacaaaaggccauauauugucugauuccauuuauaugaaauguccagaauaggcaaauccauagacagaaaguagauuagugguugccaggggcuaggagaauugggaggaacaggauuucuuuuuaggguaauguaaauguucuggaauuagaugguuauaaugguuauauaauauugugaauguucuggaaaccacugaauuauguacuuuaguuaaaguggugaauauuguuaaaugacuuuauuucaaaauuagaauuaaaagaacauugacuuuggcaucaauuagucccagauucaaaucugaguucuaugacuuuaggcuguuccuauguaaaaugggucugauuccugcuucacaggguuauuguaaagacugauucagaacuguaugcaaagcucuuaucuuagugccuaacaccugcccuaaucacucuuguuauuaaaguucugaacuugguacgcuuugcuacugugugucauuagagauuuggggcauagacacaaaguaauuuaguguuaagauuugcaggguauguuguaggaaggaaguauugcuuguugaguuucucaaaguagaaagccuuauuucuuuagaaaaacguuagccuaguuccagaccccucuaacaauuacuuugucaaauuuuaggagacugggguugggaaaacaguaaauagcuugcgaaaacacgagcauguuggaagcuuugccagggaccuaguggcccaguggaagaagcugguuccuguggaacgguaagaacauuucucuuuagguuuguucaauuucaugguuaaauuuacagauagaaaagguuuucuuuauuauuucucuuuugccuucugaaauuguuuugccucaauuauaaaaaauaauccaugaucauuguagaauauuagaaaauauuaaaaauagaaaucaaaauuuccuauuucuaucacgcaaagacaaacguuaugaacauuuugguacguuucuuuuuuuuuuuuuuuuuuuuuuugagacagagucucgcucuguugcccaggcuggagugcaguggcgugaucucggcucacugcaagcuccgccucccagguucacgccauucuccugccucagccuccugaguagcugggaccacaggcacccgccaccacgcccggcuaauuuuuuguauuuuuaguagagacaggguuucgccguauuagccaggauaggaugguuuugaucuccugaccucgugaucugcccgccucggccucccaaagugcugggauuacaggcgugagccaccgcggcuggccugguauguuucuuucuaacugcuccuuaaauggcauuuuuuuaaguugugaacuagauaaauagugagcagcccccauuuuauauaacaaauuaaacauguccccauguuuuaauaaaucuccacauuuucauguauaugagauauuugaucuuugcaucuugugguuaaacucaccauuucucauuuggguuuucccaguuuuaagauuugaguaucuuuaagcauaaccuacuuaucuucuucuuaagaccuuguuguuucuaacucugcaucuucacuucuuuggugaguucagauucugugacuuugucccucaagaagcaagauuuagaccuacuuugucugcuuuuucuuuuauuuuagaaaugcugagccugaugaacaggacuuugagaagagcaauucccgaaagcgcccucgggaugcccugcagaaggaggaggagauggagggggacuaccaagaaaccuggaaagccacggggagccgauccuauagcccugaccacaggcagaagaaacauaggaaacucucggagcucgagagaccucacaaagugucucacggucaugagaggagagaugagagaaagaggugucacagaaugucaccaacuuacucuucagacccugagucuucugauuauggccauguucaauccccuccaucuuguaccaguccucaucagauguacgucgaccacuacagaucccuggaggaggaccaggagcccauuguuucacaccagaagccugggaaaggccacagcaaugccuuucaggacagacucggggccagccaagaacgacaccugggugaaccccaugggaaagggguugugagucaaaacaaggagcacaaaucuucccacaaggacaaacgccccguggaugccaagagugaugagaaggccucuguggugagcagagagaaaucacacaaggcccucuccaaagaggagaaccgaaggccacccucaggggacaaugcaagggagaaaccgcccucuaguggcguaaagaaagagaaggacagagagggcagcagccugaagaagaaguguuugccucccucagaggccgcuucagacaaccaccugaaaaagccaaagcacagagacccagagaaagccaaauuggacaaaagcaagcaaggucuggacagcuuugacacaggaaaaggagcaggagaccuguugcccaagguaaaagagaaggguucuaacaaccuaaagacuccagaagggaaagucaaaacuaauuuggauagaaagucacugggcucccucccuaaaguugaggagacagauauggaggaugaauucgagcagccaaccaugucuuuugaauccuaccucagcuaugaccagccccggaagaaaaagaaaaagauugugaaaacuucagccacggcacuuggagauaaaggacuuaaaaaaaaugacucuaaaagcacugguaaaaacuuggacucaguucagaaauuacccaaggugaacaaaaccaagucagagaagccggcuggagcugauuuagccaagcugagaaagguaaccccuucagccccuugguggcuucccacccagagcaccuggcccugcagagcucagaggauugcccugccacuguuuuccuuagcuugcuuuuggggggcauguugaauuucagugugcaguaauuuccucugggcuucacugguugucaggguauaugguaccgcaaauaagaauuuucugcauuauucucuugugaugggcucaucuguauuuauuuccugacugagguggugucagacaugacuguggcccccuccaaccuggaucuuccugugcaagauguccaguuaaugcucccgggaauagacuguaggaaagagagcugugcuucuacucacugacucuccacccaugggucuguccccugcaggugccugauguguugccaguguugccagaccucccguuacccgcgauacaggccaauuaccguccacugccuucccucgagcugauauccuccuuccagccaaagcgaaaagguaauuuucuauaucuucuuuuucuuaaugggaaaaagauuuaaaaauucauucaaggcaggguacaguggcucacaccuauaauuccagcacuuugggaggccgagguaagaggauugcuugcggccaaggguucuaaaccaaccaggcgugguggcucacuccuguaaucccagcacuuugggaggccgaggcgggcagaucaccuuagguaagaaguucgagauuagccuggccaacauggugaaacccugucucuacuaaaaauacaaaaauuagccaggcaugguggugcgugccuguaaucccagcuacuccggaggcugaggcaggagaauugcuugaaccugggagguggagguugcagugggccgagauuacgccauugcacucaagccugggugacaagagggaaacucuauuucaaaaaaaaggaguucuaaaccacccuggucaacacagcaagaugcugucucuacaagagaaaaaaaguagccaggcaugguggcacaucccagguacucgguaggcugaggugggaguaucacuugagcccaggaguucaaggcugcagugagcucugauugcaucacugcacucuagcuugggugacagagcaagacuguuucaaaaacaaacaaaaaaacuaucaccauaacaucagauuuuugaugcauuuccuaagugcauagacucugaaguuugauggcuuggguuugaaucccaacucugguuucugcaaguuauaugaccuugagaaauaucuuaauuucuuuggaccuuaguuguauauauuguguaaaugggaguuauaaugguaucugccccauagggcucaguuuaaugaauucagaagugaugccuuuuugcucuggguuuaucacauaguaauuguucaguaaauugcugcugcuguuauuagcagcccuuuauccuauguguuacauaggauuuuugucugaaagaaaaaaaugucuaauuuucauagcaaaagaaguagaagccacauaagggucuaucagcaggagacuaacagauaaaucaugguucaucuacacaguggcauccuaugccacaguaaaaaaaaaauguggaaagucuaugcacugacauggaaugaucucucagauguggcaaaugaaaaaaagcaauguauguagugaguauguuauuaauugauucauuggcuuaaaaggaauaagauacauuugcuuuuuuuuguuguugcuguugagagucuugcuguguuacucaggcuggagugcaguagcuccaucuuggcucacugcagccuccaccuccuagguucaagcaauuccucugccucagccuccugaguagcugggacuacaggugcauguugggcaggcugaucucgaacucuugaccucagaugauucaugugccuuggccuccuaaagugcugggauuacaggagcuuauuuuuaaauucucuggaaggaucuacaaaaaucuguagcguggauugccauugggaaagggaaguaggaggcugaaggggguagaaggagaguuuucacuggaucacuuagggccuuuuguguuuuucuugcccuauagcguucucuucaccccaggaagaagaagaagcuggauuuacugggcgcagaaugaauuccaagaugcagguguauucugguuccaagugugccuaucucccuaaaaugaugaccuugcaccagcaaugcauccgaguacuuaaaaacaacaucgauuguaagucacacgcuucucucuagcucucaagcacauuguagcacuuggaccuuaucacuggguggcuuggcugcuacucagugucuucaccuuugguuucucugcagcaaucuuugaagugggaggagucccauacucuguucuugaacccguuuuggagagguguacaccugaucagcuguaucgcauagaggaauacaaucaugugaguauucuguuugggugggaagagggcaguuuucuggcuuguaccuccagaaauagcuuugucccugugacuccgcuguggcugaagggcagaucaguggucagagcauuguucuggauauauuugguuugccacugggccuuuaaacaagcauguuauuagcacuugcuccuggcaccuuaagugggccucuugggcuaggaucagggugggauucaaagggagaagaaaaacacuuaacaucucccuugagcuugccuagucaugaagguaaagggagaauucuggcagcagaguagcugggacccagggcggggaaagcacuuuguguugacacucugacaucuggugauuggcuggaugucucuuaagaaacaucaagauuuauccagaauccuccuuaggauguaggguauacacauuugauugcaucagcugucucucuuuaauucugaaaguucuaugaccuaacaccuuuuuuuuuuuuuuuggagauagggucuaccucuguugcuucgacugcaguacagaggccuaaucauggcuuacugcauccuugaacuccugggcuuaagugauccucccaaguagcugggacuacaggcacauaccaccacagcuggcuaauauuuuuauuuuuuagagagauggacucucagacucuuggccuccugaagugcugggauuacaggcaugagccaacgcgccuggccaauaacuuaacauccuucuuagguugccccuuugccaucacaguucagcguaguguugggaaguaccugauuugacuugaucgcaguucuacccuuugcugauuuucuaaaggaaaagacugauguuacacagauuuuugugauauucugucacagccaccaaaagcaacuagcauagugccucacacuucgcauuuuuaaaauuuagggaguuauuuuuuuccuagaauugugguauuuuaacauacuacuaagaugaagaccaaaaaauuuuugggaaacuggucacuccuagguaauuaaauaaucagaaaaagauaugaggcugggcauggugacacacgccuguaaucccagcacucugggaggccaaggugggcggauuaucugaggucaggaguucgagaccagccuggacaacauggcaaaaccccaucucuacugaaaauauaaaauagcugggcguggugguaagcaccuguaguccuggcuacuugagaggcugaggcgugagaaucgcuugaacccaggaggcaaggguugcagugaaccaaaauugcaccacugcacugcagucuacacgacagagcaagacucugucucaaaaaaaaaaaaaaaauauggaaaagugcuuguacacaaaugauguccugguucugguuucagguauuaauugaagaaacagaucaauuauggaaaguucauugucaccgagacuuuaaggaagaaagacccgaagaguaugagucguggcgagagauguaccugcggcuucaggacgcccgagagcagcggcuacgaguacuaacaaagaauauccaguucgcacaugccaauaagcccaaagguaacagagacgggagagcugggggagaacuggcaggaugaguguucuggucaauagcaggguguuggugggcuuggcugguguaggacugcuugccccuacaucagguagcaggguggguauuucuucugccaccgcccauucuacccuacaagugggguuucagggcacucaaaaagcccguggauuauuuaaauaacaguagcaucucugcucaagaaggcagauguucaucuccauaauuccacaggccgacaagcaaagauggccuuugucaacucuguggccaagccaccucgugacguccggaggaggcaggaaaaguuuggaacgggaggagcagcugucccugagaaaaucaaguaagaucuguguucuuaccuggcuuuugugugcuaucaacccuuagagguagccauagcggcaggaagcaaauugcuuuuggugaaagugaggcagugcagacugugggcucuggaggcagaccucaucagcucagcacuucccucaccucccucagccuccgcuucuuggacugcagugcaaggugauaauuaccccugcccuaggguagucaagauuaaauggagagcaaagccuggcuuaugggaaacauucccuuaugcuuucccuuuucccaucuaaacaaaaaacacauuucugcaaugauuguuauuuugucuaagccacauuagccuuuucaaaauacagauuuauaccaaaacagugaaaaguuaguugagauuaucauuuuuucugaaaggauaauggagacaucucugagccaccaccagaauccagggugauaggguccauuggucaaagccacaaacagggugagucauccucacacaggccagcuucaggcuguucaugcucagggcagauuucuugugcucaugccuaaccaguguuguccuguguugcaggaucaagccagccccguaccccaugggaagcagccaugcuuccgccaguagcaucagcuuuaaccccagcccugaggagccggccuaugauggcccaagcaccagcagugcccacuuggcaccaguggucagcagcacuguuuccuaugauccuaggaaacccacugugaagaguaaguaacuuggaguuccugcucaaauauuauuucagcacuaguuuuuaacucucaaugucauuauucacuguauuacauuuuguggacugcauguugcauguacaugaugccuugcacauagcuggucugaaugucagucccuccuucccccugcuuuguccauagugcauuauaucucuuaaauaguuauagugagucugggugcaguggcucaugccuguaaucccagcacuuuggcaggcugaggcaggaggaucccuugaauccaggaguucaagaccagccuggacaacauaaugagacccucuacaaaaaauuaaaaaauagggcauagugguacacaccuguagucccaccuacucaggagacugaggugggaggauuuuuugagauggagucucgcucugucacccaggcuggagugcaguggcacaaucucagcucacugcaagcucugccuuccagguucaugccauucuccugccucagccucccaaguagcuagaacuacaggugcccaccaccaugcccaccuaauuuuuucuauuuuuuaguagagacgggguuucaccauguuagccaggauggucucgaucuccugaccucgcgaucugcccgccuuggccucccaagugcugggauuacaggcgugagccacugugcccggccgacccugucucuggaaaaaaaaaaaaaaaaaaagugaaaguagaaaauaguaucuggccaggcauggucccugucucuauuaaaaauagaaaaauuagcccaccaugguggcaugugccuauaaucucagguacucggguggcugagacaggagaauugcuugaaccuggcaggcagagguugcagugagcugggauugugccacugcccuccagccuggaugacagagugagacacugucucuaaauaaauaaauaaauaucauugugaaugaccauuuuggcacucuucuuuuuucaccuaaauauaaacugacuucucuaggcaauaccacaguguucauaauuacuaauauuaacagcuaaaugacaggcccucuuacuguuuuuuuauagucuuauaacucuagcuuccaaauauuuauucuuuauaucuaauugggucuuccaauuuauuuauuuauuuuuuuuuuuuuuuuuuuuuuuuuuuuuuuggagacagagucucacucugucgccugggcuggaguacaguggcgugaucucggcucacugcaaccuccaccucccagguucaagcgauucuccugccucagccucccaaguagcugggauuacaggugcccgccacuaagcccagcuaauuuuuuguauuuuuaguagacacgggguuucaccauguuggccaggcuggucucgaaccccugaccuugugauucgcccgccucagccucccaaaguccugggauuaccagcgugaaccaccaugccuggccgggucuuccaaauauuuauucuuuauaucuaguugcgucuauuuuguauuuuguuaacuuuauuaccauagacuauccccaguauccuaaggggauguccuaacuuaagucuuauucuguauuaauugcagggcccaugggagggugggaguccuggcuugagcuacagcuaugcucagaugaaccauucaggaggcaggcuggccuuccuuaggcaguacuugcauagccaccuuagaccuguuucuacacuggacagauuggggguagacgugcuguuuacugguuuggcuauuugugaggcaaaguuaaguuaugacugaguauggccuuuagagucuggcaagggccggggcacagugguucacacacaccuguaaucccagcacuuugggaggcugggguaggagggugcuugagcccaggagaucgagaccagccugagcaacauagugagacccugacucuacagaaaauaaaaaaaaauuagccaggcaugguggcacacuccuguagucucagcuacucuggagucuaggagguagaggcuacagugugcugugauugugccaaugcacccuagccagggugacagagugagacucuuuccuuacaaaaauaaaaacaagaaagucugacagagauugaauuguaauucuguaccuuacuguacaaccaugggcaaguuggccaggcucucugagccuuggugcaggugguuagagagagugguggucaugccccuggcagguccuccgaaagugucugcucugugcuguugcuuuuauugcauugugaacagaggagauaguuacuacuuguaucucugccugguggugcacagccaagaauagcagagcuggcuuugacuguaaacuacugggggugugucuaagccgccacagaucugagacagcugccuuguuucucuuuucacagaaauugccccaaugauggccaagacaauuaaagcuuucaagaacagauucucccgacgauaaacugaggacuugccuuggaaauggaaucuggggaggcaggaauacaaggacaguggggguuggggaauggaauucuacaggagacuggagucuugcuuuguggauccuuuuggucuccgaguccugcagucugcaggugcugccccugggaaccugcgugccacagccccgccucccugccuggagcacacuuuagaauucugaagaugugaagccucugucucacugaggauuuuaaaggucaauuauacuuuuguuguucauuagcaucuuuguaaacuauaagacguaguuuuaauuaauaaauauugcccccagauuguauuuauauuaucccccagguuuguuuuuguuuuuuguccucuaccacacauuuagccuuuuaucuuccagguccuuauuaaaaucagaugaaagccuagugaaagccagucuccugccccagcucagcucuguguggacucugguccagacagaggacugggcaucuccagagccugcacaguaccugcugcacguagggcaaggaaugagcacuagaccgccuguccccaagggagccucaguggggcgacagggugcucggcggacuccaccucaggcccuccccacuguugcugugcauuccugugcaggugcaucucuuucuuacuaacugguauuuauuaagggaggugcucuguaggucuggagccuuucccucauccuuuuugcgaguccccaccuuuuuguuuuuuuuuuuuucuuugaggcucacuagaggacgcagaaccuugggagauugauuugcacagaacuccccaccucccacuuuuacaauuuccaguuucugauugaaaauuuuaggguuucuccccacugcccuucccuaucuuuccuuccccucaacaccaugaaggaaaaacacacacggcagggcuuuuuguagcccugaaggcaacuuuagacauuuaaaauccagcacuuuaaucucuuguucucugugaaucacuaugagaagugaaugguuuuaaaggcuguaaugcuauguuggaaauugguuuguuuugccuuuuauugaaaagguaagaucaugugauuggaagaacacaacuguuggcuugggaagaggacuuugcugcugaaguguuuucuaccuucugaguguguuuaaggcaggauuuggagggaaggaccagcuuagggagagugucugagccacagcgucaggaugggggaaaccacaugggauccaucaaguuccaguugaacaggagcaagaucagaacuuaggagggcagugucagcucccuuguuggcugucaaggaacaccgaucuaguagaaacccacuugguugugacccagguagagguagaugccauacauuugagauaugcguccuuaaggaaccugacaagcagacugaagggaugguaagugugacagccugauaaguuuucucaaagcccaggauacagagccaguguuuucuguaacuggagaccucaguuaggccaacuucgaauuccagagcaacguaggaagucuauucagcagaaacucgacauuguucaguguguauugcugugcagggugccuauugugacaggacacaaauguuacuauguuuuaauuugcuauauuuuugaauggguaaagcauuacuuuacuucucuugguuacuuguaccaccauuccaccccuaucccuagccugccccacaaaucuaauauuaggaagccucuuaacugaaaccaaaugaacauuugggucaggugccagaugucugcugccuagaauagcuuuuucuaggugucuaccaccuugaauuuaucucuuaacuguguguucaagucuuugucauugaaacuaguuuuucauaucuuagauucaguuguguaugauuuaaugucccuuauuaggagucuuuaggcagggagggaagaaaaaacagauuuguucauagcaaugucaguauccauuuuggcacauaaagauuuuugaugagcccuguuugcauagagccagauguuuuccccucccccaagaguaucuacaucagggaugugacuuggugcgaagagucaggggaaagaggaaaaacccaauuucuaaaugaccuccuugcccagcuuacuaaaauggcugcagagcagacacaggaugaauuugaaccugacacaggaugaauuugaaccuuuggucucauuuauggaaaaacuugugcaauuuuuuuucugugcuacacuacauacaaaucaccaaauuacaaauuacccuuuugugauccuugguguacugagcaguuucuuuggggcuuuuucuuucugggaagcgggagggaaaggagcaaggugucauccugcucuucauuuguauuuuggucccaaaauguaaauacaauuuucuauguuacuuuuuugugguaacuaccgagaugaauauuuuaauuagauaaguuauaugaaaaggaaaauuccaugucuaaauaaaaaacaaacucc

SEQ ID NO: 21390 - RNA, 69065 nt, Homo sapiens
cuguccucggaaauauuuggaaaguuuuauuuaaauguuuuguguucccuuuuaaccaccaccaaaaagagaaaaaaaaauuuuuuuuugccguuccaaacaggagagucgcuucagagaggagcuggcguguguguucagagcccaggagugugagcccugccagguggcucuucccggccugggccacgcuggguaggauggccacccaggcaccggcuuccugggacccugguggucuuggagugagugagugagcaaggccuuguccugaggagaaagaccucaacuccccugaaggagggcugggccuggggacagggacaugagcauuguagggccugggggguuccagagguaaggagaugggagugggagggucaggagaugagacugggagggucagauccagaauguuccacggaggcuucagggccucugggucuggagaaauacguucgcuagaaaaauaagaggcuuugagaaugucugcagucuguacucucugccugcccaagagaaaucuacccuguuggccaaagggcagcggggagggagcaaaggcuggaggccagaaguggguuuggcccuuggggaagauuccagaggggagcgaggugggcggcagacuuugguuucuuggguccccuuucuugcaguugcagaggcugaggaggcccccaccucccugccccuugaggggggggcugccgugugggaaguuggcaucugucacgggcuugugggugcccgggcccugggcccucagaacaggacgcucaggggguagagggccagcgcgagcagcagggggccugcagcaaggcugccugccgagcuggcaggagcacaguggccgagguuggccccgaugcaggcugcauacgccaucacgugggggacguaguucugcucguggacgccgugcagcaggugcgccauggggcccuuggagaagacggccacguccuccccgccgugggucucguggcgcaggggcacagcagacugcgccugguaguuguugugagcugugggccaggggaaacaccugcugagagccugccaggggccuggcgcugcgcacgcagcuuuuccaucucccuuccaggcuggcuugaaugcucccauuucacagaagaggaaaaggaggcucaaugugggaaagucauuuugccuaaggccacgggauuugaaccugagccuguucugacacaggagucugcauucucaacccccaacagagaaaauuaaccucauuugggcugcuuggauuagcagggagaguugacggggagacucuuaccauugcugcaucuuuagacccccuagaaccacugggaguaucaagaacgaaugaaugauaugggaugggaugaacuaacugcaaagucucguauacuggaauauuauagggccaagaaaaaugaguauaaaauauugagcaccuacuugugccaggcacuaugcuaagcucaucagacccauuuggucauucagacaaccgucaaagguagaacccuuuuagagaggaaacugaagcagagaaagaugaagucacaugcccaaagucucagagcugcuagauuguagaaggcgauucaaacugagguuguuugaaucaaacaaccugggacucaacaaucaaacugggacucaagccccagucauucugagaccccugaccuugaccacaagcugacacccuauucccaagcccauccccgaggggugcccuguccccucccagcccuggguccuggaggucucaccauaguccaccauggagacauucucucguucaccgcccaccaccuuguagccaggcccauugccauacaggauggcagugaagggcuucuugucugugucacucagcaugggggccagaccugcacagggaggggguguucaggggucaugcuggggccccaggaguacaguccccagcccccagauuaggcuccuugguggcuugguaaccccugggaucuucuuugaagggcccugcaaugccuccaagaagccaccuucuaaaccuuauuauuuccaacuaaccauuccccaguuuucauuguacccaugucccucccauucauccauccacccauccauccauccauccacccauccauccauccacccauccauccauccaucauccauccauccauccauccauccauccauccaucauccauccaucauccagccagccauccucucucauucaucuauccacguucucgcccagccauggucaacguggccauccauccacccaccugccugucuacccgaccaccacucaacucacuccccugccucacccugcauuuucuccccauccccaguaacucuuccuccccacccaguugucauugaguccccaccaugcucugggcuugcuggcucucccacccacuccugcucccagguggguagacaggagaccccaggaguguccaccccaaagaaggcccaccuaccaaagauagaguugccacgggggguguauccaccaaaugugaagacgugggaaugguccgcagugaccacggucagagugucuuccgaggaggucaagcugccugccugcccgauggcccgguccaucuccaccgccucaugcagggccugcuuggcuuuuccuucauggugcccguggucaauucugccuccuugggacaccaaggcaaaggccucggugagggaggaggggaggaagaucugcuccccagccccacaacacugcugcuggauuaaccuuuguuagcuagggaaggacaggaaccuucgccgggcaccacucugagcuagcaccacagccuaggcauuuuacgcagccauucaaccugacggaggccagagagggacagccccggugccaaaggcacaugcaugggggcugcaaaguccagauguguaaucaaauucaccaggccgggaagcuguacuccucccaccgccccucccagcacugucucuagcugcuugaaggaggcacugaagccuuugggagguagggaagggggcacgcuggaaucccuacaaugugccaggcacgacacacccaugucucuuuuccccugaacagcaaugcugggcagagaggaauaugaucaguccuguuuacagauggagcaacugaggccuaguguggggaagcccacggugggauuugccaggaugugaauucaggugugacucguccuaaccccguuuuucaucucuaccucaaaucauccccucuaaaaagaaagcacggagcucccagagguagugaaaguccccagugccugggcagugccuguggcagguuccacaaagcccugccgaagccugaacccucgcagccuccgcccccgcuucccaccuccgggugagugcaggggccuggcuggaggcuuggcccagcagccgagggcucugugaccuuaaaggaacacuucccuugcuaacaggagggcgcugccugguggacacucccagcuuggaggguccugggcgccaggcagcccucuguucccaccagucugagccucgcgguggcccggcaggcuggcagggcguguccucccuuuguuguggcucugggagcagcuagccugggcggcccauccuggccuugcucacaaaggaaaccgcucccgggggagcccgugcucaccaccgcugguuucuggcuggcuccuuggcgucagaggccuguucggggccaggccaagaccgcugugcucgagugggaaccccgggguuuggcaagaaagcagccaagcugggcuggcggacgcucaccucuggaaggcggaggcgcugagcauguguguaugcguggggagcauaugugcaaacauguucacgugugugcauguguguguauacauaccgauguuagcagggcaacaugaggaacugcggugggcaagggcuguuagcacuggaagguuucuggaaucuuuaucacuuccucacacuuccuauuguucccgccuuaacuauuguguagccauaacaaggcuaauaauagaaacacgguuuauucuuuacugggccccguuccaaguacuuuaugucucugaacacaauggaggcgaaucacucuccaggagacagaugcuauuuuuggcuucacauaacagaagugcacagguagaggucacaccgccagcagauggcagcgccaggccaagaauucaggucugucugcaaggccccuggccggcgcugaaagagccugggaacaucagcacacagcgugggaaagccggggccugcggauuugcuuuucugggcagugaggcugaggggcugcuugccccuucagggccagguccccaagaaagacuaccaaaggggagaaaucugccuccucucccaggaagccuuccuggauugcugaaccuaacuugcaucuccaugcccaaaggagagcagcuugcugggcugggagugucuacagugccacccgucuccuuccacaaccuauucuccuaaagggaccucucccuucacccccaaaccagucaguucccuuuaagagcuggacuucuccauccugacaccagggccguguuuccagcagcccccucucagcagacccggggucccuaccuuccaccagcaagaagaagccuuugggguucuuccgcaggaucuggauggccaccaccaccaucucggagagugacggguccgucacguuguuccuguucagcucguacugcauguccccuggcucgaagagaccugaggaggacgccaggaggauguggaugcugagaggcugugacccggcuaggaggacuccaaggaagcuggggugucucagggaaugcaggcuccccacagccagcuugggguagaguaugguggcugggaggauccuuaucugggugauuuuugugggcccagaauuaggcccccaauuccuuuuuuuuucuuuuuucuuuuucuuuucuuuucuuuuuuuuuuuugagacagagucucacucuguuguccaggcuggagugcaguggugcgaucucggcucccugcaaccucugccucccggguucaagugauucuccugccuuagccuccugaauagcugggauuacagacaugcaucaccacacccagcuaauuuuuguuguauuuuaaguagagacaggguuucaccauguuagccaggcuggucucgaacuccugaccucaggucauccgcccaccucggccucccaaaguguugggauuacaggcgugagccuccgcacccagccccaauuccuuucauuuucauucccaccacuauggcgcggugggaucaccaugcccguuucacagaugaggagcacugaggcccagagguguuccauaacuugcuauugucagcugagaaguggcagaucugggguucaaauccaucagucagucugccuccagccugcagggcucagcacacagcacuguggccccaaggcagagggucacagccuggacucgauggggccgcuagagugugugugcauuuacauguuggauuugaagggcacgguggccugugcagcgaaacagcagaagguuuggaaucauugucccuccugcucacugggcuccguuuucucacuugugacauaaggagaaugauccauuccuugcccauggcacaaaguuccaugugucccaugcuggugcuucugauucugguguccuuccaauucugguguccuuccagaacacccugccccucugugaguggguacacagccgaacaauagcucccaugcacacaggguucacuuggugccacaugcuguuagcgcuuuggaagcaggcaaaagccagccuccaagauggugcccaauaaccccugcccccuggaauucacgcgcuuguguggucuccucccacacuagccuuuguaugccauagaaugccaccgaaaugauggugugugauuucgaaggcuggggcauaaaauguuguagcuucuguuuauauacucuuggaucucugugggaagccagccaccauguaaugaggacacucaagcugcucuauagagagcaaugugccaaggaacugaggccuccugccaacagccaagaccaacucgccagccaugugagugaaccauccuggaagcaccagccccagucaagccuucagaugacugugaccucaugggagacccagcuaagcuguccccagauuccugacccaaagaaauugagugaggcaauaaauguuuacucuuguuuuaaacuguuaaguuuuguuuugugacagggucucacucuguugcccaaacuggugcaguggcaugaucauagcucacugcagccucaaacucuugggcucaagcaagccucccacgucagcuuccugaguggcuggcaccaccacaccuggcuaauguuuucuuucuuucuuuuuuuuaagauagggucuugcucugucacccaggcuggagugcaguggcauaaucacaacucacugcagccucaaccuccugggcucagguggauccuccuaccucagccuccugaguagcugggacuaaaggugugcgccaccacaccuggccaguuuuuaaaaaauuuuuguagaauugaggucucgcuauguuucccaggcuggucucaaacuccugggcucaagugaucaaccugccuuggccucccaaagugcuaggauuacaggcgcgagccauugcaccuggccuaaguuuuuucguguuuguucuuuguuuuuuguuuuuagacggagucuugcucugucacccaggcuggagugcaguggugcgaucuuggcucacuguaaccuccgccucccggguucauaccauucuccugccucagccuccugaguagcugggacuacaggcgcccgccaccacgccaggcuaauuuuuuguauuuuuaguagagaugggguuucaccucguuagccaggauggucucaaucuccugaccuugugcuccgcccaccucggccucccaaagugcugggauuacaggcaugagccacugcacccggccugcaccuggccuaaguuuugagauaauuuguuauacagcaacagauaacuuauacaacacaaguucaugucaugcucaugacaacccagggguugucuccagccccaucacuaucuccauuuuaugggagcaucauuaucccuacuuuauagaagaggaaacugaggcagaaagaggagaaaucacuugcccaaggucacacagcuuagaggugguagagcuggauuugaacccagcacucuggcucuaagauccaugagcaaaaccagcaugauacacgggugcaugcacagcccaugugguacugggugugugccaugugacccaggcaagcaagaggcugugugcaugugucuggaggacccaccaggugcacagcucugagcccauaaccucuaaugacacccaggacgcggagcuguguuccuugggaaaugucugcaggagauuuugccaccacuugcuuggcacuacagacagcuggaaaagaaaacccggauagcugcaugguggugcucagggcugcaucccaccagaccugaagcugccccugggcccucaccacaugcuccccacugccuggggaggagggcaaucgucaggaugggcagagauaacuuggcuggcuucugcccuggccaugcacacaguagagcugacuccaggucccaggcuccauagcccaggagcuguuaagucccaguucccagccagggcucaaacuugccugggccguaccgcugucacuugugccacaugccgcgggccacuccccucucugagcuucaguuucuucuugugcccaaugaggcuaaucccccugcacagccagcagauuucaggccuaauuccaggaaccagaacccccuuccuugccucucccagguccugaagcccaagagcagaggccccuaagugggcgucaggcuagggccuuguccccaggugcuggccacacgcagcuccggccaccaggcuccgagccaugcauccuccccuccacccccuccacuuacccaauagguaguccacauugugggggucaagggucaggaguuccgugcgguuccagaugaagugggagugcuaggaggaagggcugugucagcacaugccgggggcuagggagagucggaaggacugaccccagcagcuaucagagucugaggccuuuacuuguuuccuucccucacuuaaaaaucucucccugaggacccaccaucccugaccucaagaaaugaugaaucaauagcccauuauaauguauaaugcaaggggaugagaauucugauagagcccagggaggccgugagcccagacacaggaccagggagggcuuccugguggaggugauguucuaaugggucccuggaggacaagugggaauugaacagccuagggucaggaaggcuauuccagggaggagggaucauggggcaaagaagagccaggcacaggucuccaggggccuugagugcugacaggugugggcuguuuucuggaggccguggagggccagggaggaagcaaagccccagcucugcuuuggggaccccaucugggaggggagauaaaggcguggcuguuuccccagggaauaaaguccacagaaagaagccagcuaggccaggccuggagagggcaccaugugggccuggaccaggggucccagcacuaccaaggaucugcugugugcccuuagaagacccccugccuucucuuagcaaugacagugggaucaguggcuuugcaagccucaggggcuguuguggggaggagggcagagaggcucagaaaguggggcuccgcacccccccucccagccccugcuuccuggagguggcucuccugugcucucucccuccaggguuguuccuguuauucccucuuuacagaugagggcaccgaggcacacagaccacguagccacugaaugguaaaggugaaacugacucuaaaacccacucuuaaggcaugauuuucuagggauguggggccuacacgggaccugauacccaauguggccaggcucggggccaugguguagacgcucucuccccgucuuagaggucuagaccgaguuccuggguaagcacccugccugggcaaggaggaugaagcucuggccccaugugccacguagagaaacugaggcuggugucucucuggcuugagcuuggagggggcucuggcccagccugagcugacucagaagggauggaaaggguucaaagccacucaguuccacacccccaccauccccacgggggcccuucccuagucccuacccccaccucguucuuggcccagccucaucccacgaggccuccccaggggccaguccuggaacuugcagaaacccaaccccagagugacaucaaaguggcugccaggcuacuccccacugucuucagcccugaccacagucauuuccagaccccagcugccccaggcccgcaggccagcagcucagauuuaaagggccagaggccacuccaaggagcuggagcuugggguccuuccagaggucccuccagccucccuuccccaaucuauuccguccuccagccucccuuccccaaucuauuccaucccccagccaagggggacucacuguggagggcuucuccgcucccuccauggcuugcacacuggggccaaccauguccuccccugauccauccagcgcugccuccucccuccauccuccuacuugcccagagcuucuuggcuccucccugucaucuguccccccagggcgccugcagagccaggcgucccccaugcaggcacacagcauuccauguuuccuuggccaucugacucagccucugugccucacgcaugccccgccaggugccuacauacaauaggugcucagggugacucaauguccacgcagguuauucccuggcccagccuccuccucaccauccgccucucucugguauccccuccaagggaaggaaaugauuagucacugacuaucuacugcuuguauaucucuuaggccauuugagcccauggaggaaagauuuccgaugcccuuucuacagaggacaacagaacuucagagcaggggucacacagccucuccccaucacaggccaccucugcagccacauggccccagcacaggcuaccuuguaucucgguuugaagcucuuccaggugucaacgagguccaggccguccagccucgugccccuggcuuucucgucacucucauacuccacaucaguuuuauucuugggguacauguauuuccggccaccccccaugaucaccuaaaagagacaggagccaucacuucugcaggguuccaagaugcccagaagccccagugaccucggcuuggaaccuggacuccuggagucccuggagaugguguggacacuuucccagccuggugagccaggccucagucaucucugggccuuacuuguccagcguggggagaugaaaucacgagucuauugggacggugguuuggcgcuucuagggauauuggaggagcugauaacuuaccuuacuuggcuucccggaauccacagaacucccacucgaauaagaaucagaccauuuacagagcguucccugugugucaggcacuaagcauuuaagauacauucugacucaacuucauaccaaggcugcaauaaacccuggccaccuguuuuccaacuaaaaaaaugggcacagaaauugguuuuuucccccgaaggccacagagccaggaaguggcagcaucaggauucaaacccagggcuuuuccggcuguggcacuagggcccugcuguauucgugcagcuaagggcagggacucccagagccuccucucccacgguggaaggcugaaugcgugcagggagaggcuccagccagggaggucuuuggggcagcccacagcugggagccagcccaccgcagccugggcaaacagcggggccgggccucacggcucuguagucaccaccaggcuaauuuuacccaccagcuggugugugcgggcagacggacgcgggacuguuuguuuuccuugggaguccauguuugaaguucugacuauuuuuaaaguagggccaagagcauaacagcagccgccugcggugaccaccacacuaguguucucuugucaccgcgggugccagcccgggccacugccccuggcugacaccuugggagugcagagccuggcugacacuggccccagauccaccauuccaggccugcaucucauaggucccuugcucuauccuccacucugucucccaccuuagauccuagguuuuguggaaugcacagggggccaggaacacaggauggcuggagaggugggaaaggugccccaggaccagccuggguccaggccauggucauggccgugagcuuugaagucagacuuggguuugaacccugacucuaucgacuacugaccaagggccugccaccuaaacucugugagcccaguuuuccuauccauaaaaugcgacuggccaggcgcgguggcucaugccuguaaucccagcacuuugggaggcugaggcgggaggaucacuugaugccaggaguuugagaccagccuggacaacauggcaagacccugucuauacaaauaaaauuuguuucgaaacuuagccgggcauggugguacaggcuugugcuccuagcuauucaagggacugagccaggaggagcacuugagcccaggaggcugagacugaagugagccaugaucacgccacugcacuccagccugggcaacagagugagacccugucucaaaaauaaaauaaaauaggccgggcgcgauggcucacgccuauaaugccagcacuuugggaggccaaaacgggcggaucaccugagguccagaguuugagaccagccuggccaacauggcgaaaccccgucucuacuaaaaauuuaaaaaaaaaaaauuagccgggcguggugaugugcgccuauaaucccagcuacucaggaggcugaggcaggacaaucgcuugaacccgggaggugaaggcugcagugagccaagaucgcaccacuacacuccagccuuagagacagaaugagacuccgucucaaaauaauaauaauaaauaaaaugcaacuaacauccauccacagacccaucacaggaggaaaggcagucacccagggaaguccccagcacccaggggguggcugccacuggaaggcauuucuauugccagaaggaguggggaaacaagugguucagagaggcagaguccuugcucucagcugcagccaggagcucagggggcagggugggcugggagaagaaggagaaggggaccccaggucacgggucccuugccccgccccccacaacuguucccacagaaccugaccucuuggcaucuucagaguggaaaacgaagcccccaaucuuccugcagggagccucaucguuuccagcccggcagcgacuucacacgggcucauuaaacucccaaauaacagacuugcuguuuggcuuugggguuuagguuugugucuuucuuucuuucuuucucuucuuucuuuuuuuuuuuuaagcaacaguauuuauuuucaggguggacaccaggauuuuuguuucauguacagucuggggacugggaggcuuuuggggggguggugacggagaggcagguggggcugggagagaaaggaagaggaggaaagaaagggauccucacacagguccuccguccucacucacucccuggcuugugccccuugacguggccccugcggcccccccuccucaucucccacccccucaccugaaacaucuucccuccccucgaauuuccuucaaguuccuguccccugcucaggcugucccugacaaaccccucugaggagcaguccccauguaauuauacccugugccuguacaacaaauguucucacauccaugaccucaucacggccucccacggcccugggagcaagcaaguguggcucucuguuucugcugcacagguggggaaacugaggcauagggaggggaaggaacucgccccaggccacaugucgggugaaggcaagccaggaugaguggcuuggccucagaugucuguucagugaaaggggccaacagcacuguguguccugaaagcggguacuuaauccaccaugcugggaaaagggcagacgugggucucuacuguggaggggccaaguagcccccagaaauuuguggggggcagugcauggagggcugaaggcaggugaguuugucuggugguggagagaaagaggugagguguagcugggcaggggggcuuucucugccccucaccgaauccccauuccaggcucaaggggcagaaguccccagaucgccucagcagucccccacaguaggcaauaaaagccugaaaaggaacgagccgggcauucucacuuaagaacagagaguaagcgucacauggaugacuucugucuccaugagucagcucaguuuguugaaguguguuucagggcaaggacauguggcuccugcguaagugccaccaccuucugggcacucgcuaggccucggguccugugcugagcuccacagggauuaucuuaaucaguucuuggcauaagcuuaugaggcagguacaguucacaaaggaguugugaaagggaagccucagagagguuaaguaacugacccaaggucacacagcuagcaacacgcagggcaaggucuggaacucggaaguuuaaacacgagagcuggcacuagccaaccacuguacacaccagcucuuugccgggcaugcuggugguugaguguacagauauguacccaucugugaccaugugaauacgcagggcaggcagacgacacuuggccaucaccaccucccguguaguggggggcagaggagggcacagcaccagguuucaauuuauggaaucaucccuggaugccugguucuuggggugugguggcggucacaugaggguucaccccgcagccccaccgcagagaaaucccacagugccugccugcccaaccgcaaauccccuaaugggcugggagccucccagguguguggggagccaggccaggcugcuuucuccgggccagccugggccugaggccuccugcccaccagaggccccgccucaccccgucccugcccggcugcccccgagcacucacgucaaugucccugauguuaugcaugagcugguaggcgauguccuuacagcccuggcucaaggccucagggggcaucucguugucugaguaccagucccggucagccgagugggcguaggcggcgcuggggguggcaugguucacucucgugguggucacaaugcccacagauuucccuggggugcaggaggggcggguuuggcuuuauccacagaucggggugucccagaggccuccucccucccuucccccuccccgcuaaagacaggcccccgcuucaguucugaggauugcccgggucucagucuccccauccacagcagcaggugucuggcaguggcuuccaaguagccgagcagccagaacacugccucuggaacccucuccccucaccccgaaggcccuugagaugugagcaccugggcuggaguccuccccuucaucaaggcgcccacaggaccccugagggaucucaaguggacuguggcucugucaccuguauguuggccuugucaccuguguuuuggccuuggccccugacuaaagcuucugggggcacaggcugggccucccaauucugaggagggaaggggcguggccauggacugcaccccacaggcuagcccugggcugacuucucccuccucacaccaacccuaugagggggcuacguucccacccguuuuauagucaaaugaagaaucgacucagagaaaugaacugggaccagaacccaccacugagugaaccccaaacccucagcuuccccugucacggaaggaaucccauggauauuacagacucccagcauaucagagcugggagccccacagagaagccuuuucuagccccuucccaugacacagucagaaagacugaggccuggacaggccacgaagcuggcccugcuccccacugcucccccgacucaccagcguccuuggcccagcgcaggauggaggugaccucguuccccugggugguguugcaccgggaacgcucaguggcugcgcuuacccccacggugcccucauuggccuucaccccacacagguaggcgguggcggugccggcacugucagggaccugggcauugguguuguacgucugcaggugggagaggagggucaggagauggccaggccuucgccccaguggcacccaccccgccuacacucacaccauggggacuggggcgugagggaccagagaggaccccauagccuugaccaggcccacugcccacugaagccccccagagccacaggacuaccuagcugccugcuuccugccaucauucccugcacccuggcagcacuggggcaggaccuuagcucuccaaaguacagagaaguguccggcggaagauuggggcucagguggggucagcggaggccucucuccgggccuggggcugcaggagccagcaagggguuggggagcaggggaguccuggagaagggagagggaggggccuucuugaaggaguggggggucuggggauaggguagugaaagugagggggaaggggacuggggaagggaaggguggggccaagaccagcgcugacuucucugccaccugcccugcggccaccaucacaggguugcccuacauccggauguuuagcagagaccccaaaacuauuugccugucucccuuccccaccagccugagagcaccuugaaggcacagaaggcaccauaguccccacuacucccccagaagugagccuggggccugacccagggucuggagguuauuacauaacaccacuaucaccaccaccaauagcaauagcuacccggcagugcacacugccuugaacaaccuaggucaguacaggcacaccucauuuuaguguacuccacagacacuguguuuguuacaaauugaagaucuguggcaacccugugucaagcaagucuaucagcaucauuuuuuccaaaaacaugagcucacuucauuagcguuuuuuagcaauagcauauuuuuaaauuaagguauauacauuuuuuuagacauaaugcuaucccacacuuaaaagacuacuguagggugcaaacauaacuuuuauaugcacugggaaaccaaaaaaugugugacuugcuucauugcaauauuugcuuuauuacaguggccuggaaccaaacccgaaguauagcugagguaugccuauagucuaauuaacuucacgaacugccucgggaaagaaugaaugaacuggaacuucaugcaaaaguguauacaggccaggcacgguggcucaugccuguaauccuagcacuuugggaggccaaggugggcagaucaccuggggucaggaguucgagaccagccuggccaacagggugaaaccuugucucuacuaaaaauaaaaaaauuagcugggcaugguggcgcaugccuguaaucccagcuacuugggaggcugaggcagaagaaucacuugaacucgggaggcagagguugcagugagcugaugucaugcuacuguacuccagccuggaagacagaguaagacugucucaaaaaaaaaaaaaaaaaaaaggcauauauaggccgugcaugguggcucacgccuguaaucccaagacugggaggccaaggcuguaggaucgcuuaagcccaagaauuagagaccuugggggggucucuaauuauccauauguggugguacacaccuguagucccagcuacucgggaggcuaacgugggaggauggcuugagcccaggaguuggaggcugcagugagcuaugacugcaccacugcacugcagccugggcaacagagcaagacccucucucuaaacacacacccgcaagcagguacagugaugcuauggugucagaagucagggcaguggcugcuccagguggggagugggcuugggcauggagggggcucagggggucaggggaccucuggcugcugucauguucagaugcucgaccuggauacuggauauacagaccugaacugggcuuggggauggggcucaccuuggagagggccacgaaggggaacuuguccaucuccagccuggucuccuccccaggguugugguggagcugacccuugaggaugcgggcagccgucacuguggagacacccaucccugcaguggggagugggggccucagucucucgugcuccugccucuccaaucagccugcuuggguacccagaagcucucuaguucgguaccaaggcaggcucgggcaguuggcacugggcauggcucuguaaaugucagugagcagccccucucucccuucacccccagauccucagggggcugucuggcagagcaggccucuugaauccacagccuggccccucauccuuuuaaacacccuuccuccagagcccuagccccuucaacacagcccccuucaacucagccuggcucccggggcuccuagcuagguguccuguuccaccccucccacaggccccugggccucaccaucucccaggaacaugaugacauucuuagccacguugguguugagcuucugaagcuccagggcauauuucagugucucuugcgcuuggucucgccaguacuuggggucuuucucuuucucuaaacacagagagaggcaguuacuuggcgggguaaggauagccuccuaucuccagacguacagauccccccacuucugauugcucaggcuggaaugccugaacuuggaggugggugcaauaguugcccacccagacaacacaucugugguuuauaaauaugugccauccagauccuccagaaaagccuguggacccuggggucuucuccucacaucucagaaugaagaaaccaaggcucagagacaacgagcaacuugccuaaggccacacagcacaggcagacacuggcagggcuggguuucgcuccaaagcccaugcucauuccuucuacccaguagggagaugagcugcuaaggcagcaaaugaauugugcuagcacaauuaagagaguaauguuuaaccuauucaacaaacuccuuccagcagaagggguccccugauauagccagccaucaauuaucaacucugcuuagcuuauucauuaaaguaggcucagcaggaaccugacuugguuuaauagcagugcuggaaagcgaagcuugccuuuugcuuaauaugucaaauuuaaaggagccaggugaucucacucuuguuaggauuaguuaucaaggacgacauucugcaucucucaucgcccccuccaucccucuuggcugauagugacuucuggcuggggcuuuaugguuuugagauaaaaugagaacuaagaacacuucuuucucucucccucuuucucauguguguguguguccagcaaccaauccacagcuuuagugccagacagaccucaauuaaaaccccagcugcugggcaugguggcucaugccuguaaucccagcacuuuggaaggccgaggcaggcagaucaccugagcucaggaguucgcgaccaacuugggcaacacggugauaucccgucucuacugaaauaugaaaaauuagcugggcguggcagugugcaccuguagucccagcuacucaggaggcugaggcaggagaacugcuugaacccgggaggcggagguugcagugagcugagaucauaccacugcacuccagccugggugacagagcuagacuccgucucaaaaacaaacaaacaaaaaacccccagcugcuccaaguacuagcucugucaccucccucagccucagucucuuccccuguuaaaugacauugcuggcaucauccccucagggucgcucuaaggacugggccggauaaggcaagugacacaccugacccacaggagaggcucaaaaguugccucccauccccauuaucccgucuccagggcuggaccaggacccuggcuaugggagcuggagucccucccagagucugcggggcuccccucugucccagggcccuaucagaucugcucagaagccuagagaggaggcucccuagcgguuuccucuuucaaggccucccacugcacagaacgggaggagagaucaggaaugggagggucuuguccaaggccguguagcauguucgugggcuggggacacaauucucaucuuuuggcccagcuccgacgcgugccuggcucucggaguggccguggguaaagaacagcccuccuuccucacacacgcacuggcucugggcgagaugccagggaccccccacacagcuucucuuauuccucucaacugccuuggcaggugggcaccagugucuccuccacauuaggaaauggagagccugagauuagggccccaagugggagaaccggaaacucacgcgucgccguggcucugccccagccuagcauaggcgcagagcacaggcgaggagccgccagggugcugcagugcaccucuagcuuuggacccaagcacaccccacgccccuccccaagaggccuccccuuacgucaccaccaccccaaucccucagcccacuacccucaucccgacagccccagguccacccucucucuucuggaagugucugcugagggcaucaauuucagauguccccacgcaguccccacugggaauugggagcaccuuggcccuucugcccgacagggugccuuuggacaagaguuucugccccaggaaaugggacacccguagcuauccacaggcaguucuaggaugacaugagauaaagucugggcaaggccggggccagagguuuuccucagaggucccccaggcccaggcugguuccagccucccuccugccuuccucaaaacacaccacggugcuguuggucauagagccucuuuggccaguugggugccacuggguggugaagaccuucuacccacccugacccgcuacaaccuguaccugacuuaacagcuuggaggucccagggcugggcugacaucagcccgccccacaccuguugcccuuguucagcccagccucugccaccggguccccugcuccguugagugcuuguucucucuagacuggagucccacaagggcagaguccuugucuuuuucaccagagccacccagggccugucccugagaaggguuuggagucugguuuaagcaacaauggcucuggacaacuggauuccaagaggcuauuguuuuuggagacuacuaaaugauaugugcuaaugcucacgauagaaugccagggaaagggcacugaucgguacauacuauaugauuccauuuauaugaggcucaaaacaggcaaagcaagucucugguggccaauguaagccugggcaucuccucuggcuuugggaggggguuggcacagggaagcccacagaugccucacaaccagaaauguucugucuugaucuggguggcgguuacauggguauaaauauaugucaaaauuuuuucaggcuauguauuuaagaucggugcccuuuucuguaaguuauaucuaauugaagaaaaaaaagaaggcugaagaaguggcucauccuguaaucccagcacuuuuggaggccauggugggaggacugcuugaggccaggaguuugaggcuacaguaagccaugauugugccacugcacuccagccuggcaacagcagauacaaaaaguugaacugcugaacguuugaagauuuuucauguugucacuuuuucaccuuuucccuuuucauccauuaguucaucuuucacccaggugggcuguaagugcugagaaggcagggaccccgucccagagugaccuuggucccccagggaugcaaauggcaccacgaggucucagacgcagcaauggccugagagcucagcagcucaggcucagugccccacugcaccccaucuccucaucugcugaaauacagccguccuaagagaagagaccaacauucacugagcauccacuccuugccagacacugugacuaucccaugugauucccaugaugacccuaagcgggaggaacucauccccacuggacagauggagacacuggaguguggggaaggcaaguggggacuucuagccacauaauggacugagccgaggaaggcucucuucuccagcuccagauacagaaaugcuggggaaaaaaaaauagcacauagcuugaaaaaggaagaaaagggggaaggaaaauccucaggaggcagcauugaugagggaaucuaaaaccagaggggcccacaggagcugaugcagagaggaacgccugcgacggcaagccagguacagguucaggcugaagcugguuucuuuucuuuuuugagauggagucuugcucuguugcccaggcugaaguacaguggcgcaaucucagcucacugcaaccuccgccuccuggguucaagugauucuccugccucagccucccaaguagcuggcauuacaggagugcgccaccaugcccagcuaauuuuuguauuuuuaguagagaggaguuuuugccauguuggauaggcuggucucaaacuccugaccucaagugauccaccuaccucggccucccaaagugcugggauuacaggcgugagccaccauucccggccagaagcugguuucuuuuuaugagacagagucuuacucugucacccagacuggagugguuugauuauagcucaccguaaucuugaaauccugggcucaagugauucucccaccuuagccucccaaguagcuaggacuacaagcaugcagcacuaugcccagcuaauuguuuguuuguuucuagagauggaggucucacuauguugcccaggcuguccucaaacuccuggacucaagcgauccucccaccucagccucccaacgcacugggauuacaggcgugagccaccauaccaggccugcuaaagccaccacaccaggucugcugaagcuguuuuaagguacacauuuugccuuggagcuauggaagggauagagaaagacagucauucauaagaaaugugaauucaagucaaaucugagccaggucuaaguggggaucugaauuuauaguauaagaauuguaaaccaagaaaucaacauaaaaacuggccuagaauuaguugaaccccuaguguccugaaaacaccaugccaugcuguggaaacacuuccgcgugaaucuccaacagaaaaacaaaaaacucggccgggugcgguggcucaugccuguaaucccagcacuuuaggaggccaaggcaggcggaucaccugaggucaggagaucgagaccauccuggcuaacauggugaaaccccgucucuacuaaaaguacaaaaaaauuagcugcgcgugguggcgggcaccuguagucccagcuacuugggaggcugaggcaggagaauggcgugaacccgggagauggagcuugcagugagccaagauugcgccacugcacuccagccugggcgacagagagagacacugucucaaaaaaaagaaaaacaaaaaacuccuguugaagaugaguucacuagugagaacuacaaaugacaagaaaaaggcugggcacaguggcucacaccuguaaucccagcacuuugggaggccaaggcggguggaucacuugaggucaggaguucgagaucagccuggccaacaugaugaaaccccgucucuaauaagaauacaaaaaauuagccggguguugcggcgcacgccuguaaucccagcuacucaggaggcugaggcaggaggaucacuugaaccuggguggcgaagguugcagugagcugagaucacgucacugcacuccauccugggcaaacagagugagagucugucucugucucaaaaagaaagugucaggcgucugagcccaagcuaagccaucauauccccugugaccugcacauauacauccagacggccugaaguaacugaagaaucacaaaagaagugaaauuuaaauggucuguuccuaccuuaacugaugacauuccaccacaaaagaagugaaaauggccgguccuugccuuaacugacgacauuaccuugugaaauuccuucuccuggcucauccuggcucaaaaagcucccccacugagcaccuugugacccccacuccugcccgccagagaaccccccuuugacuguaauuuuuccuuuaccuaccccuaucuuauaaaacggccccacccauaucucccuuggcugacucucuuuuuggacuuagcccgccugcacccaggugaaauaaacagccuuguugcucacucaaagccuguuugguggucucuucacucggaugcgagagaaaagaaaggaaagaaaggaaagaaaaagaaaagaaagaaagaaagaaagaaaagagaaagaaagaaagaaagaaaaagaaagaaagagagaaagaaagaaagaaagaaagaaagaaagaaagaaagaaagaaagaaagaaagaaagacagacagacagacagacagacagacaggccaggcgcgguggcucacgccuguaaucccagcacuuugggaggccgaggcaggcggaucaugaggucaggagaucgagaccauccuggcuaacacggugaaaccccaucucuacuaaaaauacaaaaaauuagccuggcgcgguggcgggcaccuguagucccagcuacuugggaggcugaggcaggagaauggcgugaacccaggaggcagagcuugcagugagccaagauggcgccacugcacucuagcuugggcaacagagcgaaacccugucucaaaaaaaaaaaaauuaagaaagaauauauauaauauauaugaaauauauauauggaaaaauauauauaugaaauauauauauggaaaaauauauauguggaaaauauauauuuccuuguauauauauauuuuccuuguauauauauauuucauauauguguauguguguauauauauauauaugggaaaagagugaccuauccaacuaacacaugcaaguagcagggcugagguuuccugcucugaacacuguuuucagcucuuaaauacuuuggaugguucugggaccuuaaaacauagacacugcccucaucauaccccaucugcaccaccuuuuuaugccuccaccuguguccccaagcauaccuggcacuaaggaguuaguaaggcaggugccaauggccaguacuaagaauggugaaaucauggugcaccccaagaccugcuuuaucccuggagcccagagaugcaaucgacgugggugggagggggugggcuggcaguggucagauguuaacugauguuccaauccuagaaauuaaaaaaagagaaaaagaggcauguggggcacagcucuagagauccuuuuucacucacuuauucauuccuugauucauucaacaaguauucggugagcaccuauuacagaccaggcauggggcucaacauugggaugccaaacccagcuggucccugucucaggaagcuuaaccacacaaacagcugugucagugucaaugaguuccaugcugcaaagcaguuccgucccauuuccuaagugaauuuccacuuucaauucaucugaagcccccuaccucccagaguccaaucuuuuggugcaguguuucucaaacuguaaggagagcaagcaucugaaucccccaagggcuuguuacaacagauucccggcccacuggugaggcuccgauuguauuucuaauaagcucccaggagaagcugcugcuuugcugcuuugcggaccacaccuugagaagcccuguucuacagcacucggucuucagccuuuuaauuaccugugucccaggaacaucagggacaaaacagagugcaccccuucuuucaggaccccuacauuugcuacauucucuucuagagcuugucguuuaugguaagagauauaaaaaugguaggagucacauaugugaaaaaacuggcugguaaguguggccauuucuggguggugacaucacagacaacugauuuuucuuuuccauugucuuuucugcauuuccaaaauuuucuuuugugcugagauacaguauuaucuuuacaauuuuuaaaaaauauauauauauuuaaagucggauguaauugaagaguuuagguggaaaaaaaaacuggaaggaaauacaccaaaacauuaacugugguuuucucugggugguaggacuaugaaugauuauuuccucuuuauuuuuuugaauuuuccaaguagccuaaaacaagcauguauuaauggcauaagaauguuuuuacacuguggucuuccuguuaaaucacaaagaacaaccccacuggcagcugagaaauguacuaacccuguugcacaugaguuacaagacaaagaauuuuaaguggcaagaguuucacugggaaauguuauugcuucagccaaaaccaagauaugacaccauuuguugugggaaacagcaguaauacacacucuaccguuagaaaaguguugugacagauaagacaccacucuaguccaauuauuauauguuaaguaaaaacaaaauaaaacauuuuuuaaaaguuguuuaaagaaaaaaagccaggcauggugguaacaugccuguaaucccagcuacuugggaagcugaggcuggaggaaguucgcuucaggccuggaguuggagaccagccugggcaacacagcgagacccugucucuaagaaaaauuuuuguauuuuaauuuuuuaaaaguuucuuuucuuuuuaaaaauucuucucuuugcagcuccagcucaaaggaaaaagauuuuuucuuuuucuuuuuuuuuuuuuugagacggaguuuuguucuuguugcccaggcuggagugcaauggcacaaccucggcucacugcaaccuccgccccccggguucaagcaauuuuccugccucagccucccgaguggcugggauuacaggcuugcgccaccaugcccggccaauuuuguauuuuuaguagagaugggguccauguuggucaggcuggucucgaacucccgaccucaggugaucugcccaccuuggccucccaaagugcugggauuacaggugugagcugccgcgcccauccaagauuuuuuuuuuuaauuuaaaaauagagaaaaagaaaaggagaaaaggaaggagggaggggaggggaggggagggaggaaagggaaggggaggaaagggaagggaagggaagggagaaaaagaaaccacuaccaccagaagaaggaucuugauucaaccuuaaaaacacgcaaauggccgggcgcgguggcucacgccuguaaucccagcacuuugggaggccgaggcgggcggaucacgaagucaggagaucgagaccauccuggcuaacacagugaaaccccgucucuacuaaaaauacaaaaaauuagccgggagagguagcgggcgccuguagucccagcuacucaggaggcugaggcaggagaauggcgugaacccgggaggcggagcuugcagugagccgagaucgcgccacugcacuccagccugggcgacagcgagacucugucucaaaaaaaaaaaaaaaaaaaaaaaaaaccacgcaagcugcgcuccagugccagaagugacggcucugggguaggggcuggggguagcggcgcagaguggaaauuaaaaggcaauaucccacaucuaacaucuaacaacacuuaacugugagugguagaauuuggaauuucagaugauuccuacauuuuuuuuuuuguucuacuuuacgguuuccaaauauuucuauagcaaauccuaaaaucagaaaaauguuauuaacugaauacgaaauacuaauucauuaaacuauuauuuaaaaucacuuaaaaaugaagucaccucuuucaggaaggcuccaggauggucacucacucauuccaauauaacaccacugagcuucaugccaccucaaacaucgcauguaccucucuuuuugaagguaauauaguucuuuccugggccaucucagcugccacaccgggaguuucuaagugugaggacuuugucuuguuugucucugcccuccuagugcuuggcauaguaaauauuuacaucaguugaaagccagugcccuaaggaagguuguggggggaagggaagagccauccaaaauuaucuucucugugugugcaggaaaguccaagaguucgugaagauguuuaacuaccggaagguccgcucgccguugguggagugcagacaggcacagcgcaugggaaaaccggcaggaucuaccgaagcugaucauccuaccuguacccugggacccguuucucuccagcagaaugugcacaucagcccuguuuauaauggcuucaaaacugccuccaucuacggcaggcuggauaauacauuguguguguucacaacacagaaaccaccacagacagcaaggagaauggaugauccacagcuccucacaacaacaugaaugaaucgcacaagguaagcuugagcaaaggaagcuaaacccaagagcacuuacagugugauuccgaugacagaaaguauaaaaacuaacccagggcguugggagacagaacggaggcuccacguggaggguacggaaacgggaacgggcugcuggggugcuggugcgguucgguuuaugauugaucugggugggugggugcugguuacacgguggguucagcugucaauguaugauacacacauuuuucucuacgugcauuuuauuucaauaaaauaaauacuacucuuugggagcuuacaugaacaaucuauaaaggauacugacaaaaugaaagcaagucuaugugcugcacuccauaguucauaaagaauuucaccaugauguuucacuaaucagcuaugcaguggacagaaaaggaccuaucaucuccuuuuacagaugagaaaaccaaggcucuggacggagacuugcccaagguuaccaacaggaaguugcagagcagaaaccugaccacagggcuccugauuccagaauuagcaaucagguuaccaucagucacccccuccagagggagggauuucuguugcccccaaguguaaaaugaguguucugacguuugacacauggauagauuuauguaaccaccaccgccaccgucaggacccagaacagcucugccaccccaaaaaucucucuugcguucuuuauaguuacacaauccccccaucccuaaaccuggcgaucccugaucuguccuccaccacuguguuuuugauagguaugguauuaaauccacagaucaaugugggaggguuuacgucuauaccacauggaguugcccagucaugaagacaccacgucucuccacucauucagucagaguucuucgguuuuaucagcacucuguagucuucagccuguagaucuuggauauguuuucuuagauuuauaccuacggguuccaucguguaaugguuagcauucuggacucugaauccagauuuauaccuaagaauuuugcuuuuuggggaacuauuguaaauggcaauguuucugagccauauacuaccgagccaagugcgauggcucacaccuguaaucccagcacuuugagaggcugaggcggguggaucccuuaaggucagguguuugagaccagccuggccaacauggugaaacucucucuacaaaaauuagcugggcaugguggugugcaccuguagucccagcuaccugagaggcugaggcaggagaaucacuugaacccaggaagcagaguuugcagugagcugagaucgcaucacugcaguccagccugggcaacagagugagacuccaucucagaaaaaaaaaaaaaagaaaaagaaaaaagcauucagccuuucggcguuugggguggucuuuugaggcgugagguggagacaaucaggaacuuguuuuuggauauguugaguuggagaugucuuuuagaaguggagacacuaaggaggcagcugaauauuuggcucuggcauuugaaaaagaagucuggguuagaguauaaauuugggaaucauaggcacagggguggcaguuaacacccugaucaaacuugacgugcucaccuagggagagggaauggggucacagaaaacgaugugacagaagcccucagcaaaccagguauugaaaagaauuuccuuaaucugauaaaggcuuuaugccaagaaccugcagaaaccaucauacucgcuggagaaagcuuuggcaaacuccuuuuaacacuggcuuaugauggugaggagccggggcagucucguccacaacuagggaaaugaauuaguaaggagugguggaggcaaugucugcguggcagugguauuaaaacuagauguccaaacagcagcgugguggggucuaaaggcagaggacugagugaugaauguaaagaaucaaacgcaguguauguaagugcaaaccacccccacggacagaaugcuguguaacguacaaggacacuuacaacuccaaggccauauuaaguacauuagcauagggacuucggugagcugugggaauggcaguggggaggcagggagcagggacaaaggaaaaaaugaauaaacaaaacaagaacugagagcuuauuuggguaugucaugugcuaagugagauaacguaucccacucucucugcacugaggguccaaaacaggugagcgaauaaagaaaaauaaaaguguagugacccgggagcacugaaaggcucauccagccccacaugauuauucuuccgguuauuggucugucucuccucccugcuagccugaagcucugugaacguaaagaccaacaucuuacccaucucugcaucccgagcccuugcacaugguagcaguuccauaagugccaccaguucaggcugggaugcucugaauuuuggccccagggauaggcauugagauaggcuuggccuggaggcaggugccuucucccauagccuccgcucaggacaaggagaggguggggaccugggaaagccuucagaacccagagccucccugcuggccccaccccuaggaccccucccccucgcagaggcuccuggcugcucuguggcagcccuggaagcggaggggcccaguuuggggcugugggggccccggcugcccaccacccucugccaaugucugccagcuuaaaauggggccuccgggugugugucagccccaucgccacccccucccucccuucucugccaggcucccggcuccuccguagccugauuacgcauggccagugcagaagccccggcuaggcuguggcgccagaggagcagcuacuuggcaguucagugcagggggcugaggagccaggcaggccuuagcucugaggacugauucagcaacccaggcagagggcccgggagcauccuggaguggggcaaaaagccagccuugggcugggucucagaagaucuggggcaaaugauagaagaaugggacaaacgugucacuaccauuucuuaggcccucauguuccacucagccccaugcuguuuacaucccugaucucacaauauggaugaagagcccccguuuuguagcuuaggaaacccaacagaggguuuggcuagucuucgacuaugcgccauuuaagcccaggcugacgccagggcucaaccucuccgggccuugguuuccccaccaugaagaguaagagaaaugagugccccgcuugcuccaucucacgagaacaaauggaagcugaacgagcuuagggcagggaauuuggcgggaugcagggggagucaggccagcugaguuccccuaccugagcggccuggccaggcggcaagugaagaaacaaaggaggcccaggaucagccccaggaggaggaggcugagggccaccgugaggaccacauccaggaugggggacaggagggccaucuuggggcaaagagggccccugggagcagccaccacgcccugcacacacucggucacacuagcuccaaagcccugggucaguggccgugacccgcuuuaucccuggguuaaucuuuguggauuagucagaagggaugaaacggggugcuggggugggagggggagcaggcuacgaagcuccucucucccauuugagccccgggggagggcccgaugcuuguucauucaacuuuguucauucauuccucacucccaaacaccuacagagcaccugcugaguaucucugugcuagguucuauggaaacagucgggaacgggacagaguuucugucagcuuggagguaacugaccagccaguguggacaaagcaccuacuguaugcuagacauugugccaggugcccuguggggcaaaaacauggaagggaaccccuuggcuaguaacacaguagguuuuccccuaacagcagcagcuguuccagcccaucuaugggccuagaaaucugaguuggugcuuaccccagccagagggaugcacccaugcucagaagaagacgaacugcucuuauugagcaccaacuguguaccaggccccaucugggcuagggacuaguauccccauuugcagagaaacagaggcucagaggugcaaugguggaguugggauuuaagcccaaaucugggggucuccacggcccguaccucagaacugagauagcagcagccuacggaggcuuuagugaagcccugccaggcgcuggccuaaagccagcagucacccaggaggcagcacacacaggcuggagguggacgagcuguugccagcacggaggggccuuuucugcuuccaaaauugucuccccaacccagauccaaucucuccuaaaacauccugugaagucaggagagugguuaugauucccaucucacagauucagaaacggcccagagaggucaagccacuuggauaugcacagcugugcaccauuagaccaggccuuuucugaucacacuuccugucuccugguacaccucagaucccaugguccaaaauacccaaggucaggaggagacacuuuuacccucuuggugccaaggaaaguccccucuucuugaccccagaaaggccacugaccucaccauaacaggaaaacuaaucucguuacuccauuacgcccuuuucuuucucaacauucccguaacucaaauugcgucagauccucacaacauccuagugauacuggcaggguggggauuauuagcccuauugauaaaagaaaaacuucagcugaauuaaauuuaaaagaauugccugcaaucccagcacuuugggaggcugagguggguggaucacgaggucaggaaaucgagaccauccuggccaacaugaugaaaccccgugucuacuaaaaauacaaaaauuagcugggcaugguggugugugccuauaaucccagcuacucgggaggcugaggcaggauaaucgcuugaacuagagaguuagagguugcagugagcugagaucgugccacuguacuccagccuggcaacagagcgagacucugucucaaaauaaaauaaaauaaaauauaaaaaaauaaauuuaaaagaguuuaauugagcaaugaacgaucugcaaauuaggcagccuccugagccggaguaggaaccagcgcagccacuuaguagaagaagauuuaugaacagaaaaggaaagugaggugcagucagauugguuacagcuuagcacuugucauuugaacacgguuugaacaguuggcgacauuugauuggcuaaaacuugguaauugguggcugggcaugguggcucacuccuguaaucccagcacuuugggaggcugaggaggguggaucaccugaggucaggaguucgagaccggccuggccaacaugaugaaacccugucucuacuaaaaauacaaaaauuagcugggcaugguggcaggcgccuguaauccuagcuacuuggguggcugaggcaggagaaucgcuugaacccggguggcggagguuguagugagcugagauuacaaugcuguacuccagccugggcgacagagugagacucugucuuaaaaaaaaacaaaaacaaaaacaaaaacaaaaaaacccccaaaacuuggugauuggcacaaguguaggcuauagucuguuuacaccucuauuucuuauaguuuacaauguagagaaacugcuaggcugaacuuaaaauauguaagaaggcagcauuaggcuagauuugauuuaauaauucccuucuuuuaguuauuuuuuaaauuuugagacauugaccaaaacgagucacugaugucacuaucaccauuguaaauguacuuauuuggucucgaaacccacugggaaacaguaggacaguggguuuuguaaggugggaauaaagacuuuagguuauuuuuuuuaaggguuagaggguauuuuuuuuaauguuggaauguccuguuuacaagaaaaaaaaacaaaacaaaaccugguuuuagcauuuauguguucuuuuuaaaguuuuaguuugaugauaucacauuuagcacaagugacucuauuuagguuucgucuggucucuuggggccuaguguaugcauuuaguccaaaacaacagccucucauaauuuuguuuuuguuuugagacaguuucacuuugucgcccaggcuggcaugcaguggcacggucuuagcucacugcaaccuccgccuuccagguucaagcaauucucgugccucagccuccugaguagcugggacuacaggcgcaugccaccaugcccagcugauuuuuuuguauuuuuuaguagagacgggguuucaccauguugcccaggcuauucuugaacuccugagcucaggcaauccacaugccucggccucccaaagugcuaggauuacaggugugagcuaccacgcccagcucauaauuuuguuuuaaaauucccccuuuuuggucagguucucacuuaggugagagugugacccaaacuuagggccuuagcaccacucucagucaccacauuuugaaaccaaggccuagcaaugaagucacugggugagcugucacacagccagcaaaucugauccaagcccaagcuccaccacuucccagguguguguugcugggucagucccugcaccuccgaaacuguuuccuuuggcgucuaacauugguuucccauucaagaacuacggugcaccaggugcugacugugacacaccugaccugcuguguccucauuaacaacccugagagugagacagagcugucccccuuuacaggugagaaaauggagguccacuuggccauggugaagaggucacaucgauggcagguacugggccaggcccugcacaggccuccaugugggaccuacccagggacaccccugugccaagcucucuccaccucagcucagccgggggccuuccccauccaagcccacccagcucccaggccugcuccaaggacacccuccaaggcucuaccaagcagccuaauaaacugaugugccuccagggagcaucagcugguaugccccagcuuguaccuggcaggacucacagggucagguauuugcccuuagggagcccccggucuagagcacgcagccccagacuguccaggcugggaaggucuuuugcgauuucccaaaugccccgagccacaaaaaucacuugaggugcuuauggaaaaagucuuauucccaagugguuaccuugggaggaggauugacuaggcggugcaugaaggaacuuccuggggcaauggaaauguuuuguuuuguuuuuuuucagauggaguuucacucuugucgccaaggcuguagugcaauggcgugaucucggcucauggcaaccuccaccucccagguucaagugauucucaugccucaggcucccgaguagcugggauuacaguguuucugcccggccggucuuuaucaugaccugagaaguaguuaaacguguguauauuugugaaaaguugucgaggggcuaaucgucccuacccugucuauaucgugagguuuuuggggaggagcugaugagauuucaauaaagggaguguuggggaaaaaaaggguuuaguggagggaugugacuauaugcaaguuuaaaaggacagauuagaaagacauaacagcccccuaaauaaauuccuacuucuccuauuccagaccuacucggucagaaucucccaggucagggccugggaagcuguuuuuuuauuuuuuguuuugagacagggucuuacucugucgcccaggcuggagugcaguggcacgaucauaguucacugcagccuuaagcgauccuccugccucagccucccaaguagcugggacuacaggcacacauuaccacauuugguuaauguuuacauuuuuaaaauagagguggggucucacuaugcugcccaggcuagucucgaacuccuggguucaagugauccuccugccucagccucccaaaaugcuuggauuacagguauaagccgcugugcccagcuggaagcuguauuuuuuugguggggggauuggggggauggagucuugcucugucacccaagcuggagugcaguagcgcaaucucggcucacugcaaccuccgccuucagaguucaagcgauucucaugccuuagccucccuaguagcugggauugcaggcccaccaccaugcccggcuaauuuuuguuuuuaguagagacaggguuucaccauguuggccaggcugaucuugaacuccuggccucacgugauccgcccgccucggccucccaaagcaccgggauuacaggcgugagccacugcgccuggcuggaagcuauauuuuuaacaagucauuuucugagcagauucauuugggaaacuuugucuuagagaucaucccauuguccaaaugggaagacugaggccuaaagaggaggaaagccuugcccggugagaggaaccacuauaagcagacccugcaucucucagcugcuccccaccagaggcacacauagggaacugagucagcuuggagccagcauccccuagccugucagcugggccuucugggcucuuccaaggagcuguggcuagagaggagugcugaguugcccuugugucccuggugggcaugaggaaugaggcaggggcuggggggcaccugcauagcugccuagggagggagcccugcugaagaccagcccaguaacauuucagcugcagagucauagggaagggacauggaauuccucucuccgccaagcccagcaucucuggcaagccuugcuggccaggacuguauucauuacuggaggaaguuauuuauggcugucaugaagagcuggaugaagugcuugcgcaggaauguguggugguuucagagugggcugcaggucagauccaaggaaggacuucccuagagggcagugggccagugcuggggauuauaguaaggcucagacuucuagccauugacagcaccccauccuggcaggaaacagacguggaaguaccccagaggccuggugccaagccacugcaucuuuagggcuuugaugagaacccagcuguccccugagcgcucccagccucaacaccucugcacucugugcuucccagacuagaaugucccaugcuguccaaccaaugaaucccucccccugcccucucccuacccuaccccagcccagacagcaguuucggcuccuccccaagcucccagcacccagugccaugaagcccuuggugaaauuaaucagagccuuagagaaucauagguugucacccucucaccguggugagcuccuagggagcuggaauccugcucugcugauggcagcagccccguggcuggcagaggccggcacaggccggguggccagggaaugucgcuagguggaaggaugauggggucagaggguggguggcugaagagacagcucagcagcagugaagauggaugcuggagccaggcugccuggauucugauccugccucugccccucaccagcugggcagcucagagcaggugaccucaccccuccacaccuaauagaagccacugcguuguuguaaggaugccuucauacacacaaggguguaaaacggaggcugggaugugguaggugcugagugaaugucagucaggagcuaggguuauggggagggggagcaaaugagguggauggacugcggggcagagaugggcaaguggggcagaugaggggcuggagcagagaacggauggacccuuccccgcccacucgaucaagccaccauaugcuuugggauuucccagagaccuguucaccuggauggcugcagacaguccuuccagcucugagacucuagaacccagaagcucaccugccugcugaguacuuucccuucaaagggccuguucuuaagcggcagagguccuauucuuacagucaaagggcucccaucuccaaagagaaccagaucucucucucccucacacacucacuugggaagaaaggaguaaccugccagguagccugacacuuccuuuccaucuugaaggggagagagagaaagucuaggacaggguaugggccagaaguguccgugggggugggucgagcaccaggcuggaaggaugaugggguugagaugagcagagagagagagaggacacucccaacaggaccugaguguuuaaaggcaaggaggcaggaauguguggaguuugggguucagggagaaaggcacgagcaggcggcuugcauucaggacagaggggcagccuggacccaccacaaagggcucugcuccccaagcacggccugguggagagcaggcccucugcaugccucaucucacuacaugccccauugccagcuccauuuuacaggugaggagggugaggcucugacugucacuuacucaaggccacacagcagagcuggaaucagaaacccugagggucuggguucagagaagccaaagcuucucugggggucccugaggcuccaggacggucaugaugccccaaaccaacucugugggcagaggacugaagccagaggacuaguggcaggagagaagcagcagggaggcgcaguagggagaucgcaggggagggagauagcagggcccagagacaccaugccuggggccugcagugcccaggcaggggucgggggcggagcauggcugcuuugcaggcacacagccuucugccaugccauggaaaggacauguucugccccaggccaccucacucugugccaagccuagaugccaaguacagaaagcggugggggaggguggcgcacgcacuacaucugcgguguucgccaaccaccuccuccagcacuucccucagcccucugcagggggagccucccugguacuaggagacauggccggcccauccuugcucucacaaacaacaagaaaaggaaggcacaggccgggcgcgguggcucaagccuguaaucccagcacuuugggaggcagaggugggcagaucacgaggucaggagaucgagaccauccugacuaacacggugaaacccugucucuacuaaaaauauacaaaaaauuagcugggcuggguggcgggcaccuguagucccagcuacucgggaggcugaggcaggagaauggugugaacucgggagguggagcuugcaaugagcugugaucgugccacugcacuccagccugggugacagagugagacuccaucucaaaaaaaaaaaaaaaaggaaaaagaaaaggaagacacagagaggguacacaaccuccccagugucacacagcacaucaggggcagggauaggucuccccacuaaccagcugaggauuuggggggcaauuacuggaaaggcaaggcaguguucaaggcgcagcuuggaugccaaugucuuggacuuccguacauuagugauuugcggcaacugaugaaaauauuucaaacugagacuauuuuagaaaaauccuauuuuacauauuuugucaucguauucauaagauuaauaauaacaaaccuuuucauagaccuuauuaugugccaggcauuguucuaaacacuuuaccuauauuaacucacuugauccccacaacaaccuucaagguaagcacuauuauuauccccauuuuacagaugacaaaacagaagcacagagagauuaaggagcaugcccaaggucacacagccaguaagugagcgagccagaauucagccuuacuuggggauguuucugucucccaggacuaagcauaaacuccucaaacaggaggcaagacuggaaacaaaccaccauuugcccucucugcaauauguacauuacacagacacauuauacuuuugcagaugaagggauugcgugcagcugcuauuugauucacacucacuacacucuguucccaaauguuauuucauuguaucugcaccacgguucccagugggagggcuuccuauaaucauaacuuuacaggagaggugaggugacuugccagaggucacacagcaagagaaugucacaucuaggguccaagucucuucugaucuuugcacgguaucuuguagccagcccugcagugcaacucacuuggggcuugcaguggcagggaggggaggaucccagauucaagaccuggcauucaagaccuggcucugcccccggccaggugggcgcacccuggccacccccacccauaauccccuccuucaacucauccucaagacagggcauuggccaaucccggcucuccccacuccccucccccuagcagaggauguguccauugugcagauggccccacgcaggcccugugagaggaggcugaggaggcgccgggcugugggaaaagggacaaugaacuuguagcuugcugggcagcggccagcacaagccgaaucccuggguggcgggcgcagagggcucagaucagaggaggaaggacgcggguguucccagagacagugcucagggcagcugggcuccagauaacagcguuccucgcauucccagaggacgcuccagccggccacagaaggcuccgguggcuuuugcguuugaucuccgcggcgaccuugggacauaguagggcagggcugacgccgagagccccagacaggaaacuggggccuauggaggugaggucccacccaagggcaugcagcucagcaggcccccauugaccuugggcacaccaccucacccgucaaauggggaccauccuggugagagccuacgucacuggaggaacaagaauucagugagacaauaaacaaggagagaaagacccagggccugguacgcauuaaacaauagguguuagccagaaguaacagugaucacgagugugccgggcacugcucuaagcacuuuacacgcaaagccaucugguccucacaccaacgcccucauugcucccaguguacagaaaagucaaggaacugggccaaggucacauagcuacuaacaggacccaaagaggaagagggagaaacucuauggagcaacuacuacgcgccgggggcuuuucacccagucuucgaauuccagugaagugcaaaugaucagcuccggcucaggaggaaaaaccaaggcucagaacaggagggagguucagggucacaaagcaaccacgugggagcgcugggauucaggccagguccguccagcuccauguccaguguacgugccacccccaucucagucacaugccaggacaaccucggucaccaauggcagagcucgugccucagccaucccaggcacagggagcccugccucaguggggcugcaugagcucacucugcugggguguagggggauggcgguggggggggugguucuggcaaugagagcugcaggaagccaugccuggcugcugcccuguggcugguccucaugucaugcugcucucucagcucccuguguacuuucccgugaucgcagcuuccugggggccucuuguaucuagacagagugcccgcuccacaaagugaggggcuucagucacguuggccucucccuccugggucagcuccucugggcuuauaauuuugcacagagaggcugagaucagugggggcagcccaggguuacaagucagaguccucgcugaauauucaagggcuguuuccuuggcuguagagcagggauaauaaacuccauucugccuccaguaucagcgucuuagaagggaaggaaccuggccgggcacgguggcucacgccuuuaaucccagcauuuugggaggccgaggcgggcagaucacaaggucaggagaucaagaccauccuggcuaacacagugaaacccugucucuacuaaaaauacaaaaaauuagccaggcgugguggcgggcgccaauaaucccagcuacucaggaggcuaaggcaggagaaucgcuugaaccugggagguggagguuguagugagccaagaucgcgccacugcacuccagccugggugacagagcaagacuccgucucaaaaaaaaaaaaaaaaaaaaaaagggaaggaaccuugcaaaucaaaagguacaaugcagaaguuucuacggcucuccacugcacucccucuggugaguggaguggacaucuacugucauuuuuggccacccagagucuguuuccccuuccuaacaauaccaccaaguuuccuugggaagugacccucccccuuucagccugguuugggugggacugaucccgccuccagcuccagguggacccugacuggcuccagcuggaagacucugucugcuugcuggguuaugagggugugaagugguggggaagggcacuuuguauagccugaagaggaagcaaccucucagagauggacuagagaaagguagagaccuugagucuuugauagcaucacuugggcuccuagaugcagccaugccugaagccuuccucugaacauccuggcuacaugagccaauuaauuuccccauugugcgucuuggcuuuucuguuacuuggaacacagagucugaccucagaacugcagcucagccaguuuuucucagcgcuuuagauugugagcaaccaaaucaggucauucauauucugccagcuguuucugccagaggaaaaaucuugcaaacaagcuaaagcugacaaguuucaaguaugugguaauguaagaguccaacuuccuacaagucacuuucuacuuggaaucuauaaacuucuagaauuacagaaaguuuuggggcuggacuugucuaauagcccugcaggacucagauccucacuuucugacagguuguuguccauugaaguuuacaacccuuugaccaccagguuccaugcaucuauugugugccagcccugugacaggacuugcagguacaagcucugccuuccaggcccuucaguuugguaaugacugguuauaauucaccuuucuaguagguuuuacacaaaaggccucggagggagaauaccacuacacccauuucagaggagaaaguagagacucagcaaggugaagugacuugcccuaggucccucugcuaaacaggggcagggccaagccaugucuccagaucugccugggcccagugcuacugcuuuuucuccuagucauuggaguggagugggcugaggcuaucauuucuuugagaguuuguuccacucaggagcagucagagugguuuaaaaagcuaaagaaaacgagaaagcuaagugucaugagcuuccugucugccugaaggucuugacuucuucagaagccccaguauuuggcccauccagcuucacucuccuuucuuuuuuuuuugagacagggucuugcucugucauucaggcugaagugcagugacacgaucauagcucacugcagccucaaccucccgagcucaaacgauccucuugccucagcaagagaccaaguagcugggaccaccggcgcacagcaccacguucggcuggugauuuuauuuuuaguagagacaaggucucgcuauguugcccagacucucaaccuccuaagcuccagcaauccuccugccucagccucccaaagugcugggacucccgggugaggccccacacccagccaaacuuuccucuccuauauggcucgcugcuugcaggcuguggccagagaggaaaccagcacugcccugaaauccagaccccaaaugcuuucaugggagaccucgucaccccaagugagcugucccagccuuucucaggcgucugcccuaugucucuaagauccagcugaucuugacuaaacaccuucuaugccuagggcuuucccuauauguuauucaaccaacauucgcuggaacacuguuuauugagcagccacaauaugccaggggcuguucuaggugcugaacauaacagcccaaaucccugucaguguggcaggcagacaacaaggaaguaaguaaaagcaauagaacgccagguggcgguaaguacagcggggaaaaagaaggcagggaggaggacagggagguuugcaguuuuaaauagaaagaucagagaaggucucaccaagaaaucauuucacuguggccuugcaaugaucccacacaggccagaacgugauucccaaaucacagauaaggagggauaggguuucaggauaacucucaaguccaugcaugucaauacaaccagcgcaacuggauucuugcccagggccuccugucucccucgugcccucuccccuaacucuaccaagggguacuagcagcccuuuugcagaggaagaaacugaaaccacaaacccagacccucaagaguacaccagggugagggacagcgguggggggcuagaguucagccccagagcugcccucugggccuaucucuuggcaaagcccacauccacuacccuaggcuucagucugaagcuucagcucuggguuuguugaaacucaauccuccucuucgcugacuccguguccucccagaauccuccucccuuucccagagccccuguggcucucuaucucaggucuuaugagccccaaauuguccaacccaccuuuguucugccuccucaauuaacuucuggcuuaucacuaagcccacauuugcaugaaacuacaaaaggcaucuugcauauggccaagggcggacagucagaauauacauguaggauccaggugugguggcugacacguguaaucccagcacuuugggaggccaaggcaggaggacugcuugagcccaggauuucaagaccagccuggggaacauggcgaaauccugucucuacaaaaauuagccaggcaugguggcacacaccuguaggcccagccacucaggaggcugagacuggaggaucgcuucagcccaggaggucuaggcugcagugauccgagauugcgccacugcacuccagccugggagacuucucacugugcuuucccaucugccuguauuugguaaucucccaagucccagucuaaucuucuucuucuucuucuucuucuucuuuuuuuuuuuuugagacaagaguuuuacucuugucacccaggccagagugaaauggcacgaucucggcucacugcaaacuccaccuccgagguucaggcgauucuccugccucagccucccgaguagccaggauuacaggcgcccacgaccacaccuggcuaauuuuuguauuauuaguagagaugggcgguuucaccauguuggccaggcugaucucgaacuccugaccucagguaauccacccaccucagccucccaaagugcugggauuacaggcgugagccaccgugcccagacccagucuaaucuucugaauaguguggcaugguggaaagaccuuggucuugugggaaguggaccugggguuaaguccuggcuguguagcuuugaaagcaacuuugggguuucagguuccuuauccauaaaacaagguuggucauccucaccuugcaggguuguuuuacagauaaaaugcaguggagagcauccguuaaaaguuaaaauucaacagagaguguauuuggaaagcagagcccggcagauaaucaucaagaaucuaccaaacugaaaggagaugucuguauaguggugaaacaacugucaccagcagaaugacagcugcauucacugugcuccuacacuuugagguagguacucuuaguaucauucacauuuuaugaagaggaaaaaagcacagaaagguuaaguaacuugccugaggucacacagcagaccugcagcagagcugggauucugagcccaaauuguccaacuccaaacuacaagcucuuaacccauauauuaggguaaguaaacgguggcuuuccauguugaaagaacugcuccaugauacauagcguuaagugcugacccaggaagggcuggugggcagccccacuccaaagcuugugcuccccaccaugguaucacaacaaacugaaagggacucuaggaauacucuaacccaacaccuucaucuuuuucuccaagagaagccugagguccagagagguagcaugaccugcccaaagucacacagccaauuaguugaagaaucaggacaggcacccugguguccugacuccagaacccuaugccaucacugagugucaccuugaccaugaggcauggucagggaaggagucuugaggaugugcugaaguguuucagcagaaguggagggaaggaagucuaagcugcuggaacagcccaugccaagguccagaagccgugaacgucuuuccuggagaacagggagcuguaaggugcacgcagagguuuggguggggcagagaaugaggcugcuuucucauauugaauauuugcuuucagcucuuuuauuuuuuacacucucucauucuacuuuaugcugcaaauguuuuuccuuauuucucuuguuuccuuauuucucauguuucugauguuuauuuaaaauauuggucuugggcugggcgcaguagcucacgccuguaaucccagcacuucaggaggcugaggcgggcggaucacaugaggucaggaguucgagaucagccuggccaacauggugaaaccccaucucuacaaaaauacaaaaauuagcagggcaugauggcaggugccuguaaucccagcuacucgggaggcucaggugggagaaucgcuugaaccugggaggcagagguugcagcaagcugagaucacaccauugcacuccagccugggugacaaagcaagacuccauuucaaaaaauaaaaaauuaaaaaaaaaaucuuggucuuuuuauucuaauaccacugacucuggguugucucuaaucaguuuaugguuuuacuuuugaauucauugugcucuggcugguggugggacaggggauuggggaauccacacgcuccuugccccaacagagagagaagacauauggcuccuggguccuccuucucaacaucaaucccaaguaacaacagaacaaaauaccacuaagccuaggcaacaauggggaaacagaaucuccugggagauggaagagaguuuaaacuaguguguguaggguggcggggagggguugcugcagccaggagaaaaggcagggcauggucuuuaggguggagagaauauuacagaaaagaaaacaggguuugaguucuccucuugccucucuguuccaagcccaggcccccauacacacacccacuguccuggaacaacuaaggucagagcugggugugggguuggaguucagccccacagccacccucuggaccugccuccuggcaaagcccacaucugcuacccuagaccucagucuccaacuucagcucugggcuuguugaaacuccauccuccucucugcugacuccguguccucccagaauccuccucccuuucccagagccccuuuggcucucuaucccaggacaugugagccccaaauuguccaacccaccuuuguucugccccucaauuaacuuauggcuuaucacuaagcccacauuuucaugaaacccacaaaaaguaucuugcauaaagcagcccaggaggauggcacaagugucuacugagauaaagucaaagcaugggcugggccauaauuccagcacuuugggagccaaggcaggaggcucgcuugagcccaggaccuugagacagccugggcaacaaagugagacccugucucuuacaaaaaaaucaaaaaauuggccgggcgccguggcucacaccuguaaucccgcacuuugggaggccaaggcggguggaucacuugagaccaggaguucgagaccagccuggccaacauggugaaaccccaucucaucucuacuaaaaauacaaaaauuagccgggugugguggugggugccuguaaucccagcuacucgggaggcugaggcacgagaauugcuugaaccugagagacagagguugagccaagauugcaccacugcacuccagccugggugacagagcaagacucugucuccaaaaaaaaaaaaaaaaaaaaaucaaaaaugaucuggaugugguggugcacgccuguggucccagcuacuuaggagacugaggcaggaggugugcuugaacccaggaugucgaggcuccagugagccauguucaugccacugcucuccagucugggugacagagugagaccaugucucaaaaaaaaaaaaaaaaaaaaauucaaagcuugccagcaaacaauguggaacugcaggaauugggaggggaccgacagucacuacagggggccucuacagucacuccaccaccccuuccuuuccagaccccagucugaagaauucugaccuaggcauauagccccuucuccucacuguuucucccuggggucugaaagagaggcccaauccuguggagugagucacugggggagggagaauggugaugucacaccuagugagaaaccaagugguucugauguccagggauucccguccuggcaaugucgucuccuuggacucauuggaacugggcgacuagggucagccuuagacucuuaccaaagacacagcaucaaacagaauagcugaaaucccccacggaguaagcucacaaguuaaagaacagaguauccaaggagcacaaugacuucaaaagaaacccaaacugauuagagauaccgcuggaaucauccguauuagaucagauuuacugagaauuuaaaauaagcaaaaaucguaauugccuagguuuagugauguuuugcuuuucaguauuugggacugauuugagagggaggauccaggagccauacguuuucccuggcugcuaguuuuaagggcaagaagugcauggcuccccgaaucccaccccacgccacuaccagccauagcacaaugaauucuaaagaaaaaccauuaacaggaccagaugcgguggcucacaccuguaaucccagcacucuaggaagccaaggcggguggauuacuugagcccaagaguuugagaccagccugggcaacacaaugaaacuccaucucuacaaaaaauacaaaaaaaauuagcuggccgugguggugcacaacuauagucccaguuacucaggaggcugaagugggaggaucacuugagcucgggaggucgaggcugcagugagcagagaucacgccacugcacuccagccugggcaacaguggagacccugucucaaaaaaacgaaacaaaaugaagcaaacaaaaagucuccauaaacugugagaaacaugcaaaagaaaugagcaaagauguuagcaaaacagaaagaggaaugguuaaaagaccccaguggaaacacucuaugugaaaaaccaguugaaauaacaaacacauaaguagaauaaauuacagaguguauccagcugcugaacgauggaggagagagcuaaguuauuagcuugaggacgcuuccaggaggaagcagggaaggauuaagaaacagaaaauuggccaggcuugguggcucaugacuggaauuccaacacuuuggaagguccaggaaacauggcaagaaccucaucucuacaaaaaaaauuauuuuuuaauuagccaaguguggugugcaccuguggucccugcuauuugggaggcuggggugggagcguugcuuaaggccagggguugagacugaagugagccauguucaugccacugcacuccagccugggugacaaaguaagacccugucucagaaaaaaaaaaagaaacagaacauugaaagaaaaguuaaaagaacauuaaccccaaucuuacugcauuaauuugagauuaaccauaaaccuaauuguaagucagaaucacaaagcuucuagaagaaaauauaaaaggauaucuucaugacuuugggguaggcaaagaauacugacuccauaauauuuucuuuuuuuuuuuuuugagauggagucucgcucuugucacccaggcuggagugcaguggcauaaucuuggcucacugcaaccuccaccuccuggguucaagcaauucucugccucagccuccugaguagcugggauuacaggcgcccaccaccacacccagcuaauuuuuguacuuuuaguagagacgggguuucgccauguugaccaggcuggucucgaacuccugaccucaggugauccgcccaccucggccucccaaagugcugggauuacauguaugagccacgacgcccggcccugacuccauaauauuuucaugacuuuggguuaggcaaagaauacuaauuccauaaaagaaaaaaaagguaaauuggacuucaucaaaauugaaaaccucuuguuaucaaaacauaccauuaagaaacugaauaggucggccgggagcggaggcucacgucuguaaucccagcauuuugggaggucaagguggguggaucacaaggucaggaguccgagaccagucuggccaauauggugaaaucucaucucuacuaaaaauacaaaaaaaaauuagccaggcaugguggcacaugcccguaaucccagcuacuugggaggcugaggcaggagaauugcuugaauccaggaggcagagguugcggugagcugagaucacaccacugcacuccagccugggugacagagcgagauuccgccucaaaaaaaaaaaaaaaaaaaaaaacugaauaggucaggcauguaaucucaugccugaauaggucacuccuguaaaucucagcaccuugggaggccacggcaggaggaucgcuuaagcccaggaguucgagaccagccugggcaacauaaggaaaccccaucucuacaaaaaauacaaaaauuaccugggugugguguugugcaccugcagucccagcuacuuagggggcugaggugggaggaucacuuuauuuggggagguugaggcuguaugagcagugaucgugccacuacacuccagccugggugacagagcaagacugucucaaaaaaaacaaaaaaacaaaaaaacaaaaaaaaaaaaaacacguacacacaaugaaaacauccuaaagguuuagcaaaaaacagaacacuuacaaauggaauaaaugucgaauugaccaaacuacagaaggaaaaaaagauugagcugggaauuuucuauccagcuaaacagccauucaaauguuaaaggcuggccgggcgugguggucaugccuauaauccuagcacuuugggaggccgagguggacggaucacuucagguugggaguuugagaccagccuagccaacaagguaaaaccuugucccuacugaaaauacaaaaauuagccaggugugguggcaggugccacuaaucccagcuauucaggaagcugaggcaggagaaucgccuaaacccaggaggcagagcuuguggugagccaagaucacaccaccacacuugagccugagcaacagagccaaaacuccaccucaaaaaaaaaaaaaaaaaguuaaaggcuaauaaaaguuacagcaucaagggcucagguuuguacaaaaagacagccccucgcccccuccaaaaaaagaaucaaauaauuuuaaaggaaugauuuaauuaggagcaaauuccacagauuguauucaagauaucugaagacugagcaaauaauuuaguaaaguuuaguuuuucaaaacaaauucaaguucaaagaaaagaacaagaagggccgggcgugguggcucacaccuguaaucccagcacuuuggguggcugaggcaggcagaucaccugaggucgggaguucgagaccagccugaccaacacggagaaaccccgucucuacuaaaaauacaaaauuagcugggugugguggugcaugccuguaaucccagcuacucgggaggcugagacaggagaaucgcuugaacccgggaggcagagguuguggagagcugagaucgcaccauugcacuccagccugggcaacaagagugaaacuccaucucaagaaagaaaagaaaagaaaagaaaagaaaagaacaagaauaacauagaucuguaacucagaauuagacaauuuuuuaaaaaucuagacaauuuucaugugacaucaugggggcugaggggagcaugucagugaaggguguggaaacugaagagaggcaggggagcaagggacaugagaaaaugcuaaucuugucuuuguagggaaaagccacagauaauuuuuuaaagugauaaaacagaaaaagcagaacaaauugaaauaaaaauguaggaugguagaaacaaaauacauaaacacacuuucuuuucaggaacaugcaaacauuuaaauaauucaucaccuaccaggccaaaaaguaagucucacaguucaaauaauaaguuuucacauagaccacauccugugaccaucaauuaagugagaagcuaagcguuuacaaguauaaaucauuaccccuacacuuagaaaugaaaaaaagucccuaaaaauuucaaggaucaaagaaaagucauaguagaaacuuaaaauuacuuagaacugaaugauuaaaaacaccacauaucaaaaauuauauaaugcagcaaaaaagguuaaaaauuaauaaaguaggccgggcgugguagcucacaccuguaaucccagcacuuugggaggccgaggcaggcagaucaccugaggucaggaguuugagaccagccuggccaacauggugaaaccccauuucuacuaaaaauacaaaaauuagccagguauggugguacaugccuguagucccagcuacuccagaggcugaugcaggagaauagcuugaaccugggaggcggagguugcagugagccgagauggcgcuauggcacuccagccugggagacagagacuccaucucaaaaaaaauaaauaaaugaaaucugcugucuccagaaauccuuugcggccauucugcccaaggcuuagcuagguggccucucaugcuuucccucauccucuaccaccuagggcucugugggggagucugcuuacaagaccauuucuguacacacucuuuuuguucguuuguuugagacagaguuuugcucuuguugcccaggcuggagugcaauggugccaucuuggcucacugccaccucugccucccagguucaagcaauucuccugccucagccuccggaguagcugggauuacaggcacgcgccaccaugcccggcuaauuuuuguauuuuuaguagagacgagguuucaccauguuggucaggcuggucucgaacuccugaccucaggugauccacuggccuuggccucccaaagugcugggacuacaggcgugagccgcggagcccagccuacacacacucuuugaaggcaaaauccagggcagauccaucugugauuccagcaccuaacccugggccucacaggcaguugggcuaaugagauguuuguugaaucagugaauguccucccgcacccgucuuuccccuucuugacuggcuuccuccucucuccacccugacaagugccaagacgccagcacccaggugagcacgccaggagaggccgcuccaucaggaauuuccugagcaggggcagccuuuuucuuccuccacucagcuuucuccagguagaugggacaaagcccaagacaagcgcugccuccaucacaggaauagucuggggccuggcccagccaagucuaugggccaugcauuuuuccuguauuuuacccucgguggcuggagcguguggcgggaugaggagguuggcaggcuugccucagugccccaacugggggccuugcccagcugagcuccguuuggccagaggccagcugggaaacacuugauuauucaaaucauguggccgcccaagaggaaagcauccguuuccuccaagagggggaaguggggcaggcaggccagcccagggauuugguuguugaaaagggaaauuucagaacaaaguucucacacaaaccagcacucugagauucacugccccaggaagacucuggaagccucagauagaaacucaggagggucaggcucgaggccagagcccuggagugaggccuggaccaaucccccacuuacguuucugaguuagcagaggccucagccaggcuaauugcucuggccucccccugacccugguccuggagacaccaggacugccccgccaugccccuucgccuguccuucccuucccccaggaaucgcgcaggggauagauaaacuccgcacuucuaagcucagggagcuggagccucggagccucccagcaagugucacacagucuguuccugcuauuugcucaacuccugccuugcucccccuccccagaucuggcuccaaaagaacuagcagguucaagaagaguguacccaucugacaugcagagaauuaucuaguacucauuaagugagaccggacucuggagcaaggcugcccggguuccaauucuggauuaacccauguaugagcuauaggaccuugggugaucccuucccuuccuuugugcuucuauucauuuuuuuuucuuauauuuuuuauuuuuagagaugggaucuugcuauguugcccaggcuggagugcgguagcuauucacaggugcaaugauaucucacugcagccuugaaguccuuggcucaagcaauccuccugccucagucucccaaguagcuaggacacaggcaugugccaccacucccagccugugcuuccauucuuuaccuguaaaagcagagauuugggccgggcgcaguagcucaugccuguaauuccagcacuuugggaggcugaggcgggcagaucaugaggucaggaguuugagaccagccugagcaacauggugaaaccccgucucuacuaaaaauacaaaaauuagccaggugugguggcacgcgccuguaaucccagcuacucaguaggcugaggcaggagaauugcuugaaccugggagguggagguggcagugagccgagaucacgccacugcacuccagccugggcgacagagcgagacuccaugucaaaaaaaaaaaaaaaaaaaaaagcagagauuugaguaucuacccuuuggggagguuagauucaggaaaugacaacucuugcuauuaucagugaacaaauuaagguuucauaaaagagcuaggccuggaucucuggaccagacaaccccauggcagacacauccccccucaccagagccaagcccuggguccaaaucccagcucaaccacccacuagcuccacgagcugcugggugguaaguugcuaccucccugagccuccuucugccccagagcuguugcaggccuccccauguuggagggugguugucccuguuacugcuuguccugggcaguacccggggauuagggggcugacacaugcugggcugccccaggcaggggugaggugacagaucaguuuccuuuccugaauaccggucugggcccagccucagggugugacauaggggaggccccugaggagauggggauacuccccuccgccccacggaucauauagcgccagcaugcacccuggcacaggccugcugccaguggccaaccuggagcagagguaccaggaacuacccagcaggaagcuucacgagucuuuacagaaggaggcaggacagcaagaugccacagccugagugcugguguucacacuccagagcuaucauuuacuagccauuuacuggacaaaugagcuuauuccccauuuuuguuuuuguuuuuuguuuuugagauggagucucgcucugucgcccagucuggaguacagugggacaaucucagcuggcugcaaccuccgccucccggguucaagugauucuccugucucauccuccugaguaccuguaaucuugagggauuacaggcaccugccaccacaucuggcuauaauguuuuguauuuuuaguaaagauaggguuucaucauguuggccaugcuggucucaaacuccugaccucaggugauccacccaccucggccucccaaagugcugggauuacaggcaggggccacugcgcccagcccaaaugagcuuauuucugagccuggcuccccauccgugaguggggacaaugacaauaauaucuaccuccuagggcugauaugaggauuaaaugauuaauguaucugacuugcuugaacagugccugccacucaguuaauaugagcuguuacuguuacaaugauuuaugaccgcugucauuucuucucuaaaguccccccagcaccgaguuuccuccagcagauucggggcucccuccugccagcuucugcucagaucaugauuggcgccuaucccacagauggugaucagaagaccuauugugugcccgacacuggaugaggcauuuuauagucagggacaacaugaccgcuugacucgccuacuacuguucccguuuguucuaagccuaggaucuggggcgugagguguguguuaugggaggaggcugguaggggaggugguucccauauuauguuauuuggaacacacauguccugggagauauuaaaauauuugcacgugacaccaaccaggugaccuaggagacaugaacauaaucucucugagccucaggugcaaggauaaaugaaaaaauacaugugagcugcuuagaacacagccugguucaugauauauuuuaaacaaaccuggccgggugcaguggcucacgccuguaaucccagcacuuugggaggccaaggcgggcggaucaugaagucaggagauggagaccauccuggcuaacauggugaaacccugucucuacuaaaaaauacaacaaaaauuagcugggcgugguggugugugccuguagucccagcuacuggggagguugaggcaggagaauggcgugaacccaggagguggagcuuguagugagccgagauugcgccacugcacuccagccugggcgacagagcgagacuccaucucaaaaaaaaaaaaaaaaauggacauauguauugguuacuccucugaguaccucucacggagucgacacaugaaacugaggcacagaggucaugcaagugaccuuucacuuagggacucucagucucuaagaaauguuaacucgcugcgaguauucauucauucaacaaauauguauuaagugccuacuaugcaccaggaagcaugguacaugcagauucagcaaauuuacagcuaugacuauuauuauuauuaaagaaauuaaggcuguuugggauuggggguacaucugugaacaaaauggacaaagacauuggccagagguaugacacugggcaccucauaccugagugagacuaaaggccugaacugccaacaggaaaacuggacccagagacacuggcuuguccugcugccaaucacuaaccauuuaugagcugguggcauucgugcaaggacaccagugaaggucuggggaggguggccaggcuucgcauugaguggcucaagagucacacccaguggggcaucccucccaggcuuccccaugguaacaaagccaggccagcuguggaaacccuugccgaguggggcagccuuucaugaacucaaaagucauuaaaugggcuguuguaaucccagcacuuugggaggccaaggcaaguggaucaccugaggucaggaguuugagaccagccuggccaacaugaugaaacccugucucuccuaaaaauacaaaaauuagccaggcgugcugucaggcaccuguaaucccagcuacucaggaggccaaggcaggagaaucgcuugaacccgggaggcgcagguugcagugagccgagaucgcgccguuguacuacagccugggcgacagagcagacuccgucucaaaaaaaaaaaagucauuaaacgcuugcugaaagcaggcaucuuauuaggcaugggaauucacgagugacucagauggggcuccuacccuccaggaacugaaacucagagccagaugcuauguggaugaucagauuacaaaggguucaagauauccaaagcaagcucuagaaaaacagccaugaugccaacuggcaacacaaacagggagagguugcugcaggggaggggauggcagguacaaaggcaacgaugagagagacuggagacacagcuggggaaagaccuucagccugggauccugaccugaguuugaggccugguuuuaccaucaauuuuaccucaggcaaguugcuugccuccccaagccucagucucccacuuugcaaaaugaugugaauacuuuauuggguugcuuugaugguucggugaguucaugaauaagaaauggcuuucggccgggcaccguggcucccagcacuuuggaaggcuaaggugggcggaucacaaggucaggagaucgagaacauccuggcuaacacggugaaaccccgugucuacuauaaguacaaaaaauuagccgggcgugguggcacaccccuguagucccagcuacuccagaggcugaggcaggagaaucacuugaaccugggaggcugcagugagccaagaucaagccacugcacuccauccugggcgacagggcgagacuccgucucaaaaaaaaaaaaaaaaaaagagaaaaaagaaauggcuuuaaaaacugaaaaauaugccaggccugguggcucaccgccuguuaaucccaacauuuugggaagcugaggugggaggauugccugagcccaggaguucaagaccagccucaucaacauaagcaagaccucaucucacaaaauaaaaaauaaaaaaaauuagcugggcaugguggcacaagccugcaguuccagcuacucgggaggcugaggcaggagaucacuugagcccaggaagucaaggccgcagucaacuaugaucgugccugaacuccagccugggugacagggcaagaccuugucucaaaaaacaaacaaacaacaacaacaaaaaaaaccugaaaaauagaauaagugccuggaaacugagguuggcaguguuaaagugacuuguccaaggucaauggcugauuaaaacaggauaggguguaucugggugggaugcggggggcagcacaaccccugccucugcugagccaccacuccugcguucccagcacugaccucagguuccccuaggcaauuuguuccagaaggccuagggaacaggugggguaccuaauuccuuggugcaggguuuaccguuuauucgcugugugguccggggcccaccacccucccucccugagccucaaucuucuuuuuguuuucuugaaaugcagucucacucugucacucagguuggagugcaguggcacgaucucugcucacugcaaccuccgccucccggauucaagugauucucaugccucagccucccacauagcuggaauuacaggcauacaccaccacgcccagcuaguuuuuguauucuuaguacagauaggguuucaccauguuggccaggcuguucuugaacuccugaccuuaagugaucugcccgccuuggccucccaaagugcugggauuacaugcgugagcccuugugcccagccucugagcuucaguuuucucccuuuuaaaaagagaugcccuuugcugugcugcgcauguguaaacguggaaggcucugccgaugguaaagcacuuuccacgggcaaagacguaucgcacucaucaaugagaaaugaucaugguaagcugagagaaagacgcagaggccgcgggccccgcacugagccugcgguggaggaaagcaggaggaacuaagcuagacuguaccagggcccaccccaggugugggguaggaaccuuuuaugaggcacagagcugugcccauguucagucccaagggagaggcagguuucugggccucaucacugccuaggcuuaaaguaagagugacgagaaagaggccaguuucagccuuugugagcgaagugcuuuggcgaggcaggggucucccucagcaaggcugggcuacacuacagccccuuucccugugucccacuggaucugagcugaguagcgcuuguugcauuacaaagaaaaagacuugugcaggaaauaggguagaggacaggcucucuagucagaugcaacuugaucuguggcaaaaccaaguggggucuuucagcuucaguguguuagcaucucaacaccugggauggaguuugugggcgggucgguuuugccacacuguagggcccagguggucccacugucacagugaagccaaguucuagcccaagucuggcagagcagucaggcagcuaguuuucaggggagaaaaaaggggugggacgggggacuucaguggccuauuacggagcccucuccccaaaccaaauucauagcugagagcuuggggaugguacaguuacaauuuaaaguaauugucuaaauucuguauuuggguauuaauguuuaaaugguaaucugacaacaguuuauaaagugauguucugaauaccauaaaaaaaagaaagagcucaguuucagguccuccuggaaagaguuaggcuggccccuccccauccuuuguaauaauauccaucguaguaauaagaguuauuuauucgggguuugacagauaugaauucaaaucguagcuccgacacuuaccagcugggcaaacccaggcuaauuacucugagucauucuccucaccugaaaaaugggcugguauaaggauuaaauguguaaauguauacaaagcauuucgcagaguggcuuggugcguaacaagugguccgucagugucgagaacucuuauuacuacuauggauguuauuacaaaggguggagaggggcaggccuaacucuuuccaggaggaccugaaaccagccucuuucucgucacucuuacuuuaagccuagacagugaugaggcccagaaaccugccucucccuugggacugaacacgggcacagcucugugccucauaaaagguuccuaccccacaccuggggugggcccugguacagucuagcuuaguuccuccaaagacaaggaaaagaagaccaaggagcaccgugacacugaacugggugccaccugggccuaucccuucccuacccccacccacacaaugaccaaaucuaaucugguucugggauguccuuuuaucuugugugccaacucuauauuaguugcuaauggcugucuggagcacuguacuuagaaggaaucugggaaggaaagcaagcagugguugacuagugaugucugaugugggugcagggcaggagagaggaaggagacaugcuggcuauucgccauccacaaaucgaaaaauccuaaggccuugccucauucaaauaaaccaugcgugguagggaggguagccagaagcuaagagagggaaagggacuuggcgaaggucacacagcuugaaauggcagggcugggauucaaacccaggccccucuggguuucucaggaugcuuccuucuaggcuugucauuuccuaugagggggugaacaggcuaagaaacacugucugggagaacagacgcuggugccccaccaggugugucuauguucugucuccucccccuggggccucccacccccaugucauuugcaaacacucacugaaaaacaaauguguaccacaaggugcccugagagcucuucuccaaacaugcaaauuugaauccagaugccaaucugauugggcaacccuggauuugagucucaccugcacuuuccaaacuuugagaacauuacucaaucucucugagcuuccguuuccuuguuugcaaaauggaaagaauuaugagcucaauacaauaaggucauucaaagugauuagcucaguuucugacacagaguaagcccuuaaauguucauuacagacuguccccaacuuacacuuaagauuuuuuucuuuacgaugaugcaaaagcuacaguguucaguggaaaccacaccucgaguacccaaccagccauucuguuuuucacauucaauacaguauagccaagaaauugacaugagauagucaacacuuuauuaugaaauaggccucguguuagaugauuugcccaacuauaggcuaauguaacuguucugaacacauuuaggguaagucaggcuaagcuaccauguuugacagguuagguguuauaaccauuuucuacuuaugauauuuuucaacuuacaauuccaggacaaaaaccuuugguaaaucaaggagcaucuguauaaggauuaggucauggggaaaagcaaaaaaacagcauuuucacacacaaaaaaaucacuuaggugauuaagggcuuggacaagcuguugagaggaaaccugcuuaucucugauaucuugauaggcuaacagaccuagaauaugaauuucuauauuggaugguuuuaagauaaauagggaacugacucuucuaggaagauggguuaugucauuugcauuacggagaaagcaguagccuugaauggauggaugggucaccgcagggaacaaacaugucuacuucucacuucccagcugggggaguuuguguuuccguuuccucaucuguaauguggggauaauagcaccugccacccagcgcugcuguaggaccaaauaguaauuacaggcaaggcacugagcaccaugccuaguacgugcauguugggcuuauagucuauggacuuuuaguuaguaguggcauggcagggaccagcggaaugaggcagagaaagaagaggagcuauagaagggcucagaaggaguggaggaggggaaaugggccucagaugagacauuuucucaccagaauggcggcagacgggucaguuaguaacuccuguaugcugagagacagguaagucaagguggagacagguggagacagguggagggggaugagauccuccaaaaggccaggcuggccagaugcaguggcucacaccuguaaucccagcacuuugggaggaugaggugggaggaucacuugagcccaggaguucgaaaccagccugggcaacauugcaagaccucaucucuacaaguaauaaaaaaaauuagcggggcgugguggcgaaugccuguggucccagcuacuugagagguugggguaggaggauugcuugaguccaggaagucaaggcugcacuguagugagccaugaucgugccacugcacuccagccugggcaacagagccacuagacccugucucaaaaaacaacaacaacaaaacaaacaaacaaaacagacaaacaaacaaaaaaacaacaagccugagacacuucagugacagccagcaagaggccugagaacgucagccugagagcuaagugguacccacccuguggcuuuacugaccuaguaaaggugcacuaaagaaggcaagagguugacccaacaaaaagucacuggggccaggugugguggcccaugccuguaaucccagcacuuugcgaggccgaggaggguggaucaccugaggucaggaguucaagaucaaccuggccgacauggcaaaaccaugucucuacuaaaaauacaaaaauuagcugggugugguggcaugugccuguaaucccagcuacaugggaggcugaggcaggagaaucucuggaacccgggaggcggagguuguagugagccgagaucacgccacugcacuccagccuggggaacagagcgauacucagucuaaaaaagggucaccugguagaucuuuuuaaagggugcacuugugggccaggcacaaugguucaugccuauaaucucagcacuuucaggggccaagguggguagacuucuugaacccaggcugagcaacauagcagggccccaucucugcaaaaauaaaauaaaggucacacuucugguuuuuccaguaaaagcaauuugcuucagccaccuaaaaacuuuuuuaaagaacauaaaauauuugcugagcucugcccagcaguuugcagaccuggccagguaaaguucaugcaccugaaugacaaacugagcucuggaaggaugaagaagcaucucugaaacaagcuggaguggaggaggaggggguggcuuagaaagucuggagggucagggccucacuacagggucuccacggccuuauuuccagaaaugaccuuccagccuguccucuccucccuucccugggucaaagcagagaggcauagagaccuaggggaggaguaauccuaaggugucugcccucugagccucagucuccuuaacugcaaaaugcuggagaguaggggguaggugaguaucaaagguaaugugcgaaagugccugguacccaauggugcucacaaaaugccacuucccacacagggcacauuucugaagucgucugcagguguaaggaccaggggaugugagguuaguaucagcaaucgacaaucaaucagucucccuuguccaucucauaaccccuggagcaguugauucguggagaccuagaaucucacaucacagcagcugccuccagagccccccgcauguaaccaucaggcuucacagccuccugugcuacccucuggcucagacauggcgauucuaagaugcuugcugcagccaccaugguaccugccugucaucaccaggcccuggcucccagcaaaggggguggaacagagagcuguggguucagagugcaagaucguguuuccugucugagaagugguuaugcacugaugcacagggcuguuagggagcacagggugaaguggcgcaccaaugcacagggcucuuggggagcaagggguaagguggaagcugucaagggagucucuucccugcaggggcugugcaaucuuuagaaugaaguacccagcgaugccuguccccagcuagacccugggcucaacucgcugagccuugacagguagaugcucuaucacccccaaaccuccagagcccucagacucuuccugaggaccaccgaagcaggaaaaaagcuccuucgccuagcugacauguuuuguagauguugccaggcuauggaagaggggcuaguguccacgugucccauauucucacccugagcccccugagggcuggcccaagccccacacaaucauucaaguggaauuugagccccucuuacauggccucacugcaucuagcccagaaaccgcaagcucagaagguagguagguaaugucagggaggcaggugggcaagugugaggcaguggggcgugguggagacugugguaaaguggauggagcagcugcuaaucagcuccagccacuguggccaggcagggacauagccccauauggccacaucuucugaucuuucaagagaagccagaaauccuuaucuuuauauaaaaugaaauugccugguuuaaaaacaccagcaacuaaauaaaaguuguuuaaucaccgcaaaagucaacaaucccccacccccugcagccuuaggaaggcaguuugugauggaucucccauaacccagcacacagcaggcuauaaauaucugaggaccaguugaauacauuagacccauuccaagucuuagggaagucucaucucuccacuccuacuccucagauauauugguuuacagaugaagaaucugagacucagacaggggaagugacuugcccaaggucacagagguauucaaggacuucagcucagcucuccugagcuuaauaucuuuuuccaccaacccacaucaucugcauccucccuuaaacaaugauuuucaaaaaacagauaugcuaagaauauacuguagaaaugaaacacaccaaauucaggagagugguugccuuuggaaagaucauguagcuuaaggccaggagacugaauucccaguccacucugcccuaagcaauugugugacccugggcaagccucuucuccucucugggccucagucucccuggugcaccaagagcccaguugaccgagccagcuucuaaaggccuuccaacugaaauucuggggaucuaugucuccucucuggccaguacucuguggccucagaugaauacaaaauaguaauaauaauaauaauaauaauaauagagagggcgaguccacaccagccaggaaagaacacuacgacuuuuugugaaaccugacuccugguuacuggaauucagaaagaacgaugguaauacuugagcagcuuaaccaccauccuacaauuaaacaaaagcacaucugguuuaacuucguccucaucuccucccuaacccccuacucucaucucaaauuuuaccccuuaauuugagaagucaaauucaaugcaaacaauugauuucaugccacagugaggcugagaauuuaagcauggaaaacuuuaagcauagaguuuuucugggagcaauuaacgaaguguuggcggggggguugggagcugguacaaggaggcagaaaaauacggagacuauguucuucagacacugagcaucauaucuugauguugggggccuccuaugagcuugacacucagagagguaaagugacuugccucaggucacacagcuggcgauuggaauccaagacaccagcccccaaaccaguguuuucccugcuguguaggcuuuugugaccuaaacguggacuucccucaggcccucaggaucaccugguagggauaaaguuaacugcuuuugaaauugcuccacaggaaauaugaaugucuuaauaacaucaaugcugguucagcccaaaguuggaaaaccauuuaugaucuugcgacccugcaaaguauauaauuuuaacccauauugcagaugagaaaacugaggcuucgaaagggaaggugacuuguccagggucgcauggcagugcugggaaugaaccuucagucuacugccccuaacugcccucugaaagugaggacaucuccagaagaaaaaaaacaaaucuaacauaccacaaagcccagcuccagccugccaaggacgacgacauggugcugggaagccaagucagcauuccuguggccacauggagauuucugagugcugguucucagcccagcuugcucacucucccagcaauguucucucagagcucuggguuuuguauuaaaaagccaagucagacugauuucaaggugagaacucgggcucugcuacuggauccuacucccuggauuaaaaggccucauaugcccagagauggguacagcauggagauugcuagauuuggaauucuagauacgcaggcuccagccccagcuccucagguagcaucugugugccucugggcaacucacuuccccuuuccaagaucauauccagcuugcagggaauguuggguauguaagucaugggacagaacagggcugaguuugguccugagcuaggacacggugaggcacaagaacaggcagagggcaggaagcgcugcagagaugauggcuccagggcugaucucaucauggagcucugcgcucccagcccaggcuguguuuaggauggcgacagaagguggcaucugagugugagcaaagagggcaccaugccaccccacauguguagcccaacaggaugggaagggccugggcagaaguggguaacagguucagaggcaggguaggcacauaacccaacuuccagucuccgcauugcauuuucugcugagaagagagcugaggauagccaggauuuucuuaagcacagguaccagcuuaaacccuucgcaagcauucaucauaucuagaccucaccacugguaggcacuauugaucuccacagcuuaugggaggaggccgaggcacagagagggaacagaacugaucccaggucccacagcaaggcugccuuugcuaaagugagggccaaagguuggccaauccauuuuacaggugauugcgucuuaaucuccuuccuuaugaauagcuugauuucaagucuacacugugaauucugacaguuucaaagccugaaagaauuuuguuaugcaaacauccaauccagaagagggcuuuuggcugauuuacuguggcauucccggcaccuagaacagagcuuggcacacggcggaugcuuaaguauuugcugaaugaagauagcaucuuguucuggccucaguucaguuuuauuccucacaauagucccgaaaggggaauacaccccuuuuuacaaaugggcacauggaccgggaucaucacucagccuagucuucaccaguugggauguugagaagcuguguccaggggccucuucugagggaauucacagguauucaguuaaagaaagaaaaaggugacacaggaacaagaugcauggggccagggagugggauggcuggggcaggacagcguggggacacccacagguggggaggacuaaacaguuggaaagagcaagacuggagaguggaggaagagcgggcugagcccaggaggagccggaagacaaaaccaaggcucagcccccuaucucuuaggcaacacagugggagcaggacgcuagggcugcagaguuuggagucuggauucaaacccuggucccaccacuuacuuaaauugucuaagccucaguuuccccauuuguaaaaugaaaugauguacaugagaugucagagcaggucccucuacgcacgguaggccuucaaaaaacaguugcaguaucuacacugaggcugggacccaaccccugccucccugggcagcugggcccaccugagcggucugacuuuuucccagggcccaaagcccuuccuggcccaagaaucgcccccucuuuugaucucaaggaauuucacccuccacccagaggccuuuguaaaggccccgccuucgaccccauuauguguugaaaaagagucauaaggcacaauggggagugggggaggcuuuccucggccuccugccuuucugcugagaccugcguuuaacccuuucuuaccaagacugggcagggaagcagcccugggaggcccaccucgcaaagccuaaagggggcggcaggcuccuucggcuucgcgggcuccagagcuuugccccacagcugcggugcccacagugggugcccacacuuugacacccacgcggguguccucugucuccucccgccacgccccccauuccaagcgccuccugcccucuccuccucccaaaccaaacugcuuuagaccccaccgggucaggugggacgccugggagggcgccaggccacgaggccuugggguuggcagcccaggucucuagagcuacggcuaaggaggcaccaggaggggcucagucacggggcaccaagggcaggugcccagacagagcgcagggucccaggcagcggcucgggagguaggagacccugggacugcagggcggucccgagcgcgguccccugaguucgccggcuccgcgggcgccacguccaaucuccugucccgcccagagcgcgcgccgggagcuugggaugcgcgggaggacaggggcaggaccaauugcagggcgucccgaaugggcugcugugggcggcguggcgcuggagaccccggcccugccauuaaaguucaaccacggggccagcggaggaugcagaaggggauggaccacguccgcuggggcccuggggaaccagggcgcggggcagcgucgaauccuuaccugcgcagagcacuggcgaggguccguccaggcacaagcgcgugggagcacggagccaggauagcgggcgcggaguggcgggagcgcaacgcggcccgggccaccacccccgccgccuuauaaaggcggccgcggggcccgagugaggcccgggcagcccgcccccucc

SEQ ID NO: 21391 - RNA, 124877 nt, Homo sapiens
cucacaaucgcucuucacacuuuuauuguuaauucucuucacauggcagauacagagcugucgucuugaagaccaccacugaccaggaaaugccacuuuuacaaaaucauccccccuuuucaugauuggaacaguuuuccugaccgucugggagcguugaagggugaccagcacauuugcacaugcaaaaaaggagugaccccaaggccucaaccacacuucccagagcucaccaugggcugcaggugacuugccagguuugggguucgugagcuuuccuugcugcugcgguggggaggcccucaagaacugagaggccgggguaugcuucaugaguguuaacauuuacgggacaaaagcgcaucauuaggauaaggaacagccacagcacuucaugcuugugaggguuagcuguaggagcgggugaaaggauuccaguuuaugaaaauuuaaagcaaacaacgguuuuuagcugggugggaaacaggaaaacugugaugucggccaaugaccaccauuuuucugcccaugugaggguccgcaugagacccuucuccuagauccuuaucagaucccauacugcagccgauugacugacucauuaaauaacacaaguuauaaaacuuuaaaaauggagcauuuacagucagggacauaaauacgugcuuuuaaaagugucuacauacauauuuacagaguugcaagaucaaccguaguagcccugaaaaaaaaaaucccuuuaucgugugacaaaccgugcucaucagagcucccuccuuccgcucuggguuugauagcucacucuugaaauuggagcugagaaaacagcgcccaaguggucucagacauccuugccuggggucugccccaaaggcacaaaacccaagaaccucacugaacuggguccaaacgccaagcucagcucacccguuucuccgagacauggacugaccguccuccagagagcaggagucagccccguccgccccuggcaggauggccuccgaaaucucuucuucuucccccugugcuuuuuaaucuucccauuuuuuuuucauuucccaauuuguuuuuuuccuauugcagcuaauuugagaagcucagacacuaaagauguucauggucccaccaaguguggcaaugaagggcgcaggagaucccuccccuccauacaccguccccauucccugcccuucccaagggaggagauagaucuguaaguggggacaaagucuuucucccaggugcaccugaucugagguucucugcaaagacucaagagcaauggacugaugagaauuucaagucuggaaaugccucaagagccagaaacucagacaccuuaggcaaggaaggggguuuuccaugugcuggggccgaggggcauguucaggcucggcuccaacgugucaauaugcuguugauucccagagauguugccgggagagggaagguggggagagaggggugguacugaaggggaacucggccuccuccugaaggccuuccuaaggcugaccccugggucaaaccaaaguccccauaauggcaaaagacaacucaagaagcaaaaagcagggucaaggagcucuugaaaaauugcauaguaggagaggccccaccccaacaggaaggcugggcugcagaacacggucccaagagcugcauccaaguaucaucccaaaggacagcguggagucggcccccuuccugccgccccggggaucgggacccucguuugaagaccacucacgcgcccgcacgagaacacgugaacacacacgcacgcacacaugcacgcgcgcacaugcacucccuuucucucgcagccucacacaacugggauaggucgguacucccugcagggcagacugccagucccuuuggcuucacugauuccaggucacuucaggugcugaggagaaaaagaaaauaaaaauaauaacaguaagcacacauucagugccgaccauggugguccaugcguuauugcacuuaauuuuguaacuaaacuguuuauugaaacauaccauacauagagcaaaaagcacagcuugaugaauguucacagugaauacaccugcagagcuggcacccagaugaagaaucagaaugugacagccgcccaucagccccugacccgugaccccuuuaaggauacaugaacccucccgcccucgggaagaaccacuguccucaccucuaacagcauagacugauuucacccauuuuuuaaguuaaauaaauagggucaaucaguaaucuccuccugcgucuggcuuuuuccaccgaguguuugugagagccacccauucuguaugugugguugauguuuucaaccuuguuguuauguagugugcuauuauagaaagacaccaccucggccaggcgcgguggcucacgacuguaaucccagcacuuugggaggccgaggcgagcagaucaccaggucaggagauugagaccauccuggcuacggugaaacccugucucuacuaaaaauacaaaaaauuagccaggcaugguggcaggugccuguagucccagcuacucaggaggcuaaggcaggagaauggcgugaaccugggaggcggagcuugcagugaucccagaucgcgccacugcacuccagccugggagacagagcgagacucugucucaaaaaaaaaaaaagaaagaaaaagaaauacaccaccucuauccaucuauuccucugcugauccacaacugggaacuuccaguuuggugccaugugagucaugcugcuagaacauucucauaugugucuagaggacacguauggugcaaauacguaugcauuugugcugagcggaaaugcugggucguaggauguccauagauaacacaucagcauucucauagguauuuccuggugcacguggguacauaucugcugaguguguccccugcagugggacugcuggguccugagguacccacauguucagcaucagucaacacugccaaacaguuuuccaaagugauuguacuccugcuuaauuuccuuuggauguucacaacaacccucauggcaggcaacacagauccccauucuauaugaaagaaauggaggcucagagaggagaaauaacuuuuacaagccugcagaugaugagcagcagaggugagacuugaacccaggucaggcucacucacuccagcaucugugugcucuuccagucgggaggggauggcuguucccgcaugcuuccuccgcagaaaccacauucacagugcuuaguccagagcugagcacaugggugaauccuuaauaauguucacugcaggcugggcgcgguggcucacgccuguaaucacagcacuuugggaggcugaggugggcagaucacuugaggucaggaguucgagaccagccuggccaacaugaugaaacccagucucuacuaaaaauacaaaaauacaaaaauacauuagugauggugggugccuguaaucccagcuacucaggaggcuaaggaggagaaucccuugaaccugggagacagagguugcagcgaccugagauugcgccacugcacuccagccugggcgacagagugaaacccugucucaaaauaaauaaauaaauaaauaaauaaauaaauaaauaaauaaauaaauguucacugcauuggguugaauugggcugggccaaguucagggauacaguucucuugcccaguggaccuggucaccauuacuauuacuaaaaauaacuacugcuauuauuauuacuaccacuaauaauguaauauuucaauaauaauaauaauaauaccaguuguuuauggaaggcuuauugcauaccaggcacuuugcuaaggguuuuucauucacuaaccuaugcaaucuucucaacaaacccaugagagagguauuauuauuauuaacccauuucgcagaugcgugaauugaaacacagaggcgugaaguagccacugaagggauagcuccagacacugugcaccuaaccacuacgcauguucauuucaauucccugaaaugucugauggggcuggaaagggcuguuugcgggggagugggaugucuucaagagaggaggcaucccuucccagaggacgccugcuuaugcagcagacuggccugugugcccgugcccaugagccagggcagggggaagaaaaggaagcagaggcggggccggcuauggaguggcuguauucccuuggccuggcguggccagcaagugugggucuccccugggucacgugggauccauuaaaggagccaucuugccagucccccaccgagagggcagcccucuggggaggccacagcagcaggagcugggggcuggaccugagguggaggggagcucucauacaagggagaugggccgggaugggcgaccucuacaccccccacucccaggaccccaggagggagcgcaugucagaaauccugcccacagagggcccugaggccgcuggucuuagccaaaggagcagcaacagcugagagaaggaucacaaugguggccaaacaggugagaggcugucccuucccugggccucccgcugaaccccugggguaggaaagacacggggugaagacaggaugugcaaaggaagccucccuauagacuaggcagcacagcacuuuucugcacuuaaaagugaacagaaaccucugggcuuugugugagucacaguaaagagggugccacagaggcuggugaaaggcagggcuugccagaaaccaagcaccucuguguucauucucgcugcauucaaacuguccgggagacgggugacgaagccuugaauccggaaugggcaagagcaggcuaagcagccaaagccauggguccuucgagaaggccauccuuuuuucugaacaaaacccacaugcacacacaguuuugcaaggaggcacggcccaauuagaagucgaagauccgucccgggaaucagaagaccagaguguugaugccaguucugccacacgccccuccgugucaguuuccgucucuguaaaaugagggcuuugaccugcacacaccuuccugaacuaaaauacuuugcuguggcauuuucauaaaucuggagcuauguuaaacagugcuauggacugaacugugucucccuaaaacccuuaugcugaagcccuaaccccucccugugaugguauuuggagguggggccuuugggaggugauuaggcuuagaugagaucacgaagcagggcucacgaugagaugaguggacuucuaagaagagacaccagagagcuugcucucccccaggcccccgccacgugaggacacagcaaugagguggccgucugcaagccaggaagugggcccucaccagaaccuggcuaugguggcacccugaucugguacuugcagccucaagaaccaucaggaaauaaauuucuguucaauauuuaagccacacagucagugguauuuugugauagcagccugagcuaacuaaggcaaacaguauaaagagauuuuuuuaaaaaauuauuuuaaaaauaauauaaguagcacaugcuugguguaaguaccaauuuaaaaaauggaaaaaaagcuacagaagauuuuaaggagcaaguuacacgaaacugcugaguuuggagccuucguuguuggugagcaaacagagaucacaagaugcagaggcaaaugacguuaggccucucuucauuugaucgcuucgcuugggaaacuguauguuuuuaaagaaggaaaaagaaggccaucaccuaggacagugcuuggugcuggggcagagccuaaauucauaaggcuuggcaaaugcuacauacauuucaucuucgucauggccaagccugcaguggccaacagaaauggcccagucuguuuaggaagccagcccagcugcaccuggcucucccuccggcugcagagaacaccugcucugggguggaagcaagucccgggugcccaucaacacagaagguucacguagcagccuuggccgcaaggaggaugcuggacacaaaugguucccagagucggaauuguucauccuggcauggccucucacuuuccagaagacccuagccacguccuaugucucuucucuuggggccucaauuuuuccaucuguaaaaugggagguaccucucccagggccucccagcucuguacuaucuuacaguccauuucaacauuguuccaugagacuccagcucagggucaagucuccagguuccccucucagggagcagccggccccagagagacagguucaauuccagcagcagaccacagacucucugggcaagaguggauuuuauuuuugcuccccuccccaaaccccagaggaauaaagccaagccagaaacuccaacugcuuaagaaagagagaaguaaacagccgggagcgguggcucacgccuguaaucccagcacuuugggaggcagaggcaggcagaucaugaggucaggagaucaagaccauccuggccaacauggugaaaccccgucucuacuaaaauacaaaaaaaaaaaaaauuagccaggaguaguggcgggugccuguagucccagcuacucaggaggcugaggcaggggaaucgcuugaaccugggagguggaggaugcagugagucaagaucgcgccacugcacuccagccuggcgacagagcgagacucugucucaaaaaaaaaaaaaaaaaaggaaagagagaagugaggucuugggguuggagggcaggcagaaggaagaaagggucuucucuuccuggcauaauacaaaagaccucagaguuucagaauucagcccauucuugccuugaacuacacucucauuccaaacgacucugguugguguuuuaaccacugccucguguuaagcacacauucccaaaccuacgcgugucccagaaccagggggccaucugcuaaugcagguucccuggucacacccaccaggaugggccugugccaucaauacccacccaccaauacaagcagggcuguggggggugguggccaguccccucccucccauuaaccccguauucaacaucuguccugugccaaccacuuccaugcugggcaucucauaggggugaugugacuucccacagagauguaaacucaggauuugcucacugcaagcuccaccuccugcauucacgccauucuccugucucagccuccugaguaguugcgacuacaggcgcccaccaccaugcccggcuaauuuuuuuguauuuuuaguagagacagggcuucaguguguuagccaggauggucucgaucuccugaucucgugauccaccugccucggccucccaaagugcugggauuacaggugugagcgaccgcgcccggcugaacucgggauuuuuuaaugggguuuggcccuauucguacuauaguccaguaaaugggauuugagccuuuuuggccauuuuguacauuuggaacuggacucugaggucuguauuuauaaaagcauccuagaucuucugauguaugagguccucugaucacuuugagaugcuggccuuggggacacaaugaaugcaguuguguggugucaccaacagggagggccaagccugcucgugggucaccagcagaauccagguacuccaaaaaugaaaagucugguuuccauguuuuuauccaacagaaaucuuagaguaauuccagguuuuuaccaucagaaaaccuaggaagaggcuguuuuaguccaaaauaaaucugaguuuuauauuuuauggauuaggacagauuacauaucccuugucugaaaugcuugagacccgaaauuuuuugauuuuggauuuuuuuuggauuuuggaauauuugcacuacauacuugcugggucagcaucccuaauccaaaaaucugaaaccugaaacgcuccaaugagcauuuccuucgaguguauuuccuuugaauguccucacucagguucagauuuuggggcauuucagauuuuggauuuuuggauuaggguuacuccaccuguauuauuuugacuuucaaaaacauugugagaauaggaacucggucaucuuuucugggcuuaaugccucugaggcaauuaagaacugaguauaauuacuauuuuuaucauuauuacuccaauaaugacuuaccuagugcuuacuaugugacagacacucuucuaggugcuucgcacauuugacacucguaauugucacaaucacccuauaaaguagguccuauuguagugcccacuguacacauguggaaacugaggcucagaaagacuaaguaacuugcuugaaguucguagccagcaaguggcagagcugggaugugaaacaagugguccggagucugcacucagcuaagugcccuccuggagggaggcccugcaccgugccugguacacacaagcaaucacacccacugcuuucucuccuucccuccccacccaagacccaagcccacacccccuugacccacccaaacagugccagaagcuguuccauccugccucguaccugucagggagcagccagagugucuacucuuugaagaauggucccuggaacugggcugcagcuggagcuuugaccuuccuauacugccuggugauguacggggccgcugguggagagcaucgggacgccaagcggaggcuguagcugugcaggaagaggaacaacacacauugucacaggagcccagcccggugcccuagacauugcugggggggcuuccuuagugcuggucaccacuucccaggccaggauaggauugcacuuccuggacaccuugaggccaggugccuggcaucagcuaauaggacaugagcuuuaaccaccaaugugcacuucuccaugucccauccaccaauucucuccccucggaggcgaucgcagaagcacgggcaagaggaguguccauugggcugguucugagacaccaugaugggcagugccgucuggugacccccaguggacaugcaggugagccagaaugacuccgauugcaucagaacagcggcugugcccuucucugauuccauuuccccaccugccucccugcucuccccuccugccaggccccaacacccauaaggaaaaaagcaucuggggagguuacuauuaucaaaguacaaacacaccugcacaugggcuggguuguggggaauggaggcagcuccauugcccuuaaccccacacuccacaucuauccugugccaagcacuuccaugcugaguaucucacaggggugacguggcuucccaaagaggugaaucuaggaauuucgggggcaugguuuuguacuauuuguacagaaaagcacccccaaccaccgcccccaguaaaugggauuugauuuuuucagaagggcuuuuaaaaaauuuauuuaaaagauagauaacucacaccauuaguccucuccuuucgucacucagcuaacucguacuucucuuucauagcccagcugggaugcuaccuccuccaggaagcuuuccuucuuuaacuccugggugggguguuccuccaacaggccccuuagguguccccaucccaccugaauuaaaagcccagaauaaggugucugccuuucucaugagcucugagaucccaaggucaggaucuuuguccuguucauuguugcauccccagcuuggcacaauaaaaauaaacauccggccaggugcgguggcucaugccuguaaucccagcacuuugggaggcugaggcggguggaucaccugaggucaggaguucaagaccagccuggcgaacauggugaaacccugucucuacuaaaaauacaaaaaaaaaauuguccaggcguggugguggaugccuguaaucacagcuacucaggaggcugaggcaggagaaucgcuugaacccgggaggcagagguugcagugagccgagauuguuccauuguacaccagccugggcaacagagcaagacuccaucucaaauaaauaaauaaacaaacaaacaaacauccacugaguaagagugauacauacaggcucacugcauguccagaacugugcuagguauuuuccauacacaaacaaucuaacucuucacaaaaccuacccagguggauacuguuauuaucccuaauuuacagaugaggaaacugaggcacaaagagccugucaccugucuaccucucuagauggaagaauggaaagugagggaggccucuggacaaggcggcccaggucagaggaggugggaggccaggcagguaggaaagcaggagggacaaacacgcccggaacccuaccugcuccagguguuugcagagccagcucugccugcgggaacaggaggcgggaauggaguccagcucaaagcuggcacaugguagagcucacaugagugguucucaaucaggguacacacuugguaauguguggagacaucguuggcuuucauaccugagggaagggugcugcuaccggcaucuggaagguaaggccaggggugcugccaaaccuccuacagugcccaggacaggcccccgcaacaaagguuuaaccagccccaaaugcugacagugucaauguuggcaagggagcccucaaucaauauuaaaauaagcaaaugcaucaacagacaagcaaauguagaaggugcuggagaaaagccuuagacaagacuaagagaccugcuguugucacgagugagccucccccaagggccuggcucucugucaaggucagggcugccccuguuugaauuccuccccugcgcugugcagccaaggcccacggucagcucagucuacucgccugugcaagaguuaaggaggaaacggaggacccaugcuucauacaacugugcuccugacgggccaccaaggcagcuaguggccacccccgccaaccccauucuagcuggcuggugccccaggagacccaaccugggaggagacagccagcugggaggcugcuggagacauggacuccuguguccuguugggcaauaagaaacagagcuggcaaagagcagguccccucccuacgaugucccccuucccagggaaaugucuacagugguguagcaagaccagcagaagcuuuggagacagacaagcccugcaucaucaguauccagcuucucccuuucucugcuguuaaguauccaaaagccagaucaaucacacaaaaauaacaccccgaccucccaggccucucuagccagccagugugucuccgcucccuuuagcaucucuuccgccugggcuccugcggaugcagcaaccauagcgucuccaccagggggcgcgccuccuccccggcucagggcguccaucuggguggaacgaguaggucgggggcaaaaccccugaaggcagaggccccucugcuaccccucauccacugccuggccuaauggaggaccacggcagccaacaugaacauggccuccaugacucccaaggacuuucucaguuuucucucugaacccucccagcagcccaggagguaggaagaacaagugcuuuuauaccccuuucacggaugagaaaacugaggcucagacggauauggagacuuucccaggcgagcagagcccugggcuuucagcuccuuaggccaccauuuugaagaaacaccaggucacuaauuggguguuuccuguuaggacggggacaggaugucgugggggacuguccuuccugaucaagaagugcuucacugucaaagaacucaugagagcacagugcccccaaccccgagauguuaaauaccgaggaccaaggcuccggaauugggugcuucuccagggcacaguagcaguuagcgcagagccucaugauucuugguucccacccacuagcugugugaccucagugagucauggaccugucugaguuccagguugaucuucugcaaaucgggaagaccaguuugggguuacaguaaugauuaacuuuggagaaaggucuccgugcagggcauccuggcacuccaguagguaucagcacagugucgugacugcagcaguugcgguugguggacucauauggagaagucaucaccccaggaggaugcaguauggccgcuggagaccuggggguggccucuaauaauccucauucucauugacuguauggcccaggguaagccacucccugucgcucggccucggagccucgguuucccccucuguaaaauggagacagucccugccagccugccaacagagagcagggcuggaagcauuuuggugaccaggauugagagcacuuugcuuucugggaagaauccagcacaugugagaugcuccuagugggugugaccccaggaagcaucggagcaggaggugagccaggguccugacugguccuuaaagacugaaugucagguaagacuucugugucaacacuucggucagacuuuuggcucaaacuccugggcagggcuccagacccgcacacccacugccugccgggccccuccacuuggaugucuaaugagcaucucacuuuaacacggcaaagugggacaugcuagggucccaccuugcucccgccccuaccaggcuccagccacacuggacucuugucacucuucucaggaaauggcacugccaaacguguuguuguuacaacuaaagcccaauagcccuuuucuuccucuucuauucauuuugcugcuucggauuggccauagaccuagaaaccacacacauuugaagcaggcacaccaucgagcagugugcugugaucauggggccugugagaccccccgcugugcuuacccuaaagcugauccaucuccgggucccuuaauucugccuccagguccacacaccucucuccacucccauugccaccacccagcacaaccuguggcaucaacaccuuccacggggacuguggcaauugccacugcacuguccccacuucgacgcugcacccucccccccaccaccaauccauucuccacuaagcaacaagagaggccuuuauaaggaccaccggacaugaccacgacacuggaccacaucacugcccagugcaaaaguggcccaagccuucccacacagagugcugugcaccugcuugcgacccucccaguccccucacgcacucuguguucacccugugcacuugucucucagccaggccaagcucuucuuaccugguugcucccugccuggcuuuccccugcccugcccuccucugcccacagcucccucccaccuugugggucucagcuuaagugucuccugaaagaggccuucucugaccuccccaccuuaguggcaaccccagcccuguucccauagccuuuggaguucccuucugucuuccuucugucuuucugugacuuucugggccuuuugcucacagcuuuucccacagcaaucaccuugccugucgaguugcuuacuccuucaacacuagaagaggaugucuuugagggcagggacugagucuugcugacaguggaauccccuguguccccaggcacaggaccugguacaggaaauauuggguggguggguggaggcagccaugagggaugccccugguuugcagguggaggaaacauggucucaggaccacacacccuccccaggcccggccccuguccagggauggcagagcccagagucucuggcacaaggacagccugugcgcucccagcacugccuccaguuacaaggggaugccccaucagccagcagggggcgagcacagugucacaggaugcuuccuguggguuauggugauggcauggucacugugcaaguaagcguuaacgagccauugccucacuuauccagaggccccuuaaccuucacaauccagagaacagccuagaacguuguagaaagucugagccauccacaaccagugcccacugaucuguaaacucuuuuuuuuucuuuugagacagagucucacucugucgcucaggcuggagugcagucgugcuuucuuggcucacugcaaucuccaccucccagguucaagcgauucucccgccucagccuccugaguaccugggacuacaggcaccugccaccaugcccggcuaauuuuuguauuuuuaguagagacgggguuucaccauguuggccaggcuggucucaacuccucaccucaggugauccacccaccucggccucccaaagugcugggauuauaagcaugagccaccacgccuggcccagaucuguaaacucugacagaagcucacugcaugcaggcacuaaaauucaugccugggccugcagccugucccuaaggagcacaaagucacacagaacucaagcuuucagccaggugcgguggcucacgccuguaaucccagugcuuugggaggccgaggcgggcggaucacgaggucaagagaucgagaccauccuugcuaacacagugaaaccccgucucuacuaaaaauacaaaaaauuagccgggugugguggcgggcgccuguagucccagcuacuugggaggcugaggcaggagaauggugugaaccccagaggcagagcuuucagugagccgagaucgugccacugcacuccagccugggugacagagugagacuccaucucaaaacaaaaaaaaaagaaaagaaaaaagaacucaagcuuucacguucagugcacgcuguucuuacuguacacacaauucaaacgaauacggccgauggcuuacaaguccacagccaaucagaagcagcaaaaugaauagaagaggaagaaaagagcuguuagauugaggcaaauacagagucuguagcagacagcagacacuucccuggaagcgggaaaggagggcaaguucaaggguagggaaauacuaugugccaggccauguaugugccaugaugucccggguuccaugcaugcuuaauuucguccuuggggaaccugagaggucgacaaacuugagagagguuaacuguuauagauggaaccuuuguguccccugcaccccauucauaugcugaagcccuaacccccaaugugauuguauuuagaggugggaccuucaggaagugacuggguuuaaugaggucaugaggaugggacauucaugacgggauuagugcuugugccuuguaagaagaugcgugugcucgaaaaaggucaugugaggacacagacagaagguggcagucugugaaccaggaagagagccucgaccagaaccaaaccaugcugguacccuaaucuugaacuuccagucuccagaacugugaaaaaaaaauuucugucauuuaagccgccuaguccaugguauucuguuauggcagcccaaauuuuguuaagacaacuugcccagagucaugcuuggugagauuaggaucugaacacggggucuggaccacagccugucaucucugcaggugacucccucccuaggcgaugcauccguggcuuuggcguccacggccagccucacacagaugacucaccggcacccacgcccagcccacaucuggccuuugaacuccauucacgcacugacgugacaucucuuggacaucuagaaggccccuuaaaucaguuccugaacuuaaauuaugaccccaccucacgccugccacuccacccugcuccuguucuuggugaacagcacugcauuugugcccugaaagccagagaccugagacucaacacggucccuccgucacucucuccugcuacacgucaccugccacuggcuccaucgaguccgccuuccuuccucuucuaccacugucggggaccaccucucgccuggaguccugcaaggcgccuuccucacuggacuucucacuuccacacuggcuccccucccaucuguuccacagaagugugacggucuucccaaaaggcaaaacggaccacgacacgccccugcugcaaccugucaaaaccccauggcucccaggacgcaguccaaguuccuugauacaucaaguccagccugcacugcccucccagcccaucucuccccuucuguucuuguuuacuccagcuaaucuggguagaccccauuucccaguggccuguagccucggcuccucacuagauucacccagagaggccugggcugcaugccaggacaugacaucaggaucucuggggcaggauugggcaaugguauuuuuaagcucuucagugauuccaacaugcagcuggguugagaaccacugcucuggagaugcuucuguggucgcccucuugaggcaacauggcccuggucagguucccacaccggcccccacacgggcaguuucucaugcaucugcgacugucugauaaaggcaggucuccccagggggccguaaggucucugauggcagagcgugguugaguuuuguucaucauuguauucuuaguaccuaacugugcgugagugaauaauagacccucaacauguaaggaaggaagaaaugagcaauucaagacucugugauauucccacugcacagcuguucucagacaccaagaaaucuguucagugcaggggagggaaaauggacuuacuaugcuccccaagaugcuccuccauaaaaucccggcaaaaugaaugagauacguaguccucaauccuagacaucaagaaaggguugaacaaguucagcaucaacuguuuuuuuuuuuuuuuuuuuugagacagagucucacucugucgcccaggcuggagugcaguggugcgaucuccacucacugcaagcuccaccucccguguucacgccauucuccugccucagcccgccaccacgcccggcuaauuuuuuguauuuuuaguagagaugggguuucaccauguuagccaggauggucucgaucuccugaccucgugauccgcccgccucggccucccaaaguguggggauuacaggcgugagccaccgcgcccggcccagcaucaacuguuuuuagaaagcaggggaguguagcauuaccuugguaagauuuucauacacagugguugaacauuuuaaacauaguagcaggguugggaggaaccugcugugugccccacacaggcuuugcccagaagugucuggccucuggcaaagugugcucuacugccuacucuaggagggaaauuucuggacauuuuacuuagaacaaaaacuaauggacuuugaaagcacagggggaugucauacaccauccaaucuguauggacggggaaggauugggcagagggcagaccucaaacaccugguccacucccggcucauaggaaggcucagaaauggugccucagagcaucgucuccuggggauccuaauuucuuacuugucagaauuccuugcuagucugaagacaaugcaagggcauuaucuauacaauagaacgucuaauagaacaugucuagaaauagaacaucugcucuguuccuggccucaaggaugcauucauucuuucauucagucauucagauuuccaguggcccauucuugccucagggacucggcacaggcuguuccuggaacacucuucccccagguggucuuguggcucacucccaggcccccuuucaaguuucuguucaaaugucucauucccagugagccucgcuuaaccacuuuauuugaaaucacaaaucccccugauacuccccaucucgacucccuuuuacuuucugaguugugcuuauccccaucaacagagcugcguuuacugguuauuguuuacugucugucuagcaggcuccaugagggggcgcauuggaggcugguuugucacggaggcaccuccagcaccccagccgcuggcuggcauacaguagcagucaucuacuauuugucaggugaacggugugucuauucugugccaggugcuuugccaacaggaguuuuagugaauaaaacaagucaaguucucuacauauagcauaguuuuacaugucacuuaguguagccuagagaggaaagauacucauuucagaaggaguuugaugcccguacgaggccaagacucaggccuccuggcucccaaaugaccacauucuuauucagcccccagugguuuuggauaagggagaaauccagacacacugaaauauacaagagaaaaugaaacugaagaaacaggagugaaggucagaguggaggagaagacagggaaaggugacaugggaaacggcagugugugggcuacgaccugggguggggggaucaaucgguccggauacuacgccuugugcguuccaggaaguggggacaggaagugcaaaggcccugaggugagacccaccaggaaugucugaggugaugugggcagaggggagggucucauaggccuucaagugaggugucagucaguuguccuucugggcagaggaauaucaugacccaaaguggcugcugugcugggcacagaccguggguugacagggaaggaacuggggacaccagcaaggaggugacugccaccauccagggagaugaugguggccuggaccucaggucagcugaggaggcugagcugagagaagcuguggauuccgggugaguuuggggaucugcugaugagcuggauguggggauggaggaagagguuggagucuagcugguagcuggacuccaagcaggaccguuuccauucaucccacauagggaggacagcaggagagggaggcuucauggagagacaguuucauuuuggaaagauuaaauuugaaucuagacacccaagggagaugucaggugggcggcugaauggagauucugaugaggguggaaacccgggauuggucagcauccaggugguauuuaacgcaugugacuggaugagaucaccaagggggagcggagacggagcgaggggacagagcccagggauggaggcgggaugcgggggacagagcccagggauggaggcgggaugcgggggagcagcugguaaugugcagagacugggagagggcgguguccagguggagaguauuucaaggaagagaaggauuaacagcguccacugccgcagaugggccaagggagaugggacuggaaaccaaccacugcauugagcauccugggggcugcugauaaccuugguuugauggcuccucaagaagagccaaaacccugaaagugaguucaagagagaaggggagaagagacacuggaggcaggaacccagaggacgcuucaagaaggguggagggaaaggaguuugggagggaaggagcugccggcuuucagaggacaugggcucuccagggcuccaggguccccacguggccacggugcucuuccaagcucccugccagaccgccaugggcauccugggcugggaucucugccugcccuggucccuccuugcaccuuuuucucacagucuucaggagggaucuccugggacagccauacagaaagcugguuaggccacaucgcuggccgcagaagucuuacacaacucucuaaauucucagagugcaauucauuugaagucagugucugauauucugcacuuuugcugaagguaggggaaaggcagaggguggggagauggugcaaagguaagacaagccugugaugaugcugauauucccugggggcugggugagggcccacaggugggagcugugggagccaucggcccucagccaccuccaggaacagucgacauccacugcaggacccaccuuccccaagugggaaggcccacgugcuucaggaagccccugcccauucaaaugaagcccccagccugggggaagggcugagaagacagagaagaaagaagcagggcaggaacccaaaggaggaugggguggggauuccagagcccagagcuggaauccuagcuccauuacggacuugcuguguagccgcuggaaaaugccucuaccucgcugagccauagaagucuugccuguaaaaugaggaugucaggcaagggggaaaaaaacaucaucgcaucauccacugagcacuuucuauacaccaggagcuacuuuggguaguuuuugggagcuccucaaauucccagcaguccuguaaggcugggccugugaugguccugguuuuacagaggaggguucugaggcucagagaaauaaagaagcuggacacucaaguucccucggccaaguagagaagcagccaagauuugaauccaggaccauuugacaccaaagcccaugccccacucccugacacaguccccauaguagugaggauugaagaguuguuuccaauaucccaaagccaggugggggugagccuuugcccauagagcagcugcauugaccacucaagacucuggcagucuguuuugggcuggacccaccuuugcucagagggcacuggaacagagaaucucaaacucggguguucacugcaauccccuggggauacuaaaccgauccugaugccugcuuucuaucccaacaaguucugauuucguugguuucagguacagcccaggcauugggaauuuuaaaaggugucuuugcaggccacuggucuagauccuuguacucaaaaugugguccccagaccagcggcaucauuuccccccccggagcuuguugguaaugcagacucucagcucccacccacuccaagucagaauuugcaguuuaagaagaucccugggagaggcaucugcaugcagacgccgcaagagcauggggcugggggacaccuuuagcggcgucucaagugugggcagcaugcuaggcugcaguggccagcaggggcccguucugaagccuggagaggagcugcugcuugaugaaguucuguagacagucuccaaaugagggggccgaaggggagagaaugaacguaggccuuggggggcagggguaaagguuugacaccaccagcccaaggagucgcugcggugccuucaggugagacagagcccuugaguacagccgguggggacaguggggacaacacaguugaccaugaggaauuaguacacacuggcccaugcgcugucuucaugucauccucccuuuagucccagcagaugggcuguuauacccuuuuuauggcagaggggacagcaacacagagagguuaaguaacucguguacuuaagaggugugaauagaaggacaaagggagggaagauucacacccagaucugauuucagggcugaagucggccucagcagacacauuuuucuuccaucucaucagcccugagggaggccaugggcccacugcugagcccccaauguggccuccacgcucccaaaagaucaaucacgccccugcuuuguggagcuucuaagccagguucugagguccucagaggccaugaauuccccaaaccuguuuggguugaacucuaaauacccagcaugugagaagcucguaacacaugacccaguugauagggaggcuggcccggccuggccugcagugaccucggcccggagaaccugcccgcggggaaagcccccggcuguggcugccucuuuugcugccaagacccgagaagugcaggggaccccagaggccacagggaucagcccuucccuuacagacgaggaaaccgaggagagcgagcaaggcacucgcucacagucauacuccagguuguucuugggagcagugaggagacaggacuaggcucacugcuuauuuggggacauugaugaugggaagaaggguaguugaagcccccgaggacucgcugagggcacucagaucucuguaacuggcucuacccaccuggcucccccacuggacugggagcaccaggagagcacgguuggagucuauucacuucucacccaucgaaccugccacggggccuagcaaaggcuggugcucagagaacguuuccugaacaaauggauggcaaagccaggcuccuggugcgguucaacccugaaaugugccuguccaugcugcucaagaaccaaauccucccagcguggcuuccuauacgguuucucucauugccaaggucccgcccaaaccaggggacaagguccccauuuuuacgacaguucugugaaccuaacccuacagcccucaggccuccccagcccaccuuccccacuccauucagcacagggguucaagucuggagaaugucaccucggcuggaaacaccgucacugcccgugacacgaccagcccgggugagagaagcccagcaggguggaggagcgguuccuccagcuucacagcuuccucccuccucugccuucacaccucccaucacacgcuccccugcagccaccugguucuaggcugccccaaauccugucccuucuuuccucuccuguggagcugaaacauauugcuuucuucaaaaggcaacuucuaagaguaggagggaagccaaaaagaaaacacgaacacaaagugugugaagacugaugaacauauaaaaagcagauucccaacuugggaagcaagagaugauggucccuuaugagauccagcagaagagcccuuuuuagaugguaagauucuguaaggacacuaaagcuucauuauugccacuguuccaucuuuuaaagaugaucuaggucaaagaagucaaagggauuacauaaaccccaaggaccaagaaaagaagagcucaccccgugugugguuuggaguugcugggacugagagucucagaagccucauguggcaucugcccuggacccagaauuucuagaacaugaugccugaugcccacacuggacgacccggaaccgguccagggaugcuaacaaugagaggcagcugcucccuguggcgcccucugcuccugccucgaugcucaagaagccugugggagcuugggguucuuugcuacccaagaggucaaaaccagcuugucuugggaggccugggugugccuggcugacagggcgucccagaugcagggcuggcacugucaugggaaaggcacgcucacuuggugccugaacggguguuguucaacacggggaugacgcugcccaaaggccaagggcaccauggccuguggagcuggaggucucauccucagaaugugcccaggguccgggguugaauaguaaagucugcucuugugccuucuaccuuucugcucgugauccccaaaguccucaaacaggcuguaagguggccaggacgggacagcucaaucuaccuuacacacgaggagccuacggaggccugcaggugucagaugacucugauccuggcugucuggccccacccugggcugcucagaccuucccaggauccugcacuccauuuaguuugagaacugcucaaacagacacccagcccagccaggcacuauuuggggagaccacagaaugacggccagguggcgcauguggaaugaaaacucucccaguguuucuuccauguuaccagcauuucccgaaaccagguucaguggaacugguucccgcagacgcuguauuuguccucauaaucauuugcauaauugcagcuaacauuuccugcuuacuguguuccaagcacugugcuaaguguuuguuauggaauaaugaauuuaaucuucccaagaacuuuaggagacgggcacuagugcauuuuacagaugaggaacuaaggcacagagaaguuaggcaacuugcccaagaacacacagcuggcaggcggcagaacugggauggaagcccgagccauuuaccuccagugcacaggcuugugaaaccaaacgggcgugucucugcacaauuucugagccuuucaugugcugacaggcaguguaaauuccuaagaagaggagacagguugucaucuaccccaaacauauuucccuuaguuaucugauagccacugaccgcucacucugccaguuacuguggguuacagugcugagccaagcaaacauacgcugugaacgcacaaggggaauucugcaagggauggcuuugucaaagccuaucccuacuuaguuccaggagaguggccuccugcacagaagggcccuggccugaacccuccccuugcccccuccauaggaugucacuucaguccucgcucacgucgaugccccugccugcagugcccuccccaccacggccuccucuccagccccagggggcacuacuggaacacuagguacguggaggcuuuugacccaucugguuugaccuggugcuccuggagaggcagagagcaugagguuuagagucugacaguccuaacuccaccaccagcagccugagcgggucaccugcccccucaguacaguuuccuuuaugaaacgggccuaacgccaacuucguauagcuggggaagcauucccaacucugccugcauggugccuggaacagagcaggagcucaauggaguucaauccagagaggcucuuaugagaggagaccccccccaacccuccuucagugagagccggcccagcagcuggucacucaaagcagggagucaguauggguacauuuaagcauuucuuaauuagaaauagagggauguguguguguucaucaaccuuuuugauggagaaaaacacacaaacaugcugccugaccgcauuuuaaauucaugaccccaaaacuccggugggcucccagcgcauaugccuccuggcagcccuucucuguucccuggugccguucccuugauuacccacauggcugcugcucaccgucuccccucuuccuccacaucuccccauccucacccaccuccaaugauuucgcucccuauggcacacaaugaugguggaacaagacuuccacaguuugcgcccugccucccuucccagcugucuucuucuuuguaaggcgggaugcccccuccugagccccacuccucccaugggugccaggccccaucuucuuucauguaaucaaggcacuccccauuuccacuccagaagucucuauucccgcaucuguguuuuauuucucucccuagcauuuaucaucugacaugccaucuauuuacuuacuuuccugucuccaccaacuagaacauaaauuccguggaguaggacauugugacaguuuuguucccugcuauauccccuggcaccuaaaacagugccaggcauguaacagcaggcguaggccccgcauuuaugaaugaaugaaugaaugaaugaauggccaagaucugcacugccuuucuggacuaaaucacacccacauuacaucaucuguuaacuuccaguuuuuguuaaaagugcagagagaaacuaagacacuuauaaggggaaucugaguacaaaauccuccuaugccuuuaccaucucugcccuggucccggcacauuuuuaauuuucucacccacaccuuguuggacugcaauuuuuaagcgaauuacuaugugccuuucuaaguauucaacuuguuuuucauaaauagcucuaugcuagucauuggcuuguauaauauuuaauuagauugugcaagugugauaauaaauacaagcggcauaaacagguuugggaacaaaugcaacugaccuuuggcaugcauuuaacuuggcugcugggaauggaagcacacggacucucccuaugagcaguggucaggauuuccagaggcaaugaagaacaugcauuaauauuggugggucgcucaaacuaaagucagcuggguuucaacuguauguuuuauccacaguuggcguuccagcaaaaaaguucagaaggauuucugguccuauuccacuuuccaaggccuugugcuuugcaaaauguucucacuuuuuuuuuuuuuuugagauggaguuucgcucuuguugcccaggcuggagugcaauggcgcgaucucagcucauggcagccuccgccucccggguucaagcgauucuccugucucagucuccugaguagcugggauuacagacgcccgucacuaugcccagcuaauuuuugguauuuuuaguagagaaggaguuucaccauguuggccaggcuggucucgaacuccugaccucaggugauccaccugccuuggccucccaaagugcuaggauuacaggcgugagccaccgcgcccggccucacaauucuuaauucucuguucuuccuuaggcaauggugaacaugccggacuuagugacgaaguaaguggcggagaccucuguguuugccuggagugcuuguguuuguuacccuuugauccagcugacuaagucacauuacccagcagcucugacucaccacggugaaggagaaaucuccaaggcaagcgauacuguguugcagauccgguuuuuggaacagcuuuguuaacacagcccauucaaaugcacauggcaccaugaaacccaucaguguuuaaacccuaagaagaugauucauuauuuugagcaaaagucagaaaaugugcaaggaaagucauccauugcuauguauuuugggaggcucuacuagggaaggaucgauccccccauucccaccccuuaagagaugucaggugucaggagaugaaauucaagcuugguacuacagaaagggugacccuauuuucagguccaaaaauaggggaaaaagaaccuagaaaucugaaggaauaguugaauaguucuacccccaugauguucaguuauagucaaagacagccuguaaggacucgaaucuuugguguguguaccaguguagacugggaggggagacuauaauuccaccaguaccuuugaauuaauacacugugcuguaguggguugcuagcaguuuuauacuggucucuauggguuacugauuggcuuucauuaugcauucuuaaccuuaaggacuauccccagaggcaguaacacuaauuuuaauuagcuaucaccagccuuuucuuucggcuugauuuuaauggaucauuuaccuaugaacggacauucuuuguucaaucaccagcaguuaauugccccaacauucacauuuuaaaccaagagggucaugaguuagggucacauaaguaggucacugaggcggagcgguagcuuuggcucuauuauccuugaggauuucuuuuucuuuuucuuccacaaauacugaguuccuaccacaugcucaggccuacggugggugcaggugaacacacacaugcagggcgcuguguuggcgaacccccaauucccucuuaccuacgacacucagaaauguccccagcuccugagcugccccugacucaucuaucaccggguuguuauaagaauuaaggaaaaacauaauugaaaguguucugagaguugaaauguugcuguaaguauaucaaagagaugguaaacaagcaaaggaaaagaauuuaaaaucaaaaucagaagaaauuaagugaugagaugagugauaccaugucauuaaaaaaaguaauaauacuuuaaaagcccucugaagucuggguaagacucaugugacaagcugauaaaaaugaagauuucaaagucccaccccagagauuaugguuuaguaggucugaaacuuuuaaucacccaggugauuuuuuaauguaggugguccacugagcaaacauccuggggagaugauccaaacuagggccccaucacacacccaggaacacagacaggaaauggcauuuaaagcuguaauuaacaacgcaaaccaaaccgcaaaaugcucuuaccucgccaugugccacacacaacucggaacaacacuuuaauaaaacaccugcuguuagcuggcacucacgagcugugucuguaauuuuuaaaaaugcuuucaaaggauauaaaccuaucauuaauuacaauguugaaauaaucuggcacggcauauauuucaacuacaauaucugacaccaguucauugaggccuaucaaacaguuggcuccuacgugaagguaaaguuaacacagauuuguuuucacuaaacucacucguaaaauuaaaucacaggagccuaacauaagaaugaagacaguaagaguauaaaacucacaccuguaaacauaaacauuggccauuagagaaauuccaaaacaauuccagaguaacauccugaauccauaagagaaauccauuucaugggcaggucaucaaucucugcuaaagguagugaacuaccaguacuuccauggguuuguaaggaccagcucucuaaaacuaucaagauuaaaccacuuggcaccaaauagauuauuuauucuaaacauaaauuaaaggacauaggaugguaaagagaaggaaacucuuguuucagaacuaaggaacuucaccuggcaacaaauauuugcugagaaaggaauugauugcacuuuuacccaaacuuuuguuucguucccuccacaaaucauuucuuuaacucguguuuugggagcuuaaaagaaaaaaagcaguccauuauacgguguguuauacuuaauacucuccuaucuaggucacuugucccagcaacaucacuuaccagcacagaaccaagagccaaagucuauuguguuuugguuuuuggcuuucuuggagacagggucucacucugcuggccaggcaggaacacaguggugcaaucauagcucacugcggccuuggcuuccugggcuuaaacaauccucccaccucagccuccugaguagcugggacuacaggugugugccacuguaccuggcuuuuuuauuucuuguagagauggggucucacuauguugcccaggcuggucuugaacuccugaguucaaaugauccucccgccucagccucccaaagugcugggauuacaggugugagccaccgcaucuggucaagaccuacuguuaaugagugagcaaaccauguccacaaauccauguucuggaauuaaugcacuuugcuuacaagggagguccuugggagaucucucagggccaaccaucucuuuguuuacauaugauauuaacaggaccacaaucuagcuucccagcccacaauuaacagaagcauaucugaaggaugccaggaaguacagacaauauccaugagugacagauggaaaaggagaucuugaggaguacgcucuucucaaaagucacaucucaagcuucuggauccucuaguguggggucaggaucuccuauaugccagaaucaucuuuucuacaacaaaguauuaauugaugguuaccuugaacccucaaagaagggugaaauugaguccaguguaguuuuaaaaagcagaaaaguagcagacacaaugacaucacaggcagcaaauaccuggcacuccagaaccacucgccuuccugcauacaaggcagacaugggucacuuagccagcccucuuucccugagugugaacccagcuucagaauccaguucuaugcagcacccugggcaacugcucccccuacacaaauggaaaccugcuggucaacccuggcuuggaaagacuucugugaaaauagaagggggagaaguugacccuagagaguagguucauccauccucugggcuguucaguaucuagaucugcuccuucucuaacaaagcuggagggaugaggcuccaaccuugguaaaaacgaggccuggccgaaaccucagacaugcugguuucccaagaagauacaaaauggguucaucccaggaagaacaaagacauccauucacccgcaacacaguuuucagcuccuucaaaucugcuggugcuucuuguccagcagacaaggugcuuacaagucacauucuuugcugcuuaaaggccaugccacuagaaggcggcacaggggcgugaccaggggcucccuucuaccuccucacgccuagauccacagacgagagguagcacaaacucaugauuaagagaugagacagacugccuggacuugacuccuggcuccaccuccuaccaucugugacuucaggcaaauugcuugacuucccugugccucgguuuccccauuuguaaaaugggagaacaugaaauuauucauagggcucuuuugaagauuaaaugagguaauacauggaaagcccuuuauuuacaucguggccagcaagcauuaucggugaucauccuuacauuauuauuguuucagcaaagcgagguuauuugguuuucaugguuugacagagcuaaugaaaugcuuucuucuuaacuuaccuuuuaaaaauugacauugaaauucaaaaccaaaagaaauagaaaguuacagggagggggugauagaauaagaaugaaucaucuuuuuucucacuuugaauuggaaaaugauuucuugucuuacagcucacuucucuuuaguucugaugggugggagcaucugcuauaagaaggaagcagcucugguccacagaggaacagcucuggccuggcaaagacacagcaaagguccuuggugccacugguagccaaaccaggaguuacaggccacuugagagcuuucucucugggcagaggcaggagauaaugagggaauguucuggcuacuacaacucacgcugucaugaaaucuuauacauggcaugccaggcucaacuuuucaucagauucaaacugagauuagagaggacaucagucagucauaauagugaugcugacagcagcugacguugacagcacucacuggggugaacagcaucugugguccuuccaggcugcucuaaaguugucuucguggcaauucuuuguggucagauugauuacugcccuuccacagaaaggaaaacgggcucggagagguugaguaacuugcauagauuacgcuuacagaacuacacaugauaaagccagaauucaaauauuuuauucaacaaauauuuauugagcagcuacuacaugccaggcuccauucuauuaauagaugcugggaacgcagcagugaagaaaucaaaguuccugccuggguagaacucucaucuaagaagggggagacauagaguaaacaaacauaaugaguccauaacagaauguacagaaggcuuaagggucuugaacaguaaagcacagcaaguagagggaugagggaccaggcagugugacagaucgauggucaggaaaggcuucuuggaggaggugccagcugaucagccuuccagguccagagccaaugcccguaccuacauuccgcugccugucaugaaaacaguagaaccucaaccccggcuagugcuggccugcaccucaccaucucuucuguggaaugcaaguggccuucaggaaauucugaacuuggaauuuccauuucuauguaaucauggcagaccaggcugaacugaagcucugucucaacuugcauugcucccaugaggggcccuggucucagacugagaaaggcuccagggaucccaggagaaucaaugucuggagcuccccagguaccaagcuuguccgaccugcagcccacaagcugcaugcagcccaacacaaauucauagacuuucuuaaaacacuaacuuuuuuuuuugcgauaucuuucuuuuguuuuagcucaucagcuuucauguuacuauauuuuaugugugaccuaagacaguucuuccaacgugggccagggaagccaaaagauuggacaucccugcucuaugcucuccaugagccgggacucaauugcuccgcacuuaccuagauagaaaagaauacaucauucuagaagccuuuaggaguguuuuaaaaauucugacaaagcucuagccucaccaaaggauagaaccacccacucaugaaauuaauagaaacuuauguuucucaguucccacaaagggcuuuuuucucuuucagggcuuuugaaaagugagucguuucugcaacagccucguccccaaguucuuuagugaucaccaucauccaaguuccccacaugcugccccuuuccacccggggccggcuacuaagaccuggcaauuuccuuagcggugccucccuaggucuguuuuugugaggacuugagcaccugacgcggauuaagcguccacugucaucaccagcgccaccacagccaucagccauuggauccucacugggaacacaugcugccuucuguaacgcgcacggcauguggcagguggggggcacagagcuccccuacaggccaggaagcuggucacucugugggcagcaugcccugccacucaguaacuaacagcacccagguaaggaacaccuagaugggaaggcauucaaugcccauguucuucccaugauccuacacacacucucugcaguaaaacugcucucuggccaucagcaucucauuugggggacacaacaguuauguacaugcaagucucucuaaaacccaagggcacagugauuaggugguuucaaauuguaguugagcuuggcucuggaaccagauggcuggguuuggggucuccacuuguagccaugggacauaauucaagugauguugccucucuccgacucgguuaaucuaucuguaaaugagaauaccaucuccgucagaugugggagagcucaaaauguaaagcacucagaaaggugccccacgcgcuggaaaggccagugacacuccaggcgcauccucaacucccuccauggugguuagcuacaccccgaggguccucuaagagucccaggacaaaguccuucagaucuacagccugacacuuugaugauucagauuggcuguugaaagauguuuucugaauggcuggcugacugaaucacaacaggagaaugugccugaauucacaaguccaauaauagccuggaaauagaagccaucugaaaauguucuaaacucuagcuggguuggcaaggauuggaugcgauuauaaaaagcaagugagaagagaauguuaccgcaaggaaaauugaauccaugaguuuuaaauaacuucauuccaauaaaaaaaauuaaaguauauuuugggccaaugauuaaaugcuacgacaaauucaacugcuguacacugaaauuguuuuuaaguuaaaaaauuaaaauacccauaacugucuccuaaggccuaaaugcccuuuuguuaacuuaccugugccacaaauuccagguuuuuuaaagugaguccuauuuuaaauguacauuuagauuuaaugcuaagacucaguagauguaggauuccagauuguaucauaggcuccuguuuaaacaugaauaaggaaauauucuuagcuuaaauauguucugaaucagaacacaaaccugggcuuuaaaauucaccuguagcuuucugugguugcugaaaugacacuccaguucuuucuccccucacugaguaacucagguggcaccuaugaaaggguguucagaaacauggcuuguucuguugacuuccugccaugguuuauuagcuggacaugggaaggcacauuuaggcaccagucuuccguaaaauguuuauggucuccagaauguccaccugaauuucuauuuuaaaaaagaguugaaaagaaauccagcugacauaaggaaggcagaaaugcaggcaugugcaaauccuauuacccgcaacaggucgacaaguuuauuuuaauaaaaguauuucuggguaccuuuuaaugacucacaauuaaaugcaauuuuugcaacugcaaguaauuuaauguagagugaugaugguuuccucaauucuuaaucuagaaaacuaaaugaaaccuacacacccccuccagguucuaauccuauacuuuaaaaauaagguaucggcagaacguaaauaccuguuuguuuugcauguaacaaacacacuauuugcugaagucgggaggcagccuagaccaacuuucuuuuuggguuaaugcccagcagcucaagguucuccgccgguaucugaggagaugcuugaggaucccagggccuuuagaaucaucuccaaaaucaaaggguauuacuauaaugagcuuggcuucuguuaaacagucacguugccguugaugaaccacauggcucuauaaaagccagcuugauugaccugaacuaauuggucugugauggggguagaaguuuauuccacagugagagggaaacuaaaagcaaauggguccaggagcaacuccugacuaauaaaggcucgcugcaccaggaagauuuccuuacccacaaaugacuguuccacuuguucacuaaugcuuggaaaagcuuuuauggagaagguacugcguccuguuuucuauauuuagaagaaauaaaaucccuuaaaaaaaaaaaacccuaccuauaaaaacgauggacugcacaguguagcuuggaguucaaaucccaacuugccaccuuagaguugugugcccuuggaacaaaaucacuuuccccaaaucuguuucuccaucgguaaaugacaccaaccucaggcugucauugccaagacuuguagaugcucagcagaguacccagcaaacagcaggcauuggaaagccagacugaauccacccuaaagcuucucagaucauuuccaccaccacucagaggaagcggcacaagggcagaagggggggagggaggaagugacaugacccuguguagguggcagcaaggaucgggccuaggggccugggacugcagcacagagauccauggcaccaaggagcaguuucgcacuuuuuucccuacaugccacccacucaaaccucaaaccguauucaacuucuauuuugacauuagauguucugucuaaaaucuuaacggucacgucaucauucccaccaaucuggaccuuuauuuuucuuaucccauaauacuguguauucaagguucugcuugugaggcaaacccuucaggaaaggucaagccaccagaagggcaaggcccaagggggcuugggccuuggaaucaacauaagccagagagaaacuacacauuaggcccgugguuccuucacccucaaggcccaccaccuccucuuuccaccaaguggacacggcucaggauuggcuucagaauaacccugaugccccaacgccagaugcacggccccgccagccuuagaaagaacgggaaaacaauagugcccacuuugcaggauaauuauaaggaugccaugcagcacugcgaggccuaaagcacacacaauccucuagcaauugagagcuacacucaucuguuauucuucccauauuaaauucagaaauucuccugugcccugaauuuaccuggggucuuuaaaguacauauuacccaggcaggucccagcccuaaauggacucauuguagggccuuggaacuagugguuuugacaagcuccccaggugaaguguggaacccacgguguugaagggcagggcuuguggcuccccguuuuguuaagucuagcagaauggcccauccacaccugcaaggcccucgaacauacgcucaacagcagugcuucaccagaaccuucacugaggcugccugaagcggcagcugcaggaguggugccaucaggcaggaaagaggccaugagagcugggccuguaaaggcugacggggaacgauaaaccauuuucuguaacuaucagccuggucuuugaaacacuuuaaauguggccuuuauauccuagucaacccuuuucucauccgccugugcucuaauccacuuucaagguaaauugcccuuuaugauuuuuuuuauggauucaagucaauauauucaaagcgagguucaauaucaaaucaaaacccacaugaauaaaauaucaaaugcauuaagugagcuauaauuuuaguagagucauuuuaagcuaaguauuaaaagccggcagucaucuagauuacuggcauucagauauuaagcuagaagcaucuccuuguccaccuagccucuggggaacugugacagcgaggagguuuggaauaugaaguauaaaguggggaaaaaagccacuaugaaaauacaagccccacggaagucaggauuuuuguccauuuuguucagagauguauccuaagcaccuacaacacagccaggcauacauuaaguacucaauacauuaagcugguuuuguaaaauuaucuugcuagaaaguacuuguaacaacgaggacaagacagccagccuagcaaggcauuuaccagaaacacugugaaauguuucaaugguaacagggauggaaggcucuaauuagcuuuugauuuuuuaaaaacguuuaacucuaucaaagaagagccaaagcaacccaaacagggcagcuucucccuuggugagauggaugugaugugguuccuuggugacuccuccaguaaacaucugagucccugucauguuccaggcagagccagggacacuguggagaccgagccaucaucccacucuuucaguccagugcuugugucugacagcaucuugauccaggagaaaagaucuccuccuagagggcgcacucagaaaccagccagucuacuccccacuuuuugcagacugggaacuaugauccagaauguaaaggaacuugcccaaggcuaaaacacagaagacgcagccauggagggcgcuuguuggaggcccguuuacugaaggcacagggaagggaugaacggccagcagauggguuaggauggaaauccaguucucauccaagaccgugcucuuucucacaacacucaacuccucacagggcacugcuguguguugaagccucauuuguuuaaaacuacuaauaucgaagaccaguuccagauucccaccaaccucucuccuccguguuuuucuaagggaggaauaucguaugccagaacaucuggccaagggaagcuggcuaucccuucaccaccuuucccugaggagugacagacagaugugguuagcaaagugcuaugaugaugaacuauaggaaaccgcuuauagucagccauuuuuaaucuuaaaaaaccccagcaauuucacauaaacugaguaugucacaacuuuuugguuucauucuuuggaagcccauagaaauaaacaucaauccacaaacuacaguaaacuuuuaggaagcacagagaccccacagaugaaauuauuuuguauuuuacucuuacccgagugaguucacaagguacuucucggcaccguugucugacuacacguccacccucuacauagaaauccaacuggaaugagcacauauucaguuacugucaaauagaaacaagugaacagacgccaggugggcugaguagacgccgcacuuuuaaauuagagugcgggcucugaacaauccuccacacacaccuuguuuuacccccuaacugcucccaauuauguacaaaaugcaguccuuucacagauguuuagaaaguuuuuuauugguuacaauaauauaaaaugcauuguuuaaauucuccucuaguuauuaaguguuugcagcaauagcacaacaaaucuuuuuuuaauacaucugacaagccccaaugauuucaaugcugggaggggaaaaacaacaaacaccacucuugucuaucuauaauuaaccucucucucucucagugcuacauugguuaaaaucaauggacaaccccuuuuuguaugucaaauuguaaauuuuaauguuuucauuagaauagucuuuuauagcacucuccaaaaagaagcaauaaaauaacuaacagcaaaguucaauacaggagcacucuccggguuaacaacgccaacaaaaaaagugaaauguaaaucacauauaauacaauugaagcguccaaaacaauuuaaauaauuuuaaauauuuuauuuuuaaauugcuacaaaugcuuuauacaauauuucaacauaaaguccccauaacagaaauguaacaaaaugggaaugauaguggaaggauuaaaguggcacaaauucaccaaacaaauauuaaacuacaaauuuuucagagguagauuacuuuugaaguugagaacaaaaaacaguaugaauaaaaccuagccgcuuuccaccaacucagucauuaauuuagggggaggcauaaaauguaaggauaaaugauauuaauauacuuaggaagaggccaauuuguuguuuuuaaucucuauuagagaugcaaguguaaaaccugguaugcaaauucauuuauacuuacguguagacauacaucuguacaggccugggaugcgccugugcacugauauauugcuacauagucucugauaauauaauaguuauaaauuagugccagauaagaaucugagaggauaacguccauuuggauauacaaacgcaacaccagaauaggcauaaaaaagaguccauauccaaucugguuuccucuccauuacgcuggcaaucuacuugugauuuaaaaaaacgaaaacaacaaaaaaaagaaauaccagggguaagagaucagcuaaaugccucucucugucuauaauuaauuuaaaagaaaggcaucaagagcugauaugugaccaaaacguuuuaaaugagugcauccaaaucugucaucccugaaaccuacaacaaacuacugcuaaaacaggcaacuugcuuugcaagguuaaguucaaaucaauccuuucucugcuacgugccaaaaacaagggccaugcucagaucugagguaccagucccaugacgaggagccaguucaucuggccugucuuacagugcccuucucuuuggaucucaaucacccgggcgcccagcaugcgcguugggcccccaccgaagcagcagaugccugacucuaagccugccggcaaucagcugaauguuaggauuuuugagucagcuucaacuggucuugcaagcuugguagauuucguauccuuugccguagugcuuauccuaaguugagcaugcaauacuuuuuagucaauuaagguuuguuuuguuuugggggcuuuucuacaggaaguuccuagaaaauaagaaaacugaagauaaaugacaacagaacauaaccuuacaugauugaccauguuaaagaaaaaggugaauagaccguaagacaaauguuauuaagacgacaacacauacaugacugaaggcauuuaggaacgagcguccuacccagaagacacacccugcaaggaacuacacgcauuuauuuccaagggauguagcagagauggaggcaugagaaauuagcacuuuuuuuuuuaaaucaauuccugguaaauggaaaaacuuggucuagaauuucauuuugcuucucuaccuuuuucuugacugcgaugggaacucgguuugaaaagaaaaauguggcucuaaaagaagcauuaaagaacccaaaaacaccaggcacgguggcucacaccuguaaucccagcacugcaggaggccgagacgggcggaucauaaggucaggagaucgagaccauccuggcuaacacggugaaaccccaucucuacuaaaaauacaaaaaauuagccgggcaugguggcgggcaccuguagucccagcuacucgggaggcugagacaggagaauggcgugaacccgggaggcagagcuugcagugagccaagaucgugccacugcacuccagccugggcaacggagcgagacucugucucauuaaaaaaaaaaaaaaaaaaagaacccaaaaacaccgugggguuuacaaaggugaaagaugaguaggaggugaguagagaauacaccucuuuccuucccuuucugcuuuacuggagcccauggaaaugaacccuuagcaacagauuuaaacucagcacuccagaaagccauggcgagggguggggggugggucacuguaguaagagcugcagcaggagaaccugaaugacuguggcaugccugcuuuccuguguuuucuccuaagaaaaauauuuggagcacauggcuuuuugacaccuugucuggcaccauggcuuguguuccaggaaaugacccucaguguuaaguagaaaacucauggaaaaaucauauggcugauugcaagcauguacuugaaaaacuguggaauccgaaaguggcauucacauguaaaauaucugaguauggaaaacuagcucuuaaucacagcuuguuguaaagaaauaacacaggacaaggaugugcugccuguucuguaagaaaucccuguguacccaacaggguaaguaaagcaagcugcaaacagagugaaagugaguauuccucgacauguaauagaugugaugauuccuugugucaggaaucaucccuacacgaaauuuacaaguagaacuauacuuaaacagaaagacgacuguaguucaaacaacuccuuauuaguguaaugcaacaaauaugcacugaggcugaggccuccucucuacgagcccugggcaacacguuaaugacaaucaucauauuacccaggucuaaguuuaggaaucccaguuuugugcuaaacucacuacaaaguacuaagaccaaaacaaacacuuuaaagaaaugcccacuuuuguguccagauagucaaaaucuaucuugaugaacaucuguuuucuaauucccaagaacacaucacagguuuauggugacuugguaaguggaccccuggaucacauuccugaccuacagauguguccgcagcacaguuccagcaccucacacagaggaggaagagcugccaccaaugccugucauuaccaucuacgguuaggacaauaccaguguuuucuuaucugauucuucugugcuuccuuuuaggcaaaauuucacuccagcaagguaacccucuguuaacuaucaaacaaagcaaaauaaugaaaaugaacuggggcaaagaagagacaugauuuuuaaggcccuuuaguccuuuguagccuuaaagguuacucaaaagacacuggguagaggcuauuugaauaggccucauaaauuuauggucacucugacagcuuuucuuugcagaacuuaauuuuuccaaaucaacuuuaaccuugaacuguguaaguagggccaaguacaaaacaagcauuucuuuuagauaauacugaagacaaaagggauagacaguacauucuaaagcaucaaccgccugggagguguuuuauaguacaaucugugaaaaugaaggcacacucugcuuguugaagacacaagcaacuugaaaaggacucaauuugaucauguccuguugguguggcaccaccagaacacagacugagcacaaacaggugcacaauucaauuacuaaaggcaagcagcuuugacagcugauaacacaggugcuuauuuucagcagagcuaaccuccaagaugcuaccuauguaugugccgcggccagagaccgagcguuggucagaccuauggcaacuaaauauuuaacacauuuaugaaguaacuuuuuaaaaaucugauccauuaauccuacaguaaaucauucaaaucagccuuagcuaaugauucuucucuaucuuuagcugugauuuaaggcacaccagcauuaaaaauucuaccucaucaaucaugcagggcuaauggcaccucuguguccucgugaccucuacaaaauggcagucgcguccacacuuaggaucccuaauucugcuugcuuaaaacaccaaagaauuuucagacaccaaaagcuauagcaugaaagccuagagucagguggcauccugugaaaagacaagacuuaaaaguauuuugcagaaaugcuaucugaugaguaauuuucacaugagacugaacuauucagaaacagcaggaauuccaauacacauccacuucggacaaaggacucaggaaguuugagaauccaauguaacaaauuuaaccgcugcccucucuucaucugucacugagaacaguucuuaauauaggaagcacagggaauaaagcaguaaagucacuucaaaucuaagacaaauccuucuaucauuacuggggaaacaaaggcacugacaaaugaggcugacaugcccuggguaucacacaggccugaaagagcugcaaggguccugccuggaguuccaagcaugucucuccugcucugcuucccauccagauccugacuuguuuaccguccuacggcugaguucaggaggugggggacagugcauaagaccuuuuuaaaggacuauguuuuguuuugaccgaugcaaucaauuauuaaaauuuaagcauuggcaauucugaaagaaagugucagguacuagaucuaugcugaagucacagaaauauuaaacaagauuguaacaugguuuacuaaugaacuuagugacccgucuuaaccuaagaaauguucuaugaucggaaaauaagacacaugacacugagcuauuacccaagacauaaaggaaguuugagaggauugcaucuuuucuuagaguacuuuugagagcuuuucuauaguuuuaaauucaauuuacaucuggccacauuaaagaaguggcacugcuuugugaguccuaagucugaaauuagaacuauuuauucaucucuaaaagcagccaaagcaaugacccuucaugccuuuaacuuauacaacagcuauuuccuuuaaguggggaaaaaaaaaaaaaaaagcaacaagaaaccaaaaaacacccguaggcaaggauacugucgccuucccggucuuucccucccaccagcuccugagcuuaccugaaguccuucagcuccugcuuggcgcugccguccucucucuuguucucacucaagucagcagcagcugccagcugaaggcuccgggugacuggccccccacuccgcucucuagauuuuauauugaaccggucuguucuuuucuuacucgccaagguggauuugcuuuguaaaacagcuuugcuuuucuguacccucacgugcaggcuccgugauguuuugcuggaaagcugagcagaaugauucuuggccacagcuuuagguuuuuuccccucaacaugaguuauuuuggccauucuuaucgggcuggaguuccuuaaagaggaggagcuugguuuuuuggauuucaccgaagcugcaaacuugacguucugcuuggaccugaaggaugaggagggaagugggacuuggguggggccugagcugcgggcucuggucuugcccaacggagucugcaugcuuugcauuuuaaucuccgcauccgcuguccgucugcggugguugcuguuacuguuuuugucacuacuugcaggugaugaguguccaccuuucuuagaugaaugagaaacuuuuuuuuugggaggagaaagggguuuuuugggacagcugaaggcggcguguuuauucaggcuuccaauguaagugaacucucgauuacaguaagggcagaugugagaggaugacucacaagcauuuuucaagucggccuucugcuuugcagauuuguuuuucugaagaauugcuuucuguacuagcugauuuuuuuucuucaaugcauuuaauuugagcuuauucgacgacauuuugcugagcucaacacuaaaguuaagccuuuugggcugucccauucgucggaaggcauuuuucccagaguuaucuaaaaccaccacgccauuuuuggguugcacaguuuguuuuaaugguacuggguuuuucuuaggcguguaccucuucuugucacuugcagaagcacaagccaggauauguuugugcaacuccggcauauugucgacaccuuuuccacacuuugugcagcgaauggcgguagugaaagucuguggaauauuguguguagugaaauuuguggcugucacaccaauccccaugggguuacggugaugguacugaaauggaggugguuuaaagcuuggguaaugcugauugaggcccaaucgaacaucuggaucuuuugucuuuauuccagaagccauuauuuuuauagucguguaaagcucuucagaggaaucauuuaacuccucuucuucuuuagaaguuucuaaaggaucuucuggcaagcucugcauaugcucuacaugggccuugcugggaucuguaaaguucuggggccucagagucccgcuuucaaacucgugaugugugcacaccuuaucuggguggagaucucgcuggugcugcugcaaauugcacaaaaaagcaaauucuuuuuuacaaacagaacacacaaagauauucccaacuccaugaagcaaaaagcgauguucugacaaguccguuuuauccuuaaaaagcugcacacaaaauucacauuugaagggccauucuucagcaugaauagauaaauguuugguuagaucuuuaauggaaagaaaaggugauucacagacguugcaaacaaaguuuuuguugaauguuuccugaacaacaacauccuguucagcagcagacuggggcucuucccuggguuucagaccuucauucucuaauuccuccuguuugaaagauaucauggggagagaagccuccagauuaucaccagaggaaacaacagaugauauugcggagagaggagguggagaaggagaagaggaggaagaugaagaagaaaacgaagaggaggaggaagaugaagaggaggaagaagaaaguguuggaggcccgggugaggcggcagacaucaggggcuccacgggaggaaugggagagggagagggggacacuguuggggacagaauuggaaguggggacugugcgguggcauuugagaguggagaggggcauggguguggagaugcacuggaagagggggcuggaagagguacgguaggaaggaggggagggggcggaguggcaacaguuaauaccgggggacaggguggaggggaagagggaucuguggggaucaagagaggaggcagcugaccggaugaaagggagggugucugcagggcaggugaugaaggacaaacaucagguguggacucaacaguaggggcagggaaaccagagcccggaccgaggucaggaucuggcugagcuucuagggauuuacaaggacuugggcuccuggucccaucugcaggguuuucuacagguaaaucgaugccauuauauucauugagaagaaccuucugcagcaugcaggugguugguuuccuuuucuuuacagcacuacacguaggcugcacugaaugacuuucuuugaauuccuugccuucagagucacuacaaugcuuuuuaugcacacugagaucuaagacagauucccacuggacuggagucuugccuguacccucagccuucuguuugacaccgcuggauaaauccaguggcugcugguugcacacacugcuaaaagcagaacuagcuguccacucuuuagacauuuuauauucaucaaagcauggagggcucacaguuucucucucaucucucccagacaaacuccaugcuggugagucgcugugacuuucuaauuuggauuuuuuggaagucagcccggcaucgguccaugcugcuuucccaucacuuggcuuuccaaagucucgaagggcaggacugugcuguggagaacugggaggagagcugguccgccucuuaaaccuacuugaggucacaggcaacauugaugcaggagcagacacacaaacaggaccuaauuuagcuauuucaguugcugaaaucccugcaggaguuaguuuaucuuggguuugaagaaguuguuugagcuuugaugacaaauaaacacuuuucucuuuguggaaagacacugccucuguuguugauaugcuaagaggaagacuuaaagagcaagaggggaccauggggucagagucuguuucggccuuaauuuugggcagugcaggugggcucgcaguucuccgcuucuuggccucacuauuugugcugcccaaaggcucuuuaggaagaucuucuguuacagggaccuguguggucuuuauauuuugaguaauuuccacuguaacuggagugagcagacaauuuauaccauacaaaucugccgaagcagacuccaucucaaucacaucacaguuacuaguguuguuauuaguuugaauuuuaccaucaauauaguaauuuaaguuuucagagauauugcuagaaauguccaugauguacacaucaucugcuuccccuuccuccuccggcucugugcuugguacauacacguucuggguggccugggccuguucugcuggaggcuggggcucuucaaggccuccuuuucgccguacaccuuugggaaucagaugacguucgugaacucuacgcugaugccgucucauauuaguaugaguuccaaaaaccuuuuuacaauauuugcacggaugaaguucuuuaacuuccccauucucuucuacgacagaagaauuuauugugucuugggaagccuucucugaauucaugaucagacagucuggcccaagacugggaggacucgaaucaucuuuugaagcaacguuuucuccagaugcuuugccaucagccagauccucugacggcuguaguguuuggcuggguuuccgcuuuaacccugcuucauggcgccgcucaugucgccgccgguuaaucugugugccaaaggcuuucccacaguacuugcauuugaaagcaugauugacgguggauauauggauaugcaugugacgcucaagccccuguuugguuguaaacuuccuuucacaauguugacacggaaacauaaacguuucaaauacaucaccauuggccucuucuuuaguucuggggauuugcauggcagguguuaccucugagcagucuucaagaguuucuucugaaguuguuuuugguuccucuaauaaaucuucuggcuucucaucacaccguauuucuggcucuuucacagaauuuucauuuggcaugcuggcuucuucuucccccucgucuuccaacucaucaucaucaucaucuucuucuucuucuucauccuccuccucuuccuccuccuccucuucccccaaaucauucaccucacaagcugccgcuucuaaucgcucgucugguucuggcuguggcucccaggcaggggcagggguugcuaguucuggaggcaccuccugacuggccaccuccuggaggguggccggcugcucaagugcugaggcugaaggcuucucuucgucuucuuuaggaccuagaaagcacauggaagcagaagcauggaagugaagcaugggaaaccagcuacuuggugaacaaucugaaugauucaaguuauuucucuuaccaccuaaaacauaagggagaugaugaugaacaauaaauuacuucuacuuuauauacuuaauugacaaaguuguauuggauaugaauccacuucauucaacaaguauuuaggguaccagccacguaccaggcaauauucccggcagugaggacacacacgagcgcaacagacaaggauguccguguggagcuggggauuuguguuuaguugcacacagauacaacucuguugacagaaacuguaguguuuaaaaucguguuggaguagucacuacuacauuuuaggaguaguuguaaauucuaauuucucaugauuccaaacuggaaacaguucuuuaccagacauaucaccagguuagauccuuggaagucugucuggaguaaaugauccucucucccucuuaaauaaaauguuauucucagaagcuagaacauuuuccagaaucauguaaucacaaguuuuucaagcuagacaaucuuuggagaucaucucuucuaagccuagccaaguuauuaagaacucaggagcaucucacugaagggaacagaaaucugcagucacuucggagucccuaggccuagcccaccugaggugggugguagaaggcagucagggaaggacuugcuuagaaggugacaguggaggagagaccuaaggaaaaugaggcaugcaaauauugggggggggggugggaggaggagcccuacuggauagaggaacccucaaaaugcauaagcgcugagucaagaacauacuagaugcauucaaagaacagcaaagacaucagugaggugagguggggaagcugggcaaagugagggcaggagguaagacuagagaugcaaacaggggccuacuuacacaagccccugcaggcugcuggcuuuuacucuugagugaaaacagggagcuaccagaaagaucuaacggaaauauauaaucugacuuguauucaagagaaucacucugguuacuacaaggaagauagugaacccuaggugacaaggguggaggcagauggaaagauggggcccaaugcauccuccaggagaggcaggaugguggcacagggguggcagcagggcgggacuacaagugcucuggauauauuuugucaaugaaguugacaacaugccugcugacuggcuguggugagagagaagaggagauuccacgcaacugcaauaauccuggcuaauaaaacguuggaagaccacaagagaagcaacuguggucugugugcaugugcguguugugggggaaaucaagagcuuacuucagacgugcuaaaguuuaagguaccugauuauagacauccaaguaaauauauuaaguagacagcuuuauaugaaucuggaauucaacaaagaggcuggccuagaaauuucaaaguccuagagaaggccagagaagguauuuagagcacuggacuggaugaggucaccuggcaagugaacgcaggcagaagagggaugagaggauugugucccagaugacuccacgacugaggcugggggaaaggccagugagguauccagagaaccaagagaguggugguccuuuggcaaaguaaagaaacugcuucaaggagggcaugaucagcuguguccagaacuccugauggguuggauaaaaugaggacugagaauggaacauuccaucugccaaggcagaggucuugugauugugacagcaaguggaguaguggggacaaaugucuaacagaguuccuaagagaauggaaggagauggagagacagggagacuauuagcaacucuuucaaguuuaccuguaaagaaaaagaaauggagaagagacuggaagaaaacacagggacaagaggggauucuuaaagacggaagcuguaaucgcgguuucgugcuaguaggaaugguccccaaugcugcugucgcgacagucccacuugcugcacugcagaagcggaccccucuacugcaggcacuaggagaguuaagaaagguuccacggaggaggcagagcuauucugacuucuucuccaggcuacauuaccuggcuguucccccaaucacuugcaaauacugacuuagcacccacuaucugccaguacuagguaaacaagacugucacgauccuuacccauagagagcuucacuuuaauacaagccacacacaagcaggaaggcaacgaaacuguagaacauugauggcuguguuuauggaagugagugugguacggaagcaucucauauggguuugauuaaucaggaaaggcuucuuagagaaaggacuaagcagacagaaccugaagaauacaagaauuaaggacagaagaggaaaagcaagcagaaaagagucaaaacauagagaacacuguaaauuaauguggacuuaucuggggacaguggggagccacugaagguaucugaaagcaggagacugccaucugggagauucggcugcagggugggugaagggaugggggaaggucaucacuggaggccgaggagcaagacuggcagagcagaaugagaauggagaugcuggcugcugugcuaagaaggaaaggggaagaggcaguggaggcagaaaagagcagccagacccucacgaucugagaggccugcuacuggacauggggacugcguggauacaguggggaagaggucaaugccaaguauuacucauacaagcucacuuauucaguccuagccuccuugcuguuucccaggaauaucgggaauuacuguuucccaucugcuacuccauuuacuagcaaugagguuucuguuuccaaacagaaacagccuucucucccccuagacuaauuucauaaauuccaugagcuuuccacaaagugggaaaccagucauucgacaguaguaacauauuucaaauuaggagcuaccucucuuuucaaagauauuuucaauagagaccccgaauacugccaaaagaguugaaaugagacaacagaaaacgccaacucuaaggcucagaaauuuccuaacagacuuuauuuucagucaaaaucuguggcuucuuuugauggggaaaaaaugucuuuccccaugacugguaaacaaucccagauauaaaacuguccaaaguaacauaaaccgaagucugcacagcuccauuaacaagcacggcccaugccagaguggauccacgcacuuuauguggucucuggaguuuugaacauaaagggagguuugggagcacaaagaagagucugaacuguuugcucaugguauagaccauuugcugaggacaacgcagaacauucagcggaagccuacgacaccacuuugaccagcugugccaaauacuggggggugaagagcaagugucauuuuucuuuuuuuuuuuuuuuugagacggagucucgcucugucgcccaggcuggagugcaguggcacgaucucggcucacugcaagcuccgccuccuggguucacaccauuuuccugccucagccucccggacuacaggcgcccaccaccacgccuggcuaauuuuuuuguauuuuuaguagagacgggguuucaccauguuagccaggauagucucgaucuccugaccuugugauccacccgccucggccucccaaagugcugggauuacaggcgugagccaccgcgccaggccagcaagugucauuuuucaugggaccugauguugugucaggagaaaaauaauugucucgaauuacugaaggggaguaggugacugcugaaucuguuuucuaauucuaccgccaaagguagugagguuccuuaguaauuuuuguuguucaaaaaaaacucucggcacaccugcaaugaggaggcagaacuuagucuuaagacucugggaaaugaacuugacuauucuuguuucacagaaaauuauaucuuuuaugaauguuaucaucacaaacagugcuuaaaaaugguuaugaaaggcauccaaaauauucugguuauuuuccucuacaaauauuucuuaaaagagucacaaaccugucuucugaaauuugccuacuuggcucacuauaaacaacucaaguaagcugcaaucugcaaaaauuugcccauggcaaauuaagacacaccuccuucccuucuguaucaauagucucaauaugguggcccaacugcaaugagcagagggcaagcugucuuucugauuaacuuucaauccaugccucuugguuggauucuuacgucguggcaggccuagaauauuaucaccagagggacuauaaaggagaaaauuuuaaggggacaaacacgaagagacaaaauaagaauuuaaauuccaacaaaaaacagaaacacacuucauucuguauacuuuuuguucuguuauacaaaaaucaaagucucugacauuguaaguaaaugcuuaauuugaaguauaaaacguacauguauuaaaguguacaaauaguugaguauauagcaagauaaaauuuucacuaaauauauauacccaugugaccauuccacagaugaauaauagaaaacagcgagcaccccaggugccuccucauguccuugcuaucacuauuuuuugaugguuuugaacuucaugcuauuuuuaaaugcaaucauauguuucauuuuauuaucauuauuuuuauuuuuuuagagacagucucgcccugucacccaggcuggaguacaguggggggaucacagcucaauguagccucuaacuccugggcaccagugauccucccaccucagccugucaaguagcuagaacuacaggcacaugccaucaucuuagugaauuuucuuauuuucuuuuguagaaacagggucucacuauguugcccgggcuggccucaaacuccuggccuccagagauccuucuggcucagccucccaaagugcugggauuacaggugugagccaccacaccuggucucauuuuauuuuaacaaaggaacaaguucauuuuuaagaagaaaagucuuucacaauuguuugaagggaagguagcauauagaaggcucagcuuaccacauuaaauuuaggcagcuuuuuugcuguuuaaccucguaaagauccuaaaugauucucagaaggacaauauaaagagauacaaaguuaaauucacuggguacauacacacccaauucagaccaagccaauaucacaagcuuaccuucugcagaaucucucauauuugcagaggugaaaucuggcucacuugucuucaguuguaugucuuggauuuuguuuccuuuguuuuuauuuuccugggauuuuuucuucccugaaacacaauuuuuuuuaauuuauucauucauuuuuuuuuuauuuauucauucauucauucccucauguguuauucugaauuacugaagauaauuauuaauccaaucaagaacacuguauauuccugggcaauuaccacuuuggauuccuaaagaaaggaaugaaugaugacuguaaauacucuguuauauagguaaauuaugacagaggggaaaagaaagaaacacaucaaucuugcauuuuugagaaucuugggcauuaguucccuucauagcuauaaugacuaucaaauuaugagguaacguuacuauugaugucaaaggaaaauuaguaauagcauugaauuucaaugccacacagcuaauagggauuggcuauuuguaagaagcauauuagagaaaaacaguauguuauaacuuggggcccuuuuagcuaagacaugauuauccauaauuguuggaagcaaaacaagagaagcagagauucugcggaauuucaaaagauacacauucacaauggcucaaauaccaaaugcagaguaauuaugaauaauucacuguccaccagcauggcacucugagagcccuaagggaucugacuguagguccaguccaggucaauauuucauuaacaauucagaggauggaauucagaaacacugacugcauuccaagugauaccauacguuuacaagguaagauuaaauugcaacaucguucucauaaguuggaacaacggaacuaaagucaugaagauaagaaacaauuaucuauaggaguaauaauacugaagaagucagaagcccaguuucuuuaggauuuaaccagaauuugcaaccuuucuuuuacauuuuuuaauuaccagauuucuauuuuucuggaagcugguguuucagucuucagauccagacagauccccauucuuccguaacaauccuccuuuuucuccgcugcucucccccagacaaaccuccaccagcuuccagaacuacaagccucugacaccuuuuaucucugcauuaguaaaaucaaacuaaaaacgacuuaaagcugcuauauacacguaaaguuacauacuccauaacagagaaucacuaccgggaagcauaauuagcuaaaaauguaaacagacaaaaaugaggucagagacauaaaauagcaucauugaaaacaucuagauuaaaaguagaaacaucaaauacaauacaaagcaaaaacaaauccuaaaaaacaccaccagauuuugacaaaaauuugagacauaaccuuaacagucauuuugcuuguuagucuuaaaacguaaauucuaaaauaccauuuuaaacaccuuuuuuuuucuuuguuuuugagauggagucucacucugucgcccaggcuggagugcaguggcacaaucuuggcucacugcaagcuccgccucccggguucaugccauucuccugccucagccucccgaguagcugggacuacaggcgcccgccaacacgcccggcuaauuuuucguauuuuaguagagacgggguuucaccaucuuagccaggauggucucgaucuccugaccucaugauccgccugccucggccucccagagugcugggauuacaggcaugagccaccgugcccggccuacauaccuaauucuucagcccauaggaaauccgauguuuuugccacuacguuuaucaggguuugagcaaauaaauuccugauagccugucuauccauucauuuccaaaggcacuuaaaauggaacucaaaaaacgagcacacacuucaccgggaccacacucuggugauaacaagagugaaggaucugcauggagaugaccaacacacgucuccaggugaagaauuauaagccaauccccuccauaaggggcacaaacaucuaagcaccuuuccacaggcauaacguccucuugugacucuuucucccuuugucaacuuaacagcauuuugucuaaaucagauaaugacaaagguucuucagggauccaguuuuguuuaagggaauuuggauucuaccuccuuuccaucaguuuucuuaugcuuaugacauaagcuaguucugccugugugugaugcucagcccguauuagauuacugagagcaaacaaaaugcuuaucgcccacccacauccauaaugcaaauauaaugacuacugacauaacauaacuucucugugcugcaacugaugugugaggaaauucacggcuucuuuuauuaccaugugaagagagaguuccugguguagcccacagauucaaaaaucauauucagaaacuuuuucucugaacccaaacaaugacauuuuuauaagacauaccccucagguaaccccaaacaggccaaggaauguggccuuuuuuuacugaucauuuacuuaguacuuacuuaguaugagcuuuuaaaauaaauuaaaauggagagguguaaucuaaaccuucacuccuugcauaaaccucacacacauuuaaagaagggccacaguguaaaauuuaauagaaaaaccgaugucaauuucuuguaauacagucacuugcaaaaaaaaaugcaaagauuuuucuacaaccucccaaguguuguacaaacccagucuguaggucauauaaaaagccaaguacacuguucuacauguaaauagaguauuaaauaaguaaaaugucuagauuuauaucuuaacaaaaggaaguacaaucuuaauaccauuaagaugcacucaaaaugaaaucacauaacugucuaaaacauaagugcuauuuuaaguuuuauucccuaccuaaaagaauguuagagcaccuagcugauacuaaaugucaaauguccuuuauuggacaaacaaaaccuaaucagcgagaacucccuuuucucucuccagguguccucuuuaaaagccaugacccuggaaacccaauccacugugaggagaagccauuugcaguagguacaucuccaguaucuuaucagaggacuaaggaggggaucccgccacagaccacuacaggguaccaaggcgccucaaccgcagcaugaacgacaucugggccagaucauccuuggcuguggggugggcugucugaugcacuggaagauguuuaacugcaccuguagccacuauuuacuagaugcuaguggcacccccccuucuaauugugacaauccaaagucucuagacauggccagauguccccuggggagaagauuuccccagguuaagaaccacuggacuagaucaaugcauuucuggaucacacucgacggucuauacauguauuaaaaacuacaaaaaguacuugaauaacacuaauaagccaauucuaaaaauggagagaugaagaacuaaauuuaccaccaaacuaaauuuggugaauaccaacacacuuaguuuaucaaggaaaugagucuaucacaagucuauaucauucauccauggaauugagauuaucugacaccuggaacaauguucucaaucuucaugagaaccaucaguuaaguuacgucucaucgugagggccuuggacuagagaugaaggggcuauugaaaucaccuguccugccuucaauuuugugggagaaagugaaggccagcgccagaggggaaguaauuagccuauggcagaacagaaagcagaaccagggguccugcccacacauacacaggcuuggugucccucacaaccgccaaauauugcagcaacaggcgguggaaccugcuacauuuccuuaaaccaguacugauuucuucugacaccugauuucuguccuauaugucaucaaauuaaaagaaaaaaccaaacccauaaggacauuuacagaggggagauggcauuugugagcuucucucugugaggcagaggagcaggagccgcugggaggccuggcaagcacacaagugcacuuaccaucggguccuggggguccuacagggcgcuacugccagcuggcugcuccgcuuggucuagacaagaaagaggaaugaaacacaagggaagugaaauggaaaugaugacaaggaacagcagagggacaggacaacacuaugugcaugaggaaaagaaaugaauacaucaagaugagaaauugaauacaacagaaggaaaacagcaguuaucuacugcaucaaggugcucacaugccaaaaauaauguuuaacuguguacuuaguugcugagaauaagaccaauguaguauauucauucuugggccuguacugugcgcccuuauuguaaaacugaugccccugccacuuaauggaucaauuuugcuagaagcccccaaagucccaacgcauaaaucacuuuacaagguagacacccaaagggcagagaugugaaauaacuugcccaaugacacacgacuacaguagcuguaaagccagaaugaaaacucaagggccaggagcagugggucacaccuguaaucccagcacuuugggaggccgaggcagguggaucaccugagguuaggaguucgagaccagccuggccaacauggugggugaaaccccaucucuacuaaaaauacaaaaauuagccagccaugguggagggcaccuguaaucccagcuacuugggaggcugaggcaggagaaucacuugaacccgggagguggagacugcagugagccgagaucgugccacugcauuccagccugaaugacaagggcaaaacuccaucuuaaaaaaaaaaagaaggccgggcgcgguggcucacgccuguaaucccagcacuuugggaggcuaaggugggcagaucacgaggucaggagaucgagaccauccuggcuagugcggugaaaccccgucucugcuaaaaacauaaaagcauuagccgggcgugguggugggcgccuguaguauagucccagcuacuugggaggcugaggcaggagaauggcgugaacccgggagguggagcuugcagugagccgagaucacgccaccggacuccagccugggcaacagagcgagacuccgucucaaaaaaaaaaaaaaaaaaaaacucaaggacaaaauguuaaaaauguucuuucucuuaauaguuacuucuuaauaucaauaaugacuuaauaugcauacuuuuucuuuugagacagggucuuacucugucucucacucugucauucaggcuagagugcgauggcaugaucucgauucacugcagccucgaccuccugggcucaggugaucccuccugccucagccuccuauguagcugaaacuacaggcaugugauaccaugccugacuaaauuuuguuucuuuuuuguagagacaagaucuugcuguuguccaggcuggucucgaacuccugggcucagcaauccucuugccuuggccucucaaaagugcugggauuacagauguagucacggcauccagcagcauaccuuacuuuacaaagcacucuacagauccauuauuucacugguuucaagugcaagugaaaaaaguugcauaaagacuugcaucggccaggcacaguggcucaugccuguaauucuagcacuuugggaggccaagguaggcagauugcuuaagcuuaggggcucaagaccagccuuggcaacauagugagacccccguaucuaccaaaaaaaaaaaaaaaaauagaaaaaauuagcugugcguggugguguaugccuguggugccagcuacuugggaggcugaggugggaggaucacucgaccucagaaggucauggcugcagugagccaugaucgugccacugcacuccagccugggcgacagacugucucaaaaacaaaacaaagacuuaaacugcauuuauaguuuaaaaaaaaaaaagcaacaaucaaauuggaaugcuuuuuuuuauuucuauuuuauccugugccagaaacaagucaacagcacagaacccugaucugaacaaguaugauucaccacugaguaauaucaauaaaacuggauuuuguagugaaauaguuaccauacaaagacauucaacagccauaaugacuauuuucuaagacuauguauagcauuauaccacugaugccugggauaugaguuacaaaauuaaaauugccuaaagcgucacaugaaaaauuuaaccuaggucuggacuauguucuacuagccuaauaaauuggacagacacaguaggaaauucuagagaauaauguuucaccuuaaaauguucaggcaguagagagaaugcaaaauucugggagccuugcucaaguuacauuaaaaauucaucacaacagugaaggcucaugcauuuggugauuuaaaugaauuaaauuuaaaacuauauguaacucuagaugugcugccuccucacuggggagcuauccaacucugaaggauaaaaucagaauuaaauaucugugcacagaaguuagguccauccgaucuucacuuggggagcuucacaguugguuccaaagcagacaagacuccaacugggagauuuccacagcuguaccaugaauggucaucgaggacacgggcuucccaacagggcugauaccaacucaccaagguggguugugccugcugccuccaguuccucugcccuccaucaguccuucauccuugcaacugaauuuccacccucucuacucuacaggcauccaauucccauggcuaucacuaauaccauaauuacaaaacccaacaguucuucaggcuuuauuugccccaaguuucuccuucacauuugacaacuugguauuucuuucauucuuagaauuccucgucccagccuuaagacacuacuaucuagaaucucacccuuuugcagagucuuccucuucuuccugccccuacauaagagggcccuuccuaggaaacugaagacuggaaccaugcuuucacacuagguugaagaaaggcuuugacaaaagcauaugacuaagcugagggcacagacccuagggaacaggguagauguugaacucacuaugcucaaggcugagagaagaaccagaacacucuggagcaaaaagagccuugaaggucaucuccgucaccugcacuucagguaagaaugagcaaugcauuauaauauacagccuuucaaauuuuucaaagucaaaggugucuuucgugacagcaggccagcuguggcacuaguaucacucaggauacaucugguuuggaguaaaguuagaguucucaaagcaagaugaaaaggcuuaacugggaggagaaaaguauaaaguacauguuaaaugacuccuauaaaauuuuuaaaaauuacaaucuguaauagauuguguugguaaggaagaggaaucgauggauaauggcaaaguuguuaucuuaagaauggccaagugcaggccaggugcgguggcucacgccuguaaucccaacacuuugggaggccgaggcaggcagaacacgaggucaggagcucgagaccagacugaccaacacggugaaaucccaucucuacuaaaaauacaaaaauuagccaggcgcgguaccaccgcgccuguaauuccagcuacucaggaggcugagacaggauaaucgcuugaacccaggaggcggaggcugcagugagccuagaucccgccacugcacuccagccugggugacagagcgagacuccaucucaaaaaaaaaaacaaaagaauagccaagugaugcuaugugugagauggugaaggucgacuggaauuagaccucagcucugcugcauaugugccuaguaguuuaacguucuacaguuggguugaugauagagaggaagagagaagcuggaaauggauaccuaaaauuaaguuuuccauaaggaauuaacaguucauuucaauauucuuaauguaugcuuuaauguaagagaaugacuugguacucuggaagucaucaaaugucauuaacaaaagaacugggagacuugggcagaaggacugaugggggcaccagugugccucaaccagaaaugcuuucagaaagguuugcagcggggugggugugguuaucagaggaucacaaguggcuguuacaacuggucaaggcgcgaucaguggcaaagcaagccccauagaucugaaguaguaagacacugcaacaguuaguuuuuauaaaaguuaacaugccaugcauuuucuauaguuuccuuuuucacuuaaaauaacuuugaaacuuaucugacaguaaaaaauucuguuaagcucguuuggcauaauuucaaaucuuuuucugcaguuaaagucaccaagaacuaucuguaauccuggaggcaaauuauaaaaauaaaaccucucugguuuuagguagcucaugguauuaaaacacaacucuagguuuugcuuccaacagaaacaauggaaaaguuuuagauuuugcaguucugcagauugcaguauaaauuccugaaaugcuugcuucccaccaggggggcuguugcacagccucugcagcuguggaggcugcaggcuacccuaacucuuccaaaugucaggcugauaggagaauagcaaagauccaucggaagggaguccgagcuuuuaugcugucagaaaaaggcuuucagugguuuugacuggauaauuccacaucuuaagaaagggcuucccaaacaaacuucaccaaauucaagauaagaaagcauuaaguuuccuuaccuucuuuggagccucaaaaaguguuguggcaugaacaaaaugauuugggagaauaauuaaauauaaacaagaugcugaccuguucuacuucauaaucaauuucuagguuucuuucucacguuuuuuuaguagccugaaaaauguaccuaaaaucugaaaaccuuacauauaaauagugacgaggcaacuacaaaauaaagaaccuaauucaacuuauggacucagccccccguggcugaaaaaaccaaagugggagguguuguagaggaggugcauuuccaguaccuggcaacccugaaaacagaagagacagccacgcccucgagaauugcuuacucucagcuaagaagaaaaucauguuucccccuuuaaagcccaugacaaauuuuacaauacugcauccugaugaauuaacuacaacaucguuuuaaaauauuuucaaggaguaaaaauuugacauaaauaugaaacaagauacaaugaaaacacucaaaauucauucuucacauuugguuacagaaaugcccauaugaacaauggucaagccacaugacuaauuaaucaaaucaggcuacgauauauccacagagauaaauuuaaggaaaaucaagaggauauacauucagauuuuggcagguggcucccagugagagaguauugauaaggguaugauauuucuaucugauuguauuuucucagaugagcacuugguuacauuacacacaaaaaaaugaauacaugauuuuucauaaagaagacgccaacaaaaguaaaaacaaugagauaauugaaaauguuuuuauugguugagacaaaauauaacacuuuaaaauuuuguaaaauacgcaguuuuacaagugcuauuuggaaaaagccucuacuuuguacuuggccuagauggcaaaaaguacugcucaaguguuucucucuugucuacugccuacccauaaaacucaggaaaaccguucaggaaaaaaaccacaauccccaguaacaucaaacccacaauggacacacaguuauaaagacuuuaaagggauuaaaaauacaagagauaccauuaaauagccaaaaaugcuuagcauucaaauuacccuguuaaccuuuugguagacaucuuucaauuccaugcuacacaucaucacuucaaacaaaaaaaucaucuguuuccucuuuccaaacagccacauaccccauauucuuuuuccuguucaccgcacuugguucuuauacccaucauuauuuaaaucaaauaucuaauuuaaacaaucauguugaaugccugccaguauuaaccuaagggucgaugucuuggcaguuggcugugaucaucauucuuuaccucagccuuuauuuugcuucucuuaaaaaugcaaagacuaagcaacggcauuugaauaugccacauuuuagcagagguuuauaaaaacaagagcauuuacagagauacuaagcuaccuaaucacucggcccaccaugaaaugaggcacuuuuauuccagcacagguuuucagacucagcuccacugcugcugaucaaacagaucccacugcuguggaggaucucaacugugccccagccaccuccugccugcagcugugccucuaugagcacucacggaccgacacaucauccacauaaucgcaggggaggauguaaaguuccauccaccaagggagccagguaaagccgggaagccugaggagcgcgcgcuguggaccuggccuugcuaacaggcucuggcacugagaauggagccuuucagaagcacacaaucuuccuuggugcuggucuccaaggauuaucccacauuguccuugagcugaggcuuuucuauuuuuugccaauauagggguaaaguaaugaccacagggaacaaacugagccugggaggaaggcucacagaggacuagggcuugaaacaggaguccuuccuaggccagcguccaauggcugguggaaagggucucucaaccuaugcacucauuucaccugcucccagcagguuccugugucuccaagguuacucgugcucccugcaaagagcugacgcuaacugaggcgagacagugggcuaggcucuuguccccuuccccaguguggugguggcacucacaauaguagguccucaagguaaguuugguccacaaaaacagauacccauaaaagugaaauagcaugaaacacugcugcgcagcccuugggccaugauuugauuaacaagaaauaaucccauucgaggcagaugggaaccagcucugauauauacugguaauacugaucggauacuguugucaaagagaaguaaaugagguaaugcacaaaacgaaugccacacagugccuggcacagacucaauaaauggaaucgauuguaaggaguauccacagaugcuacuaaacaaauuacagaaagugcacgccuacaaaucuaaauugucggcauauguuccuucauaugaagacaauggcguucugcuuccacuaacaauuccuaauucauccauuuguuuuguucauuuguucuccgcugauucacaggaucccacccagauauuauuauaaaaauguacaaguccaaugaagacagaaguuagagagaauucugucacucacucacucauguccacaucaguauauacuaaugcucuaacaguguaagcugugaguguauuucauuuuuaaagucuguaaccuacugauuuuauugcuccuaacugucucugcuugaguuugaaaacugaacauacugguucacuguggugguucuuaaucuuucggagaggagacuucugaguaucaaguaacaccuaaggcccuucuccccagucacaaacggacguaaacacaacauuugguagacaacacugggggucagggacuccuguguuauuacaaaguuaagcugugaguuuguacaagcauuguguaucaacagaaggaauguaccugugcgacugcugaaaaagaacuccaacuccucagaaagcccagucaagaugcugcacagaucaucgggacauuucuucccggaaaacugguaucgucaaauuaauuagcaccuucuaagaaaacuguccuuucguccauuuguuuuuuuccugauuucacacccagaaagacuguaaaaaaaaauuugucauauacagcccugaaacugcucccacacaauuacuuucagggcugucugauaauuuaauaccuaagaaaauguuaagaaaaauucauucacauaaaauccucuuauaacugucaugagugcuuuggaccacauaaagguaagacgagcaaacagugagacguguuugcuucugcccaggcaaauggaacaaaucaaauuccaagaguuaccuaaugcaccaaccuaugucaccacagguguccucguuugguuaacagugaaacaagacagcuuuuaagagagaagcagguuucuugcacaugaagaauuccuuagugccacgauguagcuauuuaggugcagauccaaacaggcccuuuacucuuaacuaauuugaaacccacuuaauucacuccacgaugcaaaaggaaaauauauggauuuuaagagaacuuguuacacaagauggugaaacugcucauuuuuuuuuuuuuuuagaagugugccaaccggccagagaacggcaguuaccacagaauguauuuugcuggugcccaccauuacaaugggaugaaccaaagguuggugugccaggaauguuccuauaauguucucacuuaaugcucacagcaaccuuguaggguagguagcucauauucccauuuuauagacagaaaaauuaaggaccaaaacauggagaguaacccauccgaagucacaaugcaauuaacuggugcagcugguaugugaaucuggucucuuaauuccaaagcuauguucugguguaucacaauaaauucugcaugcugcacaucuccuaacacucaagguauagcugggucagcaacuuucccccucuccccuccagccaacauacacgcacacuccaggcucauuuuaaacaagcuauccauuuucaaaguacugaucaaucugcaucuaaugcaaaagcaacacugaagcccaagcaguauauucccacccacuaaaaaaaauuuuuaggcagguuuuuuuuuuaaugugcuuagcauagaaacugaagguagggggaagcacaagaaucauuugcuaugaaaacaaaguucaccaauuccauguacuuucugacaaucacccaugagauuuauaggauccugucuuuaaaacuuaaaagggucagacagaaauugaguaaguaucacuuuuucuugauuuaauauuuucugcacucuacuacaaccccaaauuuuaucuuggcauacaaacaguaauuuacauuaucuucuauccugaauuccuggauuuauaauaacuaaaaauagguauuaagcuuaccacucaaauuugaucuuaucaaacaagcccaugacccaccuaacaagggaaggacacuguggaucacaccuuuagcaauuaacaaaauuccuaaaaucaaguagauuuggaaucuuaaaccccugguccaaaaauccaagauugagaccacugacaacauaugauauuuauuauuauuauugauacuuuuuccuuauuuucuuggauaucaaagggaaauuauaauuucaacauuagugcuaauccuacaaaaauuacaguccaucguguguaaacagucaaggagauuguuccacauauaaaagaucaaaacuacaacuauuaucaucauggugcugcccacagcguaaaccugcuacagaagauuagaagacuugggacccagcuaugaccaacauuaacaucgucauggcaaaagcaccaagacaagagguggacaguaggaacucucauuucucacaggcccuuagacauucugcuuauggccaguaaucucuuuauuccagagaagcaggcucugauaaucccaaacaugaaagacaaaaauguagccaacagaaccagaaaggcauauccuacaucucaaacuggcaacagaaugaaaacugaaccugagaggccaaaugguaaaaagaauaacaaaaggcucagaaacugcauuguugcccauucuaaacggcauugcaacuucaaacauugcacauaauuccgucuugggguucuaaacaugggugaacaaaccaguuugccuucauuuuucuggcaugugguguuucaggaaaucuacaaaagacugccccaagagguagguuuauaaauacaagaaaaaagauuguuuaucgcuguaguuuucauuuaaaaaaaaaaaaaaaaaggguaggggaauuuuagccuaagcaaugcugaauuaguuuucuuuuuaaccggccaauccuuugcuacucuccauaacugguaacagacagcuaauucacuaagagugaaauuaguuuuucaucauucagacacugauuaaacuaacaagaacauauaaaauugaaagucaugaaaaguaucaaauuagcaguauuuuagauguuauauucuuaucuuauaaacuguuauuuuuauauaccacacacacaguaucauuaucuuauucauuagaauaaaucucuugccucugaaacuauucaaauagucuauuaaaaauaaaaaaugguauguacuuuuaauauauaagcaucuaaaauaacuacacguugacuagauuauuaaaacuuucaucaaaauauuuuuaaauuucaggaucauggccacagaagcaggaauagcaagcagcuacaauaaaugcuccagaacacugagaauuuucuagucucuuacccagaaucccuuaggauauuuucuuaauauacgcaccaaguuuuaaccuuuuaaacaaaguuaccuucuccuauuuuucagagaacagguuagaacagaaagaaaaaugcuaaagaccuuugaaaauugaaagcauagauuacaaacuguaguucugccuugccuacaguauguuugggugguuggggcggguguuaacuacuuacuuuuuuuuuuuuuuuuuuugagacaaagucucacucugcugcccaggcuggagugcaguggugcgaucucggcucacugcaaccuccgccucccaaguucaagcgauucuugugccucagccucccgaguagcuaguauuacaggcuccagccaccaccacgcccagcuaauuuuuguauuuuuaguagagacgggguuuuaccauguuguccaggcuguucucaaacuccugaccucaggcgauccacccaccucugccucucaaagugcugggauuacaggugugagccaccgcgccuggcuacgacuuacuaagucuuaacaaucaaauaaaguacucucaguaaaaguuccaaguagaaaaagccacauuacauuuggcuacaaacucaagcaguuuuaaaaauuuuauauagacauacauauucuaagaaucuauugugggauaaagacaaugaggaaaucaacgcgugccccuccuuaggaaaauucaagagcacacauggauagguuagggugacucuuuucaccuucuggucuucuuuaaugcuucuccucugguaugagucaagcagcuagaauaggaaagcuuuaucagcaaacaaaaccucuuaggaagguacugcuucaaauaguucaugugcauuccucuuaaaugaaaguuaaaaaaaaaaaaaaaaaaaaaagcuauccaccucugcaaauaaacauuuuggcaaaacaaauaaaaaacaaaaugucaccaccuaaagcugaaaagacuaacaagcaugauguaacucaauuauauccacaaacaaaucagaauugcacuuacaguuucuguaauuaaucuuuagacuacacauuaauuaaaaagcauguucauugucuauauaacauucagcuuaagaaaacuuuaaaauguguauuuuuauugguggaacaaccagacuguuaacccagucucaacacaagaccagugcugcagagcugacagcuaaagcuucucaucaauaagacaaaaugaaagagcucuauaauccuaaacucgauccucugcacugcagagggaguuaggcaaaagcaaugucuuacugugcucuuuugguuucaaaacuaaugccaaaauaauauaaaaccuaagagaaagaaaauauucauuagaaacuuaaaccaacaaauaugucauuuaaaaaacacuugaaagacaauagcuagaaagcaguaaaaaugcaaucuguguuuuuaaaaacuauuugggguguuugaaggaauacaauauaccuaugcaauccauaaaucuccaaagcaaaaacagcugaaggugucaccaugacuggucucuccuacaccaaacacuucacuuaaucauagucuugguauuuagaauuaaagugggcacuucuuacagugagcagugaaaauucaccuuggcuaguuaguaaagcaaauaaaacacugcaauuuauacaguauaacuguccuacuuagaaacaucaugcauaaaaacuggauuuagacagacagagccuuuuauuuaggaccugugugaacucggccaaagcacauaaccccucggagcaucaguuuccucuucuacaaaugaggauauggaucucaacuucgcaggauuauugggaggauuagcuaugguauacacagagcaaccaacauaaugcuagaaacgaguguaacugcugucauugucaccaucaacagaagugagcaauucauggcauaaugacaugaugugcaaauaagugucaagucaugacauauguccacaucaaaauacauuguaauaaaugaauucauccaagaacucuuguaauguaugaaaacugguuuaaucuggguggcaaaaagaaaaacagcuacuugcaguauuucucuuuuucacuuagagaauagcauuuucaaguaacuuuuguuucuccaugucauucagcuccucuaaacuauuucaaccaaauuaggaauauuaauaaaacacucugagccagauggauggucaaaauaaaacuucaggccuguacuuggcagcaugugaaauauaaacaagccaucugaaugccaacaaaguaccaugccagucuaccugaaacuucagcuucaguucaccauacaacauuuaacuaaaagaaaagucuauuuuuaaccuccacaaugguguucuugggauauuuauccaagcccucaauucuuuuuuuuuuuuuuuuugagaaggagucucgcucuguugcccaggcuggagugcuguggcgcaaucucggcucacuacaagcucugccucccggguucacgccauucuccugccucagccuccggaguagcugggacuacaggcgcccgccaccacgcccagcuaauuuuuuuguauuuuuuuuuuuuuuuuagaagagacaggguuucaccauguuagccaggauggucucgaucuccugaccuugugauccacccgccucagccucccaaagcgcugggauuacaggugugagccauugcgcccagccuccaauuccucaauucuuuagaggcaacuuuaaauacaaagcuacacccuguacaagccuguaauaccagcuauuagggaggcuaaggcagggagacagcuugagcucaggaguucgaguccaaccugggcaacacagaaagacccugucucuacaaaauaaauaaacuuuaaaaguuauuuuauugaaaaauaaaauaacuacacccuccucucuauaaugcucccacgaacauuagguuugaaugucguaacagcuaucuguaaacuggaacaugaaauugucuagggaaaaaaaaacacugaacgaguuuaaaaaaaaacaauaaaaauucaucauuuagaaaaauaaccuaguguucauauuuaaggaaaacacaggaaauuagguuuuuuacuuucaaauuauaaguggauuuguaaaaaucaacuaaaguauuuugaacuaacuauaaggaucuuguuaccucuuuuauauaguuuagaaaauuuaaucauaaucgaacuuuauuucuguauuaggcaagucuuaccuuccaauuuacauauggacaagagaaccaaaauaaccaccuaaaaauagggcacagcaugguucccaauacacucaauuaugauauuuaaaacuuuuuaaucauggcauauguuaggauuuuugcaaauccacccacuaaaauacagcuaaaaaauuugcaaaaugcuuugaaaaauuuacguuaauccacauaauuucccuguaaacaaggauagacauaagaaucaaaggcacaaaacgaaaauacugaccaacauuuucaucuaaauuuggagcaauucaguagcagcagcagaacugcaaauuuuuuauaauucccgaacuccuacuguugaaaaacuacuaauuaaaaccguacugagcuuuuaaaaacagaccgccaccauaacagcagcagaguucauccuggcaggcaaccaccagagacgggacauucaaugcucagcaaaggcacccucagcuaggaggcagccagaaagcuacagcagagacaggccccuccaagacugaccaacccagaaacagcucauuugugucucaugccacaagcuugccagcaaaaagccagacacaggaauacugccauguccaagcacuccacauccugcuccagcaccugcaaacaggaaccacaggccagugcccuauaagucagugggcacaggaccugcccaccaggcacccaguaggcauagggcccaucuaccaucauccucagacaccacagccaggccucugucauucagcuuagagccugaaacagagcugcuggcugcuacgaaagguuaggagaucaaacuccacggaagcccguccacucucugcuuuuauuaaauguauucucuaaguucaacuuuaaauggaaccaaugcugucacuucuguuguugucaacugcauguaggaguggacaaaaagcuccacauuauguagaagaaaaggcaugggaaaacugguucaaauucugacugugacacucauugguagggugaucuuggacaaguuauccaauuuuggaaaguguccuuuuccuucucucccacaucaaccagaacacccacuaagucugaccugugcguggcugucaugaaacggacuggagacuccgcacuggaggaggaugcugccugcuguagucaucucucucaucucccccaccaaccaacccagccacuuggugcagcgccuggcagaaaaagggccaauauauguccauuugcagaacugaguuucauaauccaaaaauacucauguagguuucuacaugaguagaacugcuaauagaacuaggucccucuuccuggagaccucagccccuagaacuuccugugucacuuaugucacaaccucagaauggucaccccugaucucccaccuacagucaggccauaccuccuccacccacccugcaaaacacuacugacaugacaagguuuaccuacuucaucuguuggccuguacuccccacucuccagaaugugauuccaugugaacagggacccuugucauuuuaguucuuugcugaaacuccagcacccagaauagugccugacacagaugcaaggaauacuuguuaaguaacagaagggaagaccauccacacagucacaacuucucaguccccaagguuccucuugauguccuccuccuuccucucucucuucugaaacauccccauccugccacucuuucuacauaaaggcucccuagccagcccagcccagcucagcaucccuuuuuccuucucuuagggagggucaauaguccuuacugccuauaccauccguguugcacuuuuuuuagacuaccuuagacugaguuaucuuugcauguggcugucuuaccucccuauauuuuaaguuucuaaaggcuuguuauuucgcaccuuuagagaagaauuucaaauauguacaauuucaaaaaacuugagugucgucacaguaccaagguuuuuaauuuaaacaauucugaucguagagacagauaaaauauuacuuugcuaagcugauuauaauuuaacuguucuguggugacuaagagucgcugagauaaauacuuauaagcuauagcugauauucucaggcacuacugacgguuuuuaggaaggacuaucugaaccuacuaacugaccuuaaggaacuuguucuuuauaauucauuaccgauuuuguaauaaacuuucugucuucuucacuauccagcuuucagguauaaaaacuucuugccgcuauaaacucuucucucuuaauuugcugugaacagcgaggucaauagguuagaaccuaaaauaagggugaaucagcacagaaugaggcugugacguaggagggaagagggaaagaagagacccagugcuuauuuugggcuuacacaggugcuccauaaauccccauugauuaaaugagucaccaacucaguaguuccuccgcaaguagcagggaaguaaacgccagccauguucuaaggagugguacuuacaguucccaagagcccacagcuucacagagcauguuucuauuaucucacuugcucuugacaacuuugugagguuagguggcacaagcaucaucgauaugaugauauucauuuuuaaggcuagggaaacuucaucucagaaaggugacaugagcuguccaagaucgcacaccugguaaacgcccaggcaucccgucuuuuucauuccuuccacuaagcccauuuguagaaagccacuguuguuucuccagguaaaagaacuucagguuaaggcucuuauguaacugagagagcagggaaaacacucugcuauuauaaucuacacucuggaagagcauuugccaacagucauugcuuacugcuaacaagcaaauucaauuucucauuucucaccaaaacaaacaggggacagaaaucaagaagaugagaaauacuucuaaauuugaccguuucuaugcuauuuuauaauuauaauuuuucugugguucacauuaaaauagccugaaacaccugacacuaaaaacccuccuugcucucuaccugaaagauuaaucuauuccaucuaaggaacuuauuuuccauuuuacagaggcugcucagauauguaaaaagugaagcucaauuacaaaucugggaauccaaauuaaaguccaguuuaaaaugcugauguauauccaucuuuggcccauggcaaaaaugcacgcuccaaggucgcagacaauaugaacuguguucucauagcacugcauucuuuuccuuccuaacacauuugugugagucauugccaaucaaugaauauuuauugagggccuacuacaugccaacugucuaggcacugaucagcuauuuacugauuuaacguuugucggcgccauaagaagagucgccgcugcuuuuuugcucaucacugugugcuacaacccagcagagugccuaguacacagcaggggcucaauaaacauuagaugaaugaaugaauauggggaggggaggggaggggaggagagaagaaaggugaugaggggagagagaaggggccacuacuuuguauauaaagaaaucagggcuuugcucuacccaaacacgccuuaugauccaccagcgaucugaugaauucugaaaggcaccacaugcaaugcacagcuguaaguauagcagcugucacgcaaaggagcugagguccagaacuaugaagaauucagcccuuuguuuuucucucugucucauaacgaaaaugaagucaagcccacugucaaucuaccugucggcucuauguauucaacaugcggcuuucagcaauacuaaguuaacacugccucugaaugacauuuauguugauucacucucugacaucacugccugaaaagauauuauuuaaauguuugaggucacacauaagaccuaaacagaacugaguuaauuaaaaaaaaaaaaaaagacuccauuucaggucuuugcaagcuauaaauugguuuuaacugaguauuuaauuuaaaaguaaaaaagguuugacucauuacuuaaacucuccaaaguuuaagucuuaaagagcaaauaggucucuuuaaccaguaagcuguuaaaaacagacuguaaguuccaacagagagcucugcauaaacauaagucuuuuaauuaauuaaaaccuaggauucuggguuauaggcugcccagaguaguacaaaauaauaggauaauaagaaauaugaacuauuuaauacgaaacaccaacagucuacgcagguauaaaaaugcagcuauuaaguucauauaucacuaauaaaacaaaaaguauauguucaaguuuuuccccaaauccaaccaagagaaaaauaaacagauaaacaaaaaagcaaaagaguaaugacauauguucuaaacaugcacacuaaaguaugccaaacagagaaaagcguuaaaguaagguugcuauuaaacuacaaaucuauuuaaguacaggaguuaguuaugauuaguggcacaguaaagaggguacuguccuccccaucuccagcccccuacaaauaacuuacccggaaggcugguaacauuaguuauaaacaaaaugaauacuaaauaaagaaacaaguugaauuacauaaaaaguuuucacuacaaacaguuaagcacuaagccuaauagcaauaaaaucccagaacucaguuaaaaguuaaaaaaaaaaaaaacugggaauuuucuagacucugaucgucugauucaggaucaaaagcauuuaaugcucugaagcagugacuacaucacauucaauaaauagacaaugcauauucaguaauaggccuacuaacuguuucacgggggaauuaauucuauuuccauuuuguggugacauacaaagaauacauacuugaaaaaucagaacagacuucuugccuacauuccuuaaugccgauuuuaacauuuucccaaaucgaguuuacgauaugauuuuauuuacaguaugacuuccacaacucacuuugcaauguucuggauaaaggauggacucguucguucagaugacuaaaaagaaaucuacuuaagaccuaaggagagcaaaaaaaaaacaaaaaaacaaaaaaacaaaaaacacaaaccuguauuuguaucaauaagaaacuaaccauacugugccuuggcauauuuucaaacugggaucuaugaacuauuccccaauucacauuaaaauucuucauuaaaaaaaaaagccccaacgugucaguaugcccacuggaaauaugauacagccaaccaaacuauuuuccuacccagaaauuauccccucccuuuuuaagugugacuacacuuuaccuuuuguucgaaaucaucagaagucguaaaacuaugagaauugagucaaaacgacaaaacaacacgcucucuaacuuccacaucccccugggcauccuuucggaagcccaccgcacccgcagucucccugcccuccccgccgccuccugucucugucucucacugucucugccucccccacucccacaccccgacuccgcgaccgacgcggcccgcguccugcgcggcgggcccgagucugcggagccggggcugucaagcuagccgcgagaaagcucgggcgcccgccgugcgcgcggcugcggagcgcggcuuggggugccagcgggggaacguccggccccggaacgccguccgcgcacuuucugccgcccaggagcuaagucacaaguuaagaaacagcccgagcgcgcggcggccgugauucagcagcggggccgggucggcagggcgggagggcagcgaucgcagggcccgagcgggaccgcagggcgggagcggggccggggcagggccgaguccggaaaaggucaccgagaugccgcgggcgccgccgcccgagcccgcgacccgccucgcggucgggccagcagcagcgagggcggcagggcggcguccugggcgggcguggcgccggggccgggcgggcgggccggggggcuccuaccuuuccggcucuugggggagcuccgcuugcuccgggcgcuggcucgcucuuccucaaucgcagcugcuaucucaggguugucuuccccauuguaccagaccaggagcuccucgcccggcgcgauuggcugcggggagagaagagacaagcgccgggccaaucagagcggcgguuguuggcgggggcggggcgcgcaccgggacgcgggcgggagcggcgccgauggcaaacagcugucggcggcgccgcgcgcacccggccggcaggaagggcucccggccccgugcgggccgcgccggcgcccggaacccucugcuggagggaggaccgcacccgcggcguggggcgaggggcgcggaaggcccggugacggguagcggagcccgggugcugucccaguuuccuguuuaaagccucacgacggcccacgcacgagaaaaaauaaaacaugggcccauuuugcucacgaaaucuaagucgaggagaaauguaaagcauaacugaaaagcgugcgguguggaaagcggagugcugaaagacaacgacuagcgcgcguuccagaccaagagcaacuucaacaggacaacgaggaggaaccacgcgcaagcacuuacaaaugcgccgcgguuucuaucccagagccgccaacgggaggccgcccggggccaccaaccugcucugguccagggagguccgugccucgcccuucggaccggacaucaaacuuccacauuuuaacuuuuaaauacagcaggaaguaucucccauguauuaugcuccuaaaccaucacauucuuaagccacguaugacuggaaguagugagggccaccaucaaauugauuccacccagaacaagaucccgaagaaaagauccacugagugcaaaguucacaccccuagaauuuggggaaacagccuauugguuucucucacaacaaaugaucuguuaaaaaaguuacaaggguaucaauacaaguaaaauucuaucuaaaacccacugaauaaaaugagaauccgugaguccagccucaugugaaugaaugaagaaaggaaggaaugaacaaguaaauaaaaaggaaagcucuuccuuaaaggagaucccaacuaaucaguaaaaaagaaauguuggaauuagaaaagcgccauuuggcaaucaucacaguaaugauuaauucaggcaagaaucauaaauggaugcuaaaaguagguaaaaguuugaggaguaacaaaacacauagccucagaauaucuccccauaaaauauuuauuaauuacaaaagaaaaaaaacaacacuuuuguaauaagacauaccaacaucauaugucuccugauacgaugcacagaaaacagagcaucacuucugguagauuucugcccaaaaugcauacgucgaaucuaaucaugaugaaaccauaagagaagcucaaacucugggacauucuacaaaauaaccaaccaguucucaaaacugaaagguuauaaaagacaaagacuaagguaccagccaaacacauaagacauaacaacugaauguggaaacguuuucuuuuccuacaaagacaugauuggaacaauugacagaaccugaguaagguguacauauuagcuaguaaaauaauguguugcuguuagcuuccugauuuggaucauugcacaaugguuauccaagagagugauccuuuuuguuuuuuguuucuuuuuuuuuuuuuuuuuuuugcggggagggagauuccaccuacgguuuagaaacaaaauaguuccucacuucaacauaccuucuagucuagauaaagcccccaaaagugaauauuacuucguuuaauucucugcagaacucucacugucuacacaguccaaauuuaaaaauauucuaaauucuuuaaauuaaaacaaggcagcuguuuccuuggcucucacccaccccuaagaaggcuaaaaucugccuuuuucuuauuuuugaaccaauacaugauuucccuucuugaaccaguuaaaucuaaccaaaaaacuuacuuuaauauauauuaauaaauuaaaacagccaucaagaacgccuuuuggcauucugaugaacuaaucuguugaaagaacaggcuuauguuaaaguaaacuguuucuagauuguguaaauuccaaauguauacuuucucuauuuuuuuguuauaagucacauauugaagugguaucaacuaauauuugaaaugacuagaguucucagaaauaugaaaagucuucaaaccaaugcaaaaaagagcaugggaaggagugaagacaaauguauuccccauauauucccccacugaaaugguauaaccagagaacuggcuagaagauaccaccggacauuuucaagauaccucuaagaauaagagcuuaaguuucccuguucacuccacugcaguugucagugaagugcuaacugaacuagcaacuuggugaaguuaaauauccacacaaacucuacuugggagggcacucauguccuaagauauucuuguugcugcaaaacacacaaaguaaaaacacaccagaaucuguaucacaaaucaaauauaaaauuucuagcacuggugaaguguuagaucaagaggaacacauucguuagcugcuaaacagccuucaaaauuauuagcgggcauaguggcucauggcugcaaucccagaacuuugggaggccaaggcaggcgaaucgcuugagcgcaggaguuugagaccagccugggcaacauggcgaaacucugucucuacugaaaauacaaaaauuagcaaggcaugguggugugugccuguagucacagcuauucaggaggcucaaguaggagaaucacuggagcuugggagguggaggcugcagugagccaagauugugucacugcacuccagcccacaagacagagugagacccuaucuuaaaaaauaaauaaauaaauaaauaaauaaauaaauaaauaaauaaaaacaaguaguagaaaacaaaacaaaaauuauuagcaacuugaaaugguuauauuacggagcgauauaugcuucgcaacuuuauauuaaaacagcuacaccaauagacccuaugaagaggaaaaauaauaguauuuuuuuuaaaccaaggcuuguuuucuuccauauuauaauauauugguuuuuuucuucuguacugguuagcauuuuuaagucaaguucagaagaaaagaaaaacuacucccuucaacaaaggaaauauaaauccacauuaaaaaaauaaagucaaaagaccaaacaaccucuuuuuaaauauauuuuaauauuaaaaaaauuaacaacaacaaagauuuuaaacucuucccacuuucucuuuggguucaaacagguauaaaaccaagaaucugcuccauauucucuccuuuaaacaucagcauauauaaaauaaaacuugaaauuuuaccaaacaaaucaggaagaagcaagaguucuaauauuccuuauacuggguaaggaauauuagaaaaaugugucagaaauauuagaaaauuagagaaguauuccagaaucacucaaacacacacaguacauccacucauacccaccuacgauccaguccccagcacggucuuuuaaaaaaucauaggucagaucucggccucaacucgccagugggugaacagcacuuaagccuaaaacucauccaucccugcagaccucaacagccucaucuccuaagauuccucuccuccucccuacagccacaugggcuuuuguucuauuccuuuaaaauaaaaaacaaacaaaaggcugggcacgguggcucacgccuguaaaucccagcauuuugggaggccgaggugggcagaucacgaggucaggaguucgagaccaccugaccaauauggugaaaccccgucucuacuaaaaauacaaaauuuagcugggcaugguggcaugcgcccauagucccagcuacucaagaggcuggggcagaagaaucgcuugaaccugggaggcggagguugcaaugagccaagaucacgccauugcacuccagccugggcgacagagcacaacucugucucaaaaaaaaaaaaaaaaaccauuagcuuauuccuacuccaaggucuuugcuccuaccacuccucuuccuggacuguucuuccagcagaccuuuugcauggccagcuccuuccuauccaaggagugggguucgaacgucuguccucaggaaggccuucccugacucacuggagacaaagcagcccucuccuaccuagcuagucucuaucacauuucccugucuuaacacacugaucgcuaccagaaauuacuuucuuauuuacuuauuaucugccucuuccccuauaacacgaaacauccuccagaccagagaccuugucuguccuguucacuacuauaggagaguacuugguauacaguagacucucaauagauauucaccaaacuaaugaacagagaaaugaauagauagcagauuuaacagcuaacuuucaggaauuuuaaaucauuucuaaucauauuacaaacaaaaccaguguugagauuucccaauuaucuggguauaauaauaaguugagaagauacagagcccacagagcagcacauguaauuucuucacaaagccuaacccacgggacacuuaaucuagaagaauagaguuagauaaucacuaguaaaaaaucugaaaggcuuuguacauacuugagcagauaucaaagauaaagacugggggaggucugcaaaaaucagaacuauguuauuucggacaaagguaaaaauaauaguacuaguauagcuaguuaacacuugaggacuuacacugaacuaagaacuguucacagaaccuuauauauauauauauauuggcuuguuuaaccuucacaacaaacuaugaagcaguuuuauuauuaccuccacuuuauggaugagaaaacuaagacacagagagauccuuugcguggucacauaucuagaagccaaaauuugcucacaagucagucugcuccagaguccccacuccugaccaugacaccauaccaccuugugaaaaauaacaacaaucauguauaagcacuuacuaggugcuggagcucuauccguauucacccaugcaaucaucacaacaauccuaugaggucaauaccauaauuaccuguaucuuacaaugugggaauugaggcacacagaaggacuuagcuaagguuacaaagcuaauaaggucacaccuacuugccuugggucacagcaagucaagaucuaacccaggcagucuggcuucagaguucacucuccuaaccacuauucuaucuugauucucaguguuucugugaauuugcaucagagaugaacacauuuuaacuugaaguacaaugaaggaauugcaguguccuaauaucuacaugagcuugcaugccuccaaaacuuccuuccuauuaccuugauugucucauauucauccccuagcuaguauuucaucuccaccaggauucaaccucacugauucaaccauauguauuucuccuuuaaauacuucugagaaacaaugcauucuugaauccaacuucacacuccuauauaagaaaauuguagaguaauaccuacuagaaaagcaugcuacuacgauccagcagaauaaaaauggaaaacaagguuuuuaaaguccuaaauaagaaaguguaacaaaaaaucugcagggacuggauacaaggaccuggguauaaaugugauaaaaggcagucuaguuggcuaacaaugucaggaaagaugcagcaaaauuaaacagcuacagguuaacuaaacuucagaaggccuacugccacuacacuaacaaaacacagcacacugcaaagcuggccacaauuugaaaugugugcucaucaaaaguguucaacuccauggagaucauuuuuuccauagacuauucuccaaccuaugacauuuuuaauggaaguaagugaauaaagagaaacuugccuuauagcaauuuugcuaucuauugcaaaaagcaacaaccauccaucuuaacaggcuggaaauucugccuuagaauaucuccauguauaaugugaggaucugucuuuuuuuuuuuuuuuuuuuuuuuuuuugagacagagucuugcucuguuacccaggcuggagugcaguggugugaucuuggcucacugcaaacccucccucccagguucacgcccuucuccugccucagccucccgaguagcugggacuacaggugcccgccaccaugccuggcuuauuuuuuguauuuuuuaguagagacgggguuucaccauguuagccaggauggucucaaucuccugaccucaugauccgcccgccuuggccucccaaagcgcugggauuacaggcgugagccacugcgcccguccggaucugucuucuuaaagaaugugacccaugaaaaugagggagauauggccuuugcucaacaaagaaaugcagcaacacuccacgcuuccucacacucaugucccugaaugugcuccauaaccucauuaccaauccuaaaacaugacuuucuucuucuuuucaacaauuaauaucuccaaagaaaaauuuggcagaaaggaagaaacauguucuguucaauuuguauucugaguaaaauuuagggaaaagaaaagcuaauccaaggcugcauuaauaucagagacuaacaguguguauucaguuaacacagacccaccauaccuacugauaguuucuuacaguaggauaaaucugccagacaguuccuaaugccucugugucauaggagaagggaagcagcugccacaugcuuaacucaucaguaucuuucaagaugcaguguguaauuacuuaacacgaucuucaugcuuuagcuccaugacacacacagguaaccauauauuaaaacacagaaccuuaagaguguggauaaagcacuucccaauauaaucccucccaggucugcaaagucauugucagucacaacuaaggacagcauuagaaaaauauaagcaggcccaggcauuguggcuugugccgguaaucccagcacuuugggaggcugaggcagguagaucgcuugagcccagcaguuugagaccagccuggguaacauagcaaagcucugucucuacaaaaaauucaaaacucagccgggugugguggcaugugcccauaguccuggcuacucgggagguugagguccgaggaucgcccaaggcuggggaggcuuaggcugcagugagccgugauggagccccugcacuccagccugagagacagaaugagaccgucucaaaaaaagaaaaaggaaaacacaagcagcguaacuaacaguaaauuaauucuaaugcuguuaccuuuaaaguuuuauaguaaauggcucuguugauuuccagugggaauaaauuuugcucuucuccugagcaagcccaauucacauaucgcagccaguuucccuucucuggaucaguggcaucaaugcacauccaucccaaauuuggguaauacaccuugaaaauggagaaaaguaaaaaacuuuuguuaaaauaggaguaucuuuaaaaugccuccauuuuuaacuuuuaaggauaauucuuuuucauuauaugcaaguacucuauauaaagcauuucauaaaaacaaaacaagcgacagagaaaagaaaaauacaaggugaaaacugaaauucgaaacuguaauucucauuauuuuucuauuuagguuuguuugccccgcgccccccaccccuacacacacacacacacacacacacacacacacacacacacacacaaacuuaaagagcuauagucagcaugcuugggaucuccaaaugcuuuacaaauacguacacagagacaaaugacaacuaugcucuguaaagugugacuuagaaaggaaaacagcuugcagugguauucagcagcacccaaaucccaagcuuucuggguugcucugcuaaucgaguauggcaccuggcccugcagggcuauacaauucagcaggucccuuucuggcagagguggcagggacuucaggagugaacacgcauugugaaccaggcacaugggugacaggauaugaugcuucugcaaacucaacugacccuuaaaacauacuccauccagagcaucugcaaggaugaaggggugauggaauagacucugggaaauaucaguggccuucaaaaagaaaaggaccaaaaccucaaccccuuccaggagucaaaucaaaucuccucuugcaagaagccuucccuucucacccacaccaauuccucccacagaugcuuccagcacuuauuuaucauccuucauuuuaaaagaacaucuauuuggcaacuauuuuuaacuuuaauuuuguauauacaugcauacauauacacauuuucccaaaaccagucuacaaaacacucgaguaggcacugaaacagaacugcagaaucaacuggcugacagacgugcugggcaaaagaaaugagucuuuuacuuuauuuuuaggaagaaaggauauaaucuagauguuuccauuucuuucucauuauucccaccacucaugccuucuucccucccguacccacauuaaucaccuuucuuuacugcaacuuuccuucuggaacaaagcucccacuccccccgcugauggugaggaugcugcucuucugggcaugccugggugucuaggccugugauugccaaggggcagcauccaccuuaccgggcccuaacacugccuucuuccucuugaaagucaaacaucaggcauaaugcuacaugccugacauauuaucucauuuaacccuauguagcaggcuuauuagcucuccuuucaacaugugaaaauugaggcucaaaaguuaaauaacuuucccaaagucaccuguuuaauugucauaaagaaaggcuucgacucagaucuccuugucuucuguguaucacugccuuccuugaccauccuaguuaacugaacuaccaacaucuaaugagcaccuacugcguaacagguaccaugcuagaaggugcacuguaguuacuuuaaucaucauaggcaccaaggagaguaucuguacacaguaacuuacauuauuaccccaucugcaacauaaacugccccugggcucagggauaauaaguuucauuuuaauuuacugcagugauggcaaagucccacucacuccccacccaaauacuggcacagcuacugagacugaugagacuacggagacaaacacagagauaguugccaagaaaaccacacaguucacaagguagcuggagucuaucuaccugccucaggauaaaaauauagguugugccacaacuuccuggcucucaggucaauacagccauuugcaaaaagcaaaguguuacaguugaguacaauuuuuauucauacauaacucauuuuguuucaaaggagacuaaggcaucuucuaagucauacugacugauguacaaaaagagaauacuugcuuuuguagaaaaagaugacacuucaauuuuuaaaaauaggccaagaaguaauucacaaacgaauacacguagccaaaaccucauaauacuaaacuuaguuaauaaaaaauaacuugaaagcaaaacaauuuuaaccuuuuaaaugggcacacaaaaaaaauuucuuaaagauaggaaagggugugaaaaaacagauauucccccaaacaccucugaacagaaaacaaauugauuuugugaagaauuuagcaguaccugaccaaaaauauauauauauauuuaaaauauacacagacuaaccagcacauacacuuguaggaauucauucuaaugagaucauuggacaauuguacccagauguauauacaaaaauguucacagaagugugguuuacuguaaauugcuuccaauucauggcuaaauggaaaacaauauggaauuaacucaguaaauuaugguccauccauauagcugaaaccuuagacacuaaaaaguacuguggugcaaaugauuaauuagauuauauggcacgauuuauuuccuguuagauauaccuauauacuugaaaauuuuuuccaauaaacaugcauuauuucuguaauuagaagacagcaaagauaaccagauguuguggaaauacauugaucagcauaaaggcauucacaauacguugaugauugaauaaagcauuuauaggccaggcacggugguucacgccuguaaucccagcacucugggaggccgagacgggaggaaucaugaggucaggagauugagaccauccuggcuaacacggugaaaccccaucucuacuaaaaauacaaaaaaauuagccgggcgugguggcgggugccagaagucccagcuacuggggaggcugaggcaggagaauggcgugaacacgggaggcagagcuugcagugagccaagaucgcgucacugcacuccagccugggcgacagagcaagacucugucucagaaaaaaaaaaggaauaaagaaaaaaaagauaaucucaauuugguaaaaaaguguuucaaugaaagccuuuuuuuuuuuaaauaaaggauuuuauugacauugcuaccgagaaaauacuauaccuucuugguauguucaaauuccaguuguguuucaguuacagaauuagauaccugaaggguuuguugaagauuauaaaacugacauccuacagaauuaaauuucuggugacuacagacaaaaacgggucuucaguaucaacuacuucacuccucagauuacuuuaggagaucagagacuucuuuuaagaacuauucuaauacaucacuguauucuaaaauguucugaaaauucuagaauaaggaaauaaaagagaaucuaacaggugauagcacauuuuauuucaauaagcccacuugucagaggacauuucccaaaacauagguuacuuuuauagagauacuaaaauacaaguuuaaaaaauaaauagcuuggccucucgagcccuugaagccgcacuaacagacccucucuuaaaauuagacuaacuagauuuuauacuacaacuacacaaauguuucuggaaaaucucccagcaacaaaugcacaacaaauguugacugguucacaguagacccccagugaacggccacuggacaaauaauuuauuuucacucuuaaaucagaaauucuaucuaugaaccacagauguuuaagaaucccauauaaccguauaaguaacaugcaaaauuuugugcacauaugugcauuuguguacuuucgggggagauucucaaaaggguccacaacacaaaaaaaguguaagagucucugggcuuugcuaacaggaagaagacugaauaagcaaccaagaaaugggcuccuggccugauuccaggacuaauauucuaacaauauuauuuuuaaaaaggcccuuauuuaaaaaaggcuuucacugaaacacuuuuuuaccaaagugagaucaucuuuuuuuuucuuuauuccuacuuuuaaaugaggguaaguuccuaacagauuuguuaggaacuucaugaagccacauagaacucagauuucuugccuguggaaagaucuaggucacuucuaguauaucuuuauuccacaaauaaaaauuuccaugagguauuaccaguaguuuauaacaccacaaacauuuuaugccaagcaugguguucaagaacuuaagacagugccugguaugugcuaaaagcuuaauagggguuaaaugaaugaauaaauaaacucccaaagagaguuuuuuuuuuuacaccagaccaagcugccaaucugaguacaaguaaaccuguucaaaaagaucacuuaauucucuguacuucaauguccuugucuguccuacaguuccugagagaagaggaauguaauuggcucaucuguuucuaugacaaccaauucuacagccaucccacaccuuuaauuacuucauucaaaaccuaugcacugcuauuaaccacucagcuucucagcaaaccugaaaccagacaucaccacauucacuccuacugcuacucuucccuacacaucaagaccagggcucagcaaacuuucuguaaagggccacacacaaauauuugcaguuuugcaggccauauggucuccaucaccacugcucaacucugugauuauggggcaaaagaagccauagauaauauuuaaaugaaugaccagagcuguguuccaguaaaacuuuacucaugaacugaaauucgaauuucauauaauuugcauaugucacaaaacauuuuuauuuuuccaacccuuuaaaaauguaaaaaccauucuuagcuccagcgcuguaauaaacagguggcagguuggauuucccuggugaucuaaaccuuucccuacugcuagaaagcagcacugagagcugaaaaguacuuucugagaaaagguucugcagaaucagcugguugacuucucuucuugccugcaauuuuaacuuacaaauaauuugaaaucagaagaacugagauagcgaagacuauaaaacucaccuguuaauauuuaaucauagcagcgcugacugauaaaaaaguuuauauaucuuuuaaaaauuacauuaaagucuucucauuauacagagacaauuucucuaucaauuuuaacugacaugcaauucuacuucuucccucuauucuccugaccucaaaauuuguugccugaaugaauaaaauguaaauauuaauagaagcagugaccacugguuuuccucuacaaaaauagauauuuuuaacaauuuaauauuaaaaagauuaacaauacuggauuuuaaaaggcuggcaagaaacauauacucuuggugguuguauaaauaauuaauaguacaguccuucuggagagaaaauguuuggcaaaauuuauaaaaaguuaaaauguauauaacuuuuugacaacauuuauacuucuagaaauucaucuuaaggaaauaaucagacaagucaacacauauuuauauacaaugaguuuuauacuuugaaaaauuauuuauaaucauaaaaacauuaaaacaauuuaaauguccaacauaaggcuuaguuaaauaaaucaugaaugguauacaaugaaauuguggguaggcauaggaauaaugauguaaauaagccaggugcaguggcucgcaccuguaaccccagcacuuuggaaggcugagacgggcagaucgcuugagcccaugagccccugaguucaagaccagccugggcaacauggugaaaccccaucucuaccaaaaauacaaaaauuagcuggacauaguggcauaguggcacaggccugucccagcuacucgggaggcugaggcaggaagaucacuugggcccaggaggcagaggaugagcugugaacaugccacugcauuucagccugggugacagagcaagaccuugucucaaaaaaaaaaaaaaaaagaaaagaaacaaacaauaacguaaauaaguaguagacauagauauguccacaagauacugaaagaaaaaaaaagcauuaaaaacugcaugugcuguuugaucucaauugaaucaauuucuacauauagguuguaaauguaccaguguaugugugaggcugaaaauagagaagcagcuaagcagggaguuaaaagaauguucaggaagauguucacagugguugcgccuggaugauaggaguuucaaugauuuuuauguucuuguauauauuuuucuguguuguuucuauuauguugcagugagcauguauuaauuuuaaauuuuaaaagcuuuauuagaacauauaacagaaacagugaccgcuaauguaaacuauggacuuuggguaauaaugauaugucagugcagguucaugggcugaccaaugccccgcucugcuguaggauguugauaauggggaaggcagugcauguguggggacagcgaguauuugggaacuaucuguacugucugcucaauuuugccaugaaccuaaaacugcuccaaaaacaacuaaguguauuugaaagaaaaagaagaaaagaaaaaaaaagcuuacuaaaauaauucuuacccaagcaauucuaaaguucuguuaauuagaagcaauuugaaucccauaaaaguacaucuaaaaggcuuuuaucagaggugguuuuaaaauauggcagauuacucagugcggauggggagagucaagagaacgaaaacaccaagucccgagcgccagcuagcuagcggcucccugccagaaacucaucgaagaacgcucucuucuugugagaaccuauuuugugcauucacccugaggauacucuacuguuucucuccuguuauuucugauuuaacagaauguuuucagugaaagcuuagaggacuuaagacuggguuagauaaucaagggcucaaggagagcaauuuaacacuuugucuuagauuagcuuuaaaauggaauucuggcuggggucuaagacccugcugcuaaaagauaagcuggucuuaggggcuuugauggaagaacaaaugccaagaugagauucugaugauaagccauuucuguuacauuaauacaaggcauucugaugcaggucugaggguaagagcagaguuggaauaaguuaguaggaaacuacuaagucuuaccucaaugucauuuucuucuaagaaauauuuacauuauaauugauacuuccuuugccauauacauacuuacacauguaugucauaucuauucacuuuuauuuuaacagagcaaaaggcuuacagguuucuauaucagauguauauuuuguagucagaacuacuugaaugagauuuuuuuuaauugcaggaagacaaaaggcacccuugauaagaacuaggauucuuaucaaagauuugcaaacucuaguaguacaguauauaagaaguaucuuacauuaacaaugggauguuaacagguuuauagaagaaauucuaauaagucaugguuccaaauuuucaacaacuaucaagucauacuauguaugaaucucaaugcaaaugaagcuuaauguacaaaaagcacuauuaauaaauuauacaauaugcccaacaacaucaaguuguuacaugggauaaaauagguacuacuaacuuaaguuuaauauugauggcauuuguucaagauuaguguuauaaacacagcacuagagaaagcaguuucugguuccuugacauuauucucacuaaacguaguguuaaaccuggugagccaauuuguuaguuucccuugggaaacaucuaaaauuaaaaaugcaguuuauuugggagcauaauuuuguggucaagacauuuuuaaucaugcaggcauuaucuuuaguaauucacauuuuuuggccgggcaguuuuucuacaaauacagaacucuuacaccucaaaaguggugaaauaacagaaugcaaugacucuugugguaaauccucauuuccuaagacaccccccguuaauagucagaagauacauuauaacaaauucauaagaaacaaauaacucaaaauuauugggagaaacugucagauuuuucaaguugggaaacagcuuagagcauaaagaaaaauagcagcauacuucaaccauacaaaugccacagaacuucuugaugaaaaguguccacacacuuccuagccauacuuuauuuuuaggcuuuucuauguuaaugugugaaaaaacagaugugauucaguuucagacaaucugacaggaaugcuuuuucucaucauccaaaaacuuaacuuguuuugaaaaggagucacaccauggagcuccuuuaagaacucaggggggcuuccagggggcacugacuugaacuaaauucaucacaaaugcugaauuccuacgcaauaccccagggaacaacaaaagcaacaacgacaaauuuuaucuucacaacuauccuaggagauaucuucuaucucuauuuuuuuaauugaggguuuucuagcccagaggcuauguccccugcugcaagucacgaagcuagagguaggauuugaacucaggcaaugcaaugaaaaccuuaacugccucccagugaggcaggagagaugcauucuaguucugcaucuacaggccucccggguggagccccccagggaaggagagcucagcucugucuccugacugcuucuccucucaaaggagugugcagaugcccugcugucuuccagaauugcugggaaaacaugaaauuaauagaugaaaaacuccugaaaaauuacaagcucuauauaugugccauaugcuaaauauauccaacugaauauccuagcaacauagaaauuacuuucuaaaauauagagaagaaccuaacagugcuuucuuugcagccaccauagagugucuuuuaugggguuuauguggcggccugugaagugacaaaccaucaaacaggaagucacggucuuaguugcaaagcaaaacacccuggacacggcaauguaaaacauggauuugacauuuauuguugaggacagccaagcaguuucaaaauacaaaagcauauauaaauagcagucuguauccagggaaacacauuuucucuuuaauaaaaauauucuugacuuuaaagaacacauuaaaaugauuguuuuaaauucaaaaugucaaauucugagagaacagaauaauuauuucauaaaacucugaaaaacaaagaaucagaauuacuucuuaccucccacauguauacauuauucuuaaccugagaucuuuuuuucuuaucaccaacaaauggcccaaauuuuuugccuuuuaaaauugguuuaguggcccagacaccuagaaaauaaaaucaguauuuuuauaauguaucaugguuauuuuaaagauugaaaccauuaaaaucgcuuaaguuucacaaaacaguuaaaaggcuagacugccuaaaucaagcuaauguuaaaauagccugagaucaaguuaaauuaagucaaguccucaauggggauuuuuauuuuucuucuuuauacucuucuguucuauaaagaaccuauauuguuuuacgauuagaaaaaaauguuuuauauacuuuuaaaauguuuuacauguaacacuacccguacaguaggaucacaaauacuugaauaacacagucacaacaacugaagagaaaaaauauuggaauggagugaaacuacaacugauuuuugaacuccucugucugcuuguuuauaaaguucaaauugucucuaaugaacaugacuuguucuuauaaaggguuagaaauauaguuuuaugaauaaauaguuuugaaguucauuugcuuuaaaguagaaaacccuuuccugccuaacuaagcuuccugaaaacuuagcuacuggaacggcucacuuuucagaguuucuaacagccaaaauagcuguucauccacaguauucuuaggguuguuucuauuuacuaugcacugaccauaacggaaagcgauauaaugagcaagcagacaguaaaauggcaggagucuggcccagcagucaacagcaucacuuuagaucgguucccucaccuuuuggcuucaguuuccucauauacagaaugggggguaaaggcugggccaguccuauccugcuaggauguacaaauuccacuucucuguaaguccgcuauguaagucaacaaucaguugagcuauaaaaucaaccacuuucauuugaacaauauguucaaacugcucaaugaauaaguuuccaaugagaauuuuuaaaagcauguauuaaaauuuuuucauacauauguacauauaaauugggauaucggaaguacaucuaaaaaaaagaaacagggauauaaauaugauauauuccaagacuguauuuugacuaaaguuuuacaauuuacuuccuuagcuucugucuaaagauuaggccacauaaaaaccaaacacacacgcgccugguuuguguucaaggagaaaucccagccagaagaauuuagauacacucacagcaugucauucauucaaguaucuacugaggguccacaaaguaucugguacuggaggcacaaagauacauaagaaauaaaggcacucacaagcaauaacagagccaaguguaaaaauauuacaaaacaaugaagugaauauaaugguacaaucaugcuccucauggugaaaucagagagaagggaacaacacguucuguggggugaggcucagcagggagacucagaggaggaggacacucaggcaagagggaugggaccuacguguguguguguguguuugugugugugucuguuuguguguuccugguuuuauuuuuacaacccauguccaaccuggauucuugacuagaaaaugcaucaacaccauauaaucuucuaagucaaggguaaauugcugcuuuuauggugcgcucccuaccugacaugccccugcaggaagccucacugccaccugcucuuuacugccugacuugcuccgugacaggaggagcacucaccaauccgggucuugucaacagcagaagggaaaagccucacuuccuccggaaguccucgcagcacauguucggguaccucagccagggucucgguggccgccacaggcucaguaguguucugcaagucaagaaauggaaggaucacagcaaaagaaagaaaacucaaaucauggguuuuuuuuuuuuucugguucaauaagcaaguaugcaaaaauguaaccgaaaccugaagcuggcaagacagaccaaaacgaugaugucaagcauuugaggagcugcuuugaugcuuguuuguaacuguccaaaggaaaccacugcaaccuucaagcaugucuguguuacucuauuuuguuccagccaccuguggccauuuccaaaauaugauaaucucugccaccauacugcuuuaaacacaaauagaaucuggcagcaaaauauagcauaagcuuacuucuaaaucaaaggcuaccaucaguaccuuagcacauuuaaaaaauaaaaaccaacacugcccacuucaaugaaugcuuucagcacacaccacaaaggcuacuggggcccuccaacccugccccauccauguugcccuccagcaacaaccccuaacuggauggggcuugaauauuccaccccaaaacacgacaacuuauuguggucccuuacugcaagugccaccuuuccaggaaacaguaauuuaccacuguuuaccaagucacuaaacagcaaagucaccaggauaucacagaguugcuaagaaacagagaauuuuuuuaaauuauuuaucaaaguuuaggcuggaauucaucauaaucuuaagaaaagauuacuauuagauauguauguaaggaagggagagauuugagccaacugggagaauaugacuguuauuuucucauuaacuuucaaaucaaaggaacaccaagggucuaguaaccaguacaccauauauccuacggagcugaugugcacaucacggcacugcuaagaaugauaggcuuuguagucugaguguguuucauuucacugcacagggaaacacuucuccaggacuuuuaaaugaaccaacacaggcaaaaguaaaccccaaacaaaaaagauuaauuuuucccacaaccaggaagcucuugucgucuucaagaauauauguaccaagaaaagaauaucauccaaacuggcauacucucagcauuucaauuuuuggcuuauuaauuaucaacagucuacuucaagagaaauaaaucucacagucauuauaaacauggucaucuacucucuggccugcuucaagcucgagagcccaagagagggcaucuagagacagguuugucucucgugcagagccgagccaacugagccuccauuucagacacacaaaugcuuuguuccugcuugauuuacaccuuugucccaacaauaucccugaaacauuuuccaaaacauaagauagccaauuagccccagaaaauggucuuaugguauuuuuaauuagcuaaagugugaauaaauuaaccauagacauuuuucacuucuaaauauaguguccccauuuuuaaauucuuaaucuauaagcuggauuuuuggaaaugugaacaauuuauuuccaaagagggaaaagguauuacacugguaguuggcauuggcauccuaagcuacauaaugauuauuucauaacacugauaaaguaagugacauuaacaaauauuagccagagugauguccuaucagcacuggccauuuaguaaaguaaaaggggauuuucuucuuccgucucagcugggacccuaggcaaacacucagcaccauuuauccuccccaggagcacagccgcuuugaaaagucaccaugucugcuaaccuaaacggauacuuccaggcacuuucacaguaauucuaaugacaacuucguauuuacugagaacuuccucgcucaaggcacugugcugucuuacaugcuggguagaauguacuccaaauaguccaagagacagguauuaucagugucucccccucuccacacagagcagggaauuagagcuuagagacauugcuuaaagggcucaaagccuggaucugaauaucugucugauucgagugccuauagucaguccuaaucaucaaggaguuuucacuuaagauucugcuggaauaucaucuaagaaccucugaccuaaaacuuccagauuuccauggaaaugucagcaggagauggugcuuaaggcaggaauggucacucccacaagaaauguguaacuugaguacaaguuagagaucacauguauuaaaauuucugaagcgcccgagaacaugaaggaccucagcagagaagccaugggaaaaagaaauaccaaaaaauccuauguauuuguuuaucuguuuuaagucaacccauuauuuuuugucuuuuuuuucuuuuaaauuacuccuuuauuccacaucuugucccacuagacccauugguuuuuccuuuuggacucauacacccagcagaggaaagcuuuuucuguuauugucguauccuucacauuacaaaaagaccaaacuacaacagagcaccucaguucacagcagcacaacccagacgcugggcagccccagggcccucccucccuucuuccccacagccccgcuggacucuccauggccguggcuauggcugcaaacugccuagaacauuucuagaaaaucaaugauuugagaaguagaagguagauucaugggcuggacuucugaaauagaaccacccucuuuucuuccuugguucuccuucacagcucuuaccacaauuuuaaaugcuuauuuguauagcuguguguuuacugugugccuccucugugagacugcagugaagacagauggugucuaucuuauucaguguuguguucccccagcuuagcaguagauuucaaauguuuguugucacuuaaauacuugaaugaguacauggcucuuuguaagcuaacuuaaagcuuuuuuuaaaaaggagggauagaaauaaaugaaagagcugggucaucuaucaggaaguaucuccuccacaugugccugaauuucuugaaauugagguagguauucuucuggaucaauauaagaauccuuuuuuagaaaaugugguaugccauuaauuccaagcaaccaauguacaagugaaccuuaggaacaaaggaauguuuucaaaaaauucucucccccacauacucauaaacugggaucucuucuugguacauauccugacaggauaagauguaauaucauaucuaaacagguucaucuugauucuuauacuaaagaaucacaauuugauccuggcacuauuucccagauugaucuugucuaaaauaaguugcaccaucuacucuauuuauuuauuucuauauuuccaaaucccugcuacaggccaggcaauguucuaggcagcacgcuugccucaacacggcaucacucugguaagaaauagagacaaaauuaaacacauacauacaauggcugaugcccuguagaaaacucaagcacaaaaaaggggacacaugccuuccgaucaguggcgaaugaaaaaaaagaggggaacgcgaggcgugguggcucacgccuguaaucccagcacuuuggaaggucaaggcgggcagauuaccugaggucaggaguucgagaccagccuggccaagauggugaaaccccgucucuacuuaaaauacaaaaauuagcugggcgugguggcucaugccuguaaucccagcuacucaggaggcugaagcaagagaauugcuugagcccggaagguggagguugcaaugagccgagaucgugccacugcacuccagccuggcugacagaccgucucaaaaaaaaaaggaacacagucauggaguagggauggagaugccuguucagacagaaugcugaggccucucuagaaguagaaagggaaucugugacaauauuggggaaacaugucaggaaaagaaaacagccaggaccaaaucucaaauuaagaggaaacgcaguauccaggcaaaaagacccauguguccagagcagagaagguaggagaagcagcuagaacugaggcaggaggggcaggcagggguaaggucucugagaaacacucaucgccauucgcuugucuacccagaauaagcagaauagaagucaucaagcagagagcagagagcagaucgcaagcuccgcaaggcaccccagcugcuggcgucucccaguacgcccuguccuugcugccccugaauagaaguauguuccugucucauggguuuuuaacacugaucacugugauaugaaagaagcuaaagaacuucucugcuucccuauuagcugaccucaaugaggacucauuauuugacugcuuaaugaaguacagucuuuaaacauguaucaaugaacagaucuggaacaguauguauuaaauuuaacauguuaaauuuaagucaauuuaaugucauuuaguuauuaacuauuaauugaucucauuaauucgauguuuccaacuuccuaccucaaacucaaagaaagucacuacccgcuucucuucccccaauuaaucgccaaagcgucucuccuucauucagcccauccgucagucauuaacacauacucccugagugucugcucagagcuagcaccaugcuaggacccccuccucaugaagcccacuggcuagaggaagaacuucucuguuccugcucccugagacaagaaaccuuggacagauuuugauucacgaguuuugaccuugcuggggagccucugaagggcccuucuacugcuuuccugauacauuuucucugacccaggaugaccuuuccaugcuggacggggugaggagcuuagggaauauaacauuuauuccauccucugagccaagaucugugcuaagcacuuuacaugcauuaccucauuuaaucaucacaacaguaacaaucacaacuaacacagauggagcguucaagaugugucagauacaacugugagcacuuaucaccucauuuaaucugcacacuaccaauugcuauaggcacuucuaugaucuccacguuacagaugaaacuaaacuuugcccauagucccagccagcagguggcagagcuagguaauuucaauccagacaaucucgcuucagggucuggauucucaaauacuaugccacagagcagcccugcugaguaacuuucccaagcuacauaguuuugaaguaguggagccaagauaaaauccagacagauuccagagucuacauucuaaccaccaacccaguggggucucauaccucacaguccguggacaccugagaauucccuuucuggggcccacaaggucagagcuauugcuauaacaacacuaagauguugucugccuuuuucacucucagauguguagaguggaguuuucuggaggcuaucaugugugaaaaugucaucauucugguggcuuaugaaaugugugauuguuuaaucuuauguuuuaaauuuuucugauuuaugaauaaggccuguagucuaacuagcauuauuauaccaaaucaauuuccuagcuuucauauuguacuaaagcuuuguaagauguuacugcuagaaaaggcuggguaaagaguacacaggacuugggccgggcgcaguggcucaugccuguaaucccagcacuuugggaggccgaggcaggcagaucacuugaggucaggaguucaagaccaaccuggccaacaugguaaaaaccuaucucuacuaaaaaaacaaaaacuagcugggcgugguggcgcacaccuguaaucccagcuacucaggaggcuaaggcaggugaaucacuugaacccgggaggcggaaguugcagugagccgagguuaugccacugcacuccagcccgggggauagagcaagacuccuucucaaaaauaaauagaguacauaggacucucuacacuauucuuauaacuucauguggaucuauaacuauuucaaaauacuuuguuauaauuuccaauaugguaaacauccauagauacaacaaacaucaucaaaaagcucaagcugcuacugcacuaagaccgccuccagucuuccaucguaccuccccucucagggcuaagaagacaggaccgacuccuagagaccaaaccuacaagaguggagggaggcaggggggcuuaauccaaacauucauguccuacguucuccccuuccugggcaccucccccacuuccugaguacaacuguuaacauuaaaaacuacaagcguuacaacuauaagcuuucuccccucuuccuccuccuuccuuuuucucccuuuaugcccugcaauaucuuuuucuuccauacuuuguuuuauacauuuucccuuaaaaauaagccaugaacuuugggagguugagauggguggaucacgaggucaggagaucgagaccauccuggccaacauggugaaaccccgucucuacuaaaaauacaaaaauuagcugaguaugguggugccugccuguagucucagcuacucgggaggcugaggcaggagaaucgcuugaaccugagaggcggagguugcagugagccgagaucgugccacugcacuccagccuggggacagagugagccugucucaaaaaaaaaaaaaaaaaagccaugaaaaggaauuucuauaacuuucuacaucaauguacaugugaaaagagugugagcagugucaaguaugcaaaguuagggacaaaacauggcugugacauuugcuuuccccaaacaggcacaagagucuuuaucauuugaaggguuucacugcuaaucucuaaaggagaaaaagcaaaauauaccagaauaaacugagauaaguugcaauggcuucagaguauuaauaaacacaacaacuuacugucaaugcccguuuaggcuccugcagggaauggagaaaaaagcagaagaaaaguucccaauacuuuaaaccccaggguggugaagcugagaccccagcaaggugagguuaccaaaaggggccaauuugcauuuguauuccaggccugggcucuacccagagaacacuuuagccuccuagaagcuaguccccacuauccuaaccuaguaggauuuccccuauggcucuguuacaacacucuccacaacuugcaacagugugcccuguguauugugaaagcccuuccugguuggcuugguuaaucaccucuccagagaggcaaguuuagggcuguagacaggcaggcugugcuuacucgccucgauacagccuggcacagagugcccagcucagagcaguggucacugcgaacgggcaaacaaaugccuggcaaucaacugcccagaggucugggcacagagagauggcuguaagagcaguacagccccagcuggccauggaguccauggaaguggaugagaauccucgauggaaagcagaggagagaacagccgaaaacaaagcccucagaaugcccuuaucaaagaaugaaacggaagaagaagcacagcaaaugagucccaguccuagaagucaucgcagagccaaagaggcaccaagcacauggcaucaccaaagcuggggaagacuccaggaagugaggguggucaacagagccaaacccugcugcugauccuucaaaaucugucacguccaauuccuuucuccaguucccauugccacugacaucuuccaaccugaaguuauucaggaaucuccaaucauccugcacauauuagcagcaaguguccaugugcuggagcagcgcuaccuggggaacgcagcaaccaagagaaggggcagguccugcccaccugcaccccaagcuaauguggcagacuagggguguucaacgucucagugaccuaaagagugauguaggagagauaaggaggggacagugcagugcuuuaguuaggauggcagggggaggccucucagagaagaugucacacagggacuuggacuugagagaugaaaaugagucauguauuaagaacugagcaguccaggcaaacaugccaaggagagaaggggccugggcuguucaggaauaaaaagaggccaccgcggcugcaccagaauagagacgggaagaaagcagaggcagccaccacuggaacaugcaaaaccaaggcagggcaaagagcuggacucaauucagagagcggugggaugacacaagaggguuugggcaggagagugacgagauggggugaggcuuucuggcaucuaggcuacucuacauucaacuucucugaaccuuuugucuucuugaauaagcagucuacaaaguaucugauucaaaacgcuuuuuaaacuuucuaaauaaaaucuagucauuggucugcuggcuuuagagacugucaacguucaagagaagcaaagaaaauaagucaccugagggcucauccccuccucuuguccagaagauucuaauacagaaugggaaugggugaggguggggacaggggauugguaagcaggagaaggagcuuucuacugccucccacugaggcuguuacuggugagacugaguuuuaacuucucaaacuaucuucauccaaagcaacaaacugugggcuacagccuuucaucucagaugggguuuguucggucuacccauggauuuaaaaaaaaaaauucuauuggaagaaaucacagaaaaauccccauuuuacucuuacaggucaucccuggccccuacaggcaucuggguuccuggcacacccucuggccccuccuacccucaccacauuagguccccuugcuacucugggccuuucucaauuuagacuuucaccuggcccucaauucuucugacgaucaauauccuccacauccuuccaggucaaguucaaaucccagcuccuccacgaaaacauucccaacaacucgcaacgaccgcuggcuuuucugauuucccagauggugagcugcauguucuguaaggccuauggagaauggucccauagggaggaaaacguuggcgaggaaaucaaucaggagcuuucuguaauagcccagagaagggauguuugggucugaauucaagcaguaauaguaauuaaacuauuuuacaggacagaaucaggacaugguuaccggcugaaaaauaacaguaauaaauaauaauuuacgguguuuccuaugucaggcacuagccuaagggcuuuacaucuauaaacucauuuacuauugacugcaaccacacgggguaggcaccauuacuguccccauuuaacagauaagaaagugaacacaaauaagccgaggacuugcccaaggucacacagcuggaaugacauugccagaacugaccaaggagagugaguuagagggcaucaaaggagaggcagagaaaaacagucccacagcuuuuuucucugccgaaguguuacuauccuaacauaagaggaaaggcuucuugccacaagcucauuccacugacuuaaggaaaugcuauucagguuguuaauuuuuuuuugaauuucacaaauaauauuuucauucagaaagacaaggucccagauuuucuaaaauuugcuaauuuaucuaguagaauacaugauucaaaaugagauuucaagggcuaccacuauucauucaacaugcuaauuuccuaaacuacacauuuauuaguugagguuuaagucaaaacagauagcaaccaccuuacuuagaagucuuuuuuuaaagugaaaaaaucagauucauauuuauaauuaucuauaaaaaauauacuucuauauuaauaauaugauaaaacagugaaagugguuucaacuuuuuauaucauauauauuuuuagaauuagaaaaaagggggagagauaacuaagaugaaagauagaaagccaucccaggguuucgcuaacucuuuggaauuaagauuaugaauagacauaucuacauggucagauggucucccauaaaacagcucccguaaagaaaugaacuacugauacaugcaacaauauggcugaaucucagaaacaguauaaagaccaaaaugagacaaacagcaaagggcaaggacuauauguauuccacuccuaugaaaccccagaauaggaaaaaccaauguguaggaacagaaagccgaucaguagugaccuugggcagggaaagacuaacuucagagcaguagaaaagaacuuuuuggggugacagacauguccuaugacucgacagcagugauaguuacacgggugugaaacuuguacuauacaguuaaaacaguuaccuuuuacuguaugcagcuuauaccucaaaguugauuuuuaaagucaaauaacuaaacaggucaauaaauccuaaauucucaucuuuaaaucauguuaaaaugaaacuuuaaugcaccaagaaaauauuuccgauuguauucacuuucuuaucuguuaaauagggauaguaauggugcccaccccaugugguugcaaucaauaguaaaugacuuacugaacggaaagcacuuaggcuagugccugacauauaugaaacacgguaaguuacuauuuuuuauuauuauuauuuucaaccaguaaccaaguccugauucugcccuguagaauaguuucauuauuuguauuuauuaagaauuuuuuaacucaacucuaacagcccucuccucaaaacccuccaaagguuccccaccucacuggcaaagucuacucuguccuucuggcgaccccagagcugagcccacacuucuuugaccauuuacuccacccuccucaggucugcuccagguacaugaaccacagaaccaaccuccuccacucucccuacccagcccuucucuccauacucuuuagacaaacauugacuguaaucagcaagguaacucugcucuacagcauaacauuggcauuggcugcuguuacauaaagcugcauguaccaucuuacauggucaacacauacuaauguuuuuauuuuuaaaaguauauaagaauaagcaaauuuuauuagcgucucauuuaaauuuauauaaguaacuccuuuuacaugcuuugcccagagaauuaucagcaaguauuauaucaguuuaaucuauuuaauuaaagcaccuaguuucaaauauugacuugaucaaaacuaacuggaaaguggcagcaauacaugacggaauagauuagaccaauuuuccuuaauauuaagaacaauucauaguauauucauacuaaaauauauauuauugcuacaauagacuaauaauaaucaccaaaguaacuguuacaagcaaaaaacagcuuagaaucauaccauauuaaaaucgcuaaaauucuacgaacccaucuuuguauagauuugcaaacaagaaucuaagcuacuaugcuggaacaaacgaugggaaaaaaaaaaucaaacaagcuucaguuuacugaaauggcauuaaauuauuugguuaagaaaugagcaggacugcuauaacaauaaacagaugaaaacacaaaccaagaaaugcuuauacaccauuuuuuaaaaagaacaggagucaaauuaguucugaaauacaaaaaaguacccucuuucaaaaagcugucagguccauuaagucguccaacugaagaaacuguccuaaagcaugguguuaaucucaguagugaacacacguuaucaccacacucuugcucccuuacaauccagucuccauagcacaguggggaggacauccuaaaaaugaaaaucagcuugugucacugucccguagcccuaaaggcccuauaaaacuugccucucacaccaauguccucuuaucccagagccccugauagggccaagcuccagaccauagcuugcucuccguuucaugaacuaccaagcucauuuccacuucagggucuuuguacuacuguguguucacucugccuggaauuuucuuuuuccagaucuucaugugucuaucugguuccugguuauuaccuaaguuucaguucuacuagcaaucaccuccacagaguagccuucucugaccauguaauccaaagaccuucuuucaccucuacccaucauccuuuauaacaagaucuuguuuaauugucuucacagcacuuuucacuaucugaaauuaccuugcuugucuuccugcuuuuuaacugucucccucuuggaguauguuacuggcagagcccuugcccaccuaguucacugcagaacccauaacaugcugggauacagucuguccacgaugaaugagggaaggaaugaaugaauuuuagggacaacugagauaauggaaccauuccugagauaaagccauuccuagauaagucuaggaaaauaagaaggaaaacaguggaacaucucaaaaguuaaguaucaggauggguguggaacguuaaugaagcaaguaggauaccuacgaucugagaauggagagaagggagcauggagagccaggggaggaggcacaaugacuacugcucucgcugccacccaggcaugggcucaagcggaaggaucgaagacucacaugcagagcaagcugggcucuaauugagagguuaagagauauuaagaaaggggugaguuuugagugaagaacagaagggaagagaaagaaagcaaagaauauguaggucggggagcuuugugagagcugggcucagagggagcuaucacacuaggaccgacuuggaacacacugauacaacugagcgcaacaguccagaaugccgccucaauagucagugcugaaaguacuggcaggcuguggacucuacugcuucuucuaaaggaaucaauaacaaacaauaugauaugcccaugacgaggauccugcagucccugaaacucaacugucaggcauauaucaacaaauuauucuaugcuauugucuuugagaccauacccaucauaagaaacagaacugacaauuaaaacccaucaaagcaaugcugauccauuccuggggagaauaaccuaacccuaaaauaaccaucgggauuuuauuuauaagucaaucuucuucaaguucaaacuuuuuuauaucugaauuuuguugugugguuauuuuucaguuuuucaagcauuuacugcucauuuucacugucugaaaaugacagcaauaaauacgagaagggaaaacuguaaauuauccugaaauaagucuuaacccugaagaaugacuggggugauuguugaaaaacacugauagauuuuaugccauaacaauugggucuaaacagcauauaacuaauauucuucuaguaaugaaaauauaacaaaagaugcuaaaaauuuuacucauaaaaagugggcaauuuuuauaauccaaauaaaagcuucauuacuaccagaccauuuaaauuacacccaaaucagaaauguguuaaccauuagaaacauaagaggacacuuuuccacugauacuuggcauuugggaucaaaggcggucuucugcagaucugauauuaaaacuugucaaaagcaaaacgaaauuauaaaagagccaaaaaaaaaaaaaguaguaguuauugcuaccacuuuuugacuggcaagcagacuuuuuuaaacacaaguuugauauaauggaaauauaaagcaaaaguuugaagugucaagucuaauucacuagaaauauuacaagucuaauacuguacaagaauuaaggcauaauuaauccuaagguuaaagauguagacauaucaaauaaaugauuucugaacagcgaugcaacaagaacaauauuaacauuuagauuccacuuuggaagaacucacaaccauucuaacgcaggaucaagacuccuccaacaaaacaguuccuagacugcagagaaccgagcuccuuugggugaccagguucguaauaagaaucaaucuuaaaauaggaaaauaaaugaaaucuaugaaauauauaugaguauaacuuugauggacgaugacugugaaaauccacucuguucucuuuucccucccccaucucaccauuucaaaaauaauuugccuucaaaagcaugucaauaaaucugcaaguuuuaaaauaauagaaagcaugugccccauguguucgccagauucguuuuuuaugacauauguccucugcauuaaaauaaacauuucugauaaagaaaguaaugaaaucaaaagaauccaaaaauuucacaucucucaaugcagcacaggacugaauguauuaaacuuggcccagcuaauuaaauugaacuugugaucucuagguagagucaccuguacaugaaaaaaaaggugucuaaaguuucaguugaugagggauacaaaauguuuucaagucugagaguuuuaagcuaaggacuaaaaaaaaaauuacauacuucauauuuuggguuuuguccuucauauuuuaaaaguaagugcuuaugaacauuuuaaaaagaaaacauuucugacacccacguauuucuguaacuacaagagagaugauauugaaaccagaaaauaagaauccuacucuagaauauauuauuagauccacauaacuggcucuacuuaucagaacacccuugaagcuaugaaaauauccauagcagaauaauuuaaucaccagguaaucccacaucuccuguaaagagaaacacaucuuacauuucaauauuugcccucuuguuuuuauucugagaacagguuuuucaaggacaaaugcuuaaaguuucuucuuugaucauuugcagucucuauaaauaacuuuuaauccucucuuuuuuuuauuuuuuuauuauuauacuuuaaguuuuaggguacaugugcacauugugcagguuaguuacauacguauacaugugccaugcuggugugcugcacccacuaacucgucaucuagcauuagguauaucucccaaugcuaucccuccccccucccuccaccccacaacaguccccagagugugauguuccccuuccuguguccaugugaucucauuguucaauucccaccuaugaauaagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccaguucuaucauuguuggacauuuggguugguuccaagucuuugcuauugugaauaaugccgcaauaaacauacgugugcaugugucuuuuaaccaacaaauaaucacaaaauaaaaaacgcuaaaaaugaaagcuuaauaagcuucaaaacaaacacacacaaaaaacucacacuagaguguggcaagggagaggucaaaaagaaagucuuaaugaaaaucccuaagaaugaguccucuccucagggaaccacagaaacgccaacccacgcccaaacaaugcacauuccacugcacgaacaaaugcacgguaugaacacaaugaacuaauuaaugguauuaagaaacaaaaaugagaauccaggagaaaugaaugugugugcuacuaucuuguaaaaaucaagagcuggucuaacaucuaggucauguauuuguauaaauucugauuuuuaaacucaccugauucauuuucaauuccuguuguguucuguaaagauacacacaacaaagaaacuucuuugauuacaugaacccuaaaaagaaaaacagacaauuguaauauguaccugccuacaaauuuacagggauuuaaaaccacauacagaacuguagaguuugcugaaagggcuauuuauaaagcaacucuaugccaaaucaacuucaaucuaugcugagagcuuccuugucagauuuauuaucuccaguaaaauagauuucuuacuacucuuugcuagggcuucacuguacucuacaacugaaagcggacucauuaggaggacaucaaaucuuugcuuuggaacugcaucauuccuaagaagaaauaaauuagcuuucuuaauagaaauacaaagcauuauugaguaccuuauuaugcaauauaagugucuuuuucuuuuaccaauacuguguuguacguaaacaccauuagaccccauuacauuauucuguuuuucaaguuccugaauuagaaaguugaauuuacuaacauuggccaccaggaguucucucugaggaaaagaacaaaaaacuggcaguaaaaugcaaauguuuuaauaaaagauguugggaaacagcuacauugucccuuuaaaaacccauguuccauguauucauaguauaguaaaauaaaaagacaaaauuauuucuuguaaaugcguaugacauacuuguuucuaaauaauaaucucugaaaaugguccuuucugcaacguaugccuugagucauuugauguaauucauaauaaauuaaaucaugacacuuuaaguagaacuuccacuguaagguucuaaacauuucccacguuuacauacacauaccauuaggcauaauucuccuauuucuuuaugcacuugcuuauaacuuaucuuuccuuccuugacccacaagccucugcuuacauuguaacauuauguucuaauuguuaauaacccaaagaauacauaauuuagugacauucuuccuacugccuacccacuguuuugacauuuuacccuuguuuuuuaauaagguaguuggauuuuucuuuccuuuucuugaucuauuuaaccacucaccugaucacccuuaaccaccaaaggcacuauauuuaaguuagggccuggccgucugaacuacuuuuauucauaauuggcauaaggauguauuccaugagauugcaucuuguuagacagcucacugcuagccaaaccaauauaaacucuugguaagcaaguacucaggaaaaaaaaaaaaaaagccagagaauugcaaguuaaaccaugaaguccauuccuuuacauuuuaauacugagcaucuuucucaucuauauuuacauguccugccuuaguaaacaucacauauugaacauaaucaacccucuucucuaagacauaagauuguuaucaaguuaaaaauguauauuuugggccgggcacaguggcucaugccuguaaucccagcacuuugggaggccaaggcagguggaucacgaggucaggagaucgagaccauccuggcuaacacggugaaaccccgucucuacuaaaaaauacaaaaaauuagcugggugugguggcaggcgccuguagucccagcuacucgggaggcugaggcaggagaauggcgugaacccgggaggcggagcuugcagugagccgagaucgugccacugcacuccagccugggcgacagagcgagacuccgucucaaaaaaaaaaaaauguauauuuugguauuaaacagugaugagguuagugaucccucagaugugcacaccugacccucgaccagaaacgccuacugacuacuauccaguuccacgugguggcccugcgugacaccuuauucccccaggugaauaagauguuagggguuucacguguccucugacaaagcuuuuauagguagauuuauuaacacuggcucaggggaguucucuuugaggaacagaacaaaaaacaucugcgguaaaaugcaaauguuguaauaaaagauguuuggaaagagcuauaaugcuuuaccauuucccuuuguuugccuuuucccucucacaagaaucaucgguaucaucaucacuaucauuuaugaagcuucuuccaaggacuugcaggcacugugcugccuucaaugaaccagcucagguccccuucaccaaaauaagcacagcacugguauccucaauuaacaagagcuuaagauaauucggucaaggucucauaauuuugguuucugcuaaugcaucuuaacuacauuucaccaauuuuuuacuccugccuccccaugagcacccacuaugugucaagcacugcccuugagcaguggaaaggaggaagaucacugcccuuuuggggaagacagucacaguaaauacauaaguaaaauauguggcaugccagaaaaugaaagcgcuuuagaaaaaaauaaagaguuauggagagggagauaguuacuacaaucucuaugcaaauucaacaguguggucagagaaggauugagaaggagcagucuacauaaaagccaggaaagggacgagcuucaaaccaggaaaguauggggagaaauguuauauggagguggagguggaagcaaaagcgagaagccucacaaggcugcagccuggggaagcagagagggagccaggauguugguguggcuggugcagagucggugaggggcgcaugaagaggcaaugucggaggcugaugcccagucuaaccaagagacaaugggggcauggcucagccaguagaagagaugugaaaaguaacuggauccuggacggacagacggacggauggauggauagauuuuauuucuuuuuuuuguuuguuuuuugagacggagucucgcucugucgccaggcuagagugcaguggugugaucuuggcucacugcagcccccaccuccuuccaggguucaagcaauucuccugccucagccuccugaguagcuaguacuacaggcacgugccaccaaggccagccaauauuuuuguauuuuuaguagagacggaguuucaccauguuggccaugauggucucgagcacccaaaaugugcugcaguuuuagaucuuaggcaugaaagaaagaaagucagucagggauggcacugagguuuugguccugagggcaugggaggauggagcugcuguuuucugagaugcugccuucuucuuaccaucugcuuuucauguuuucccucuuuauuuaacacuucuuuucuuuuccucaccuuuugucauugcuagcuuguaggcacaauucagacaacugagauauccuaacaucugauauugaauaauuacaauaguacuuaaaacauugcauuauuugauuaucucaaggaaucucauguucuucuuuuuuucuggagaugguguaguacucucucacccaggcuggacugcaauggcacaaucauagcucacugcagccucgaacuccugggcucaagugauccucccaccucagccuccuaaauaacuaagacuacaggcucgcgccaccaugccuggcuaauuuuuuuuuuuuuuuuuuuuuggguagagauggagucucaccuuguuacccaggcuaucaucuuuuucuuaauaaaaaaagguuagaauaaaauucagacugcuacauaauuaauaaucuucucuuucuacacuaccuguuuccucucuguccaaaugagaaugcacuuauuucuuuccagagaaaagaaagaucauaacaucuuuuucuuaaagauucacuauauaucuguguggggagagccuccucccuauuacuuccaaauccuaauugcuaaaaaccagacucucauuuuuuccucucucccucuuggacucacaaaauugucaagcuauauacauaaaauauuguacaacaacaaaagcacuguaaaucugacagugaauucucaaauguuauuuuaaaaacuuaauucuuuauucaacuauaucaaaaacaagggguguaaaaggaaaagaaguaagaccugggcggagucucucaacagaggaacccugcauuuuggacuggccaacuccuugagcaagacugucccuuuccuuaugggcacuuaacauugcuuugagcaaucaacacuggcagugccuccaaucauuuugacaaucgaaaauacguacacacauucucaaaugcccuuccaacugagaaccucugaaugugguaaccaugugacgagcugcaauagaauacuaaagcaacuacagcaucuaaaaauguuuggaauaacuuccuuaagauuccuccagcacugcucaaaacccccguggaagugccauggcaauccuacauaaccuucauauucaguguugacuucaacaguccugucuuuacacacccauuuaacuaauacaugguaucuccaggccaagguuuuaucaaacgugugaaacggaaugaucaauccagcagugcagaggcagagaaaaaucuuuccaagcguaucacugaaaccuuagcaauucuaccaaaugcucuuuuuuuuuuuuuuuugagacagagccucacucugucgcccaggcuggagugcaguggcacgaucucagcucacugcaagcuccaccucccggguucaggccauucuccugccucagccucccgaguagcugggacuacaggcgcccgucaacacgcccggcuauuuuuuguauuuuuaguagagacggaguuucacuguguuagccaggaagcucucgaucuccugaccucgugaucuguccgccucagccucccaaaguguugggauuacaggugugagccaccgcgcccggccaaaugcucuuuuuugaagugcuaaacaauuaagugccucugcuuugcuaacagcagauacugaaaaucuuuaaaucccuaggacuucucugaccuuggcuuaugccuuaguuucuuuucugcauuuccacgccuaaucaaaccuucuugaauauuuguacagcaccccucgaauaagucuaacauaucccuucuaucccaccuuaauauuuaucagucccagaagagcaugcacucuuagaaaauaagagcuugaucucuauuuuacauaucuaacauuuuuaauaacaugaguauaugcacuuaacuuuucaagauauugcuuucaaguucuagacaaaucagucuuagaaacauuuauuaauagcauaaagaugauuugaugauuaaugaucaguaucaauauaaccacaauaaaauaauuugagucauuacuaagacacuagucccauaaagugucaacacaaccucaacaacuguuaagcugcugucuucugacacggaaguccagagaccagaaaaucuagacacaugugggacagcccuuucccugggucauaccagcccugcagccccagcacccucuauuaccaauccucugaaauaaagcagguuuaucuaaacaaagacacaaacuagcauuaauguaaugcauguaacacuuaaacugucuucauaucugcccuuuacggacuuguaaaaaucuacaaaucuauaugaaaggcaaaguaggagaacagauuuuuuuaaagauuaguuuacaucuguggggcaagggacagaauugggaaaauacauauuugauuuguacauucaccucuaaaucacugauauuauuuuuuacaauuuucuuuaggaucacuuuagaucucuggcagggagggaggaguaacuggaaaauaauuaacuuugcaauagacacauagaggucacuuauacuauuuuauaauuauuuuaaguuacaaaaaauucuacauugugacaucaagaaucagaaaaaacuuuaacuuucaugauucaggaaguuuauggauaaagaguaaaacagaaauaaguaagagaauacguuuuuaucaaauuuaaaagaccagaaugaaaacauggacuagacacaagaaaaacaguugccauuuugggaaaggagucuuagaaaguucauggccaacacaaaaaaaauucuaaagcuaaucaccacagaaaguaguucucaaggcaaauaaauacuguagcaaauacagagaugaugcagcuuuuagcagacuagauuuguagugucgucuaacacugaccuuacucugaccaaaagauucuugcaauccugaaacuucuagaaaaauaauaaaaaugucugaaauaugccaacuucucaaaaacaguuuuuauugauuuuaaaaugcuauuaagguauucauugucauagaaaacuaccacgcacaauuccuaaauuacaaucugugaacuuuuuuucuucagaaagacuccacgauuagaaucuguugaaauuuguuguagaaaauucuuuaaaccaaacauuuaaaucuaggacuucaauuuaauuuguuccuugaaucuauuuuuauguggcccuuaaaaacauauccaaaaaacccacugcuaauauagcaauaaaaauacuuuggguaaaaaaaaaaaaaacuguaaacuucagaugucaauaugaaaacauguaguauccacuuguuagacuaaacaaaagcacagauauugaaucugcccaggaauuugcuaaaugaaaauucaucaguuuuccuuuucuaaaauaauacaauuucacaagaguaaucaucuagcuucguacuaaaaaaauacagccccaaccuugguauuaaagugcagacuauauuaccaaauuaaauaaagugaaaaaucaaaccugauacguuaagaauaaggagauucuauguguguggagagagacugcgcagacaggaaagguguggcaagcugcugaaccagaggcaauaaauuccuucugcuugaaaccacucacgccucucacccaccgaaggauuucucccaauaccaaaagacaauguuuaacacagaguauaucauauacagcaauuucccuaccuacaaauauauaagagauacaagaauagaauguucacaaauaaaccaguaauuucucccauuucaaugaucaguuuccucagugaggccuagaacacgacagacagacaacuaucgcaggcccugacuccccgaaugcauagagcagagaaaccuaaauagcgaaguggaguguaucgaguuuacuccaggugggacgaucugauacuaauaacacaguuuccauguaacagauuagaaaaaccaagggucugcuguucucaguggcuuuggagcugcagagcuccagugagaaaaugagacugauucaagcuuuuguuugauauauuuaaguuuauagagcucugaggucaacagcccuccggcuccaaugggccuagagcaauuaaauaacaccauaucaaaauggcaaauaagggaccugcugauaugcuaggaaaggacuauaaauccgcauuuagauuguggcauuccaggguucuuucccugucagaauaacucuuccuuuacuugggaagaaaaaaaaaaaagauuaaaggggaaauuuucaaaaucuacugcuccaagcauccauuaauaaugugccagcucagaaguaaacguauggcaguugcugauuauuuauucuuuauuauugauugcuguuauugacagcuauuaauauaugcucucccucauacuuuugauuaaauuuauacaccuaagucauauuccacugaacauguaauuuauuacaucacaaaucucaagcuuuguuuaggguuccuacaauaauucccugcaacccccuuauuaaaacuacccaguuucucuaaagaaauuaaaacauauuaucuuagcucucacuauaggauauuccuccccuccaacaguacaaaaaaaaaaaaaaagaauuauugucaauuuuccugcaugaaguaacuccauccaaucaaaggacucuugaauuaaaauguuaauuuccuuuccuuauuuuuaagacuaauugccaagaaauacaaauguaaaaaucugggggcaggucagaauacaagaguuuuccaaucagugcuugcucucugaugagaacuaugcuucagauucaaggccauuauuaccuccugcaaaacaguauuaaaguaacagaaguuuccaugaaagauucuuuucugacauuuucccuacauuagauguauaaaaacuuuaacuuauaaaaggaaaauuaaaucaauucuugacuaaggcucaaaugccaagcuucuaacucagacaaaauuucuaaagcaagaugccauaugauagcucauuucacaauucccaaaacaaaaugaauccucaguugaccccuguguacuauuuuuccacuggaguugccaaugcagauguuacuuuuaaaauuaagagaugucuaggaauccugcaaaagauuugugaauuuccugaaaagcggaagaacacuacagcagcacgggcaggguagugguccuggcaccaaagucuucaugucucacaugaagacucucugagcaacagaggcaucuuacaaggagcugcucgaagcucuuuucauuuuccauacaaccugcacauaaaugguggggaggcuuccugaauucacaggugaacaaccuaaagcaaaacuggaagucauaauagauaaaaugacaacuuaaacucuuuugcuacggugucaggcacacuuauauuacuacaagauucuauaggucuucuccgaagauuuuauuaaguuuuuuuuuuuuuaguuuugguagaaagugacucuucuauuuuaaauaauuugagauuugggauuuauucucuaaauauguuacuacuucucacaaacauuuaaaaauaauggcaaugccuacuguuugcaaaguguguacacuauucuacaguuuaagaggcccuuaaaacuacauacaugcaagcuuuuuuuggaaaaaaaauguauauuuccucaaaauaaaucauuaguucuuguuucaagguaaagagaaaugccuaaccauuuaugauuuaaaaaaaaaaagaugaaagacugucuuuugauguuugucugcuuuagucugcaaaacagugcaacucaagugagcuucagugcagagcaaggacagaacagaugggcaguucuugggggcucuuaguuccagguuaaaucuaaacuugaccuugugguagaguucucagauaccgugugaggaguugcuaauccuauuccacacccuauuccaaaaggucuguggagaaagauggaagaagaaugacugagaagcagagccuaugaucaccuguaagaggagccggguuucauagcagcccagaaggaaggcagcuuuagcaccugggauggacuaagaaggcaguguuggcaagaaaaauugaauauuuuaggaagauuacguugacagaaaagaauaaggaaguaggugaggagagggcagccagaaagacuggggcugggcaagucaguucagaauccaagagaacaggcaauuaggguuugaauugcagucaagagcugaaacaaaaaauaugauugacacugcagagggaaggaaugggcagaauguuagcuaacugaacaggagguaaaaaagaaauggcaaagaugagucccaaaauuggaaugugagugacugcaggaauggugguuugaauauauuuuaaagacagagcagucaggaguagggacaauauuuaaguaaaagguggugagcuccauuuuuuuuuuuuuuuuuuuuuuuugagacggagucucgcucugucucccaggcuggagugcaguggcgcgaucucgacucacugcaaccuccgccucccagguucaagcgauucuucugccucagccucccaaguagcugggauuacaggugcccaccaucacacccggcuaauuuuugcguuuuuaguagagaugggguuucaccauguuggccaggcuggucucgaacuccugaccucgugauccaccagccucggccucccaaagugcugggauuacaggcaugagccaccacgccuggccagugagcuccauuuuacugacucuaaggagaugcccgaccuucccgggaaaaguaccucagucucaaguggaagaacacguccaagcacaaacgggccaucaacauggagauggagauucagaugucccaagugggugccucaggaaaggaaauugccaagcggaaaaauauccacagagaaggguagacggugcaggauguggcuuugugaaaggcacggaaggagguagaaaacauaguggccccuuccaccaaguucuguaagaguggagggaaggucaaaacgccuaaggacucaauacauaacugggaaggcuuuucucucaacaauaacugccauguuauuucacaacacucauuguauuaggagaaauaucuaagaaaaaauguuacuaauguucuugaaaagccuaaaguauccaaauugccugccuauucuuuauucaucucaaaccaucccgaucaaaaagacuaaucauagucuucacuuuacaaauaguaagagacaacaggggacaagugaccuaccuacccccaccauagccgaaaaucacucguacuccauucuugaucugugauacugucauucuguacauugagguagggcuccauuaaauuacucgagagugcauucauauauuuaccuccccaagcaggugagcugaccugccuucuaacaagugguaacagagcuucacaauuaagaaucuaaauuuaucccaagagccauacuucugaaaacuccuacuuucagauguacuguaaaacuaagucuuucagaauuauagcaaagucccuaaaaaauaagccucgcagagugaggaacauuuagaaugucacuuuuacacugauacuccaauuuauauuuaauuuacauucucuuaacaaggucuugggcaauguacaggauucauacugaaguauauaaggguuuagugacucuuacauggcauaauuuaaauuaugugaaagugccacggaauuaucccaccagaguuuaacauaggucuuaauagaacuacauauaagcacauauaaaauguguggguuuuaccaauuuccagacagacugcccccuauaaucaaacuaacacuugcacuuagcuuuacauauuucagacaagcugugccaagaaguaauucagcucuuucaaagcaaaacccagaguaugauuuauugcaagagcuacaaaauauucuuuucaccaaaauggcuggaaaauaauaaguauucaguaaaaucuccuuuauugcauguuccaaaggacuaauaaaugaaaacacaguauaggcaugacaugaaccaagacucuaagaauaaauacuauacaguacuaagaaaaauacuguaagcauauuucauuccaaaugagccagauuuacuacauacaauaacucuaauucaugccucaggaagguggggguggggaaugaaaggcauucucuuuaagaaagaauauuuaaacgacacaugcauucauuccagugaaauuauacagauguucuguaauucagaaaaccaccccuaccaaauguagcuccaaaagcacaucucuuuucacguuuuauuuaucaauacauuccgacuaaagauuacguaugccacaauaaaaauucaaucaauacuaucuacacuuagaaagauuacaaauaaggauuuggcaacuuauacuuuucccccuagaggaaagcugcauuaaugcugcauguuuuccacaaagaucaaugaacuaucuuuaaauuauaauguauuaaguuaaaguuagguaagcacuucaaaaguaagccuuauugccucagggcaaacucaccauuucugugcauaaccucaaauugguuguuuucaaaaaaacagguuucggaaaaacuacagcauagccucuaccaucaaucuucaagggguugcuggaccaaguugcuuuucuagaagacaguuguuucugcgcuguucagcauaauggucuauaugcuuaaauuauuuaccacgcaucaacucuaugcaaauuuauucaaauuucauaauuuaaucugcauacuaagaaugcugauuccacgucaugaaaacuccuuuaugaucuccaggauaccucacauuguuuuaccucaugccacaaaacugaugccgaagcaaaagugcugaaacugaccauucaauaaagucacaaaaccaaagguggaaaggaacguggacagaccugaaguccacuucuuggcuucaagguguaaaccaucuagucuauccuuacaguucuuaaagagauucaauaaucuguuucaauaauucaaccauacaguuagaugagccuuccuucacugcagcgguucaagugcuauuuggaaaugucuggagauuuuacuggcugucacacuggaaggaggugcuacuggcaucucccugauagaggacagggaugcugcugaacauccuacaguguacaggaucguccuccacaacagagaauucucucacccaaaugucaguaagugcagagguugagaaacucugcuuuaauggaagcuaaguauuguuuucaguaauggaguccacagcuuucagacacuccauaaaggugguuuuuauagcucuaacuagaaacuuguagcuucaaaaagagagagauggaccaccaccccaggccucuaaccaaauguuguaaccauaggugacagcauagcuggugcucagcgcacaaagcgugaagcccuagacacagggcggcaguuaucugugguaaggacagucaggugaugucccucaucaucuggaaacucccuuagcuacccaucgucaugcaaguuugacgauuuucccccaaccaucaaccuccuccucuuccacuccccauuauggaguuuucuaguagaaguccgcuguuuugguuuuuuuucugcaugaguauuaaaaauaacaugaaaagcuacucagaagacaugaaaauaguaaauaaccuaaggugcuuuccauccuggaaagucuaugauuuaacaggacuuaaaaaggguuuguaaaucagguuuggaacuugaaaagaaacaggcugcuuaaagaaacagucucaugaauaaauaaacaucuaacguaaaauaaucaucaaaagaauaggcgcagauauauguacauaacugcacagccacagccaagaacggaagaaaggaagcugaaauugaguguuacuucuuaugacugcacccgcaagaaaaaugcuuauuuagaugcuaaaaagcagaauuuauauuuuucacuguaaucucaaaagauuacagaacuuuaaaacccacgauuuuaaaaaaacuuucaaacaaaucuuaaugaaaagaaaacucaggcuugagaaaccuuacagaucaauauggacuugauugauaacuuacggcccauccacauauuaaauagccauuaaacauaauauugacuaguuaguggcauggauacaugcucaccguaucauaaggcaagacagguugcaaacaauauacacacuauauuaucaauccuguauaaaauguaaauaaauauauauauaugugaaugaacuguaaaauaaggaaagaaauacgcauauccacaccaagagagacaggaagaucugccaaacguuaacaaugguuaucugaagaggggaagguuaugcccaauuucuguuucuucuuugugcuuuucucuacuuuccaauuuucuacagugagaaucuuuuguuauguuuuguacuuacaaaauuaauacauucuuacagauuuaaacuguacuguuucaggcccuguccacaaaauaaggaaaaaacaaaccugaacauaccaaccuuucaauuaaagaaaccaccuucagaaucaacaaaagcaaacauuuacugagcaguauuaucauguucuggcacuuuucuaagcacuuaaaauguauuaacuuauuucaaucaaaccaaaacagauguguugaguaaaaagagcccuggaaucacagaaaauguaaaugaguuuuaguuccacugugaauuuugauuuguuuccauagcucgaaaugaggggguuuaauaaaaaugaucuuuaaaggucaucucaaggcuaaacuaagauucuacauguaaaaauuuggccaauaaguguuaguccggaagccucaagagugauggggcaguuuggaccaucucaaaaacacagaacccuacuaaaaaagaacguaugacagugugucucaguuccuccuccuuaauauauguaaauuuccuaucauguuuuuuuuuaaaaggccuacauuuuucuaauacuuggacacaacugaucaaaccgaggcgaaguguguaccauuguaaaagaaaucauugaagaguuccauuuguuguuaaaaguuucggucacuuuuaauaaaccuggaguaaacaaaaacuuaaacauuuuagucgaguucugggguaaaaaugauucuucuagugucugguuaaagggaucuaaggaccuacugggauucagcaaaagacguuccacgucucaaauacacccaaaaucucaauacaacacuaaaagaaaagugaggggccagcacgaaauuucuguuaggggaaauuucagcugcguaguuaaggaaaucaggacuucccgguuaacuauggggucuuugccgcagcucacagcccgacacaaagcuacaagcccggagggucgguggcucacgcguggaucgaaagaaccacgaagguuuggggaaugacacugaccuguuagguuuacuucaugucucacuuaccaccaucaaaagagguucauugauagcuuuauuagcaaaauuaguaacagaguugcacgucuguaacacacacacacgcgcgcgugcgcacacacacacauacacccgugggucuaugggaacauugagggagacaaucuccagguuaaaaccacacaaaaacuauuugggaaacacaaagacgcaagacacaaaacaaauuuggagugcaaaugugcaagacacacucagugggaacacaaaagagaaaagcacagcggcuugacaauugggacggcgcccggccccacguggggccccagguggccccaccgccgcccgcacccggccagucucugcagcccgcacgcgucccccgcggggcgcgcggcucuucacggcgacaaaccgaaucccgaacuucgccgcagggaccccacggccgacaaggaggagcccggcgccgccacccacccgcggggccaccgacccggaggcccgcgccucgucccggggcccccggcacgcccgggaccucugagggggcgcguccgccgacccggccaucccugcggcgccggguccccagcgugucgccgccgccgucgccgccgcgcuccucggggggagggaccagcgucccggcgcgagcccagaggccgcccacccgcgccacuccuuacccgcgcccgccgcgccagcgccucagagcaccgagggccgccgccgccgccgcuguuucgccggccccggcgcccgcggccgcgccgccgccaucuugacucca

SEQ ID NO: 21392 - RNA, 17797 nt, Homo sapiens
cgaaaagccaggguccucccagcugggcacuacugccccucgcuaggaauaugggccucgcaggucggcagcgugagguccucugugccaccuuccaucagguagcugucaccgaggagcauguugcagugccgggugggggcugccuugcaugcaaggagccuggcagcagcggagggcaaggcuuugagugaggcggcccggacagccauagcugaggagcauggagccacugggagggggcagugucaccuuuuuuggccuucuuccuguguggaaauacagcgccuccggcuugaaccugccacucaggugucuugaugugucggggguguggcugccugcccccugaugcucccugccccacccugugcaguaggaacccagccauggugaacgaagccagaggaaacagcagccucaaccccugcuuggagggcagugccagcaguggcagugagagcuccaaagauaguucgagauguuccaccccgggccuggaccccgagcggcaugagagacuccgggagaagaugaggcggcgauuggaaucuggugacaagugguucucccuggaauucuucccuccucgaacugcugagggagcugucaaucucaucucaagguaaacucaugcaagguuaaggugggaggcgggagugguggugccuggggagcaaacugucagcccugaggcugggcugcccuuuaacccggcagaaaaaagcagccggagggggcaggaaggagaaggcagagugggucaucugaucugcaacuucucuguugccuguaaaagucccuccacagugucaagguauuuuagacacacucuucaauggguuaaaaauguugauucucacacuguauucuuugagggaacuugggggcuggaucacgagugcaguuuaggaagucacaaagcagugagauuguuuucagcaaguuagaaauuuggauuaugcuucuugaacucuagaaaugccaacugaauuacauuagcacuucaugaauugcaguuuuuuuuuuaaguuuaugccuuuuacuguaugcacgucucacgugucacucccaaguuuuugaaguuuaaaugcacaaggauguuuaaauacaccguugauagcuuguaacacaaguacucgugcacauccaggcuuuuuuuugagucucguuucggaacuuggccuuggucugcauaacuguaagcugcugcacagggcuugggggguggcaugaaagaaagugagucugcugacccucuuucuaacuguuccuacagcgaggcugugcuugccacaguuaggauuccccuaacucucaaucaugaugucuuaacucaccugagauaauaaacaggcaagcgcugugaaaagucugaagugcugcucucacacaaaaugauagcgcuguuguugugucuuaccucuguaauagugauuauaacggcaccucacauauacugaguauucgguuuguacaccaggcacuguucuaaguucuguggaaccagcugccgucauauucuccuaguguuaugguuuuuuguuguuguuguugcuuuuuuuuuuuuuuuuuuuuuuuugagacagagucucauucuguggcccaggcuggagugcaguggugugaucuuggcucauugcaaccucugccuccuggcucaagcaauucuccugccucagccucucaaguagcugggauuacaggugcccaccaccacacccagcuaauuuuuguauuuuuaguagagaugagguuucacuauguuggccaggcggucuggaacuccugaccucaagugauccacucacuucagccuccugaagugcugggauuacaggcgugagccaccacgcccagcauccuaguguuauuaugaaguggguacuacuaucugccgugucuuauaaauaaggaaacagaacucacagagauuaaguaauguacccaagaucacacagcuauaaguagcaaagccaggauaugaacgcugauuggucugucuccaaccuucauugaugcuucucuaacucccgggccccaugggaaggcagugacggaugguauuucuccuggaaccucucuucagaaacaaacccccuacagguuugaccggauggcagcagguggcccccucuacauagacgugaccuggcacccagcaggugacccuggcucagacaaggagaccuccuccaugaugaucgccagcaccgccgugaacuacuguggccuggagaccauccugcacaugaccugcugccgucagcgccuggaggagaucacgggccaucugcacaaagcuaagcagcugggccugaagaacaucauggcgcugcggggagguguggagccagcacuccccuacacucuggguucuggcuuucccggaggccacuugguagccugaacuugguuccugaaaugguccuuuacuucuuccugggccccacgcugaggauccgcaggaucccauccccgccaguagugucaguaggcauuguggguagugagucauccugggcaccacacacaggcagccaccucuuccaccucuugaccucgacauaggaguuccgucaggaaugcagucgcggccugauaacccucugccuugccuacaccacugcaucgauugcuggcugcacccagcacuuggcccaaucacagaguaacagaguauccaggagugagaauagccggucaggccucuggugcccgcuguugucaggccaccuaagagugggaagagggagccugaugggugggauccuauggccucgugcucccuaccacaagaccccuucacuugagaugaguagaaaauucucccaggaggcaggagccccaaggccgugggaugggagaggguggcaggcaugcccagguagaaguagggaagggcucuccaauccuccaggcacggugagaagcagcgguggucuccuauucuccaccgccagcacagggucagcaugcagugaauauugaacuggugggcugcuuuuuucccuccugcugucuuaccaagugcuagaaagagacgaaccaaaccuaaauaauaugaaguuucugccuuccagggacucgcaguccugggugucggggcuagguagagggaacagaaagggucucuggagguugggugagacccagugacuaugaccuccaccaacccugcagacccaauaggugaccagugggaagaggaggagggaggcuucaacuacgcaguggaccuggugaagcacauccgaagugaguuuggugacuacuuugacaucuguguggcaggugaguggcuggaucauccugguggcggggauggagcuagggaggcugagaugcccagagagccugucgguguucgguucaggacacagugaucaggggcacucauggguccaugcuggaugaaggacaugcagaggugaacugcaccauguccuugcuccuuuuguaucacccacuccccuccugggccugccaccaucgaccccuagcuuuuuguuccucugccuggcugugcccuuagccugcuuggccuuauucuuuucuuuaaaacgaaagaggggucugggcgcgguggcucacaccuguaaccccaacacuuugggaggccgaggcaggcagaucaccugaggucaggaguuugagaccugccuggccaacauagcgaaaccccgucucuacuaaaaauacaaaaauuagccaggugugguggugcacggcuguagucccagcuacucaggaggcugagccaggagaaucucuuggacccaagaggcggagguugcagugagccgagauggugccgcugcaguccagccucaguggcagagcaagacuccaucucaaaaaaaaaaaaaaaacaacaccccacaaaagagggauauuuacuaacaggauuccagagggcagggaacccaagaucaggagauggccucagaccucacaaggcacuggaagaggucaaaaagcaaggcccucccucauucccucuggggccacagggucccccaucuccgcuucccacugcacaucugugcuucaucugggagaccugauacccaugcuuuuccacacaccuggccugcuccugagugugcagagugucaguuccagccaguuccccaggcuaauggacaggccuccguuccaaauucccaggaaagagaaucaccauuggccacagccacaagaccagguucccccaacagaaauggguggguuggacuucucucccacccuugaagcugaaggcuggcauugagcccucagcgucucagacagcgcucagguauggcaagacagugugcaccagggacaggaagucccgggauuggcacauuuucugggaugacaguuuuuuugccaauauucugggagaaauccuaccauuuuuauauuaaacauggcuauguuauggaguagcaucuaaagugauaugaacuaaaaaaaaaaggccaggugcgguggcugaagccuauaaucccagcacuuugggaggccaaggcggguggaucaugagaucaggaguuugagaccauccuguccaacauagugaaaccccgucucuacuaaaaauacaaaaauuagccgggcaugguggcgcgugccuguagucccagcuacuugguaggcugaggcaggagaaucgcuugaacccaggaggcggagcuugcagugagccgagaucgcaccaaugcacuguagccugggcaacagagccagacuccgucucaaaaaaaacaaaacaaaaaacccaaaaaacaaaccacguggcuucaagaaaauuacauguugugaguaacuuuggccuugucccuaacccccgauggacauguccauucugucaacagggguguuuaggugcuaagucugggaagcacugauuaggagucagagaacagacauuuccaacuguuaaauugucaucgcuuguaucagccauuauauagucaguuacugggggaauaugcacccgugaugggcguuaggugauaaugauuggaaacuagugaagcugugagcucacaguugcugaaugguuucuuacuuugcuuaucaaguggguaaugaagaugaguggauuagaaaacaccaaccuguugggcaugguagcucaugccuguaaucccagagcuuugggagacugaggcaggagaucaagaccagccugggcaacacagugagaccgugucucuacaaaaaauaaaaacauuuuaaaaaagaaagcccucagcuguucaugauagaaaaauagaguaaauagcaaaaucuauacguaaucaaaugcuagauuuguucggugauauuuagguauuguagcuauacuuuucagcuauuaaaaagccuuguuguuucugaaauuccuacugggaaaauagcuuuguuauugcaagugugaagccccauugcuuuaucccccacucccuuaccccuugaaacaauaguuuuuauauucauuuuuugaugacucuggguuucuuaagaacggaacugccuuaucagagcaaagcagcuuggccuuccgccuggcucagaguccugcccugggcuugggcugaugaaaccagcacuccauguaguuucaugaaggccuauggucauccugcuugccugaccgagcaaggcggcuaguaaguuuagucauugaggaaaggggucagagaguucacagagccaguaaggagccuaugggacaucugaucccaccuccuaagcaauucuggaaucuugucuucagcauccacugccccuguguuuucagacuccaggagcucauuguuuugugaguggcuuauaguacucuagccagcucucugaaccggaugcugguucugccauuagaaacaacacagaauaugacuaauaaagaacuucacuagggggcuggguacaguggcucaugccuguaaucucagcacuuugggaggccaaggugggaggauugcuugagcccagaaguuccagacaaaccuggacaagauagcaagaccccaucucuaaaaaauaaauaauuaauuaaaaaaauuuuuuuuaauuagccagaugugguggcuugcaucuguaguccaagcuacucaggagacugaagugggagaucacuugugcccgggaguucaaggcuacagugagccaugauuguaucacugcacucuagccugggugacagagcaagacccugucucugaaacaaaacaaaacaaacucaccuaugguggauccuuuuuccccaggacagaccuuuggacauuugaaaggaguuucuguauucuuuucauucuuuuuuuuuuuuuuuuuuuugagacggaguuucgcucucguugcccaggcuagagugcaaugguacgaucucggcucacugcaaccucugucucguggguucaagcaauuuuccugacucagccuccugaguagcuauuacaggcauacaccaccacaccuggcuaauuuuuguauuuuugguagagacgggguuuuaccauguuggccaggcuggucucgaacuccugaccucaggucauccuccugccuuggccucccaaagugcugggauuacagacaugagccaccgcacccugccauccauuauuuucuuugaagaaaacaucacuuucuucaguucuuccuuguguaacuugguuuuuagcuuuucacuaucuuggaccccugaguaauuucaguguuacauuaaaaacaauguuuaauccggugccuagagaaaagucaagcuuacuaccccagaugcugcccagccagugcuaacuguagcauuuucucuuuucuauggccaccaagugcaggccugauuugcuuggcugcucaaggcaggacagugugggaguuuggagcaauccacccccacucuuggaacugggcucugagccaccuccccugagagucaucucuggggucagaagcauaucagucaugagcccagccacucacuguuuuaguucaggcugugcugugcuguuggaaggugcaagaucagagcccccaaagcagaggacucucucugcccagucccuguggucucuucaucccucgccuugaacagguggaggccagccucuccugacugucaucccuauuggcagguuaccccaaaggccaccccgaagcagggagcuuugaggcugaccugaagcacuugaaggagaaggugucugcgggagccgauuucaucaucacgcagcuuuucuuugaggcugacacauucuuccgcuuugugaaggcaugcaccgacaugggcaucacuugccccaucguccccgggaucuuucccauccaggugaggggcccaggagagcccauaagcucccuccaccccacucucaccgcaccguccucgcacaggcugggggcucuggguggagugcugaguucgcugaguucuucccagaucuccucucagguccagaacuugcacagcguugcuuggccaccccauuuugguuaccucuaauuuuccccccaaaacccagcaacagugucuguugagggguuuguuguacuuuggccaacaagcaucaccaaaagggauucuaauucucauuacaaauccugcuuaaaucaguguuucccaaagguggcugucaucagaaccacuugauaagcuuuuucaaaaaguggaucuccaggucccaccccuggagguucucacucaguaaaucugagggagguccucggaauguguguuuuacuucuugagcuuggcaggugauucggaugaucagugcagcaugggaacagcuggguuagaugacaccauguuaccaacagacacaucuagggcuaaaaggcuggcucaacccaaggcuggaaugcuuagggcagcugcucuacucuguaaaaagugggaaagcugggcauaguggcacgugccuguagucccggcuacuugagaagcugaggcaggaggauggcuugagcccuggcguuugagagcagugagacucagucucuaaaaacagaaaaaagaggagaaaacggcaggccaagcccaggugugcuccuagaauaugaucggacuuucgugggucccucugccugacacugugguuggcauggaugauggaagggggagaaguauuuagggugggagacgggcuggccagcagccgccacagccccucaugucuuggacagggcuaccacucccuucggcagcuugugaagcuguccaagcuggaggugccacaggagaucaaggacgugauugagccaaucaaagacaacgaugcugccauccgcaacuauggcaucgagcuggccgugagccugugccaggagcuucuggccaguggcuuggugccaggccuccacuucuacacccucaaccgcgagauggcuaccacagaggugcugaagcgccuggggauguggacugaggaccccaggugagggcaguggcccagagauccccagaggaggguccaagagcagccccggcugcagugcuggcuccccacggugguacagauggaugucugugccauggcuagcugggcacaucgaaggcuccagucucagagggcaucagauggaagaacucagccucaggggugcuccccugcuuccggcucccucuagccaaucccuugucucaauucucuguccccauccucacccaggcguccccuacccugggcucucagcgcccaccccaagcgccgagaggaagauguacgucccaucuucugggccuccagaccaaagaguuacaucuaccguacccaggagugggacgaguucccuaacggccgcuggugagggccugcagaccuuccuugcaaauacaucuuuguucuugggagcgggagggcagaagaaguuugcaugcuugugguugaccugggaggagucaggggcagaauuuacaggaauggccuccugggcaugugguggcacugcccucugucaggagugugcccugaccucugggcaccccucugccaggggcaauuccucuuccccugccuuuggggagcugaaggacuacuaccucuucuaccugaagagcaagucccccaaggaggagcugcugaagauguggggggaggagcugaccagugaagaaagugucuuugaagucuucguucuuuaccucucgggagaaccaaaccggaauggucacaaagugagugaugcuggaguggggacccugguucauccccugccccuggccugaccccagcugcaggccaggcugcggggcugugacuuccccauccugugcccuccccuccaugcuguggacauggcaaagggagaaggguaaguugggagaccuccaccuggaagggcuuagggaggcaaagacaggcugggucuuuguugggggccgugagagggacucagggugccaaaccugauggucgccccagccagcucaccgucucucccaggugacuugccugcccuggaacgaugagccccuggcggcugagaccagccugcugaaggaggagcugcugcgggugaaccgccagggcauccucaccaucaacucacagcccaacaucaacgggaagccguccuccgaccccaucgugggcuggggccccagcgggggcuaugucuuccagaaggugugguagggaggcacggggugccccccucucuugaccggcacccguggguuccccagagcuuagggcagagcagccugccucuccugggcucuuaaauuuugaaugagcauggauuggagcggaugggagcucaugcuuuaagucagauagaccuggcugggcacggaacccggccagcacuuugggaggccaaggcggguggaucacuugagcccaggaguucgagaccagccugggcaacauggugaaacccauucucuacaaaaaauacaaaaaugaccgaggcauggugguguacaccuguagucccagguacuuagggggcuggggugagaggaucgcuugaguccgagagguugagccuccaguaagccauauuugugccucugcacuccagccuggcccacaaagugagacccugucucaaaaaaaaaaaaaaaaaaaaaaaaaaaagauuggcugggcuugguggcucaugccuguaaucccagcacuuuaggaggccaaggugggcagaucacaaggucaggaguucgagaccagccugacaaacaugaugaaaccccaucucuacuaaaaauacaacaauuagccgggugugguggcgggcaccuguaguugcagcuacuugggaggcugaggcaggagaaucgcuugaacccgggagacggagguugcagugagcugagaucaugccacugcacuccagccugggcaacagagcaagacuccaucucaaaaaaaaaaaaaaaaagauagaaaucagaccuauggaggcaggucacucgaccucucugagccugguuuucucgucuguaaaaugggauguagcuuguguucugggcaugaaaccuaacaaagcauguaacgugcuuggcacaugguaagagcaggaagcacucccugaaaggcagcugcuguuacuauccugaguugacaccuuucucccagggcugcuggaguuaacauuauguucugaucuaaggcccacaggcccuggagcagaaagaccugaguuuaaggaccagcucuacuguuuacugucagaguagccaacgugcucaacuucccugaacccacuuuccucacguggggcucacugugcccagccucccguauuaucagcauucuagcaaaugaguuugaguaaacccagcuuaaucccugauaggcacugguucuagaggagaugucaaugucauugucagcuugcacuggggaggauggaauguguggggccucucucccaugacucggccugucaaaccaguugcugcuguucagaaauggcuucuucguggagucuucccugacugauugggagagggguggcugauagcccucagaccuguccagacugagaaacucacguccccacuccccucacccuuugcuuauggacgugccaacgccacaguucauuauuccgcccacauggcugccaguaguccugauaccuuaggugucugcgaaagggcgucuggcagggcugggguuggugacaggcaccugucucucccacaggccuacuuagaguuuuucacuucccgcgagacagcggaagcacuucugcaagugcugaagaaguacgagcuccggguuaauuaccaccuugucaaugugaagguaggccaggccccaggguucccacagaguaccaggcccuucguugagcaaacacccagcaccuagccugggcuaggcauugugcaagacagagagauacaggcagaacuggggcccugcucuuaaggagcucccagccuagagugagggaggcagaucaaugugugaccaccagccaguguaagugggaaaaucaaguucaggagaggaugcugucggguccagaggagggauaucucaccugggaggccagggaaggcuucucagagggucaucugugggaaucacugaggacaaagaggaguuggccaacaggagagaaggguauuccugggacagggcagaggacaggcagaggcagugagcugcaccaucuggggaaacggggaacaugagcaggaggaggcgggaguguuaagcaggggccaggcccgcagagaucaugguuguccugcuggaauuugaguuuucccucaaugcaagggaagccuuucuccagcagugggguggcuugguuccugcuuuauuuuaggcaaaucacaguggauagucauacggaugagagagauuggggacggcuagagccggggaggccagugaagagaccccuggagugacccaagccaaacacacuccuggaggugggcuagacaagagggaauggaucagagagugagcagggggugcucaaggaggagaggggaaguggccaggacgccucuagguucaggcuuguguggggagagauaucauucacagaugcaggcagaggaggccaggagcggaggcacagggagaggggaguggaggcgcagggagaguggaggccgggaguggaggcgcaggcagaggguauugagcccagacagccucauugagucaaggcuguccaggcagugggacuccaguuguucuuggcccaggucuuacccccaccccacauccccucagggugaaaacaucaccaaugccccugaacugcagccgaaugcugucacuuggggcaucuucccugggcgagagaucauccagcccaccguaguggaucccgucagcuucauguucuggaagguaaaggagccgggggcaagcuugccccgcccaccuggaaaaccguggggagggauugggaccaagucccaagcgugugcugaaggccacacuggacccagccuucagggcacacccagcucugacucacccaugucacugcugaugcaggguguuuauuucugggcaggggugggaagugauacuggcagugggccuuguucuauuccgggaaauguccuguugagcagagcccuuggagagcccuguuaaucuugccucugugugugugugcaugugugcgugugugcggggguauguguguguaggacgaggccuuugcccuguggauugagcgguggggaaagcuguaugaggaggaguccccgucccgcaccaucauccaguacauccacgacaacuacuuccuggucaaccugguggacaaugacuucccacuggacaacugccucuggcaggugguggaagacacauuggagcuucucaacaggcccacccagaaugcgagagaaacggaggcuccaugacccugcguccugacgcccugcguuggagccacuccugucccgccuuccuccuccacagugcugcuucucuugggaacuccacucuccuucgugucucucccaccccggccuccacucccccaccugacaauggcagcuagacuggagugaggcuuccaggcucuuccuggaccugagucggccccacaugggaaccuaguacucucugcucuagccaggagucugugcucuuuugguggggagcacuugcguccugcagaggaccacaguggguggcaccuccugagaaggcgaggagagugguuguugccaacuaagcccucgaaccaaggcagccuccagagccagccugggacucccagugaacuuacacuuggagcccgugcaguacaggcaaaacacgcaagggcaucaggcacugguggcaucguagaagagauguggcaaagugcuguacccuuccaccuccuagaggugggcagcugggccccaccuacuugugacugaaggggcacaccacugcccugccugcccacuuagccguccauggcaccagcccccuggaugggcauugggcugacaccuaccaugcugcuuuuuggcacaguugucuauucugagccuugagagaaaaagugccccuuaaggguugaaggcagucugaacccuugugcuugguggggcucguggccuuccccuuuugccuggcuguggaggccugaugcugccccguucccugucagaggcuaagaugagauuugccagcacaggggccccagaucugccugggccugugcagcagcccagcuuccugguguauuuuucagguaggcccuuguccugccagcugccuuccucauccccucguccugucccagagguuaucugccuggccuggcuccccacgagucaccugcaagccccagggccugggggcagugacuggcaggugcagaugggcuguuucguguaguggaagagcagccugauggccaaggggguggacgcaauugugggauguccucuuuacucccuuccuggccucacuggcuggggcagaggggcagccgcuaggagagacugaaagcagcagcuaggacugaggaguggguuuuauuguccuucagagcucuucaagcuguccccucugucaucacucccuggauguguggggcaugguuccuucccugggaaggcuaaguucaguucuguuuuuuauucuaugagaacaagucacagcugcagcugggccccaugcucugccccaagcccccaaccccgcggugcucuggcggcuuccuguccacucucggggcccuuggggccuggcuugcuccagggucuugggcuacuggcagcuccucuccuugggcuccuggcugccaggcguuggugccacuucuuaaaggccuggaaccagggaggagaggaaaugcuauuguugugggcuuucuccggggucugugcugugccugcuagagcaaccccuguacccagcuccuuuuguccccagggccccucccucugccccaagcagccagccagucuugccuaggccaaaugcacaagcucagaauagaucugauggugagcugggaagcuguacucagagcagagcaaaugagggagggggcgcucaggacccaggcccuccaugggcuagugugaguggcagccaugccucaugccacaccuucuucgcaaacugauggaccgggugggccuggccugagcuggggccacaaaucaaagcaagggcuccagcauccagccuguguguucuguaauggaacugacccccuccccugaaaacgaaggggccccggggcuggcaagcagggaaagcuccacggugcguggcuguggcacagacuucuggaaggcuggcugaguggaaugcagggaagagggcaguaccugggaaaggacccacccaucuuccugcugcuguaacugcugagccacucgcagucgcaggauccgcugccaccacgucugccaggcccaucucaggugccacucccugagcuuuggggacaguuggcagagaaggccucuugugcucacgcucccccgcaguccccagcccuucugccuuucucccccgacacugcugcaccagagugaaagggcuauggcaagggggugucaucugaggaguauuaagaaugcagauuccugggccugucccccaagguuuuggagucaguagguccaagggccauacuuuugagagggguuuggguuaaguaugaggugaaaugggagauggucaguguggagaggggugcacccacucaccaggguccgcaccagcugcucugccccuugggcauccacccagugcugccaugccacugccaggcaccuggccugcugggaaccccgcagcccgugaagcagugccucgaggcaccggcgcugcagguacuuccuccugauggccaagagcaucgugacccuucagggccagaaggagggcagagccaugggccugggccugcuuuuccaggauccugcaggaacgagcacuggccagagagggcccagcuguagccauggcucaggcaagccccucagcccuugcccccaucccucggacccaccaaacugcacacacagcuccucuuaccguagccuccguuuaugggccuugcuuugggcuuugcaggcucugggcucagggcuggagugcgcucuuggucccuggucccucguccacaggggcaggccugggacccagcuacucuguccaggccacuguggccagagcuggaaggcagggcagagggaauguucccugcacccuggaaaggggaguugagucacaagagguuaagguggguccaggaaggcagcugcucuuagugcccgccuaggaguugaguacagugaggaggguggaggaaggugcugagcuuagccuugugcccugcccccaucuccccaggccuccagccucucccggcugccugccgcccaaagagaaaucacaggggcggggcaggaaugcaaaguguuuucucagaacagcugaaacauuccgaagagggaauggauggggagaauggucaauacacauaagaccgugucccaaggagcugauuuccaggccccugaggacuggagaccgcuucaccccugcacuucagacaccguuugucccccggggcaaggucuccuuacucugagcccaggccguuccccuuggcuuccuccguccacccaggcugcacugcagugauggcgcgggaggcaccagcucuguggccuguguccagcagcugcgggucugaaggaauagccagagaggagcaccugaaccccaugggcuuggacuuccuggggccccgcugggauuucuucgcugcucuagcuggcaggacacaucccggccucuuccacccauucccccauguggcugaagacauuccaacaauggggugggcccauaauaguuagcccucagucaguucccggagcacagcccugggagggggcuauuucucuccccacugaaaacauuucaaagcugaguuacuugucugaggccucaucccucggaagccgucugacuccagagucugagcccccggcuaguacccuauagagagggggcucuccaaaggggcugcuggggcaugugugccuguggcagaaaagaggagacccuggaauucagcacccugggugccauucccagcguuuaguuucuagaggccucaguuucuccaucagcuuaugggauccuugucuuuacugacaagaauggaauagaaauguaaaaguacucugaaaagcaauugcccuguaacuuaucuagaaagaaaagacccugagacuccagaaucugcuguugccauagccccauaugugugaauucugcaacuagccaaggcuaguuccuuucaauuccauuuaaaaaacaaaaaccagcaggugugguggcucauggcguaaugggccugcccaaugcuuugggaggccaaggcagguagaucgcuugagcccaggaguuugagacaagcccuggcaacauagugagaucccauuucuacaaaaaaaaaaaaaaaaaaauuagccgggugugguggcacacgccuguagucucagcuacucagguggcugaggugggaggaucguuugagcccuggagguugaggcugcagugagcugugaucgcaccacugcacucuggccugggcgacagagugagacacugucugagaacaaaaaacgacugaaaaaaaaaaucaccuuagcuuuuucucuuagaaucuucucuaaaacguauucuuuguggcauucugaaauaggauucaugaugaugccuguugaucuuagggacacuaccucaccugccaguaucuuuggggcuguguccuucaaggacauguccccagacugcugugcagugucauuuuuuguguuugguuuggugguggcuucuucccccuugcuaggcuaucaaccucuuaucaccacuuguuggugucagaacuaacugcuucuggucuggagagggacugaccgaugccuuuggguagagagaauuaugaaagaaauuuugguauuuuucuacuuuauauuuucugagguuucuguaauaagcauauuucacuuuuccaauaagaaaaaaaaaaacuuggccuggcgcgguggcucacaccuguaaucccagcacuuugggaagucgaggugggaggaucacuugaguucaggaguucgagaccagcuugggcaauauggugaaaccccgucucuacuaaaaauacaaaaauuagccaggcgugguggcgugcacuuguagucccagcuacucaggaagcugaggcgggagaaucacuugaacccgggaggcagagguugcagugagcugagaucacuccucugcuucagccugggcaauugagccagacucugucucaaaaauaaacaaaaaaacuugacaaaaaaaugcuacuguccucg
